United States Patent 10,724,096 (METHODS AND COMPOSITIONS FOR INHIBITING AND TREATING NEUROLOGICAL CONDITIONS) - sequence listing, part 16

SEQ ID NO: 90 - DNA, 277953 bp, Homo sapiens
gaatgtcgaaatgaagcatgactaagaaggaactctctccagaaatatcttgataaaccccattgctccttccgctgcattttgctttgtgacattcataacttagtgggaattaatttgtaagacaaattacatcctgacaaatacaataaatttctgtctggatgacttgacagaatattgaactacgtatttgttagaaagtaatattaaaaataaaccttaccaataagtcctatttctgtctcatactttttctacttcttttttctcaaacatggattgagttcattaagaaaacacaagaaattttaataacttcaaaacacatgaagcaaaaagggacaccctcttggctccaaagattcatgtctattccacatgaaaatatattcaccccatctgtaggttcccaaaagcctcaaaccattcagcatcaactcaagtccaaagtcttgtttaagtctcgtaagctcaagagtcccagatctcatagtgtaaatcaggtatgtgtgcaactcttaatccatcatggggcaaaattcctctccatctttagagttgcaaaactagaaatcaagttacctgtttccaaaatatgatgacaggaaaggcaaggatagttgttatggatattcctactcaaaaagggagaaaatgaaaaagaagaaagaagttatcagtttcaagaattttgaaatcgcagcagggagattccattaggtttcaagggctggggataatcctctactttgaacagctctttcctgtgagctcacagctcatcctctgaagccattcttttcgtaaaatgagcagtacatatttgcagatgagttgttttatgggcccgtttcctgactatagaattttggaagtttagcagccttctttcattctacccactctgtgtcccttttagtccagtttgtcagtgcttctgctgttacaacattcccagaatcttgtgaatctcaaatgtatgtcatagatatttattctattagacaagaggctcctccccatatgttaaactggataataatatctcttattttggcttcttttgaaagactaaagaggatctatgggtcaagtcatatgtctaaactctttaaagagccttctctgtaattgaataccgtgaactttggatattgccaaggcattagcaaaaggttatccagtcacacccttggttttcactccagagcacattttcatgatgatgagtttccgaattttttattcttttgcaatctgtattggctgagagtttcccaaatcatcaagtctttcttcttcttttttttttttttgcttaacagttctttcttcaatttatttctttcctgtagcattttacaacaaaaagcaagaaaaaaacagactgcaccttcaacattttgcttggaaacctcttcagctacacatgcaagctcattgctttaaagttctgctttcacacaactgaagagcataattcagctaagctttctgcttctatgtaacaaggatcacttttccttcagttttcaataatctatttctaatttccttctgagcactcaccagcagagacattaacatttgtatttgtactaattttctttttatgacaatgtattttttctctaagaagatataggctctctctaccatgctccttactttattctgagccctcaccagcaacagctttaaggcccatattgctagcaatagtccacacaaaacagcagaaacagatgccagacaggagagatgctaagatgctggcttgaaatgtagagaaaagaaccacaagtcaaggaatataggtgaactgtaggaggtgaaaaagacaaggaaatggattctcccttagaacctccagaagaaatataggcttgctaatacctttattttagcccagtgaagctgatcttagatgtgtgaccttcttcactgtaagataaatttgtattaagatattatgtttttgctaacttattatagtagcagtagacacctaatagagttcatgtaactgattttgtgttctatgtttattatttcttagtatatatttttgtccctgacagaccatctaattcctaataaatgattcccttgaagtgacccccttatagaatttgaggtgagggttgtgaaagaagaaataaaatagaatagtgatttgtaaagtaatagtataggttcaaggagcaggctgcctgtgttggaatcccaaatctacattattgctatgtgaccatataactttatttaatttctctatgctttagtttctttatatgttaaatgatgataataattatatctaccttgtgggcttgttttgagtataaatgagataatctatgtaaagttttggcatagattggacacacaggaaagtttaggtaatatttttctcccatttagtacgtatattttcggacttaaatattttttttcacaggatatagccatacgatctgtttccctgcaccaagctagatatatgaatttttacaaagtgaaaatacaaatcaataatatataaaattattccagacctgctttaggtggaggagactggaaaatagacagcatctcaatatccaaaagtgggggaagatgtggaactcagatgggaaaaaacatccaagggagatttaaatgatgaagataaatttgagggatttccaagacttatcccatcttttcccctgtcaaaaacatagatcaaaagcatttcattggtaagtgaacgtgtccatactttccaagtttgtaagtatgttaatcacatagcacatagcataggcataaatctaaccattatgcattctaaaaaaaagagtgaacaactcttaagtgtcagatactctaaatttgcttttatttcccctaattcaatgctgtatctttttttggtgtattacaagcctacacagaaagtacttgataaactctacttttcttatagaatataaccaagccatcttctcatgttatctcttccccactcagcctactttacagccattagaaatgaagtttcagtctctgaatgtcatattttttcaggcctctaagatttaacacaagccatcttctcatgttatctcttccccactcagcctactttacagccattagaaatgaagtttcagtctctgaatgtcatattttttcaggcctctaagatttaacactgttcttttcccttccaacgtgattttgcaaccactttacatatagaggtagaacccatttcctctctcctaaatctaatagccttgtgtcttgcgttagtcaatagacacaggttgttatacctgtgaataaacctggcctagtctgctggagtatgagagactacatgaaacagagactaataatctgaactgaggctctcctggaccagccgaatgatttaccatctgcatgtagctgtctaaaaggtttaatcaagtaactctgtctcagatcaatagaaataattagctgatccataaacttatgagcaatacaatcccttttgttttaaaccactaaattttgcagtggtttgttatgtaaaaattactaatagatatgcctgtctatctcattagactgtaagtttctttaagacaaggagcatgtcagattcatattggtgctgaaaattgtcttgttcaatgttgtacatatttgtttagtttttatttaacttttgcatgctagtaatattttcttgaccaatattttctacttctgaagtcattttttatcattacaaaacaacttttggggcgaatattaccttctattttcattcagactgtggtagaatcttgtcagttgtttctactttttatcctacagttaaaaataagtcactcattcaacatttgcataaactttccttgtgataaatatatgttttttctctgattttggtcattctcttttctgttataaagactatgattgactttcttctctggccactttatgctacgctaagcttttaaaatatattcaatttcttgccttgtatttcttatcttgtctacttcacagatattatttctatttattttcctttgcagatgtcatggtaaacaatatcacaagtctattctatctttcccacttcctgatttcttctcctgcattctcaacacgtattatttcattctctctgaatctgcctgcaaacagaccagatcatcttctaatgccttttgaaaaatgtgtcttcaaggaaaatgtttatcccatacaggatacctgggatctgatttttatcttttagctatattagtcctcttatgatttttgtatgagttttattatctgaatgcttgcagctacataaattggatcctatttccccatccatttcaagactgctttaaggctcacactcactaaaaaagaaaagctacattacacagctacaacttgaatatgcagagtcaggttcgtaggaattaaagagtcatgtagcattaactatacaatataaagtagaggaaaaacttgtggacataatgttccatgttgtcattctctactaaactttgttcctatttgccccctgctgaaagtaacattaagtgcagtataagtcatatttattagtcagtacatacaaaaatactaagaactcataggctatggtctctataatacctggaaaaatggaagagtacaatcaactattcttcatgtaatatttgtattatgaggttaagtacctaagaggacagtttggatgctacaaaatttatcagggcccttagaaaaataaagaagaacaaagtttctgtagagaattacagtggctcctgttgccaagaaaatcctaggaataatttttattgtagcatcttttcacaggaggaactatgtttatgattgttgggtctcagattaccagggcattatgatggaaggcactatggtgatggtggatgaaaaatggctggcagaggctccaactccttttagctaatgagaatatcagcaaagatcttgcaggctggctttcacttatgttctagagagtagattaggggtcaggataaaaagaagcagatggttgctggaatagacttcatgattctcagataaaaacagctcttataacttactttttgtggagtaaattattttaaaaagttatttcttttgagattgcatttgagttaaaaaacattttttacttatctgcttctcactggtacataagtgtaaaaagtaatcaatactttaaacagggtaaatttaaattataaaacaaaaataataaatttaatttgagtttatgcaaatcaagatcaatattcattattttattattatgaaaataacaagtcaaattctaggtagagaaagaatgataggaaataatgaagatattatttttgtttatttcagagttgaaaatattactgagatcagtactgatgtctaggcaaaaagaagacttctattatctttaaatcataatgtattagcttaagccttcaaactaaaataactctgacgcagatgagctgagatgtagcactattactcctagttaaaagatgaagctgacatcatcacaataacctaaaactgagaaaacaaaattgggagtaaatgttctatgctctaaataatggttagtgcttctgaatttcgactacttggtgaaaaattggatgtcagagtggcacaactttgggaggacctaaaaaaattacaaaaaatgaaaatgtttaggcaggagacacatttctgttttttgcttcttgtttctcttgacctccaagtctttcatgtcttcattcttcattctctcttcctcctttgcacacttggatcctctggtgtttgcaatcttttcagccctctcgtcaacaccttctcacctacagcaggttattcttgacttacgtctatttttttttctttttgtagcctaatggatgtgagagggtaaatctttttctctgctcagggaatacatttaaattttagcaagggttttcttgtaaaaaaaaaaagtcaactcaaggaagtgactagtttggcgatgggaaggaagagttttagtcagtgtcatgcaagtaagtgacatttttgttgttgaaaggtaaggccttgagatttctctgaaattataaatcattgaagcaattgctgcacttaagtcagatcaatgttgcttttccaatgtttttaggtgaatttatctcagagatatacaacagaatcctttggaattcagatagtgtaaggtcataatgacgacttacaatttagtatagtattaaaccttgaacaacatggaagttgagtgtgccagtcctccacacagttgaaactctgcctataacttttgactcccccaaaacttaaactactagtagcctactgttgactggaagccttactgataacataaatagtgaacacatattttgtatggtataagtattatgtactatattattataataaagtaagctagagaaggaaaatgttattaagaaaatcgtaagaaagggaaaatctgtttacaatttattaagcggaagtagatcctcatgaaggttttcctcttcatcttcatattgagtcggctgaagaggaggagaagaggaggggttggtgttgctttcaggggtggcagaggcagaagtggaggaggtggaaagggagacaagaaagaaagtcacgcttggtgtaacttttattgaaaaacaatgtggcataagtggacctgtgcagttcaaacctgtgctgttcaagggccaactgtacactaagatcttatttgaaacccattgaaaaagaactctacatggcatattcaagtctaaacagggaccctagaggagatagatagatagatagatagatagatagatagatagatagagacatagagagatagatgatagatagatagatatagatatagatatagatatagatatagatatagatatatagatgatttagatatttaagacagagtctcgctctctcaccaggctggagtgcagtggcctgattttggctcactgcaacgtttgcctcccaggttcaagcgattctcctgcccttcagcctcccgagtagctgggactacaggcatgggccaccacacccagctaatttttgtatttttagtagagaccaggtttcaccatgttggccaggatggtctcgatctcttgacctcgtaatctgcccacctaggcctcccaaagtgctgggattacaggcatgagccaccgcgcctggccgagaatatttttaaggcatatgaagtgattcggtgggatgaattagaccagttaagtggtcttttccaaacttaatatcaaataatgtgaaatatgttctatgctgccttaactttataaagtggccttagacctagcagagcaattaggcactggactttggccgaataattttttaaaagcacaggccatacgttgttgcattaacagtagttctcaggcaatattcagacaatctcactgcttcttggatagtaacttattctcttcttttcatctccatgttttcagtatgttaaaaatgtgttaatttatcatttattttcacttttgtagaaatagacaaggtagtgaaaggatagtaatatctaaattctggtgaagaagaaaatttataatatacttgtttatgtaggcataatattcatgttaatatgggtttatgatttttgactttaataaaatatttttgttactttgaaaaactaattcagtactctctcatccttctaacagagttatatgtataaaggtcatgttacatccccagaaaatttaaatgtcttagactaagtaggtgttactactagtgttaaaacagaacggaagaaattaactacattgttaaaatgcaacagtaattaaagcaaacatctaagtgaaagtatttatagatcctactgatgagtttaacaatgtttcaaacattcatttttaacacctgtgctattaactgtggtttactaaatataagtcttaccaaatcattcttctcaatcactgtgatctaaaacaaggcttcatcttgtggtaattataatagcttcattcttcatatcacaattattttgaagtatattccattctaagaaaattaatataaacatatacatatcaggataattgttcacaatttaaaaaactgtttcataaaaagactcatgatcacatctttgaaaaaaatataagctctttcaacacacctaagtgttattttacacatcattaactgcttgatagagaggaagaagttgggaacagaagagagaaatttagagctaatgtaatgaaatcactaatatttgaatataaaaacaatatttacttgaaatttataaaatgggccaataaggaaagatggttttattacctggaaattttagaacaacatctatggtataaagtaaaataagtctttagtttatcttattaaaataatttaaggtaggtaggttttgaaatttttcatatctatcctcaagtcagaataataggtgattatatattttttttcattgcacaactgtcagcagcattaaattctgaggtatgagtttttatagatgcctatggcaacttaatactcctacaatcacaggactgggaaacacagatcaacagcacactgtggttgtaatcaacatgcagattaatgaacagagccatattcaccagggaacactagaacaaagaccagttgagcattttaattgctaagttactgctaagtctcaattccccatcaatctccatccattatgaccattgatgcatagcagacattaagaggaaaacaataacataatgattcataagtgctagggtgcaaataaatggttagctctgggaaaatcatggctgtgattattttgtggctcagactacctaaaagatctaacccgttatttctaattttcattgttctctgaacctgacctgactatatttaatgagttggttttaatggaactaatagcacagtaaaaggttagttgaacaatcttttctttagctacctccacataggcttgaattgttccttaacttacttagaaaatcacagccagagaaattagaaataaaaggattcatgaaattatctaaaatattatcatcttgtgagggcaaaactgtttcacagtatgattatgtattgttggtggagttataactaggtacattcaatggccttagtctttattttctttaacattgacagcttagtttctatcttggggtttcaaataaatcccctagaagtcgacttccatgcaaactacagtactgttttctaatctggaagaaattttccacagttgctttgaaaggcataaaaattattatgatgtagattcagcactgtactggagaatttacctgtgctctttgaatccttacaacaactttttgatgtaaataataaagtttgtgccacattctctacacctttctaaatcctggacactaagtctggactgacttttgggcatttttttaatcaatcaatttagacatttttagcttacttactgattatacatatgccaaatatcaacctactattttttggcttatcttaaaggcaggaacctttcacttcagtggaggatagctctttaaacttgttttagtttacttcccttgaatctctgctcccttcttggatagacattctctaaaagctactgcagttacatggcctctatccagtggactttccctgggaagctagagcatatcaccaagtcagtattcaggaaaagttataccttgatttatataggcttttcctctttcatggactcttcctatacaattttaaaaatttgatcgtcaccacaaccttgtcaattggttagcgcagatactagccttaatttgcaaatttagaagctgagagtcacaatgctgaagtaaatgtctaaggtttcagaccaaattcttctgattccggtgttcttgcagtgttttataagtcagtgtggaacatattacaaaatggtctgcagagaagaaactaccgcaaaccaccattcttgcattcaccctagtagaatgaactctacttcctttagtcctctaagaaattagtatggaattttaaatttctactagattcccctcacaaggtatctcctatatgagaatcagaatattttcatgtccctgggatgctaatgtttaaggtggacctggcaatgatgtgagagtttagcacagaaattagtagtcaggagacgaccttcagcccaggttttaacaaatatttgctctaagactctgggctagtagcttagcctttcttggtgttatctataaatggagagcactttttaggatcacgtgattggaccaggcccctttgaaagttcaacaaaattaagcaaccttacataaatttttatttttatgaattattagttctttcagctatctcttcttgccaatctttaaaaaattatcttctattacatttatgctaacttgagattaatacatcttttcaagacctatctgcgtcttcgtacagtgtatgatgtccttctgtgtgctcctctctcagagactaagttggatcactggccatttaaaattgatcatagtgtagaaggtggctggcaagatggcagaataggaacagctctggtctgcagctcccagcgagatcaatgcagaagtgcagaaggtgggtgatttctgcatttccaactgaggtacaaggctcatctcactgggaacggttagacagtgggtgcagcccaccgagggtgagccgaagcagggtggggcaggcatcgccttgcccgggaagggcaagggggtcagggaactccctcccctagccaaggaaagccatgggggactgtgccatgaggaacagtgcattccagcccagatactatgcttttcccaaggtcttcacaacccacataccaggacattcccttgggtgcctacaccaccagcgccctgcgtttcaagcacaaaactgggcagccgtttgggcagacaccgagctagctgcagcaattttttttcataccccagtggctcctggaatgccagtgagacagaaccattcactcccctggaaaggaggctgaagccagggagcccagtggtctagctcagcagatcccacccccacagagcccagcaagctaagacccactggcttgaaattcttgctgccagcacagcagcctgaagtcggcctgcagcactagaacttagtgggagaagggacgtctgccattactgaggcttgagtaggtggttttcccctcacagtgtaaacaaagccatcaggaagtttgaactgggcagagcccactgcagcttgacaaagctgctgtagccagactgcttctctagattcctcctctctgggcagggcatctctaaaagaaaggcagcaaccccagtcatgggcttatatataaaacttctatctccctagtacagagcaccttgggggaaggggcagccatgggggcagcttcagcagacttaaatattcctgcctgctggctctgaagagagcagtggatctcccagcacagtgcttgagctctgctaagggacagactgcctcctcaagtgggtccctgacccccatacctcctgactgggagacacctcccagcaggggtcgacagacacatcatacaggagagctccagctggcatctggcaggtgcccctctgggatgaagcttccagaggaaggaacagacagcaatctttgctgttctgcatcctccactggtgatacccaggtaaacaggatctggagtggacctccagcaaactccagcagatctgtagcagaaggacctgactgttagaagaaaaattaacaagcaggaatagcatcaacatcaacaaaaaggatgtccacacaaaaaccccatccaaaggtcaccaacatcaaagaccaaagatagataaatccacgaagatgaggaaaaaccagtgcaaaaaggctgaacattccaaaaccagaatgcctcttctcttccaaaggatcacagctcctcgccagcaagggaacaaaactggatggagaatgagtttgacaaattgacagaagtaggcttcagaaggtgggtaatatcaaactcctccaagctaaaggaggatgttctaacgcaatgcaaggaagctaagaaccttgaaaaaaggttagacgaattgctaactagtataaccagtttaaagcagaacataaatgacctgatggagctggaaaacacagcacaagaacttcgggaagcatgcacaagtatcagtagctgaattgatcaagtggaagaaaggatatcagagattgaagatcaacttaatgaaataaagcgagaagacaagattagagaaaaaagaatgaaaaggaatgaacaaagcctccaagaaacatgggactatgagaaaagaccaaatctatatttgattggtgtacttgaaagtgatggggagaatggaaccaagttggaaaacactcttcaggatattatccaggagaacttccccaacctagcaagacaggccaacattcaaattcaggaaatacagagaacacctcaaagatactccttgagaaaagcaaccccaagacacataatcgtcagattcaccaaggttgaaatgaaggaaaaaatgttaagcgcagccagagaaaaaggtcgggttacccacaaagggaagccaatcagactaacagcgaatctctctgcagaaaccccagggatgtggatgaagctggaaaccatcattctcagcaaactaacacaagaacagaaaaccaaacaccacctgttctcataagtgggagctgaataatgagaatacatggacacaggtgggggtgggcatcacataccggggcctgttggggggtggggcctgggggagggatagcattaggagaaatacctaatgtagatgacgggttgatgggtgcagcaaaccaccatggcatgtgtatacctatgtaacaaacctgcacattctgcacatgtgtcccaaaacttaaagtataataataataataaatactcagagaagttccaaaataggatttatatatagaatttatatatttgtatataggatttggaactatatatatgtatataaacatgaaaatgtatgtttatatatgtctataaagagtgaaacaattaaacttcttctattaaaaatattgatcatagtataataatattatgtactttcattttcaacctgagagtcattgaactataaacaccatgtcaagtatcttcaacccatggaattggatttttagattattttcctgcttgtatatttatacatttttttctgtgctcctatttttaaccttagagtctctgtcctttgctgtatgtgctatacctttgaattaagaaacatctgtgaatttaattaatgtgctgttgattcccacccttttccaagtcattaatgaggaggttaaaacagaacagactagggtttatttcacgtcccaagagacttttttggaaaaaccttccccatagcgtttttatttatttgcattggtttagagaatttatgctgtatggaagtgaatgtatttcagaaatacaatatatgaaatgttaaaggaatattttgatcatatgtttttagttatgtctcataattttcatacttctctgatagagattgtactctgtggttgagtagaatatatattttggaggaaatcaatgagttggcacatgaagggggtagatcttgcagtcagtggtattaccctcaacattctacaaacacatgaactctttggaatgcagaatagcctgagatttcttccatgaagatgtgggaggcaggaagatactctgatcataagcatatacaataatcaatgaaccattaaagtttatgctattagaattgctgttagctgagcagatactttataaaaccagaaatttatatttatggttcttatatttatttttaataatacatacacaatacacatataagtgttgatcaaaattgacaatgaggagagcaattagccaatataccaactatcttcttagttttcaagagcaaaatgaagtactgcagaaaagataggatgtaaagtgcagatttataaattgctccctttcaaaaacacaactgaaagttttgaatgccaaaaaaaaaattagcttcaaaatcagagaatgatttttttcttccatttatattgcttggactacctgccaaacacactataatttgcagcaaaaagaaggtaaaatccaagaaatagtttggacttccacaaacaccactgcctacacagacaacacataaaacatacttttcaagagtgctctactgcttctgcaaattaaggaatgactgggtgaggggcatggacaacaacagaaagaaggttatattccatttggaagctaccgtcctcagagcattattaatgtcatactgacattttaatgagagaatttctggagaatatatgtgaccagagctttccattaatttttttctgtcttcactctctaataattgcagagtgtattcaaataaagaatagaatttctaccttacctggaaggacaatatctagcataaagagctgtattagtttccttgggcttctatctaactccaaccttcgattccttctccacatggcctcatctctttctctctgtgtgtctctcctctgtatatccttgccaagacatttatcattgaatttagggcccacccagataatccaaacttttctcatttaagtatccttaactgaattacatttgcaaaagccctcccctactttccaaataagatcacattcccaggtttgtggacatatctattgaatgctaccattcaactgactataaaagcacaaagcagaagagtgaaaaagaatattgcaaagtcatgtttcttttttttttttttttttttttttgagatgtagtctcactctgtcaccgtggctggagtgcagtggcgtgatggctcactgcaacctccgcctcctgggttcaagtgattttcctgcctcagtctcctgagtagctgggattacagccacacaccaccacacccggctaatttttgtacttttagtagagatggggtttcaccatattggccaggctggtctcgaactcctgacctcataatccgcccaccttggcctcccacagtgctgggattacagccatgagccaccacgcccggccttccaaagccatttttacaactaaaggccatcaacagcagggaactgccaggacaagatgtgtagtcacatgaaattaatagaatccacacttttcaaaataaactttttattgaaattgggagtttgtcccaaggtgggaaatcaaatttattagaaaccttaattaggtggtaaatgctcccaattcagtaggttaaacataactttcagatagaattttaacaaacgtagagacaaagaatatgcagatataaaattccataactgtggctgctggtggtcttagtttcttctttatctccttcaggttactggataggtgaaaccttaacagccagctctccaactcaagtttgaaagagaacagaaaatttatactcaggtgtaacagattatagatataaatggaatatacctactctttcgcaagtaaataccagttgctgattaatttgcacactttcagagagatgtaagtagagacaaagtcaccccaacattgaatctattaaaaaatactgcaacacaaagaaggaaagcaacaccagcctgcaaaagaaaagcatagagctcacattaggaaaacatatacttctagacatttttgaaaatgagattcattgaattcaacaaatactgagcttcctatttgtgataagcatgtaccagtgactgggatgacagcaatgaaagaagaaaaacagataaatacaaattgggaagttagaaaataaaaatagaataagtttggcttagaaaagtgctaagaagagaaataaaacagaataagtggagagtaagaggtgcaattttgcatggggcagttaagatagattgcaagtggtttacactctcaaatggattatatgaaacaagaaataaaactctaaatgaagtgaaaaaggagttaagagaactaagaaaaaaactaaaagggcaaaacatataaaattaatcattcaaaaaataggcacaggaaactgctaaatcaatgctaccaatagaaaaatacggacagtaataaagacgtttaaagaataagccagaatagagagaaaaatgacaatgctaaaaataaaatgaatataaacattggcatgtgcagtgtggcaccagcaggtggacactaattggtcttaaagtgttgattcttaagtgtcttctattgtactgctacaaaagaataccatagactgatgtcttaaaaaacaaacttctatttctagagactagcagtctgagataagggtgccagaagagttgggttctttgtgaggggcctttgccaacttatgtcctctatatcctcacatggtcttccttgttgcctgtgtggagagagaagaaagaaatcttgcgcctcttcctctttttataagaggactaattctgtttatgagagctccaccctcctggcctaattgccttccaaaagctccccttccaaataccttcatattggagattaggttccaacatatgaaatttgggggacacaaacattcagttcataacactaagatttcttccgcttttaatgtttgaggcaacaaggacttgaaccagtgtgatggttagggaaatggtaagaccaagttggaacttttgtgttaaatgctatccttcaagacttcttgcacatgtcaatttatatatacaacctttttgctctgcttcatctctcactgaagtaaggctcttgaacaatattgaaaagatttttttttaaatgggacactacttgagggcaagattggagtctcctatatttttatcctctggacagagcatgaatcagaataagtgttagagtaagtgctgaaataagaactataaaatatgtcaaatactggatgaaaaaaataatactttgatttttatttcaaagcacactctcatacacagctgcactttaaatgaaggatagtaaacttaactaaatgcctcacctttgcagtaagaaaactgcctttgaatccccaataccttttactagatgcctaattcaaggaaaattaatttgcctattagtccttcagttttattatctgtaaattggtcttttgtgaggaacctggcatataataaacaccccataaacaataatcctgacagtggctatctactatttttatcttaaagctgggaaaacagatattcagagagttttggtgacctgttaatgtcactgagtaggtaggtaactcaggaaaggctagaatccagatgcttagatttctagtttagttttatgtacacattatggggggaggcaaggaagaagaaggaattgatagtgaccataatattgtatatgtatttgaatgatagaatcttgatttttaaatgtcatagaggaatcttaacataaagactttttagggaaacaaagtatgggatggataatgagtttgatttttggaaagttgaattggaaattttgccactagataataatagagatggccatatcatgctcaatggcttttcattgcatgagcaataaaatatgaagccctttcaatggcctagaaaatgtaggttaactgcatcatatctgtgtatattgtgttatatcttccttctttgatcgcctttctccgttttctgcacacctctttcttgacattttgggattatgccgggcctgtttttataatctgtaacaggctgctctatcttcctaaattgcttttcttcccaatgtttgcataaatattctttcccccagcttcacttcatgaagattattttcaaagaccatctcctcagaaaggtctttcattataaccgtctctataatgcccatcacctttactatctctcctcttatcttgctttgtttttcttcaaagcagttgtcacaaactgaacataagttactctgtgtgtgtgcatgtgtgcatgtgtgtgtgcacgtgtgcagaggcatgtgtgtctgtttcactagactgtaaactctatgaggataggggctttgccttgccatcactatatctccatacctttagtacctgacatttactaagtgctcaataactgtgtgttgaataaataaatatgtaaataaatacgtgaatggcacaagcatttaagactaatatcctccaccaagatgtagtgttggtgactgagatgccttattcatgccttacatctttgcttttcagttgcttgcttaactcatacagaaaaagtataggccttctctgttcacattgtttttcacaattcttaaaatatggactccccagtagggaggaagcacagtagcacaacttatcatgcacacacacacacacaaaatctaaccacccaaatcccatttcatttcctttttgtgcatccttcttcagttaaattttttaaacagtcaacacattactatattaaaaacaaatacaaaatcttttaagtaaagactgggttaaaaatctgtttgtgaatgtgaggttgcttattatgctttctctgctctctttaaataggactcagtcagctcaattagtttatcaaacactggaaaatccctaaggtgtctaaatataagcagcatcatttcctgaatatttaattcctaaaaacaggacgatagtcatagtattcacattctctaatctactgtgttctggaaatcttgtaatcaatgatatagcaagagaaaagtacccttgattcccagacatgtttcaacatttacaaaatgtattgcttagaatttcatttttcttctttcacttcaggctggcatattttcagaatctagatatttgttttaagaaaaaacttttctgaatactccaacaaagcaggaatagcatctgtcttattcagaatttatcagaaggcctggcataaaagaggatttaatgtatatctgaggagtaaaggagtaaataaatgtatactacatgaaagaataaaagcaattcagcttaatattaaaaaatatttttaacattttgatttttctaattgtctattgcttttctattccttttttataattacacatatttaattttattgtacctgagtttttattttaccccatatcaaattcttttagaagcaagattatacctcaatcaaattgatatggtttggctgtgtctccacccaaatctcatcttgaattcccgtctgctgtgggagggactgtgtggaaggttattgaatcatgggggtggatctttcccacactgttcttgtgatggtgaataagtcttatgagatctgatggttttataagggggagtttccccgcacaagttctcttcttttgcctgctgccatccacataagatgtaacttgcttctccttgccttccgccatgattgtgaggctgaggtcctgtggaagtgtaagtccattaaaactttttcctgtataaattacccagtcttgggtatatctttattagcagcatgaaaacagactgatacagtaaacattaaccttttctgccttcacccatatttttatgttaccaattatttgggttttaatttagtaccttgaactcttaatactttaacaggaccaagtttaaaattagcctactggataccttttatctttttaaatccaactattgacatatatgtaaattttattctgtaacaagtcttcattgttctttgtgttattaaaataattataaataaatggtttaatgggaacattagtgtatcaattaatactttgagttgttcaaaggaatgctttcaaatcccttacttgtgggatggagaaggccatatttctccctgaattttattattatttctgcataaactactgagggaatgtttgactctgaaactcagatcaggagtgattggtattcatttgtattaaatattttagaaagtgacaataatttctgacttccaaaaagaatttccccaggcatgtaaaaagcaattaaaaaacccacatagttgaatgatctaacacgacttaaaattcataataaaagtttttagggaaaatacataaattttaacataatatatatttgagaataaattgtaaacactggcttttaaaagactccaaattgaaccttctttagtgtctatgcttaagtgatgtgtgcttatatttttaggacctcatttacctgaaccactcctcacccatgatcaatagtggctatggtggaggtaatcctaccctgttgaccatacttgatatttctagaagtgacagcaaatacaaatgtggccagttagttccccaggaatttaggccccaaggacatctgtgttttctaccatgatgtgcacagagagagaaaaagatacagagaagcagtgaatagagaggtagagatgttgagacagttatgctccctggttctcatttctgtgtattagatatctattgtaatgtaagaaattactccagaatgcagcaacttaatacagtaacacttacaattttatagtgtttgtggatccaaaatccatatagaacttaactacctgtctcccagggtctctcacaaagctgcaatcaagggattggctggggttgtagtcatctcaaaacttgatttgcagaatgtccacttgtagggtcactcacatatagctgttgtcaggcttaaggtcttctcttaaggttgttggtctgaagcatcatttccgtgccacacggacttctctacagggctacttgctttcttcagagctacttttccacgagctagggcttggagggagagaggaagagtgagagagagtgaataaagcaaaagtcacaagctttttgtaacctaatttgggaatttatatcccctcacttttgctgtattttattcattagaaaagagttactagggccagcccacactcatgaagaagggattgcccaagggcatgaataccaggagataaagatcattaagtgctattctagtggctgctactatagcctggcctctagccaccaatgattcatgaccctatcatattcaaaggacactcagcccctcctaaggtcctcaaaagtctcatcctattacaacatcagctcaaagcccagaagctctttgtataaatcaggtgcaggtgcagatgaagattcttagatacggtttcttaagtatagctccttagagttcctatcatctgtaaatctttagatcaacaaaactaaagagaaaaattgtctactcatacgcacgccaaaattatggctatttgtaacacggtagctggcttcccctgagcaaaaactgaaagagaggtgttaggggagaaactgaacaaggcaaatgtcacagtatttttgtaacctaataattgggagtgacattttttcacttttgtcatattttattcattagaaatgagtcactaggtcagcctgcacccaagagaagagaatttaaaagggcacaaatcctgagaaacaggcatcatttggggccatttgcaggctgcctgccactctctcataggagtctggctgcatttgtgtctggattatatcaagacccttctggcttgtacaaaaaaattccactacgtttttaaggcagctgaagttgatgtctgaagcttgaaaacaaaaagttatataagttcaatatctgttcttaaactagactcatcttttctttgcattaaaaaatagtcaacctttcttggagcatcttatatgtgttaaaaatttctcattatcaggaagattctctcctattttttcacagtcctaaattaccttatttcttttaaagtccctggatatattcagactactttagttgacatctctgcagtatttgacactgtcagctacatcttctttcttgaaacactcaatccctctggcttctgtgaaatcacactctcctggattaactcttatctgtttctttcatgggaacttctgatctctcttcaattttcatgtacatcaggatttcattctttttcttcttctttcactgtatacagtccttgaatgaatgcaccaaacagggtttcaatgacaatcaaagttgatgacctaaatctaaatctccttcctagagttatatccacctgttcaacacctccatttcatatttcacaagtacttacaacttagcttcttatcccaatttctttccaacctcaatatgctttctttatgcttcctcatttgctcaagctggaaactttgactttgttcttgattctgtctttcttactcacatcccactcatctaatcctgttctctgctcttgttaattttcccttagtatctctctttctgggccaattttctccaccaataccatacttctaaaattttatttttgtaataaatcaatatcatctttcttgtaatgtagaatatacaaaagtttaagaatgtgggatttgaggccaggcacagtggctcacccctgtaatcccagcactttgggaggcctaagtgggcagatcacttgaagtcaggagtttgagaccagcctggtcaatatggtgaaagcccatctcaagtaaaaatacaaaaattagctgggcatggtggtatgttcctgcaatcccagctactcaggaggctgaagcaggataatagcttgaaccagggaggtgaagttgcaatgagccgagattgccccagtacactccagcctgggtgacagagcaagactctgtcttaagaaaaaaaaaaaaaaaaagaatgtgggatttggagtaagactacctagttttgaatcctggatctactacttacctacttactagctgtgtgatcttgagcttgagcaggttgcttaaactgtctatgattgagcttcttcctttgtaaaatgtataaaataatgttatttacttcactgagttttccacaagattaaatgagataatgcaagtaaaacatttagaatagggccaagctcatagtatatatgaaataagcattggttattactaatattagctaatgactgcaataacctactaagtagaattcctttttcactcttagtcatcaatataaaccattctaacactttggtaaagtacaaatgtaatcatgtccttctttactcttattaaaacttgtaaatggggccaggagtggtgagtcatgcctgtaatcctaacactttgggaggttgaggcgggtggatcaactgaggtctggagtttgagaccaacctggccaacagggtaaaaccccgtctctactaaaaatacaaaattagccagacatggtggcacatgcctgtaatcctagctactcgggaggctgaggcaggagaatggcttgaacccaggaggcagaggttgcagtgagccgagattgcaccattgcactccaccctgggcaacaagagtgaaactccatctcaaaaataaataaataaaacctttaaatgattatcaattgctgtcagatccaaaatacttaaagtaccttacaaggaccctcacgatcttgaataattactatgtgttaggtaaataccaggcgtggtgaattcagtgacgctgtcctgcccacattacatgtgtgctggtcatggacccatctatgttgtctgactttcagttctccaaactgatcacactttgtctcagttctaggcctttaaaaatactgctcccctacctctactgccattcttcctcttatctgatggtgtaatttctctaatgccctggttttgttatcaaacttgcttttttctaggagagtctttcctgaccactagtttactctcactcactgggtagtacattggaattagccctactacaattttctatttacttttcagttttactaatagactgcaagcttcttgaggaccaaggttgagtttgctaatgagttttcatttagcattccatctccagtatgtacctatcatcatgccccatacggagtgtgccttcaacacatgactgtttaatacatctctaggcatatacttaatagtcatgtattgaagtgtgccttccatacatgactgttaaatacatttctgaacaatttgggggtgttgggcagggatctagatatacaagagactgtgaaccaatctgggaaaaaaatttgccctagagtgaagttacagatgctggtttcaaaggcatctgactagcaagggagagaagggaccactttgaatacagaatagagttagtcttttaaaatctcatccggatcagtaccctagagtcatctctgttttctttaacaagaaagcaaaagataccagagagagagagggagagaaagcaaatgaaaggtattactaaaatttctgagggacccgaaacaccaaggcaaaacagaattggtgattgaagtttagttagcaatcaccactttagcagggacatagaccatgctgttcttgcagacatcagctccctggatatctggcatcagaagcctcagaatagactccaaaagataccaacagcattgagaatgcccctggtgtacactagctatggaaataatctttcttatgttggcagatacagaagacatctgtgcagcaagctgagccagaaaggaagagactagtaattgttgcagaaaaatcaagaagactaatcttgcatctcccttgaaatatccaagaggtatttctggaaatgcctggagggaatttgtgtatgaggatcaagaagatgaaaagcaggtagaaggagaggaaatcaattgttatttttgactattaacaagactctaattttatcttcaatgtgctaagatctatgtcttcatacacataaatatataatttcagctcttttatacattttttttgactcttaggtggattttcttaagattagctaaaacaagcaaaacatcttgttagctaaagcgtcttgtttagattacatgtgtatatatgttgtttgaatgctttgtgttagtcagtctttactaggttatgctgcaataacaaacaatcaaaaatctcttcagcttacaggaaaagaaaaggggacttatttctaatttgtgtgtctgttgtgggttatatttaactttattttacagtttgttttcattctagaatccaggctgactgataagccccttacatagacacactgtccttgagaaaaagcgaaaagaaaagatgaaaagcctagcagtgacatctaaagcttctgcagaaaacttaacttcatattttactggaatacttgacacctgtagggaggaacactgcaaatcacatggcacaggtaggaatggttaatcttctcactgcacttgcagagaataatcgagaatattaatttagtaatttgtatgtttccttaattataaattaatgtgttctatttcccaagattaatttgtcctttgtatacatcttagtagatgttgtgtactctagctctattgttgctgttcagttttctattcagcatggctattttactacctcattttaatagttgattaggtaatgccaaaatagtcaaattcttataaattgtgtctccagtttttcttgacactttgacagctacatggccaaaactattttcaattgatttcctatatttgtttttatttaaatgttttttattagttacctattcttccttttgcctgttaattctaatagataattttgaatattgtgcaagaaaaataaattgaaaccattaaaaattaattttaacttttctaatttttacaattaatttatatgcttgagggaaaatatattgacattgtatgcattttaaatacaaatgcagtttagtttctaatgcttttttaaaaagatattggtagaatgcattttttatgtatgtatggatggatggatggatggatttatttatttattttataatttttgtttttgtttatttcttctaaaaaaaaaacacaggatacatgtgcagagcttgcaggtttttacatgggtatacatgtaccatggtggtttgctgtacctgttgttccctaagttccctcctcttgccccctaaccccacttatgagtgagaacatgtagtgtttggttgtctattcctgtgttagtttgctgaggatggtggttcccagcttcatccatgtccctgcaaaggacacgatctcattcatttttatggctgcatagtactccatggtgtatatgtactacattttctttacccagtctatcattgatggacatttgggttggttccatgtatttgttattatagtgttacaataaacatacatatgcatatatctttataataaaatgatttatattcctttgggtatatacccagtaatgggatttctgggtcaaatggtatttctggttctagatccttgaggaattgccatactgtcttccacaattgttgaactaatttaaattcccaccaatagcgtaaaagcattcctatttctccacatcctcaccagcatctattgtttcttgactttttaaatgattgccattctgactggtgcgggatggtattttgttatggttttgatttgcatttctctgatgaacagtgatattgagcttttcttcatatgcttgttggacccataaatttatttttttgagaagtgtctgttcatatcctttgcccactttttgatggggttgtttgtttttttcttgtaaattttttgaagttccttgtaaattttggatattagacctttgtcagatgggtagattgcaaatttttttcctattctgtaggttgcctgttcactctgatgatagtttattttgctgtgcagaagctccttaattagatctcatttgtcaattttggccttttgttgcaattgcttttggtgttcttgtcatgaagaagtctttgcccatgcctatgtcctgaatggtattgcctaggttttcttctagggttttaatggtttttggttttaaatttaagtctttaaatccatcttgagttaatttctttatgagatttaaggaatgggtgcagtttcagttttctgcatatggttagccagttttccaggcaccatttattaaataggagatcctttctctgttgcttgtttttgtcaagtttgtcaaagatcagatggttttagatgtgtggtgttacttctgaggtctctgttctgttccattggtctatatgtctgttttggtaccagtaccatgctgttttggttactgtagccttgtagtgtagtttgaagtcaggtagtgtgatggctccagctttgttcttttccttagggttgccttggctatatgggatcttctttgattccatgtcaaatttagagtatttttttctaattctgtgaagaatatcaatggtagtttgatgggaataacattgaatctataaattactttgagcagtgtggccattttcatgatattgattctttctatccatgaggatggaatgtttttccatttgtttgtgtcctctcttatttccttgagcagtggtttgtagttctccttgaagaggtccttcacatcactttttagacgtattcctgggtattttattctctttgtagcaattgtgaatgggagttcattcatgattcggctctctgcttgtcttttgttggtgtaaaggaatgcttgtgatttatgcacattgattttatatgctaagactttgctgaagttgcttatcagtttaaagagtttttgggctgagatgatggggttttctaaatataaatcatgtcatctgcagacagagacaatttgacttcctctcttcctatttgaatatcctttatttctttctcttgcctgattgccccggctagaacttccaatactacgttgaaaaggagtggtgagagagggcatcattgtcttggaccagttttcaaagtgaatgcttccagcttttgtccattcaatatgatattggttgtgggtttgtcataaacagctctttttattttgagatatgtttcatcaatacttagtttattgagagtttttaacatgaagggatgttgaattttattggaggccttttctgtgtctattgagataataatgtggtttttgtctttggttatgtttatgtgatggattacatttattgatttgcatatgttgaactagccttgcatcccaggatgagcccaactcgatcacggtggataagttttttgatatgctgctggattcggtttgccagtatttcattgacgatttttgcatcgatgttcgtcagggatattggactgaagttttctttttttattgtgtctcttcccagttttgatattaggatgatgctggcttcataaaatgagttagggagaagtccctccttttcaattgtttggaatagtttcagaaggaatggtaccagctcctcctttgtacttctggtagaatttggctgtgaatctgtctggtcctgggtttttttttttttttttttttagtcttagaacttctttcttttttatgagactattaggtatgtgttaaatacttacatattctctgatacctttttgatcaccagcactaactttcatttactcatgctttcactcagtatatttccattatcaacagttcaggatttttaaaattattgttttttcacatattggacaatttcattttcttaatttaatttataaaaaagaatactttttacttccctaaaagtaaggcatatataacacttactgatgttctggagaatcaaaatgatcaacaatttaatatatccatgaaagtctgacctactctgtgaagtggagatttctcagtgtttttatttacatttccatgcctctgatgcaaacaatttcaccgacatttataattttctttgcatatgtattgagtagcctactttatttaagtaagaaataactcccatcaaaagggttatcctttcctggcgttggggctcacacctgtaatcctgccactttgggaagccaaggcaggtggatccaggagttcaagaccagcctggccaacatggtgaaaccccgtctctactaaaaatagaaaaatttgctgggtatggtggtgggtgcctataatcccagctactcaggaggctgaggcaggagaatcacttaaacttgggaggcagaggttgcagtgagctgaaatagcaccactacactccaacctgggtgacagagcaagactccatctcaaaaaaaaaaaaaaaaaaaaaaaaaaaaaagaagaaaaaagaaaaagaaaaaaaagggcttatccttaaacaataaggacatttattggctcatataaatgaaattcctcaataggactggttgtaaggtagactcaatcaatctgaaatatttggatatctttcccttttcttgcttttgctttatcttcatactggtggcaagaagcacaagcatcacatccatacatgataacaactggaagatggaagatattgtcccttttggaagccctttcaggaagaattttttaaagttctggaaagaaactactcagaggctctggaaaaatccttgtggtgtttcattggcacaaattagattacatgtcattccttaaccaatcattggtaaggggaatgtgattatccttaatacaatcaggcaccatttggagatggggactggaggcaacagtccttttggtacataatttcaaaacaaacaaacaaaagaggataacagaacaaaattagggtccacatagtaaataaagggaaagggttaaatgaatgcttagcagcctacaataacaacgttcaatttagtgtgcactgaatatgtttgtttgttgcctttatcattatattgagaacataataaaaaggcatctatttttgttagagattgactaacagagagaaagactagtttttctataaatgtttaagtcggccgagtgcggtgactcacacctgtaatcccagcactttggaaggcctaggagggtggatcacctgaggtcaggagttcgagaccagtctggccaacatggtgaaacccccatctctactaaagataaaaaattagccaggtgtggtggcacgtgcctgtaatctcagctactcaggaggctgaggcaacagaattgctttgacctgtgaggcagaggttgcagtgagccgagattgtgccactgcaccccagcctgggagacagagtgagactccatctcaaaaaataaataaataaaaatgtttaagtcatttcctctgattccttgaaggattttgctcttggtacacactctgtctcttacatggctcctgccctaattcatcgtaatttcaatatctacatagatggtcgtataatgatgtggctgcttagttctgtgaactttctccaatgatcttgttttatactttttcttggtcatcttttctaatgtcatagttcagaccttatcattataaaaaaaatcacaccctgttcttttcttttttttattattatactttaagttctagagtacatgtgcacaatgtacaggtttgttacatatgcgcaccctgttcttaatcttaatttcaaacatcatctttttctctcctatcaaaatctatacatttttttggtccatctcattcccttttgtattctaaaatcagaaaacatagtacctagcatggtctcaaatccattgattctatccatttatactttctcttatctgtcttatatctttgctcttctttttagtctgctcaaattccctcatcaattcttatggtcactctattgcataacagctgcaacttttgtgtttctttctcactttcttatacctgttttagccaagtacagtcctaattaatcctaaccaaattctaccctcgctgaatgtctgaatccacacaactgatcaaagctgtatgaatctgtagccaactatcttactttaaattcatgattactaattttacctgtgcctttaatattgcctggccatgagattacatgtatttctagtttgctaaacgttttactctccttgataattatttaatatttttacttttcttctgaaacctccaacctccatccctatactcactcttagctcatgattttgctttctattttactgagaattaagaagctattagaaaagaaatattactggaacccaccaacaaatctactcatgtggacaactgggtccatatgctgaaccttcttttctggttactatggatggcctgtctgctcctagtaaaggtcaaccttttcactggtgtactcactcaagctctcttgccctttcaagaccattattccaggccaggcgcagtggctcacacctgtaatcccagcactttgggaggtggaggtgggcagatcatgaggtcaggagttcgggaccattctgatcaacatggtgaaaccccatctttactaaaaatacaaaaaaaaaaaaattgccaggcgtggtggtgcgcacctgtaatctcagctactcaggagactgaggcaggagaatcgcttgaactcgggagacggaggttgcagtgatcggagatcgcaccattgcaccccagcctgggtgacagagcgagactccatctcaaaaacaacaacgacaacaacaacaacaacaaaaactctcttattttctctgtatcttcttattttctcctcataagcgtacaaaatttactatttttattaacttaaaaaatctcagactgatcctatgtatgctactgccttctatcccttttcttcttcactttgcagcaaaactcctcaaaagtattgtctatgctcattacctccagcttctctcttctcatcttctcttgaaattatttcagtcagacctttgctcctccccactgaaattgttcttgtcagtataatcatgacagtctattcttattgtcaaattcaaaggttaattcacattcttcctctgatttggcctttcagcattatttggcacagttggtaactaccttatcttttcaacattttatttccttggctttcacatgatcctggtttcttcttactgacctcttcttcctttttacatttgtcagtcctcccttatttcccaaacctcccaaatttggaatgcctcagagctcaggctcctaaatattctttattcaattaattctcaaaatcccaagagtacatcttcaattcaacctccctgaattctagaactatgtagcaaactgcccactcagcatctacatgtgagtaggatcagggttaggaaataaataaatgacatgtccctacgaaactggagtagaactaaaaaaatgtaaagatcttaatatacttggtgtgatggtacattatctggaaactgaagaaatagctgtattttaaaaccagggttggtattgggcagaagtagaaaacctgtactgttaagggatgaatctgacatctggaccttagagaattttctgagatactttaaggagggcatctagatacctatctgattaaaacatcactcttttttttttttttttttttgagacggagtcttgctctgtcacccaggctggagggcagtggcgcgatctcggctcactgcaagctccgcctcgcgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaacatcactcttaatagagcctctagtgcctattcagcatggctaatggtgtggggagcatcgattgaggagcagagctggtctttggaaagaaactgaaagtcagaaggatgctgtggaaaagcctttggaaaaatgcattgttggatattaaatgttttacctggagagtcacacatacccagtgtctgtgagctgattagaatcgatcaaagaaagtccttcatgaaggagctaactgtacatttctgtttaaaccaaagctgacatcattcttaggaaattggaatgtgtcaagtgaaaaaagtgtgtattgcatatatgcttgagctaattaaaagacccaattggctttattagctgtaacaggtctgctattgaaaaccttattagagccaatctttgggctcttggttgagagcttgtattacccgggaactagagacttggcagggatgggacagggaaaaattcaatgccatagacttgagaggtaaatattgtattgtgtttagatcacatcattggaatgttagtggggtgcaaagcctcagggatatagatgcaacagagattaatagaaagtttttggagactggtactaagaattatgtacattttcaaaaaccacaaaatgccttcctttctacagcagaatgtctgacatcagtcaaaaagttactcaataacacaagtagatgctgagacgtatatgtcaactttgtaaacacacatcattggaagtaccttagtatatgtgtcaaaacttgagggacttttgcattgaagtaccgtggagtgcagtatgaaaaatcaccatcagttagggcacattgccggaggagctatttacaataaagaaaactgcaggatccaggaaaggccagaaggttcctccacttctcactgctagtaaaataaattactgaagaagaaatgaaagagacagcattcccaaataaacaaagatgggatagttgtgttgtactgagactgaaggcaacaattcagatttagggagctgacatggataccatcatgattacgctccctaaatataatcacacacaagcagagtgtcaggaaatgggagtaaccagatcatccacctctggctgaaatgttgcccagaagataccaggtggtctcttcagagactatacgagtcacctggcttccagttagcaaaactggctaaatgttagcccaaatagggcagttgtgtttatccacctaggctttgaactcttagcacctagggatctcaagttgaatttggaggtagattaagagagaacatataaaggagttcctaggattaggtaaagtagaaaagagcagggttgaaacaagaatggagatcttagggaccatacagccataaagataactatgtctcgatagttgagaggagaatgttggaaaatgagaaatgggttggagtaatgagcaattttagtaccatgacagaaaaaaacccttaataaaaacctctctttgtaggatatagaattgctggagtaggttgctgaaatgggcggtatatatacacccttggacccttgccctgagaggagaggaatgacagccaagaactcaggctgctgaagtggcttactttcctggctccctatgatgcttcctgggcaagaaccactagagacagaagctgacactcaggaagcagcaatgggaatattttgactaggttgtgagatgtgtccaggaggggagaaggaaacctttcgtgtatataggtaactgggtagctcaggagacagtttgaaacgcagttacagatgcccggaaagtcagaagagtgggatacacctaggaatgacaggtaaatgctctacattgttatcttccagataatagaggcattctctagaaggaatactacaagtcatgttttctttttcttttttcaaagaaatgtgtaacagtacattgaaacatttatcttttcagcagcagacacagaaattcctttgagaaaagtgatgtagttttctcagcctttggaggaaggcaggggaaggaggagagaggcagagtccctgctgtagcgggaagggtcgagtgggagatgtgatctggtgactgcagccaggaggaaatgctgggcatccaaggcaggccttctgatgatcacatgttacccactgcaaagtaacccatcactcattccaacaatattcattagagctataggctttgtgtgtagctttctccagaaagctgttattggagctagtttggtggtcaaatttgagttcagatagatacaggtggattatacagaagtggtaaatgtctaacagctgagttatatatcattttcattgatggataaaatttgactttatctcaaaagcatttttaaaaattcatgtagttctgtatccagggtatcttgagaaatgtatctgaaaacttggtgccaaaaaaaaatctcataaaagtgtgcaaaatctgttctgtatagatcagtgataagtgaaagataagtataaatgagagataaatcaaaagtatcagacattcagtgacttaataattagcaattaatttgataacttcaatggaagaaaaatttagcaattaacactctcatatttatataaaaagtaataaactaaatcccatatttttaatgctaggaaatatattagtgcacacataatttagagtacattctcacttcttaggccaaatattacttcatcagagcaccaaaaaaagattactgatcctgtctttatttaaaatgttgacattttgcttatcaatttgatattttctcaatactaattttatgttaatttatatttttttaaatattgcatttaatattatttaccttggctactgaattttttggaaccttcttaaattttgtgtctaagacaattgtcacagcctcttcatcatctttgatgctctgggtggcagcaacattatctatatgggtgctgagataagcagaaattgcaaaaagtctgcagcattggcacctgtagttggaggaactgcttaagatattctgaatatttccctaattatttgagataagctgcacttttgatgtgagtagttctaatgaaagttagcaccctctaaggcaagtcctgatgcatatctggaaaaaaagaaacttttaaattattgctagattacacatttacttgaaagagtactttgagattcatttaacaagtttagaaagttaactcctgctctgaacatggtaaaagagatgtgtaaccaatgcagaagagacacgatagacaggtatggaataaaaaactcctactaaagtgagacagatgctaagggcttcagttttgcataggaggatacaagtaaaaggcccttgggaatgtatgccttttccctttgaactctgttactcttttcatctttaagaagtaagcttctttgaactctaccattttaacccaaccaatatatttttttctattttaactctattatgtttttatacccttccattttcctatacagctccatgtagacccaggcccatctaattcttgagtcaatcacagaagcatcaagaaatacaatctcagcttttccctaacccctacaacctctgtcgattggctttagatcaagtccttgtcctacacttgagaccctcagagccatctattttctgtgtagctcatgtcctatgttcctctagctgccaacaatatagtgagtcaagtgtgttagatataagcccaagatgttcacctagttacagtgtttcatattactatggttccagttataagaccataggaccgagcttttttttgactctaaagattcactctatttcaccaatttctgcctgtaggatcaaagcttcaatgtaaactaaatctctcacttcagccttatgctctgtctttgatcttgtttttatgaattttcccaggagcttgatcgtgcctcatctctccagtatagacaatttcttctacatatgctcagatttctaggaatgacattgtcatgtctttgttctttcgggtcccaataattgggctaacacctgacttcccctgttgattggttgccttggagcttgttgctaagggaataaaatagctgatgtacgtcctctcagacaagacattttcatataggtccagtgaaccaagtataaaaatacaaacgtttgttgaatgtgaagctgtcctcacagggttaacaagaattctggacagaaatatagtgataattgggcattaatcaggcggcacattgacctacttctttgtaactgcaagtcacatagcattagatactgaccatttgcatctccattgtttctacagatagaatttctggcattaaaatcacagggcttttatttaagataaatagggtctctgacattagaatcataaggctttgtttaagaattgcttaagatctttttcagatcctgaattgcagcaaaacagctgaggccagctattttgaagaccccaagagaggaatggatttgcatgaaaatatcatttcttcaactccctgtctcaagacttcaccctgcactctttgacaaatgttccccacactttgcttcattccaaaaccttggacccaaattccttggggagtttaaatttgaggtttcctcccatctcctcatttggtgatcctacggattaaacctgtttctccgctgcaacccagtttcttggtgcattgacttgctttgtgcattgggcaatggagttattacagttacacatggtgaagaaagtgattgatcttgtcccagttggcatttttcatataatattgaagacacaaataaaaaaataaactgagcaatacattttgctagtttgttttcagggaaaaaaagtgtttttgtaaattcttaatacgatttgcttgtaggatttataaacagattctagaggcaatgccaaaaaattttaaacctatttcgacatggcaccagattgctattaggatttagctatgaaagctggcagtctgaaatgacaattctcatttttaaattctaccatgttaattaacagctacataaaaatattttccatgctttccaatcgcacttcacagattcttgtgctaaatgatcaaatttaataaaagtttgtgttcatattctgaaaatgaaaaattatgttggtgtaatcatcattactagtcagaggtgatctggtcacagttaaacacctgcatttaaattaatgaccttcatttgtaaatgtatttacttagattttaaaaagaaatttttcttattattattatacttcaagttctagggtacatgtgcacaacgtgcaggtttgttacatatgtatacatgtgccatgttggtgtgctgcacccattgactcgtcatttacattagatatatctcctaatgctatccctcccccctccccccatcccacaacaggccccagtgtgtgatgttccccaccctgtgtccaagtgttttcattgttcaattcccacccatgaataagaacatatggtgtttgatttttcgtcgttgcaatagtttgctcagaatgatggtttccagattcatccatgtccctgcaaaggacatgaactcatcattttttatggctgcgtagtattccatggtgtatatgtgccacattttcttaatccagtctatcattgatggacatttgggttggttccaagtctttgctattgtgaatagtgcctcaataaacatgtgcatgtgtctttatagtagcatgatttataatcatttgggtatataccctgtaatgggatggctgggtcaaatggtatttctagttctagatccttgagcaattgccacactgtcttccacaatgtttgaactagcttacattcccaacgacagtgtaagagtgttcctatttctccacatcctctccagcacctgatttttcctgactttttaatggtcaccattctaaccagtgtgagatggtatctcattgtagttttgatttgcatttctctgatggccagtgatgatgaacattttttcatgtgtcttttgtctgcataaatgttttcttttgagaagtgtctattcatgtcctttgaccactttctgatggggttgattttttcttgtaaatttgtttgagttctttgtagattccggatattagccctttgtcagatgggtagattgtaaaaattttctcccattctgtaggttgcctgttcactctgatggtagtttcttttgctgtgcagaagctgtttagtttaattagatcccatttgtcaattttggcttttgttgccattgctttcggtgttttagtcatgaagtccttgcccatgcctatgtcctgaatggtattgcctaggttttcttctagggtttttatggttttaggtctaacatttaagtcttcaatccatcttgaattaatttttgtataaggtgtaaggaagtgatccagtttcagctttctatatatggctagccagttttcccagcagaatttattaaacagggaatccttcccccatttcttgtttttgtcaggtttgtcaaagatcagatggttgtagatgtgtggtattattactgagggctccgttctgttccattggtctatatctctgttttggtaacagtaccatgcagttttggttactgtagccttgtagtatagtttgaagtcaggtagcgtgatgcctccagctttgttcttttggcttaggattgtcttggcaatgcgggcttttttttttgttccatatgaactctaaagtagttttttccaattctgtgaagaaagtcattagtagcttgatggggatggcattgaatctataaattaccttggggagtatggccattttcatgatattgattcttcctatccatgagcatggaatgttcttccatttgtttgtgtcctcttttatttcattgagcagtgatttgtagttctccttgaagaggtccttcacatcccttgtaagttggattcctaagtattttattctctttgaagcaattgtgaatgggagttcactcatgatttggctctctgtttgttattggtgtataggaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccccttatttctttctcctgcctgattgtcctggccagaacttccaacactacgttgaataggagaggtgagagagggcatccctgtcttgtgccagttttcaaagggagttcttccagtttttgtccattcagtataatatcgactgtgggtttgtcatgaatagctcttattattttgagacatgtcccatcaatacctaatttattgagagtttttaccatgaagggctttgaattttgtcaaaggccttttctacatctattgagataatcatgtggcttttgtctttggttctgtttatatgatggattacatttattgatttgcatatgttgaaccagccttgcatcccagggatgaagccaacttcatagtggtggataagctttttgatgtgctgatggatttggtttgccagtattttattgaggatttttgcatcaatgttcatcagggatattggtctaaaattctctttttttgttgtgtctctgccagcctttggaatcaagatgatactggctttataaaatgagttagggaggattccctccttttctattgattggaatagtttcagaaggaatgataccagctcctctttgtacctcgggtagaatttggctgtgaatccatctggtcctggacttttttggttggtaggctgttaattattggctcaatttcagagcctgttattggtctgttcagggattcaacttcttcctggtttagtcttgggaggttgtatgtgtccaggaatttatccatttcttctagattttctagtttatttatgtagaggtgtttatagtattctcttatggtagtttgtatttctatgggatcagtggtgatgtcccctttatcatttcttattgcgtctatttggttcttctctcttttcttctttattagtcttgctagtggtgtatcaattttgttgatcttttcaaaaaaccaactcctgggttcattgattttttgaagggttttttgtgtctctatctccttcagttctgctctgatcttagttatttcttgccttctgctagcttttgaatgagtttgctcttgcttctctagtaaattgtgatgttaggttgtccattttagatctttcctgctttctcttgtgggcacttagtgtcataaatttccctctaaacactgctttaaatgtgtcccagagattctggtatgttgtgtccttgttctcattcgtttcaaagaatgtcttcatttctgccttcatttcattatgtacccagtagtcattcaggactatgttgttcagtttccatgtagttgaggggttttgagtgagtttcttaatcctgagttctagtttgattgcactgtggtctgagagacagtttgttataatttctgttcttttacatttgctgaggagtgctttacttccaactatgtggtcagttttggaataagcatgatgtggtgctgacaagaatgtatattctgttgatttggggtggagacttctgtagatgtctattaggtccacttggtgcagagctgagttcaattcctggatatccttgttaattttctgtctcgttgatctgtctaatcttgacagtggggtgttaaagtctcccattattattgtgtgggagtctaagtctctttgtaggtctctaaggacttgctttatgaatctgggtgctcctgtattgggtgcatatttatttaggatagttagctcttcttgttgaattgatccctttaccattatgtaatggcgttctttgtctcttttgatgtttgttggtttaaagtctgttttatctgacactaggattgcaacccctgcttttttttgttttccatttgcttggtagatcttcctccatccctttattttgagcctatgtgtgtctctgcacgtgagatgggtctcctgaatatagaacactgctgggtcttgactctttatccaatttcccagtctgtgtattttaattggagcatttagcccatttacatttaaggttaatattgttatgtgtgaatttgatcctgtcattatgatggtagctggttattttgctcattagtttatgctgttttttcctagcatcgatggtctttacaatttggcatgtttttgcagtggctggtactggttgttcctttccatgtttagtgcttccttcaggagctcttgtaaggcaggcttggtggtgacaaaatctctcagcatttgcttgtctgtaaaggattttatttctccttcatttatgaagattagtttggctggatatgaaattctgggttgaaaattcttttctttaagaattttgaatattggcacccactctcttctggcttgtagagtttctgctgagagatccgctgttagtctgatgggcttccctttgtgggtaacccaacctttctctctggctgccctgacattttttccttcatttcaactttggtgaatctgaaaaattatgtgtcttggagttgctcttctccaggagtgcctttgtggcattctctgtatttcctgaatttgaatgctggcctgccttgctaggttggggaagttcttctggataatatcctgcagagtgttttccaacttgggtccatttaccccgtcactttcaggtacaccaatcacatgtagacttggttttttcacatagtcccatatttcttggagactttgttcatttctttttactcttttttctctaaacttctcttctcacttcatgtcattcatttgatcttcaatcacagataccctttcttccacttgattgaatcagctactgaagcttgtgcatgcatcacgtagttctcatgccatgattttcagctccgtcagatcatttaaggtcttctctatgctgtttattctagttacccattcgtctaatcttttttcaaggtttttagcttctttgcaatgggtttgaacatcctcctttagctcagagaagtttattagcaatcgtcagaggccttcttctctcaactcgtcaaagtcattctccatccagctttgttccgttgctggtgagcagctgcgttcctttgcaggagaagacgtgctctgatttttagaattttcagcttttctcctctcgtttctccccatctttgtggttttatctacatttggtctttgatgatggtgacatacagatggtgttttggtgtggatgtcctttctgtttgttagttttccttctaatagtcagcaccctcagctgcaggtctgttggagtttgctggtggaccactccagaccctgtttgcctgggtatccccagcggaggctgcagaacagcaaatattgcagaacagcaaatgctgcctgatccttcctctggaagcttcatctcataggggcacccagctgtatgaggtgttagttggcccctactgggaggtgtctcccagttaggctacttggggctcagggacctacttgaggaggcagtctgtccattctcagatctcacactacatgctgggagaaccactcctctcttcaaaactgtcagacagggacgtttaagtctgcagaagtttctgctgccttttgttcagctatgccctacccccagaggtggagtctacagaggcaggcaggcctccttgagctgtggtgggctccacccagtttgagcttccaggcagctttgtttacctactcaagcctcagcaatggtggacgcccctcccccagccttgctgctgccttacagttccatctcagactgctgtgctagcaatgagagaggctctgtgggtgtgggaccctctgagccaagcatgggatataatctcctggtgtgccatttgccaagaccattggaaaaccacagtattatggtgggagtgtcctaattttccaggtactgtctgtcatggcttcccttggcttggaaagggaattccctgaccccttgggcttcccgggtgaggtgatgccccgccctgctttggctcatgctccttgggggctgcacccactgtccgacaagccccattgagatgaaccccatacctcagttggaaatgcagaaatcaccaatcttctgtgtcgctcatgctgggagttgtagactggagatcttcctatttggccatcttggaacttcccctgaaaagaaaagatttaaccagcatatttagctacacaaagaatgaatccacactttaaagccaaacaagtaatagaaataaacttgcattgatctttgagtcacccttggctcttctctttctcttatacaccatatcaaatctggattaatattttattgctgttgccacaaattactacaaaattagtagcttaaataacaacaaatttcttatcctactattctgtaggattgaagtctgacacgggtctcaccgaacttagatccataagtctagacagtatgctctaaggggcaacctatttccttgccctctttggtttctagagtctgctcactttcctgggaacatgcagcccttcctccattttcaaagtcagcagcaatgcatctttgtttggtagaaacttcttcctctgcctcattcttctgcctcatccacttctaaggacctttgtgattacattgagccctctagaattgtccagcatagtctctttattttaaggtatgctcatgtgtaaccttaattctatctgcaaccttaattcccatttgctatatacccaaacatattcatatgttctgttctgaggattagacaggaacatttgggaggcctttattctgctttccacacagcaaattgctaccaaaagcaaaaatttttactatttttttaaatacattactgtgccaccacttttcctaccacaactgctgtcactgtggttcaacatcatctcttgcctgaattattatatcaatcttataactggtgtcaacaaaaagagccaaactgtaaaatatttgaagagatttattctgagtcaaatatgagtgaccatagcctgtgacacagccctcaggaagtcctgagaacatgtgcccaaggtggtcagagtgcagcttggttttatacattttagggaagcatgagccatcaaatacatttaagaaatacattggtttggtccagaaagagaggacaatttgaagtgtggggaggtgcaggaggtgggattccaggctaaaggtaaatttaaacattttctggctgacaattggttgagtttgtctaaagatctgggttcaatagataggaatgtctgggttgcaaaagaggttgtagagaccaaagttttactatgcagataaagcttttagctaagaggcttaagaaagaataggttgtaaaatgtttcctatcagatttaaagtctgtattgatgttgagaagtataatgaggtatgtttgaacagcacttcccatcagggcctgaaacagactctcaggttaaattttaagagccctggctgaggaggaagtgcattcagatggttgggaggggggcttagaattttatttttggtttacagtggtcttattgctttatccttgcctctgtaagccataaataaaatctaagctttccaaccaactgaatggaccccctctgaaaaactaaattctggattttaacaggaagtgggggtcagacatgcctcattatgcctcctcctctttggagcttaggcacaaatgactagtattgacattaaaatagggatcctcagactgacaaaacagactctttgtagtaataagataccaaattgcaacgtcactctggtatggcatgacgtgacagatgttgcagactctgaaagaaatcaaaatattttactcccaaatatatttcgttgacatattttgaaatggtcctccaatgttgccatctgtaggggaaacttggaatctgtagaggatctctattagtgcagctaggtctttcccatatctagaagggatttagagtctgacaccttctaagatgctaaaaaaagacagcatctattctctctgaagcctgttacctggaagcttcatctacataacaagaaccttggcttccacaaccccccccttatcttaactcaagcatttctttctagtgatttcaagtctttagcttaactctttcaaccaattgccaatcagaaaatctttgaattggccaggcacagtggctcacacctgtaattccagcactttgggaggtcaagatgggaggatcacttgaactcatgagtttgagaccagcttgggcaacatagggagagcttatctctacagaaaatttaaaaaaatagaaatagccaggtgggttgatgtgcatctgtagtcccaagtactcaggaagctgaggtgggagaattgcttgtgccttagaagttgaggctacagtcagccatgactacaccactgcacttcagttttggtggcagagcaagaccctgtctcaaaaaaagaaaaaagaaaaagaaaatctttgaatctacctctgacttgtaagccccccactttgccatctttctgggctgaaatagtatacacttattttcatgcatgtccgtgtgaagagaccaccaaacaggctttgtgtgagcaacatggctgtttatttcacctgggtgcaggtgggctgagtccaaaaagagagtcagtgaagggagataaggttggggccgttttataggatttgggtaggtaaaggaaaattacagtcaaagggggtttgttctctggcgggtaggagtgggggtcgcaaggtgctcagtgggcaggagtgggggtcacaaggtgctcagtgggggtgctttttgagccaggatgagccaggaaaaggactttcacaaggtaatgtcatcagttaaggcaaggaccggccatttacacttttgtggtggaatgtcatcagttaaggtggggcaaggcatattcacttcttttgtgattcttcagttacttcaggccatctgggcgtatacgtgcaagtcacaggggatgtgatggcttggcttgggctcagaggcctgacatttatatgtgttgatttatgtcttgtctataacttctgtctccctaaaatgtataaaaccaaactataacctgactgcctcaggcacactttctcaggacctctttagactttactgtgggccatggtcactcatcttgacttagaataaacctcttaaaatatttcacagagtttggctttttcataacaccactgcagactattttccacatagcagcctggttaatcttttaaaatagcagtcataatttgtatcactttcaaaactcttctaatgcttcccaactcacttagaataaaatccacagttcttagagtgatccagtacaccctccaaaatcaagttatgtccctgtcctcatccatatcactctctttctactcaccctgcttcaaccacactgacctctttgtctcacacatccatgtaaagagaccaccaaactggctctgtgtgagaaacaaggctgtttatttcacctgggtgcaggcaggctgagtccaaaaagagagtcagcaaagggtggtgggattatcattagttcttataagttttggggtaggcagtggagttaggagcaatgttttgccagcaggggttagatctcatgaagtatattcttaagggtggggagaattacaaagaactttcttaagggttggggagattataaagaacattgatcagttagggtggggcagaaacacaatggtggaatgtcatcagttaaggctattttcacttcttttgtggatcttcagttgcttcaggccatctggatgtatacgtgcaggtcacaggggatatgatggcttagcttgggctcagaggcctgacactcttgatgctgtggcaataggccaagcttattcccatccagggtccttgcacttgttattccttccacctagaatctttttcttcagatgtctgtatgtttcactccttcagaattctaactaatgagatttttccctgaatatctctatctaaaatagcacccttgtactgtcccaaactccctgtgttattttgctttcttttttttttattctcagcactcatcactgtcacacacgtccatgtgaagagaccaccaaacagggtttgtgtgagtgataaagccttttaattacctgagtgcaggtgggctgggtccaaaaagagactcagcgaagggagataggggtggggccattttataggatttcggtgggtagtggaaaattatagtcaaagggggttgttctctggtggacaggggcagggggttacaaggtgctcagtgggagaggttctgagccaggagaaggaatttcacaaggttaacctttcagttaaggtggggcaggaacaaatcaaaatggtggaatgtcatcagttaaggcaggaactggccattttcacttattttgtgattcttcacttgcttcaggccatcaggatatatatgtgcaggtcacaggggatatgatggcttagcttaggctcagaggcctgacattcctgccttcttatattaataagaaaaataacataaaatagtgttgaagtgttggggcagcgaaaatttttgggaggtggtatggagagataatgggcgatgtttctcagggatgcttcgagtgggattaggggcgaagtgggaacctagagtgggacagactaagctggaggaagattttgtggtaaggggtaatattatggggttgttcgtgtagcaggacgagccgcagacaaaagctctcagacaccgagttgtagaaggaagggctttattcagctgggagcattggcaagctactgtcttaaaatccgagctccctgagtgagcaattcctgtcctttttaagggctcacaactctaaggatttcacacgaaagggtcatgattgatttgagcaagcagggggtacatgacaggggctgcatgcaccagtggtcagagtggaacagaacagagaagggagtttcacaatgttcttttatacaatgtctggaatctatggataacaatggtttctaagtcatgagttgattttgaactactaggtttaggccaggcaggccaggcctggttttgggcctggcaccaggctgcctgtctttgatttcacttctttgtttttttcttaaaacaggtattgagtataaaacaatataaaacagtatgagaaggtctctttcttccctcatttcccccctttgagactctcactttttattagtgggagttctcactcttattttcactatatgtgtcttcttgtgcaatagattgatagtgatttatatagtacacttgtgctgaagcattctggtgaactaaggtaatgatgaggctttgtatcatttgaagaagtacaggtagcaaacaagggagcagtaagcaggttcttattactattataacttctattataagagttttaaatcctcctagtgctgggaactaatttttaaacatggcttcagggtcgaattcatgctacacttgtacgggcacatgtgtcagttttgtcatatttttaactatgtctttaactacttgccttgcttatctatatgtagacagtaactagtaaggttaaatttcttatagacctctctttcagctgctagtaagtagtcaaaagccaatctattttgatagatggcatttcttatctgagtttcttgctgggccaaaatagtcaaggcttgaccggttttattagtgattatttctaaaacagcttgcaaccatatgattcggttgagcatgtaaatgggggtatggtaaccctatgagctgtcttgtgtctaagtggcaggcctatagtattgtataatttttttttttaggaggtcatttatcatctttctaattacctatggctatgcttcattttccgtgggaagcatagacagggaagcctaggagtttgcctgtttttatgggcagtaggaagaaagatggtttaatggtgccaattacacagctacttatccactgatcaggcagcttagcataggctctatgtccacatatctagtataatctggtgggggcagtctagtcctggtggaactctgggtgggcctagacaggctgcaaccttggaaatttagtgaatggatctctttctgtgtaattggaactccaccacataactgttatttttttgggggggtactattatacagtttttgtcctaggcaactaagtcatcttacagaatcagtgaattattttctttttctagctatgcagtcttgtctaataattgagacttttagaacctagaaatgatcagggtgattcttttgtgccaggaattcatcaggaactgggtctgcaggcactaattctcaggcttcttatggccattgatctcttattgcagtttttctacaaacataacatgaagtgacatttaaagactgggctacgtgcttggctaactgcacaaacaaatttctggtttttcctggagtctcaggtactagcacatttaattcatcatagaaagtctgaaatactggttctggagagcgtctttgaacctcatcttttactaagatatttactctaggacctagtcctttcctattgatgcccagagatatgtgttctttttttctaccttgggtttaagggatttgtaattattaattttaaggggttgcagcttccactcatacaggaggggctgccttctcctttttggagctaaacaggatctttttcatctttttttaaagtagtctagatgacacaagaccagtaattacacacacttgtgcatgagcatcttattctatgccaattgctattgatagtggcacaagcattaaattttagggttatatgcttggagacccctctttcttctgtcctagctattacttcacttgtgtcacctagaaaaggaccagtccttaattttattttaaaaattgtgattatgggaggcttaaaattggtcataatacgcatcaggttggttatttcctgggctacatactttggatagaatagcattatacaaacaagtttcttttagagtcctggtacacttataataactataaaataataggactgtagcaatctttttgtcctaccttagtgacttgatgtatatactgggaacagttctcagtctgaggaaggtcagttgaagtccttactgtagaagtccaaattttaaggaaaatgagtctcggaatgagtttcctcatgctttggccatgcgtggcccagtcagcttccgggtgtgactggagcagggcttgtcaacttcttcagagtcactttgcaggggttggcaaagctactcctctccacgtacagctcctagtctactgatgtttaaggatggtctcggaggttgggcccactagaataaactgagtccaatacttctacacagttatgtttgactgggctcactgataccaggagcaaggtggcagggtttagggtgttgcaaacttcaatggttatgcggggattttcaaagagcaaggtttggtatctagttagtctagcattcattagctaattgtgtcctttggtatttattaaaatcaccaccgcatggggggactttatgtttaggttttgcctatgagttagcttatctgcttcttgtgctaatagggccattgctgccagggcccttggacatgggggccagccttggaaaccccatctagttgttttgagagataggccactggccttggccagggccctacagtctgggttaaaactccaactgctattttttttttttttttgacacatagagtgtaaaaagttttgtcaggtcaggtagccccaggtctggagacgacctgagttgtttttttttttaactcatgaaaagcttgttgctgttggttgtaatacatgtagtattacagtattacaataaaaatttatatttttattgactgtaatctactaaaatattgacttaaatcctgtaactatttgatttcaagctttaaattgatctggtattccttgcggggctccaattgcatctaaatagatgcgagagttgaaaaacttataaggggcttctcttgcttctcgatgtcttatttttttatttttcctcttgttgatgaaatgccagggtgaaagggatagccaattggaccaaagtacaagtgccactctagttatttggcagagtgcctagtaaaggtccatcacaataccaccacacatccactcagggatgaacaagagatgactgattgataagctcttgaaaattcttaagctcactgcatcccttcaggtctccaaggaatgctaagtctcctccctgccatgagagacatgaagtgaacttagtgttgggagacagaagctggatggccctcgggggctgactcgaagggacttcgggatatagcagagagagcttggcatgacttattactccagactgtagaatcctggaaaagagctaccatgccacccacgcctggtcgactggaggaccaccttagtggaagggggacaatcagggcctctggcctgccatgtgcacaagcataacaattgcttttttttaacatgcagatggaatatttgatccatttcaaccaggcatttgtatcttggtatgctctcttaattgccaaagtttgttttaagtctttaacttctatgatcctctagtagaatgaatgtttcctttagcacctatttttattagtttttagaccaaagaaagctaaacaccattttatatttaataatgcttcttgtatgatttttataccagataagttaaattttacctttatattagtgtgttattgatgttaaacttaattttaataaaatcttgtagacatatttatccaacttttcatgtttcaccataaggtaagattttatagactctttttaactttttataatttttgttaaagagcaggttggtgctttaagaaaaacttgttgcatttttactttaatgtccagttcacagaaaaactggatggtacatttttaactttagctaatatgtttaaacacatatttttttttttttacaattaatgttttaaaacttgcttaaacttttaaaacaataatttttttaactttttaatgtaggtaaaaatctacattcttatgcctccttatgatcttttaaccaaaggtatattttactttttttagacaccttgcacataaactatttcttcaatagtactcaggaggccttattacttttaaattatacaacattttttgcataaatttgtcttttataacatttgttctttcatgacttttgtagacaatttttcgacatgtcttaactttctgacttattaaaaacatttttttttttctttaaacaaccagttaatttctttcaggacaagaatttaccatataacactctttttatataaattctgcctccccctttttttttttccttttttttttttttctgaagataaccatttttttttaaagtgaacttcctttatgtctgtggactagactatctaaggccacaagattaggagttactataatacatgtgacactgttaacttttagcaaacttcacttttgttgaaaaccttgtaagtttgggatttcaattatcctttgctattaataagagcttgtttagtctaaattaacttagaataggtatagatggcctctttttctctctgcttgtctttctttgcctcttccagccgcttatgctgctgttctcttaactactgtgggggggaagggggtctaaaaccagctgtaactgtgtatgtatggaaactggtctgggtgctttggcttacaggttaccttgtgccataccttttaaacaaggaaactgtctaggcttccttctgatggccaacccacctctaatgctggccagtctatttcacacaaagttttaagttttcctggtgccatagtaacactgtaatatcccttaaatcctttcttgaaatttttcaacatagtggcttgggcttactttgatcctgatccatgcttctttgagacaaaacaccatgatcacaccacaagcacaccacaaaacaaagaacaagtaaaaaagggcacccacacacttttgcagtttacaccaaaccaaaatcaaaaccaaaatcagagtatccagaaatccaagccaggtcaaaaactgaaaccaaagtatcaagcaatctaagtcaagtcaaaaacaaaaaccaaagtgccagtacaggcacaccgttggtgatcaggccacgcttccactcaaatggagtgggcaagttcccaagaccagtcctgtcaagcaattcaaaccaagtcaaaaccaaaaccaaaaccaaagtgctgataaaggcatgctgtgggtgatcagaccacgcttccactcaaacagagtgggcaagttccaaagactagtcttaccaagtttcagatgtccagactccaagtgccagttccttcccggtgttcagccactgtgttaatcctccatgggggcctgctactcgctgctctggtgaggcgttccactgggacaattgcctacctgggagcgctacttggattgcatcactcaggctggctggagtcccctgcagggatgctccacaggacaggcctaagctgcctaaggggctgccttggccgtccgtcagtcaccttgcttcccggtcagggaaccaagaaatgtagcaggacgagccacagacaaaacctctcggacaccgagttgtagaaggaagggctttattcagctgggagcatcggcaagctactgtcttaaaatccgagctccccaagtgagcaattcctatcccttttaagggacacacaactttttaagggctcacaactctaagggtttcacagaaagggtcgtgattgatttgagcaagcagggggtacgtgacgggctgcatgtaccagtggtcagagtggaacagaacagaccagggagtaatttcacagtgttcttttatacaatgtctggaatctatggataacattagtttctaagtcatgagttgatttttagctactaggtttaggccaggcaggcccaggcctggttttgggcctggcgcctggctgcctgtctttgatttcacttctttgtttttttcttaaaacaggtactgcatataaaacaatataaaacaatatgagagggtctctctcttccctcattagaaggagcatttgtcatatagaatgattggtgatggcctgtatatggttttggatgaattgagaaactaaatggaagacacaaggtctgaataagagaaggagaaaaacaggtattaaaagacaaagaaatgggagcacccaggacatccaattagagaatgaccaagggggtgcagcgtaattactttcttgttggtgagttttttggactctatcaaactttatcagtccttcagacccaagttgattctctagctgcagttgtcctccaaaactgcagaggccttgacttactcattgctgaaaaaggaggactctgtatatttttaaatgaagagttttgtttttacctacatcaatctggcctggtgtatgacaacataaaaaaactcaaggatagagccccaaaacttgccaaccaagcaagtaattatgctgaacccccatggtcactctctaattggatattctggtgttactgggggtccttgctcccagaactcccaagatgatggctagcacttacaaaatggcggcaagcctcgtgttctgtgacctggggttcttggcctcacaggttccaaggaatggaatcttgggccatgcggtgagtgttatagctctattagaagccatgggtcacggaagagaaccgtggaacccagtgactagtgttcagctcgattaggacgaacccaggcacttagctgtgcaggaacaatggcaagcctttagaccgatcgggagcggcaatgggtgcctcgctggatcaggagcacagcagacaccctgctggattgggagggatggaagtcagtggcgggtctgcgatagcagcaaacagcagtggtagacggcgagcaaaagctcagcttgagctgtaacaaacatggaccaaaagagagtgcagttgcaagatttaatagagtgaagacagagctcccatacaaagggaggggacccaaagagcgtagccattgccacctcgaatgcctgggtttgtatcctgatcattgtccctcccgctgtgctctcaggcaatagatgattggctatttccttacctcctgtttttgcctaattagcattttagtgaactctctttgctatctgattggtcgggtgtgagctaagttgcaagtcctgtgtttaaaggtggaagtggtcaccttcccagctaggcttagggattcttagtcggcttaggaaatccagctagtcctgtctctcactgggtcctcccaattctttgtcctttaatacctgtttttctccttctcttattcagaccttgtgtcttccatttagtttctcaattcatccaaaaccgtatccaggccatcaccaatcattctatacacaaatgctctttctaacaaccccacaatatcaccccttaccacaaaatcttccttcagcttaatgtctcccactctaggttcccacgccacccctaatcctgctcgaagcagccctgagaaacatcatgatctctccatacctccccacaaaaatttctgctgccccaacacttcaacactattttatgttatttttcttattcatataagaagacaggaatgtcaggcctctgagcccaggcctgcatgtatatatccagatgacctgaagtaactgaagaatcacaaaagaagtgataatgtgataatggccagttcctgctttaactgatgacattaccttgtgaaattccttctcctggctcagaacctcccccactgagcaccttgtgacccccacccctgcccggaagagaacaaccccctttgactgtaattttccactacccacagaaatcctataaaaaggccccacccctatctcccttggactcagcccacctgcacccaggtgattaaaaagctttattgctcacacaaagcctgtttggtggtctcttcacacagacgcgcgtgacattcaccacctgatatatagcattttatgtgtttccttacaacagaacataagctctgtgaggacagataattttgttcattgctatatcctcagcatcctgaagagaacctggcacaaagtgtatgttcaataaaaatttgttgaataaatgaagttatggcaatgaagaaattcattatatggaaactttcctctgtggttcttcttgaaaaattttaaacaagttctgactaccagctttcaaataggtattggctcttatatatatatatatatttttaatcaatcccttaatattttgtccactcactaaggtagagtctaacatcttgctttttatctaggtccctatataccacagttcacattcttctttagttgatggaaaaaatgtccagtagataaatctgaatttgtgtgcagacatgttttattgtatttgcattacactctggtataattaatcctaacctgaatcactggagtaaattagtttgttattatgattataaatgaattttatttgtttttcttcgatataagatcattttggatgatctagccaattccttcctatcagatgaatttagaaataaataatctaggaaaattgtcccacaatttaaaaaaaaaacagatctgaaacaagacttatgatcaacattccagtttgttctctaacacatttagtgtgctaaacattctgggaacctattaataatctataagggagttatacatattttatactaaagtatgtctgaaaaggctatacctttataggtaataagctccttacaaaaacactttcatgaattttttatatttatttggaaaaacaaaaatcttctctcactttagaaggtcagatatgacacccaactattaataaaatagcgtttggtcttggattcagtagttgggtagcttccaatcaatgtcgaaagatagttatctgttataatttaatcaagcaagacattgatatataaagtatagtacagcctcttattcttcacagataaattaaatgagtaaaggaataaaatgcttacaaaaagaatctctacctgaagaatgacgatattagataatagaaagactattaaactcaatgtgtattttgataacctttttggatgagtggggtcaaccagcttattcacatttctttaaaccttagtttattcatctgtaaacaatgtgattggactagctatctctaaagttctttccacctccagaatttctcatttctcaatttggcttattgttattatttccacaagatatattttctttacaccttgtatttccagacatccctacaaaaatgtaaagatgaaaaacaatgaatgctaataaacgcaatgctgataaaatcttaagacatcttaagaaataattattttcctaaaacttaatcaaattattcaaaaatggaaagaataatgcataatttaaagtaaagttggcatgtgtaatggaaaaataataatccatgttttactgtttatcttttgatatgaaatatctgaaggctgcttactgtgatagggaaaagttttgttgacttagtttagtttgttggaaatgattttgaagttaatatctgtatatattctgtctgtaagtggaaggatttggaggagccctgttaagaaggcagtgacatataaaaatctctttacagcaacaacaaaactcacttcaagagaaggaaaaactttccttatttttctttttgtatctgctcactgccttaaaaccactgcttcattgttgaaactttatcagattaattaacattttgagattttgtgattaccattacatgttttcaacattaactcagcctgtatgtcaacatgagctagttctaagtcttgtgactaagttaaacttaactacagataaagttataatatcttgtgaaatggtagttttaaaggtgtcatcctaaccttttatatatcattttattttaacaaaaattgtataggaacccttctggatttctgagtagttctatgagttttgactcagtgtatgagtttcagttattcacacatattctttctctttctatcagcattctagaggtgctttgaatagattacctgctgcttctcatttcctcattctattgtgatagtacagagagctacatacatacatacatcgaagcacatagaatttttttctgagaaaatgtgaagccaattacaaaatacattgaatttctgcattaagagcctattcctgaatcatagtgacatgagcaattagaaaaaattgcctgaaaatgaagtactcttgagaatataccttagagctcctggctgttaataatttcttaagtagatgtggacaaacagtgaaagattgtgacatccttatgaggaacagtttgtccattacaatattttatgctatcaaactctttggtaatttccatggcagagtaaatgttacacaaaaagctctccagaattcttaagaataataaatgaatttctgtaatacactttctttttttttttttttttttgagacggagtttcactcttgttgcccagcctgcagtgcaatggcgagatctcagctcactgccacctacacctccgaagttcaagcgattctcctgcctcagcctcccgagtagctgggactacaggcatgtgtcaccaggcgcagctaattgttgtatttttattagagatgggatttctccatgttggccatgctggtctggaactcctgacctcaagcgatccacccgcctcggcctcccaaagtgctgggattacaggcatgagccactgggcgtgtcctgtaatacagttttaggtaacagggacagccaagtttataagcttcacaatcagataatgcaggttcctattcattttagcaattagaatagtgtctacaaactaagttcagtagcatgaacttgagagttagtctggattcaaatcctagccctacctcattttagctggtgaaacttcttaagcttcttcatgcaaatataacatcaatagctctcagttccattgctgtattcttgaactccatgagagaaaacacaaacccccagcaatatttttacaatttaatttttcctggtagtcttgcctttacatgcagaagctgcctctcaagctatttcctcagtgacccttccctgtccacctacataaaagagatcctccttgagcccttcaccctaaggcatttatgttgtcctctttcttttcactctgagtttctgtcacaaatatctctaacagttgacactgcgtattgtgcttcaagggttagaggacaagaaaactgcaccactcaacttgaaaccatcaaactcctcttaataagtactttatgagtacctattgttaagattaaatgaggtaatggtcttggaaacagctgacatgtagttaaggtctttataaaggctaactattattatgagacaagtttattgcattggctgaacttaataagagtacaaagagaaaatagctctattttatttttccaaatatggtcttttaagaggttaggtcattctcctgtgctcaccccagtataatgagtcaggaaaatgtcaccttttttccaagtgtgttggggatgtgagaacagatttaaaaaaatcgagtcaagtataaaatcatcacttcaatctgttgtacaatttaaagcctgagcccaaaccctgcaggtcaacagcaggtaaagttctgctttactgttttccttactccactttctttgcacgaattttgctccttctggctcctaggatgctgatgggtcaagatccattcaaagtttatactgaatttaattgattatgaacatattgtgaaattaagttgattagcataaatttacataacactttatattttatcttttacaataaagatatgcattaattggtgaaattttaattctgtccctcagcaacatttcacaaagagacagaaggagagaaagagaggagagagagtgagagagtgtgtgtgtgtgtaccggattgccatgtaaagcgtattttatgccataggttatgatgtaagagatttcagtaatttaaagaccattggattattggtgctggatattaataccttctgtctttggaacatagggctttgtctctcctgggatgtctttcgtctcttcagagacctctcacagaacatactacattgtgttctctggatgaggtgctctcctgttgaccacttattatttccttgctactgtctccaatggtacatccctggcctcttcatcctaacaggcagccctttctaacagcctcctttccagctgaactgggctcatgggacacactcactcttgcccaggcagcagtggaatgcaggctgccttcactgcaaccttgttcattcaactttctacctttagatttctgtagatgaaagtctgggtctagtctctggctcccaaactccaggagactcaagttagaggaattctctcatactctattctagcgctaggagggcttatatggttaatagactcattaattgtcttaccagagaaagaaattgtaatctcttttgcttattgtcaaacaccatcactatgaaggttgtcatgggtctcctaacttggcacatgagctgaggaagcgagagaagagagggaaaggacatagctcactttaaaattattaattatcttcaaaggatacttgatgttatttctactcaatattttggaaacacttgtatagattgaaggtagaatttgttaggagtcataggttacctctgtgtagtttctgtggagatatgtcttaaactctgcaatcattatcagtaagttattgattactaactgctctcaattttggggcctttgtaaatctccaagacaataggaaatgtaccatttactgtcttgttgaactttattattcttctgcattacctccttttccttgaagctcttttcagggacttttatactgtgctgatggccaggagattctgagtgagcactcaggggattctgaatattaaatatatatatataatatatatgtgtgtgtgtgtgtgtgtttattttaatatatatattcccctgtttcccttaaagttgtgggaaaatactgccatagtctgagacttttgattggtccaaatgtgggtacctaatttaagctggatcaacgagtctcttttcgagtattttttgaagaacgtggatttagaaaatgtgcttctaaatcatcgtgtctctctagtaaatgagtaagattttctaaattaggggtggctagttattattataatgcagtgaccccaccatggtgccctgatgaccttgcacatgcctgcccaggccacacagacaaatgcttgtgccaagactcagaatagcaactccagcaattctgagtcttggcagaatgccttccaagtctcccagaacaggatgcgaggcctataaggagctactacgaaaccgtcacccccttgcttccccatctttactaggagtctgtcatgagacagtttctcatccacactttgctgctgatgccttgcccttttctcctcccctaggaatagagctgcagattgtaaaaacacttaactgctgtctagaattggctcttcatcaacagggtatctcacaactcacactgtagtcatctggtcccctcatgcttcagtgtcttgctttttggtgagtgctacaaaaccctggggagctggcacctttgacttaacttttcctttcactgtcaatgtaagtcataaactgtgtgaatttaaaagtggcttgctgtaactttacctgtcgaatcagtcaggctttggccttggccttgatttgccttgcacatgcttgcaagttatatgtcctgtccactggcggtggggaaggggctgtttgatcaatcttcaataaaagagaataaaatagagacaagaaaagagagtctaaaagtgttctggttgctgcccctccaaccttgctatatcttaattatttaagcctttcctaattctgcatattattagtttacgttgtatttctgtttctggaagtcaaataagtcttgactcatctacatgaaattcccctacatttctccaaccctggtatcctggtgtcagcagttactaaattgatttaaatgagtcaaattgttctgtgactccattaccccaattcctactacagaacacatgctcttttaatcaatgagtgctcattattttcctgttcacatctatttctggggaattgttgtggacagtgatggaccaattacttatctaggtctgttctcagatgctactttcaggaggatttggagtccttgattccaacccagaacaaattaatcaattcatatcggtaaacggtgaattgacaaatacaaattaaaaaaagataattatctctgtcgaaaatatgtagacattttcctcccttctattttcttaaagcatttactttagaaaacttttaagttctttcttcttttggtttaaacataaataaatccttttaatagctaaataagtctcttgccacttttaaaactcaggaatgtctttcttaagtacttgggaccatttctttgaaatgtaaacatcaagtgagatagtgccaacatctcccagtgtctgtggaaggataggagcctaacttccaggagctctttgctccaacatccaaaattaccttctgtcataaagataggagaaatttgttttttctttgtataaagtcaattaattaacacatatagtatcttaattaccaggtgaatttagggtgaattatgtgtattaaaaacatggcattgtctagtcctcttatttaaagactagttattgtttatcttgaagacatatatataatgggctgtatctacctgcctagataaaaaggtaagatttttttctgtctttgcagtctcttggtggattgcctgtgatactcatcacattctgatttaatgtttctttcagtagcaaatttcttttttctttactacttttgtggtaatcttttctgtgttaggagaagactttgtttttatctatatttcttcagtaatgagtctgagcaattacgttttaaaaacgtcacagatatctttttaggcacacctagctaatgctttgtgtcttgtataggagtggatgaggctgcctacctcccagcaacaattgatctaaattccacttgtcaagcatgagtacagtccttctcacaaagcagaacggatggtcttttgtactagataagatacgaaggacaatattaagaaaggataaggaaaaataacttataaatatgctcactatgtaaccagctccaaatctcaggaggcagcatagtacaagaaaggcatgaacttcagccagccagtctgagcagggttctctttctagcttctctacctactgtgtctgaccatgggcctgtcacttaaccacacacagcctcagtttcttcacttagaaaatcagctttccctatgtatacactctgtactttactgtacctatctcactggtgtactctgatgatgagataatctgaagtgtttcattcagaacctggtgaatagttagtgctcaacattaaattgttataatttccagcgtgccaacaagtttcttgcttctttctaatttcacaatcagaacttcaatattgttttttgtctcaaaggccattcaatcactaagcaccattcttaagttgcaaatatccctggagtaaggtaaccttttgaactaattttagcaccttgtaagtaatagtttcaaatgcactcgctatctaaaagtgaaatgtcttgagcgaaaaaggagaagggatgggattgatgacttggttggtgttacaacggtggagattggaagagatctaaaggaggatgtgaactggagatgtgaggtccatccttataatggaaccaagccagatagtataaaacccccaaagaatcggctctttgacaacacgaatgaagatgatatactcctctaggcattttgaatgcatctggtcatttaatactcacaacatccctgtagtgtacagagtagtgcccctgttagagatgagaaaactcaatatatttagggcaactagtgcagctacaacccaagtacccccaaatctcagtagcctaacacattaattataataatgtatttctcactttctgtaagtcagaagtaggacaagagtctctccttggcaaatttctcgcaagctgggaccctgggatccaggaaccagtcatagtgttactggaaaagggtcccaatccagaccccaagagagagctgtttggacttcgtgcaagaaataattcaaggtgagtccatagagtaaagtgacagaaagtttattaagaaagcaaaggactaaaagaatggctactgtataggcagagcagcccagagggctgctggttggctattttttggttatttcttgattatatgctaaacaaggggtggattattcatgaattttctgggaaaggggtgggcaattcccagaactgagggttcctcccctttttagaccatatatggtaacttccagacattgccatggcatctgtaaactgtcacggcactggtgggggtgtcttttagcacataatgcattgtaattactctataatgagcagtgagatgaccagaggtcactttcttcgccatctcggttttggtgggttttggtcactggcttctttactgcatccttttatcagcaaggtctttttgacctttaccttgcgcccacctcctatctcattctgtgacttagaatgcctaacctcctgggaatgcagcccagtaggtcacagacttattttacccagccgctattcaagatggagttgtcctggttcaaacacctctgacaattgtgagagtcagcagtttcaggattcactttcagtcacacacagcctggaaaaaggaagggagctgaattgccccgaagattttagagactgggttgggaaaagatatacaatatccgctcatgcttcatgggcattttaaccctaacctaactgcaaaggagattgggaattgaaatcttcttgtgtacccctgatgaggaaacaagatctgtgaggctataacctgtttttaccaccctaggaaagttagggtgtcagtctggaacctctaataagggcaataaaagtgttgtaatattcatgaaatcagtacctcatacagaatcatgtaggaaaccctcaagcggggggaaaaaaaccccaaaaatatttgtgttgctgaaaagaacagtaacgtttttcttagaaaatctgcagattgttagatttactatttctaagatttgttcatgttctaagcataggtgaagtccaagaaagcaatgagctatgttctgagtgagtaatcttgccagtagcaaataattccctttatttagagcaataatgttctctatgttgctgtagatgctactctgcaattttgttagtcttctgtaaacataaatcctgagtacattatgggagcatgagagaggcaggattaagtaacagactgggtggatgtgtctcttagcctggagagaaagaagagatgtacaccagctgcagacctcccaagggaaacagagaaagattggatttcttcacctagtattctagtgtaaataagactgagcccatacttccccagtaattaaacatttgctttcattctgaaaatcaaaggtacctctgagaacatctaagacaaattcttaatgactgtcatttgtgagctttgggaaatagcatatcacacttggggatatggcctcgaaatagctggtggggaaactcctatctcatcttattctgagtcactggtgctaattttgcagtgagatcaatttctggaaagcttactatggaagtcaggaacagataactgttgcataattactgagattagagcatattcattttcctcattgcgtgattttaatttagtccatcttaccacaaatgagaaacgttgtcaaagagtagtttgtcatttcaaaattaagggcctggtgttttgattgaggggcatagatgaatggaatggggggccttgatcacagtggggtgttcctacaagaatttcaaataagatgttaattgttttaatattttacttttctcttatttcaagataatgcaggttcatctgaaaaatttaacataaaattaatataagcattattcataaatctatctcacagataactactaaaagcattagttgtctattctcacaattatttttgcttctgtatgtccctctttctctacagaaatgcaccacactatatatactttgacttctgaaaggaaaattcacctaatagtttattttggacattttccttcaataaatcttctgtgatctctttaatgactgcatgaaatttcatagataataatattatttcccctgcctgaaatattctttgccctggtttttgtgggactatctcattttatattattcacatctcagaaaatgtcaacatgctgaaaccctgactattgaatccaaaggagccagctagtcatcctctatcatatcactctttaaattttctgtacaccctttcatcattgtctggtatctcctttcatttatttttctcttctttttatatccttccttctctatttcattgtttccttctttatttttttattgtcacttttcttaactcaactataagatttttttcttcttaccagaacagcttactgtaattatcagaccataacgtttatttgttactcgagttttctgcttcctctttggtttttggtgtctggagatgtccctcaccttctcacaagtttaattgtgtattttaaaggtattaaggatacattatgtgtatcaaaacatcactgtgtaccccataaatatgtgcattattgcttgcccattaaaaaataaaataaaaaatatcagttaattataaacaaaatttttagatactttatagcaataaggatttttttggggggataattattctattttggagagtgtgctttataagactctgttccatttttacattgtcacctgatgtagagttaattgtccatgtttttctccagatgtgttttaaaaattaagtaaatgttaagaaaatacacatgcacttcagaaattggtggtaggttgtctagaatctactgaaagagattcaatttctctctgggtcattgaataaaatttatttcatataggtaagacatgggctccttttcaaaacctcaatatttaatatttctttataacattattgaagaataacaaattcttagatgagcaaacaattggggaataaggtaataaaaatgtattagaaaatttggagagggccaagatggctgactagaagcagctagtgtgtgccactctcatggacagaagaaaaagtggcgaataaatactggctcttcaacgggtacatctaggtggacaaattgggattgttcaaggaaacaatttaacccatggagaacagaggaatgagacaggatgattgcttacctgggaatggcacagagaccggggaggcctgtccactattggaaaatggtgagtgagtgagagtttttagggacccacacttctgccatgcgactttgcaaccctggactcaggagatcccctgtgagtcccccaggtggggcttccagactgacccagagagctatgtgaattctgggtagagacactgctcctgcatctgtggaattctgagatccttgcatccctgggcatcatggaattagcagctacagatccagcagtaggggaggtcaggctccctctcatgtctctaggaaaggggtcaaatctatggggctaagcagcaatgaactgcaagcctcatgctcactgcaccttacaggataaggaccactgacctgggatcctagtgtgaccacatcagccccacctggactctcaagctggtagcagctctgcacttccctgggacagagctcttatggggagagtcaggctgcctcttttgctgccctgcagcccttgccacttgctgtcctcaggctctggagggtgagtagtgattagggactggcatggattcccagcacagtgcagctgccccaaggaaacacagccagactgtttcccacgcaggtccccattcctgcttctgctcactggctggggcctcttgacctgggacctcaggacaactaccttgcccctgctggaacacttcagtcagagatggctccacatttctctgaggaggaaatcccagagacaacccatagcccctccaccattgcagctgcatgatggtcccaccctaaccaccctcaggctggggaaggagcaaggggcctggttgctacactggcacttccagcataccacagccaccatacagagaggagtgcagtctcttccctgtgagattctattcctcattctaccaggcagggatcctggctcaggactgcagaacacctgccccactcttggcttaacatacccactggtagttgctttgtgtttccctgagtaaaggctaccagaggcaagcaacagcccctctgccactgccacagcagcagttctgaccatgctgccattcatcgggggacaaaacaaaaagcctgggggcttcattcacatttctaggacttgacaatcaccatacagaagagttcagtctctcctccctgtgagttctcaatctcctgatccttaacaagtgaagccccaggtcaggccagaggcacagccacccaacccatggctgaacattctcgttaccagtggctccatgtttctctgagttggagctgcagagttaaccaaaagcccttctgccatggccactgcactggtactgcccatgctgcccttggactggggaaggagcaaagaccctgagtgctttaaaaaccatactgccagcaagctgcagtggcccaaaggagaaggaaccactctatctcaaacatgacatccctgaagccctgcttatcaccaggcaggcctcccgttccctggcttgggcccacagtacatctgcttcctcctaggctgatcacagtgattgataacagctctgcatcttgctggggtggagacacaagagacaaataaaaggccctctaccacaaccactgccaaggagtcttcttcctctgcctccaagctggtggggaacataaagcctgagctcatcccagagctgcaatgtgtagcctgggagtgccaagccaggatctgcagccagcagtgaagtgggagaggagcctacactttcagcacattgagagggagcatggttgcaatgatgagaaatacagaggagccaagtggctaagcaagagcctatatactgggcagtatgcttatgtaccatctactggatcacagcccaaacttcaacacccaaaatacttgaataatatacccccccgtgaaaccaaggacaaggattcagctacaaataaagactctgcactaagccctggccctctgaaaaacatccagaaaggaagtctactcactgcattcaaatgacaaagcagttaaaggaacatcagcctacagagatgagaaagagccagtgcaagaactctggaaacttaaaaggcctgcctgtcttttttcttccaaatgatcatcctagttccccagcaagcattcttaatcacactgaaatgtttgaaatgacagaaatgtgattcagaatatggataagaataaagaccatcgagattcaggagaaagccaaaacccagtgtaaggaatctaagagattacaatgaaatgatagaggagctaatagacaaaatggccattataaggaaaaaaacaaaatgatctgatagagctgaaaaacactaaaagaattttctaatgcaatcacaagtattaacaccagaatagaccaaggtgagaaaagaatctcagagctcgaactgagctctctgaactgactcagtcaaataaaaagaaagaaaaaagcataaagaagaatgagaaaaaactttaagaaatatgggattctgtaaagagaccaaatttataactcactggcaaccctgaaagagaaagggagaaagcaagtaacttggaaaacgtatttcaggatattgtcaaggaaaagttctcaaacctcactagagaggccaacattcaaattcaggaaatgcagagaacccctgtgaggtactacacaagatctgtttcttggccacctccaatataggcccccaatctcttctagcttgtagagtttctgctgaaaggtttgttgttagcctgacttggttccctttgtagatgatcgggggcctatattcagtattcttaaagacagaaatttccaatcaagaatttcatatccagccaaactaggcttcataagtgaaagagaaataagatctttttcagacatgcaaatactgagggaattcattaccaccagaactatctcctgaaaaagcactaaatatgaaaaggaaatactgttaccaatcactacaaaaatgcacttaaatacacagaccattgacactacaaaataaccacacaaacaagtctgtataataatcagctaacaagacaatgacagaatcaaatcctcacatatcaatattaaccttgaacgtaaatgggttaaatgcctcaagtaaaaggcagagcgtggcaagcttggtaaagaatcaagacccaatggtatgctctcttcaagagactcatctcgcatgcagtgacacccataggctcaaaataaagagatagagaaagatctacggagtaaatgtaaaactgaaaaaagcagggattataaccctaatttcagacacaacagagtttaaaccaacaaaaatccaaaaagacaaagaagggcatcacgtaatggtaaacggttcaattcaacaagaaaagctaactatcttaaatatatacgcacccaacagaggagcacccagatatataaagaaagctcttagagacctataaagaaacttagatttcaacactataataatgggagacttcaatacctgagtgacaatattagagagatcattgagatggaaaattaacaaagatgttcaagacctgaactcaacaccagactaaataagcctaacagacatctacagagctctccaccccaaaataacagaatatacattcttctcatcatcacatggcacatactctaaaagtggccacacaatcagacataaaacaatcctcagcaatttaaaacaagataaaacaaaacactgaaaccatactaagcacactttcagaccacactgcaataaaaacacaaattaatattaagaaaatcactcaaagtcatacaatttcatggaaattaaacaacttccttctgaataactttcaggtagataatgaaataaaagcagaaatcaagaaaacatttgaaactaatgagaacaaagatacaacttaccagaatctctgggacacagataaggcgatgttaagagggaagattatagcactgaatgcccacatgaaaaaagttaggaagatctcaaattaacaatattacattacgcctagaggaactacagaaacaagtgcaagccaatccaaagctagcggaagacaagaaataaccaaaatcaaagccaaactgaaggaaactgagatgagaaaaaccaaacaaaagataaaaaattccaggagtttgttctttgaaaaagttaacaacatggactgttaactagaataatatgaaagaaagagaaaagattcaaataaacataatcagaactgacaaaggggacattactactgaccccacagaaatacgaagaaataatcagtgactactatggacatatatctgcacacaaactagaaaacctagaagaaatgaataaattcctggatacatactacctccctagactgaaccagaaaccaggaagaaactgaatctctgaacagaccaacaatgaattccaaaattgaacaagttttacaacacctaccaatcaaaaaagtccaggaccagacagattcacagtcaaattctgccagatgtatgaagaagaggaggtaatattgctactgaaactttttattgcgaacttttttattctaaaaaattgaggaggaactcttttctaactcattctatgaggccagcattatcctgtgagagacacaacaaaaaaataaaacttcaggccaatatccttgatgaacatagacgcaaaaattctcaacaaaatactagcaaaccaaataaatacacacatcaaaaatctaattcaccaagatcaagtaggctttatccctgggatgcaaggttagttcaacatatgcaaatcaatgaaagtgattcatcacataaagacagctaaaaacaaaaactgcatgattatttcaacagatgtagaaaaggctatcaataaaatataacatcacttcatgttaaaaaccttgaacaaactaggcactgaaggaacatgattcaaaataataagagctatctatgttaagcccaccgctaacatcataatgaatgagcaaaagctagaagcattcgccttataaactggaacaagacagggatgcccactctaactggatatcctggccagggcactcaggcaagagaaagaaatgaaggtatttaaatatgaagagaggaagttaaactattctttcttacagatgatatgagtctgtaatagaaaaccccataatctctgctgaggaactctgtgatctgacaaacaactttagcacagtttcaggatatgaaatctatgtacaaaattcagtatcatgactattcaccaacaacatccaagctaagagccaatttaggaacacagtctcattcaaaatagccacagaaagaataaaatacctaggaatacaggtaaccgaggaagtgaatgatctgtacaaagagaggtgaagaacacatttgaaagaaatcagagataatacaaacaaatggaaaaacattccatcctcatgaatagaaagaatcaatattgttaaaatggccatactgcctaaagcaatttatagattcaatgcttttcctatcaaactaccaatgacattcttcacagaattagaaaaacctcttttaaaactcatatggaacaaaaaaagagcccaaatacccagagcaatcctaagacaaaagaacaaagcttgaggcatcacattacctgacttcaaactacattacattgctacagtaatcaaacagcatggtactggcacaacatcagaacaacaacacagaccaatggaacagaatagagaccccagacataatgctgcacatctataaccatctgatctttgacaaagttgacaaaaacatgcaatggggaaaggactctctattcaataaacgctgctgcaataactggctagccatatgcagaagattgaaactggacccttccttatacaatatacaaaaattaattcaagatggattaaatacttaaatgtggaacctaaaactataaaaaccctggaatatactctaggaaataccattctggacatagggcctggcaaagatttcatgacaaaacaccaaaagcaattgtaacaaaaacaaaaattgacaaatgggacctaattaaactaagagctcctgtgcagcaaaagaaactattgagtaaacagacaacctacagaatggaagaaaatattggcaaactatgcatctggcaaaggtctactatccagaatgtaaaagaaacttaaacaaattaataagcaaaaagcaaaccaccccattaaaaagtgagcaaaggacatgaacagacacttttcaaaagaagacatacacatggccaacaagcatatgaaaaaaatactcaacattactaatcattagagaagtgcaaattaaaacaatgacataccatctcacaccagaatggctatcattaaaaagtaaaaaaataacagatgccaccaaggttgtggagaatctgctggtgggaatgtaaattagttcagccattatggagagcaatgtggcaattcctcaaataacttaaaacacaattaccaatcaacccaaaaatctcatcattgggtaaatacagaaataaatagaaatcattctaccataaagtcacatgcacacatattcagaatattgattgaataatattaaacaatattcagaatatgtgtgcatgtgactttatggtagaatgatttctattttgcacaattcacaatatcaaacacttggaatcaacctaaatgcccatcaatggtagactggagaaagaaaatatggtacatatacaccatggaatattatgcaaccataaagaagaatgagatcatgttgtttgcagcaacattggtagagctggaggccattatcctaagtaaactaatgcaggagcagaaaacataccacatgttctcacctataagtgggagctgaacaatgagaacacatggacacagaggggaacaaccgacaaggggcccacttgagggtggatcgtgggaggagggagaggagaaagacatattgaatactatgcttattcccttggtgacataataatccatattacaaactcccatgacacacagtttatctaacaaacttgcacatatacccctgaacaaaaaataaaatttaaaaataaaaaaggaaaattacagataggtcagactgacagttgttgcagatttcttgaactattgtttacatccatcattacattatacttattggacactcagctcttgttatttaatgtatcaataaataaacctacaattagtaactgtatctcaaaattgtatcaataaagaaacatacatttggccgggcgtggtggctcacgcctgtaatcccagcactttgggaagccgaggcgggcggatcacgaggtctggatatcgagaccaaggtgaaaccccgtctctactaaaaatacaataaaaaaaaaaaattagctgggcgcagtggcgggcgcctgtagtcccagctacttgggaggctgaggcaggagaatggcgtgaacccgggaggcggagcttgcagtgagctgagatcacaccactgcactccagcctgggcgacagagcaagactccgtctcaaaaaaaaaaaaaaaaaaaaaggaaacatacatttaataactgtaaaaaattttgatgttagtgatgaatattttaatatctcgtgattttatcttagacaagtgaaacttggcctctctgtgctgttgttctctcatttggaaaaatgatgaagataaacaacatatttaccaatatgacttaacaaatggcagtgactgttgtcagtggtcaaaagtattcacggtatcttgtaactttatcatgacatagctctgctatagattatctgttttataacattttatattcttgaaatatcatgtgagttttaatgctattagtcattagtatttgtttctataacactctacagatttctttattttacagttctcttgattaaacaatgtgtttgtaagtatttctggagaaacattgtttacatgagaccaggaaaaaaacactaaaatttaagtttctgaactgacaatttggctagcctttctgaaagacatacttgcagaaaagatatatatatgtgccctccttagtcaagcatattatttgcaaaataactgagtaatatactgttatattaatggaaaatgtcagcaagaaagtcctttacctgaaatttatgactccaaagtttttacacatatatgaagtttaaaataaacatattttcggttactatttaggcacaaataaatccaggaaaagctttgactagctagaggttgcctaaacagaaagttaacattattattattattattattattattaattactgatttgagcaagttagaaacacctagaatgtcctttgtgaattatttggccagcatgttcatggttcaccaccataaaaattaggtgtacatactagggaagtggaaggcagttttagcctcccccaaacatattctccaatagtttactcaaaagacaatccaagaaaatatttcatctaaacaaatcagtatacttgccatgaaagtgcagtttcaaaacatctccagtctattctatcttcccttttcccctttccaaccaatttctacctctaaaccacaattataagaaaatctgggaccctagtattgattgcaagattttaattcaatgtcaaagattataagattttaatttaatggcaaataaccttatcagttcatagaataaacaggtacatatgaacttgacagcactcactaagataccatttttttgcacagtgaaaaggggcggtgggaacaaataggaactacaaaagagttaggtatgtgtatgtcaaaaaacacaactaataaacttattgacatacttgtgtgtatgtgtttacttattgttaattaggaacaccttatacttatctattaatattgcaagtgtttcaaaatccttcttcaatatatatggagatatatttctacaaggatatttttattttcataactcacagtcatacattcactgttttgtttatattagtgtacaggctataattataattgcaagagatatagataatgtcaatagcccttggaaaaccagtcacttaaatctctattaagaaatattctattacgattttatagatttcaaaatacagaaatgtccctgtaagctatgatagtgtctctgtggaaatcagtagtcatagtgagaaattaacctgtctgttgagaagcttctgaaaaaaccattcctctgaatgaactttctctgaacttaaaacatccctcctataatctactcacatctgaatattaatattttgttctctgaagaggatgtaaaattttttgtgattattatttttgcctcttttcaatcagttaacaaatatttgttcctttgctaatggcgtgcaaagcatttggttgggtgcttagggattgcaaagtagcaagatgctggagttcggcaaaattataattcagttggaatgccaaggtgcctctaaccttagaagaaaaataatagtaaaaagcaatggtgcttcatgacctacgattaattaccctatctttagtggaagttcaagttgcactgagtactgaggaggataagtttctcttgttggagatattgggcagcactctcggatataacataatttgtagggattttgaagactgggaagaatgcttcactatgttagatgtaagccactagctctgtagcagttggcattgacaagggacttattgagtgtatgcatttatcctccaggaaaatggaaatgtagtatttgaatttcgtagatcttaactgtggtaataataataacattaattaatattagtagttaataaaattagtaatatcaagaaaaataataaactactcttggaatatttactatgtgccagacaccataataagcagtgtatataggatctaaattgagccacccattatctaaatatggggggaagcataatggctaaagcaataaggctaaaaaataaactttgaagtcaaacagacttgttttactcataactcttccatttactgcctgtgtaaccttggtaaagttacccaacccttgaaatttttgtttcctcacttctaaaattggaattattttgaatacctacctcatggtactaatttcttttctttcctttttctttctttctttttttttttttttcagacagagtctcactcagtcccccaggctggagtgcagtggtgcaatcttggctcacatctgcctccacttctcaggttcgagcaattctcctgcctcagcctcctgagtagctgggaccacaggtgcacaccaccatgcctggctaatttttgtatttttattagatatgggatttcaccatgttggccaggctggtctcgaactcctgacctcaagtgatccgcccaccttggcctcccaaagtgctggaattacaagtgtgtaattccactgtgtccagccatgacattaatgattttaagtaagataattaatgtaaaagtaattaatccagtgccaaacccagattacttacttaaaactagctattgatatttttaataactatatgaagtgaggattattgtttccttagtatagatggggagactaggagagactacccatgtaactagtaagcatagagctggaatttgaactgcagtgtatctgactttagagagtttgttctctcaatgattacattattatgtttttgtttttcttcattcatttaataaacaatttttggtactgattaagtgccatgtcgatggccttcagctagaaatgcaatggtgagaaaatataaactctccctgttctaaaggagactacaaatgaaaggtgtaggcattaatagatatttaattaaaaactgagggtactcagaaggaagaaaatatgattccctgagaagataaaataaaccaagttcactaggattgtgaagttaaaaaatatttccgtgacaaaaggaagatctaaaaggattgtgagattaaaaaatatttatctgagaaaagaagatctgaaagataagactaaaaagatggcaagggtcagataatacaggaccttgtaggcaaaaataaggatcttgggatttttcctaaggacaatctaaagttattgaattttaagcagaaagtgacctgatcagatttattactggaaaaaccattgcctagtttgaagaatagtgggaggcatccaatatggatgaaggcaaagcagttagtaggttaactaataattataataatattaatttatatttttaatacattataaatattacccaggaagtagatgagagtagcttggataaggactggtttcagatgagatggtaataagaatagaagtttaaaatatatttgggtgattaacttaaataatttaatgattaaataattatgaaagaatgagaggtaataataatgactcctaggcttctggttcatgcatctgcaggacgtgtggcacctaaagtgtgaaagagtatcaaagtttagaaggaagataatatgctgaaccttggatatgaggagtttgaaatgcttttggcatccaggtaagttgagcaggcagttagatgtgtagtccagagaagagacttcagctggagccacaaagatggaagtcaccagcatctagatggtatttaagggcatgggtctgattgcttagagagagagaatcagagagaagagaagacatccagccatgaaaaattgcaccattaaataactacatctaggagaatggacataagcaagagattgaaaagagaacaaagatacagttgggaaacaaagagtgggttatgtcacagaaacccagaaaagagaaggatgatattggggacactagacattatggactgggcaatattgtcaggtgctgtggaaactttaataagacaagaagagaataatattcataaattttttggcatgagggtcagtggtgtggtgacatcaggggaaattttcactgtagacaagagtgaaagccattttggaatacattgaggagtgactggagctgaagaaacagagatagcaattatgaacaattatttcttaaagttagacgtaaagaagagtgtggagataagctggaggcaactttggagtttaaggatgactttgtgtaattttatgttacagagatggatccaggcaataggaactggcacacaaataggaattaaagacaataattaattgcataaggatcatcagaatgcaaaagtgaagaggtcccaaagcagattattaaaggactgtgcttagaagggagaaaccatctcttctaactcaagagggaaaaatatgttatatgctggcataaataggtttgtaagttttgtgttttgtgggagcaatttaagaaagtccctgttggatttcagttttctctgttcactgttgtctccctgaaaatcaacttgtctgccttttaggatttagaataaagttattatttatttatttatttatttgtcttttgttaccatatacgcctataaacaactgaaactactgaatgtggtatttaaactattttaatgattgaacaatttacttatacaaagttagcctgaagccttagggtaaaggttatatacgaaaatcaataataaaggctagatctaactggtttaatggaaagaatcaatatgttgtaaaagagcttttgaaagtggaatttgtacactgaaaaagggaagtttgcttttagcaaaaaaaaaatccattattttcttaatttcttaaagagtagatttttaatattttattttttacatgtacatatgtgtataaatgcatacatatttaaatgttttaaaatcatataattttgtgaaccttttgtatcctaaaaattttcttttttttttaattatactttaagttttagggtacatgtgcacaacatgcaggtttgttacatatgtatacatgtgccatgttggtgtgctgcactcaataacttgtcatgtaacattaggtatatctcctaatgctatccctcccccatctccccaccccacaacaggccccagtgtgtgatgttccccttccagtgtccatgtgttctcactgttcaattcctacctatgagtgagaacatgcggtgtttggttttttgtgatagttttctgagaatgatagtttccagcttcatccatgtccctgcaaaggacatgaactcatcattttttatggctgcatagtattccatggtgtatatgtgccacgttttcttaatccagtctatcattgttggacatttgggttggttccaagtctttgcgattgtgaatagttccgcaataaacatacgtgtgcatgtgtctttatagcagcatgatttataatcctttgggtatatacccagtaatgggatggctgggtcaaatggtatttctagttctagatcgctgaggaattgccacactgacttccacaatggtttaactactttacagtcccaccaacagtgtaaaattgttcctatttctccacatcctctccagcacttgttgtttcctgactttttaatgattgccattctaactggtgtgagatggtatctcattgtagttttgatttgcatttctctgatggccagtgatgatgagcattttttcatgtgtcttttggctgcataaatgtcttcttttgagaagtgtctgttcatatcctgcacccactttttgatggtgttgttttttcttgtaaatttgtttgagttcattgtagattctgcatattagccctttgtcagatgagtagattgcaaaaattttctcccattctgtaggttgcctgttcactctgatggtagtttcttttgctgtgcagaagctctttagtataattagattccatttgtcaattgtggcttttgttgccattgctttttgtgttttagacatgaagtccttgcccatgcctatgtcctgaatggtattgcctaggtttttcttctagggtttttatggttttagctctaacatttaagtctttaatccatcttgaattaatttttgtgtaaggtgtaaggaagggatccaatttcagctttctacatatggctagccggctttcccagcaccatttattaaataggggatcctttccccattgcttgtttttgtcagatttgtcaaagatcagatggttgtagatgtgttgtattattactgagggctctgttctgttccattggtctatatctctgttttggtaccagtaccatgctgttttggttactgtagccttgtagtatagtttgaagtcaggtagcatgatgcctccagctttgttcttgtggcttaggattgacttggtgatgcgggctcttttttggttccatatgaactttaaagtagttttttccaattctgtgaagaaagtcattggtagcttgatgggatggcattaaatctataaattactttgggcagtatggccattttcacaatattgattcttcctacccatgagcatggaatcttcttccatttgtctgtgtcctcttttatttcattgagcagtgatttgtagttctccttgaagaggtccttcacatcccttgtaagttggattcctaggtattttattctctttgaagcaattgtgaatgggagttcactcttgatttggctctctgtttgtctgttgttggtgtataagaatgcttgtgatttttacacattgattttgtatcctgagactttgctgaagttgcttatcagcttaaggagattttgggctgagacaatggggttttctagatatacagtcatgacatctgcaaacagggacaatttgacttcctcttttcctaattgaataccctttatttccttctcctgcctgattgccctggccagaacttccaatactatgttgaataggagtggtgagagagggcatccctgtcttgtgccagttttcaaagggaatgctcccagtttttgccaattcagtatgatattggctttagtgaatctgacaattatgtttcttggagttgctcttctcgaggagtatctttgtggcgttctgtgtattttctatgggtttgtcatagatagctcttattattttgagatacgtcccatcaatacctaatttattgagagttttcagcatgaaggttgttgaattttgtcaaaggccttttctgcatctattgagataagtatgtggtttttgtcattggttctgtttatatgctggattatgtttattgatttgtgaatgttgaaccagccttgcctcccagggatgaagcccacttgatcatggtggataaggtttttgatgtgctgctggattcagtttgccagtattttattgaggatttttgcatcaatgttcatcagggatattgatctaaaatcctctttttttgttgtgtctctgccagtctttggtatcaggatgatcctggctttataaaatgagttaggaaggattccctctttttctattgattggaatagtttcagaaggaatggtaccagttcctccttgtacctctggtagaattcggctgtgaatccatctggtcctggacttttttggttggtaagctattaattattgcctcagtttcagagcctgttattggtctattcagagattcaacttcttcctggtttagtcttgagagggtgtatgtgtcaaggaatttatccatttcttctagattttctagtttatttgcatagacgtgttcatagtgttctctgatggtagtttgtatttctgtcggatcaggggtgatatccctgttatcattttttattgcgtctatttgattcttctctcttttcttctttattagtcttgctagcggtctatcaattttgttgatcttttcaaaaaaaccagctcctggattcatggatttttcgaagggtttttatgtctctatttccttcagttctgctctgatcttagttatttcttgccttctgctagcttttgaatgtatttgctcttgcttctctagttcttttatttgtggtgttagggtgtcaattttagatctttcctgctttctcttgtgggcatatagtgctataaatttccctctacacactgctttaaatgtgtcccatagattctggtatgttgtgtctttgttctcgttggtttcaaagaacatctttatttctgccttcatttctttatgtacccagtagtcatttgggagcaggttgttcagtttccatgtagttgaggggttttgagtgagtttcttaatcctgagttctagtttgattgcactgtgttctgagagacagtttgttataatttctgttcttttacatttgctgaggagtgctttacttccaactatgtggtcaattttggaataagtgtgatgtggtgctgacaagaatgtatattctgttgatttggggtggagagttctgtagatgtctattaggtccgcttgttgcagagctgagttgaattcctgaatatccttgttaactttctgtcttgttgatctgtctaatgttgacagtggggtgttaaagtctcccattattattgtgtgggagtctaagtctctttgtaggtctctaaggacttggtttatgaatctgggtgctcctgtattaggtgcatatttatttaggatagttagctcttcttgttgaattgatccctttaccattatgtaatggccttctttgtctcttttgatgtttgtttgtttaacgtctgttttatcagagactaggattgcaactcctgactttttttgttttccatttgcttggtagatctttctcctccatccctttattttgagcctatgtgtgtctctgcacatgagatgggtttcctcgttacagcacactgctgggtcttgactctttatccaatttcccagtctgtgtcttttaattggagtatttagcccatttacatttaaggttaatatttttatgtgtgaatttgattctgtgattatgatgttagcttgttattttgctcgttagttgatgccgtttcttcctagcctcgatgttctttacaatttggcatgtttttgcagtggcttgtactggttgttcctttccatgtttagtgcttccttcaggagctctgttagggcaggcctggtggtgacaaaatctctcagcatttgcttgtctgtaaagtattttatttctccttcacttatgaggcttagtttggctggatatgaaactctgggttgaaaattcttctctttaagaatgttgaatattggcccccactctcttctggctcgtagagcttctgccaagagatcagctcttaatctgatgggcttccctttgtggataacctgacctttctctctggctgcccttaacatttttttccttcatttcaactttagtgaatctgacaattatgtttcttggagttgctcttctcgaggagtatctttgtggcgttctgtgtatttcttgaatttgaatgttggcctgccttgctagattggggaagttctcctggataatatcctgcagagtgttttccaacttggttccattctccccgtcactctcaggtacaccaatcagacgtagatttggtcttttcacatagtcccatatttcttggtggctttgttcatttctttttactcttttttctctaaacttctcttctcacttcatttcattcatttgctcttccatcactgataccctttcttccagttgatcaaattggctactgaggcttgtgcattcatcacgtagttcttgtgccaaggttttcagctccatcaggtcctttaaggacttctctgcattggttattctatttagccattcatctaattttttttcaaggtttttagcttctttgccatgggtttgaacttcctcctttagcttggagtagtttgattgtctgaagccttcttctctcgactcgccaaagtcattctctgtttagctttgttccattgctggtgaggagctgcattcctttggaggaggagaggtgctctgatttttagagtttccagtttttctgctctgttttttccccatctttgtggttttatttacctttggtctttgacgatggtgacgtacagatggggttttggtgcggatgtcctttctgtttgttagttttccttctaagagtcaggaccctcagctgcaggtctgttggagtttgctggaggtcccctccagaccctgtttgcctgggtatcagcagcggaggctgcagaacagcagatattggtgaacagcaaatgttgctgcctgatcgttcctctggaagttttgtctcagaggagtatccggccgtgtgaggtgttggtctgcccctactggggggtgcctcccagttaggctactcgggggtcagggacccacttgaggaggcagtctgtccattctcagatctccagctgcatgctgggagaaccactactctcttcaaagctgtcagggacatttaagtctgcagagttttctgctgccttttgtttggctatgtcctgcccccagaggtggagtctcctgaagcaggcaggcctccttgagctgcagtaggctccacccagttcgagcttcctgaccgctttgtttagctactcaagcctcggcaatggtgggtgcccctcccccagcctcgctgccaccttgcagtttgatctcagactgctgtactagcaatgagcgaggctccataggcataggaccctctaagccaggcacaggatataatctcctggtgtgccatttgctcagactgttggaaaagcacagtattagggtgggagtgacccgattttccaggtgccatctgtcacccctgtctttactaggaaagggaattccctgaccccttgtgcttcccgggtgaggtgatgcctctccctgctttggctcatgctcggtgcgctgcacctactgtcctgcacccactgtgcgacactccccagtgagatgtacccggtacctcagctggaaatgcagaaatcacccatcttctgcattgctcatgctgggagctgtagacttgagctgttcctattcagccatcttggcttcaccacaaaaattttctaaaatacgccctcccacttgattttcctacctctacattatttacccaatgaccatgtcataaacataagcatatgtattcttctgcattttctttattttccaaagttataagaaaaaatgcttatattaatatacctactgggtttttaaaataaattattatttttcagcaatgggtcatagtatacacttttttgtgaatttagattttcttttttgcactcaactatagcttatggaaatctttccaagtcaactggtaaagttctaatttagtctttttaatattttagattgaggtttgtattacaaattattcagccattcctatactggtgctaatttacatttttagtaaagttttttcatttttgcttctgtaatcaatactgctagactaatctttttataaaatctttatactagtgtcatgttacatatttatatgtgtgtatgtgcatgtgcatatcatatggtggataaattcttctcagaaaagcaatttccaaagtgtctaggtattttttattttaatatagtagacttaggttgtataaaaacatggttgtaacagttaacatttttaccagcaaggcataagagtgcttttatccttgcatctctactaaaccaaaatgcaagttttcaaaagatattgagaaaagtagtcatcgataaagttgattatttaattttatttatttattttttttgagatggagtttcactcttgttgaccaggctgcagtgcaatggcacaatctcggctcactgcaacctctgcctcccgggttcaagcgattctcctgcctcagcctcccaagtagctgagattataggcgtgtggcaccatgcctggctaatttggtatttttagtagagacggggtttcaccatgttggtcaggctggtcttgaactcctggcctcaggtgatatgcccgcctcagcctcctaaagtgctgagattataggcatgagtcactgtgccccaccttaaaatattttaaagagtggagattggtagatttgtgaaaaggatttttcctttttggtataaagctaagagatccatgcataccatcactcaaggagagtgctgaggacgtccctctctacctaaaaccattgcctagtttgaagaatagtggggcagtgatgactacagaagtattaggagtaggatttcctagtaaaccctactaaaaggtttaaagataaaatatgggatacccaagctgaattagaatggctgaataatgaacgaatagtcttttagtaagaatatatccaaaatgtttcaaagcacacacttatattaaaaatgacatctgacactataacttattccttatattaaatcatatttctgtacacattaaaaactcccctttatcccctcctccaccccacacccttcccagtttcttgacatccatgagatcagatttgtagctcccacatatgagtgagaatgtatgatatttgtcttcctgtgtctggcttatttcacttaacatgatcaccttaagttgcatccatattgaggggactataattaacattaatattttgtatatttcaaagtacctagaaaagaatatttaaaatagttcctattcaaagaaattataaatgttcaaggggatggatggcctaaatatcctgatttgatcattacacatttatacattgtatgcatgtgtcaaaatatcatatgtaccccattaatatgtacaaatgctatatatcaattaaaaaatacaatttaagagcaaaaaataacataatgcataggtataagcatatttaaaatagtttaaacttggagactctctaaatgcctatcaataagaaaatagataaattgtgatgcattcatactatagaatacaacactgcagttaagggtaatgagtgtaatcttcatatactgacatgaaaacatatccttgaatagaaaaagggtctagaagaatactattaatagtgactgctctttgagggagtgactttcttttttaacttatacacttcagtatattactttagtttcatcaaaataagcatgtatggccaggcgtggtggctcacgcctgtaatcccagcgctttaggaggccacagtgggtggatcacgaggtcaggagattgagaccatcctggttaacacggtgaaaccctgtctctactaaaaatacaaaaaaattagctgggtgtggtggtgggcacctgtagtcccagctactcgggaggttgaagcaggagaatggcatgaacccgggaggcagagcttgcagtgaaccaagatcgcgccactgctctccagcctgggcaacagagtgagactccgtctcaaaaaaaaagcatgtattacttgatttttatatatttattttgaatttttgcataattagtatttagaaaacataataaatacaaaccaaatttataatttaaaaaacatctgttatttatctaaagttcaaatttaactgaaagtcctatactttaaagtgctaaatctgacaaccctaaccaggagagtgtgatatctacactcttagttatggcaatacaattgactaatctttcacacatgccttggaaatctagatgggctagtcacctgcttagggtgggattagccttacattggtcatttgcctgaacagaggataggtgttttctcccattgaccagatgtagaacatgggcaaaggaaagcagtgcggggtgtgtgtcctgctctggtgcactcctagagggacactcccctgctgagtccagttcacacctctacgggcatgtctgaactcagcagaggaaccagaagcagaacactaattcctagaacctgaagaaggaataggcaaaccccaaagtagagtgcatttgtgtgagtcaaggaaacttcaggtaagagagtaatagtgagatttccaaagaacccacaaaaatagcgaggagtgagaaagtcagcattttttttttaaaccaaacagaccaaagagtgtgaggcttccctatgacagtaagtaaggtgcttcatgtcttacttcacttctattttgctttgatttggacaggggcacaaactttgtcttctaaatggtattaattccaaaaactttcaatataaattattgagggtagtttaattgatgttaagaagaaggaagacaaaatgataaaatcttcagggtgctggtgtaagagctacagctatttatgtgtcctattctgaatcccaagaatgctaaatgtaacttatcctttaaaattttcatgatgggtctttccaaattgtaggtccttaaaatgatcatatcttttggttctttgaattcccaacgtaaggccaagtactttctgcatggtaggttaaacatatttaataattgattggtgtctgctggtgacccttgaaggatgagaaataatagaaaatccaagtcaatggaacagacaataagatccctgggaaaccagaagcagagagattggttttaggacagctgaagaaagtctaatggaaagagtggggggccatgtgagttttgcaggaaaaatagtctttagggaagttttgcatgcagaatgcttttcaggcacatgtagaataggcaaatggaggaggtgtgaatacatgggttgtacttagtaattaaagagcagttgtcttcggatgaagcacaaaggactgtacggatgactactgagaaacttaagaaacacattaaaataggttgtagtcatacaaatttgaaatttctgctataacttttaaaggtatttgagaaaagaggtgatttacacaaaaatgatttatttatttttttaaaagtaagtcccagtaaattctgaactgggagaagagaaagagcaagaggttagaggcaacaggaggctggagctggagtaatggccacatagagtgttattatttcaagaaccctggaagaagtaggtaaggatttgaatagaacagtgaagtgaaacagaagaaattcacatgaaaggcactgcaaagaagagactaatacgatggcagaaagaagtagaaataaaaattggcaggatagattggagctggggaacatgatggtctcattttaagaaataaaatctggaaagagaagagatttaaaagtctacatggtgtactttattaaatgaaaaaaaataaattgtatagacttaaaagatcctcactcactagatacaaaaatattttgcaaataaattttgttttatatctacgaaaaatgtaaatgcctttccaaatttattttttaaataaaaaactgtttctttttaaaagtgaaatacagctgtctttttttttgttcttatgtaataattctgctgtttttagttctcagtcagcaggcaagcaagaccctcagtatatgtgttttctttatttggttaggttttgttggaataatttttgtattaagtcttatattagaatatgaatgtaaatgctttgagagatcaattagcagtgaattaaacatgacagaagatttatttctcctctgcttaaaaatctaagctggtatataatcaggtttgaaaacgttgcttattcatcatcagcataaatttcatccttggattcaaggtgattgttctgcttgttgctatttctcagcttaggaggaaaaaagaatacgtagaaggcaagtagccttcctcttttaagaatgtgatctgaaagttgctcatatccattggctaaaacttagtcatatggtttggaaaatgttatgtctaggtgggcattgcaaccaaaattggaagtaagaggaatttgtttctaaaacaaagaaggatagccttgtgttagaaaactcatatctgcttatatttcttaagaaaatttttggtttacttttgtatttctgtaagagctggggtctcactatattgcccaggctgttgtcaaactcttgccttcaagcaatcctcctgcctcagccttccaagtagctggtattacaggcatgagccaccgtaccaggccaagtctgcttatattttatgtattgcattctgtcctattaatgtatattcattatctgtctttttcttttcattctttatgctttttaaattatagatattcttatgaaattttaatttattatgtatagcagaaagatgccaagacactcaaggacaatatcctctttggtaattatttggattgaaagtagtatgaagccatatcacttgtccaaataagagtctttagatttactcaaaatgataattttctatttgatagcctagatatattaattacaagagataatttctgctagtctgtagtctcccttacctgaagtgttttttacatgattaaacatgcatgggagggtttatttgtttatttatttttgactaaaggggattcttttggggttgatgttcttgggaagagaaaaaaagctatgaggatgatagagatgaggagaatgcacacacttgctccataaactgatcttgagccatttgaaaagtgtttctaaatgaaaagatgaatgagctgtgtatatggacaaacgtgtttgaccctgggcacaaagcactgctgctgagagacccaggggtaatggtgacatgagttctagatattcatttttcatccattcctcaaccccgacacagacagtaagatgtatttgtggtcccaaggactaacagaggaaggaagaaggggtcactgtgcctgaagatcatggagtatggggaaagtaaagagtagtgtgttaaagttgaagaaagataagtgtatttattgtgttcctacacgggagtcccagaaacacctgggtgatcgtgatggtggtaaatctggtggaagtcctcattaatggataggtgtagacttggagcaggggaccataatggattatttccaatgtaacttaatatgcgcttagagataaagtttaggacagtacttctgaaactttaatgtacatatgaatcaccaggagaccttgttaaaaggcagattctgatttagtagctggggtggggctgagattgtgcctttctaataaattctccggtgatgctgtgctgctgttccacaaacaacacttccagtagcaagggattagtaatattgaattaatcaaggtctcatcctcaccatctgctaattcttattgctttctttcctacagtcagaaaagcctgaatttcaaaactgactatgctacttacaagtgtcattgagtaagttatttaacttccctgaggcttagtttcactactcaagtagatttttattagcattgtagtatttgctatttctatccagcagatatttcgattttcttcctgtgcacctggttggattgcatgattaagcccgtttggagttaggtgaggctacatatatgctttgtcattagtatgtaggcaaaaattttaatatatcacttgtgtggtttgttaccttctctttttgtctgctatgatcattggtaatgttctagtaaatgttttatcatgggaaccactagagtaaagcccttagcaaacccttggtggacatgtaacatgcaaataaacttttattgctttaagccattgagatcgtggagtatgtattatttcagtgcaacatggcatactctgactgatagaagcattaaatggaaaaagtcacatacattggttatgacacagatattcttttcccattgttttctgcttccaacctcttataatctagctttttgtcatctctctgtgtatatataataagagtaacaagataatttagaaattggctaaaagctacatttatgttttttaaaaaatcctttttcattcttataaagtaatagtaattcaaaaatgcagaacttgcagataaataaggcctctttttctccatgatcatgtcacgtcagctagactgttccaatgaattctaatctgttgggtgatatgtaacagtaagtgattgggaagcacaacaactgatgaagcaggcccatgaaatggacacttagtcagagggatggctgttttctatttataatattgcatttttatttctgcatttttttgtttgcaaaaagaatgtcatttttattatttctctggaaaccaatttgagtttggcatgaatgtagcaaatgctcttctattcttgagctgttagttcttttaatgtttcctctaccctaagaagaaaagtgctaagcagcatttctttgacctttttgctgggttataatttaaatgtctggtatttctttttctgctcacctttcatcctgctctataatccatgtgacagaacaagaatcactagcgaatcaaaatagagacaatttacaagtaatgtttaaaccaatctgcctttgaactttccttgtaattattctctgtcatttctcctttttttttctaatttatatactaactctctctctaagggaagttttttctttatctctcattgtacttatgttgttttaaaaatatatcccttaactcttgaaaatattaatatataagatttctcttttcatgattccacttaacatatgtaatatcttgaaattcaagcgcaatgcccaatagccatttattcattcattcatgcattcaacaaatattcattgtagcattctatttagttatgagtacatagcgttgaaaaaaattgtagctcatgagggatgagcttcatccttcatgaagcatatattctagtagatagagccaggtaatagacaacaaaagaagtatgcaagaaagtaatgttataggagaaaaatgaatcagaagaagaaggcacagagtgtcctcaagtatgctgctactttaaataagatatactgggaaggccttgtccataaagtagtatttaagcagaagcctgacagaggtagaggcagaattatgagatatcagtggaagaactttcagacaagaggaaatagcaagtataaatggcaacattgtcactagactcaggttgatgtaggatttgccaacttcccttttgactttgaaggttgctctgggaatcaataatgagtgacagatggaagaggagagagggtagctgcatggaaagttttatgaattagtcttgggtgtggagtgcctcactttttcttcattccattgaccaggaattacttagatgaccacatctaaatgcatgggaggttaggaaataaactatagcctggtattcaggagggaaagaatagggaattgagaaataaatgagtagtttctgacttagcatatacaatactgtactgaattttttatattatttataatttgctatctctgagtatcaaaatactgaacacatccaatgaatgaaattcttagaataattataggactatccattaagacatcatgttattacaataaacaaagagtactttgttctagtgagcagtatattgagagagtatgattcctttggattgcaaatgacccactgcggcagccaagtctcataatacttgggatgtctttcacataactctgctttgactgtacctttgtggttaaaggaggcctccttgagatattcctttgggtcccattagtggaaagcagggcatctgtattagtctgttttcacaccactgtaaagaatattacctgagactgtgtaattataaaggaaagaggtttaattgactcaaagtcccgcaggcataatagaagcatggctagggagacctcaggaaacttacaatcatggcagaaggggaagcagcctccttcttcacaaggcagcaggaaacagcatgaatgtgagcacagaaaaaaactgccacttttaaaactatcagatctcgtgagactcactcactatcatgaaaatagcatggaagaaacctctcccaaatcctatcactttcctctctctacccattgggattacaagtccctccctccacatgtgaagattacaatttgtgatgagatttggatggggacacagagccaaacaatatcagcatccaagtttactgttccaacaagaccactctttacttgaaatgggtaatttttcaaaataaataaagctgcttttagggaaaatggataatgaagaatgcaaatgatagatcttcactgttttatacatacatatgtgtttgtttacatatatataacataaaatgtactaaataatatattgtacatagcaagcagtatgtaatatataagatgtgatctgtgtgtatatatacatatacctatgtaaatatgtatacatatacagtttgagcatctcaaatctcaaatctgaaattgtacaaaatctgaaacttttactgagcaccaacgtgatgctcaaaataaatgctcatagaagcatttcagatttcagattttgggatttgggatgctcaaccagtaaataaggcaaatattacaaaatctgaaaaaatctgaaatccaaaacactctggccctaagcattttggataagggatactccacctgcatatatgtctgccatatttgattcgcataatggaaaagaagaacaataactcttatttaagttaggcagagttcatttagcatattaaaacgcttgttttctgtctaatcataattggctaaaaaccaaagaaaaagatcacatgtcatgattgtatttattttcatttgctatgtgatttggtagttatggtataaaaaccttggagattttattaaataggtcaggtccacattcaaataagcagatttctattatatgttaatctgctgagcatattgctgttcatatttgcttcactacttcttgaatgaatagaagagttaaggggtagatggggattaaggggtagatgaagcttctgagaacagagtgcctgggtttgagtcctggctccactatttactagctggttgatcttgtgtaaaatactaacctcggcctcagtttccttatctgtaaaatggggatgaaaacagtatccctctcataggactattgtgaggattaagtgagttaatatatgcagagtacttggaacagcatctagtacatagaaggcacgatgtaagtgttagctgtttctgttaattatttattttttcaaactctggaataaatcataagcccttgaagataaagatcacgtctaaaaattatatttagcccttaacacagtgtcctataaggtacctaacacatgtttttgaatgaataaagtaatgagcaaacagttacacattctagcattcatgttgtatgtttaatgtagcccattccttacttaactcaaactacctttgttactttgtgactaaactgttatttttcaataataaagataaaatgcgctggggtaggtggctcatgcctgtaatcccagcactttgggaggctgaggtgggcagatcacttgaggtcaggaggtcgagactagcctggccagcatggcaaaaccctgtctgtactgaaaatacaaaaattagccaggcatagtggtgggcacctgtaattccagctactcaggaggctgaggcaggagaattgcttgaacctgggaggcggaggttgtgatgagctgagatcatgtcattgcactgcagcctgggcgacagagtgagattccatttcaaaaaggaaaaaaataaaaagataaaatgatatattttttaataaaactacgtagctgttaatgatttgtttcaattttgtgtgccccgcattgtcagtgggagtacagttgaactaatcttgatgggaaaaaaatgacattattctatacaattgactactcacatattttcccagaaattctccacctagttaaggatctaagataacttcttgcacctataaacagaagacatacaaaagcattcataataaaactgttcataaaaacaaattccaggaaccatctaaatgttcagaagaacacggataaacaagctgtggtaatacagtcatctctatttgttgtttgagatcggttccagacctcccttggatactgaaatttgcagttgctcaagtccctgctaccaaatggtgtagtatttgcatataacctatgcacatcctcctgtaaactttaacttatctcgagattacttataatacctcacacaatgtaaatgctatgtaaatagttgatatgctgtattgtttagagaatagtaacaataaaaatgtctgtcaggttcagtacagacataattttttgaaaagtattttccacctgtgtttggttgaatccacagttgaggaacccactgatacagagggctgagtgtatatagaataaaatagaaaagtatagtagattgtagcagtaaaaatcccaacttttatttatcccttccttaatccatgtgtttagatagcacctttgcttactgactctgggccttaccacatgctttggccaatgggacaacagcaaacgtgtttcaagaagaaacttaaaaaatgcttgtttattggagcttgtggctcatggaaactctgtgactgccactgtttgtacaagcccatgccaactggctgaaaacatgtttttccagttaacgttataacctgagctgacagccatcacttaccgacagccagcacgtatcgccaaacatgtaaggaatgccatccttgagtgtccaagttccacataagtctgtgaggtgattctagctgtacatgtgtgcatagggaaaccagcataataagtattgtccatttaagcctaacctaagttgttgacccacagaattgtgagcttatccttgaacgctcttttaagccactgagttttgatatggtttattatgcagcaaaaaccaactcttgtgagagtaaagggaaatgaccaacagttacatacaacagaattaaattatataacatactgttaattttttttttttttttgagatggagtcttgctccatcacccgggctggactggaatgcagtggcttaatctgggctcagtgcaacctctgcctcctgggttcaagtgattctcctgcctcagcctcctgagtagctgggattacaggcatgcaccaccaagcccagctaattttttgtatttttagtagagatggggttttaccatgttagtcaggctggtttcgaactcctaaccttgtgatccacctgccttggcctcccaagtgctgggattacgggtgtaagccactgcgcccagccagtactgttaattttttaaaaagcaagtagcagaggtctacctgaagtttgcaaacctattaagaagtaaatataaataaacattgccaaaataaagataatgcttaagcatttatatattatgtatgttagtaattaagcaaaaattaaccacaatttcagaatataaagatgacagtgtttaatattttaatgttcttaactagcatatttctatacataaaggtaacataattgaatcgtaaaatgaattaaaatgtacatatttttataccttaacatgctattaaattctccaaaaatataattgaagactgctactaattcatcatatcaaataatgtatatatttaatcagtctctcattcttggcatttgggttatttataactttttattaacaaatgcagtaaacagcttggtatataattttatacattttgagacacaatccccatagaataactccttaaaagtagttttaataaaaatattataaatatactcaaaagttattaatacatttttattaattgcattttggaaagggcaaaaatttatattccagcagaaatgtgtgaggttactttcaatgtttaactcatgcaagcatttggtattattctattgataaactgacaaattgataggcaaaaataacatctcatttttaattaagttactagatgaatgtacaatcttattcattagtcatttgtattttcacatatctgaattatcttttcatgtactttactctgaataccttcttttgacagtttataatacagttgattgggttccacctttcttaattacaatcacattctagtacctgctatagagattataccctcatcaccttgattgtacttcagtgtttctgcagttttcagtcacacatttaaaaccatacttttctcatgattaacctcttattttatgagtatcttattattcctatatttgtacagtgagttttattcctttgaaatacaagaccaagctgagatggctcattttgagttggttcttaataactatataaggcataattatttccataattaaagagcacctcagtagttcttaaagaaattagaagaaaaagttataaaaaaatttatatcactttgtttctacatagactctaccatttggtttaagaatttgccaattgtggaatgaaattagtgtgatcacagaagataacactatttgaaaacttcaagtgaacgaaatgtggtttcaagatgatagattaataacaaaattaaaacaaatggtatcttggtaaacttccttttggtagccaaacttggatacaaatggtctttcattttgtaagttaaagaaaatgataaatgtgaaatgcccactagtctaattcaaagatctattgggtcactcattctgttttgtttttcaatgactaaataaagaggaatcaaaactatatttaggaaaacataaaagacggattaaagtgaaacgaataaaaatggaaataacaccaaaaggtgaaaattcaaggaaattatattattaggctcctgactgtaaagacatagagtataatgaagctaattctttccaagtggcaataatttcccaatgagtttattttgaagtctaacttaaaacaaaatcacatttgctttttcttctgagttaaaactttttggatgtattcatatttttctctgttaacactgtaaaggtacagtgagcacacaggatgagttatatgtagaagtgttcaggtttgaagcctaaagcttttggctaccgcaagtcattcattaggttgggatgccataataaacacccttgaaacagcacatttttcattatatatatatatatttcattttatatatatatatatatatttcattatatatatatatttcattatatatatatatttcattatatatatatttatttttatttttctccatatatatatatttccttacaaaactgagtttagacctgtaggcaattgagagtgcatgaaaacaaaagtatttttgtttttagaaaggccatcaaattagtgctagaagacacccctccctttaggcatacgtgttccaagactttatccctaaagggtttatttaggacaatattttgacttcctagactaccattatgccattattcccatagtactgataggtggaaatagtattaaaatggatgtagctaatcaggaaataggctctacatattacaatagttcttaaagatattaaagataataacttgacatgtgaaaaattgttataagagcactgcaacagtagcataattaaatacaatttagatttgtcctgaatctgcctatcaaaactatttgtttgaaaatcaagtcctttatatctctctgaatatgcagcaagttcttttcagtcagtaatacaatagatgaatattgtactactcacagaaatctttagcattcattaggatttcattatggagttaaggaggaaatagagaaaaggaattgccttctgtcaaaagaatttacatgtagtttgcttcaggagactgattgctacagagagaaggggaagataatgtgatttgttaatgataaccaaacagtattgcggacaacctcatcatttgtagcttttattagattgtcattattcaatgctaagaatactttgcatttccattgttactcacactttcagagagtctgacatgcttcattcctacagcccttctgcctttcagttgaaataaccacttggaaataagtagctgtaattaaggtaaagggtgacaaataaacatttgcttaaacacatacgcatatacagaagttgttcctctgaaaagctgtaatgctctgggacacctgctgggtaattgtcggtttgatccgggaggtgagtgcaggaatcgtcatcagtctttgttttccactctgaaagatttacaatttgcatgttattgtttttgttggcaaaggcatactcataaatctatgaagatcatttaagaggcaaattgagatggctcaagagaaatgttttgtaaaatataatttgtaatttttttttttgtagtttgtttagagttcaagcctagaacagtagattcccaaagctacagggtcttaagaactatctggagattggaaaagatcactacaaatcgtagtgacagagacaggagacagccaggggtctccagggaaaccctgccttcaagtctacaacagcctgaaggctgaaaaactggactgctggttctggatgaagcccaccctttcctgactgattctccctgagcaatgcccacctgcgcactgggaggacagggtggagcttcaggaagtttgcgctggttcgcagtggggaggagcctggcctcttcagttcctgggtggtgacctggaattcaatctgtgaggcaggaaacatgctagcgggactctctcttgctttgctgagagttatttttccattatccttttcacccagtaaattccattttcctcacccttctttatgtccgcgagccttatctttcctggtcgtatgacaagagactggttttagccaaactaaggagaaaattctgcaacggtagcaagagatagaatctattactgccacttcttccaaccctccaaaatgactgtgcattcctacccattaccttgtgatttgcaatgcttccagtgggaggatcatatattccttccacattaatggcatgtgagcaacactgaacagatttatgaaccaaaacatacctttatcacctctcttactctttttcctttaccctgagatcagtgttgtccaagtagagcttcggtttctgtcttggtcccagacttcatggagcagagaaaagctgtttccatagtgtcttacctgattttctagtcaacagttgccgttttataccacaaagttcggagtatttttatggaacaattaatggcagaatattaattcacttatatgtaacactgagcatgtattttaaatttgaaatatgttttgtttcttctgaaaactatatttgacaatagtcaactagccatgaacacagaaaaatttacaagtacattccccaggcagtcagctcagactgatactggctcaaggtactgaattttttttttttttcaatttattttattgtggtgaaatgcacataatgtagcatttaccctcttaatcatcttaagtgtaaagttcagtcatattaaataattcatactgttttacaaccatcacctccatacatctttataattattttcataataaaacggaaactccatatacattaaacagtaactccccatttcctccttctcttggcaatcatcattatactttctgtctctgtgatttggactactctaggatctcatataagggaaatcatatagtatttgtctttttggaaaccggcttatttcacttagtataatgtcctcaaaattaatccatgtagaatatgtcataattatacttttttctaaggttgaataatattttatggtatgcatatgccacatttggcttatctagtcatctgttgatgtacatctgatttgtttccacatattagctattgtgaatattgctgctatgaacatggttatacaactatctctttgagatcctgttttcaatttgttttggtatatactcagaaaagaaaatgctagatcatattgtaatttcatttttaattttttgagaaactgccatactgtttttaacagtatatatattttacaatcctaccaacagtgaacaagtgttccaatttctccacatcattaccaacacttgttattttctgcttttttttttttaaatactagctatcctaatgggtgtgacgtgttatctcattgtaattttgatttgcatttccataataattagtgatgttgaaaatctttttatgtgtttattggccatttatatatcttctttgaagaaatgttcattcaaatccttgcctatgtttgaatatgtttttttttgttgttttcaggaattccttatatattctatatatcctgtatatacatatacaggataaaaattctctctctctctctctgtgtatgtatctcaaatattatattttgcaaatattattttccattcttcaggttgcctttttactctgttgatcttgtctttagttacacaattaaaacaatatgaagtccaatttatctgtatttttctttgattgcctgtgcctgtggttttatatccaaaaaatcattgccaaatataatatcattaagttttgccctatgttttcttctaagagttttatagttttatgtcttatatttagatttttgatccattttgagttagttttgcatatggtgttaggtaagtgtctgactttattattttgcatgtgaatatacagttttcccagcatcatttattgaaaagactgtcctttctctattgaatggttttggcacccttgtcaaaaattattttttgacatacatctcaacatttatttctaggcttgtattttatttccttagtctacatttctgcctttatgccagtatcaggctgttttgattactatagctttgtagcaaattttgaaatcatgaaatgtgagtcctcccactttgttctctttcagtttttttttttttaagatatctgtggtaccttttaattacatatgaattttacaatagatatttctatttctccaaaagatgtcattgggattttaatagaaatggcattgaatctgtagatcactttgggcagtattgacatctgaaaaatattaagtctttcaatcaatgaatagaagatgtgtttccactaatttgtcttctttaatttctcagcaatattttgttgttttcattgtacaattctttcatcttattgcctaatttctaagcttttattctttgcgaattctatgcaagtgaaattattttattatttttataatttctttttcagattgctcactgttagtgtataagaatgcaattgatttttgtttgtttagctgaattctgctactgtgctcaattcatatataggactctttagagcctcctacatataagattgtaacatctataaaaaggaattttttttcttccttttcaattttgatggcttaatttctttttcttgcctaattgttctagctagaacttcaagtactatgttgaatggaagtggtgaaagcaaggatccttgctatgttcctgttatgacagtaaaaccttttagccctttaccattgtatagtatgtgggcttttcatatatagcttttatatgatgaggtagttttcttttattcccagcttattgatagggtgttaaattgtgtcaaatgctttctcagcatcaattgagatgatcatgtgtttttccctatcagtctgttaatgtaatgtattacacagatcaattttcatatgttaaaccatccttgcattccagaaataaatcccacttgatcatggtctataatcctttaaatatattgctgaatttcatttgctagtatttgttgatgattttgcatcagtgtttataaaggatattgattggtagttttcttttcttgtggtgtctttgtctgactttgttagcaagtaatgttggcctcatagtatgtgttacaaagtgttttcccttctacatttttcgagaaaagttggagaatttgtgttagttatttaaatgttaggtagaattcaccaatgaagccatcagatccaggactttttttattactgattaaatttcctcactagttgtaggtgtatacagattttctatgtctttgtgctttagtgttggtagcttttgtgtttttaggattttgtccatttcatctaaattatccagttggttggtatagaatttatcataacactctctataatggtttttatttttgtagaatcagtagtaacatcccaaatttcatttccgattctagtattttgaattttttttcctagtccatatagctaagattttgtcaatttagttgagcttttcaagaaaccaactttcgatttcattgattttctctattgctttcctatttttaaatttcatttatgtctatgtaatcattattattattttttcctttttctaccttggcttagtttgttctctttccattttcatgggttataaagttaagctgttaatttgagaacttatgtttaatgtaagtgtttctagctataaatttccccattagccctgcttttcattgccactcatacggtttagtatgttatgttttgattttccttagtctctaagtattttccaatgtcccttttgagtttgtctttgattcattggctgtttaagagaatgttgtttaatttccatgaatctatgaactaacttcatcctattgtggttaaagaaaatactttgcatgatgtctatctgtatctttctaaaatacatcaaaacaatttgtggcctatatatactctattctggaaaaattcccatatgcactagagaagaatgtatatgctgtttttggtagaatgttttgtatatgtctgctatacctagttagtttattgtgttgttttaatcctatattttctcacttagtttttgtctggttgttctatccattatcaagagtaaagtattaaaatctctaactattatcatgaaactgtttatttctcccttcaatctctatcctttgatattaatccagccactcctgctctctcttggttactatttgcatgaaatatcttttttcatcctttcacttttaatctatttgtgtcattggacctaaagggaacctcttgtagacaacatatagttgaataatttttaaaatctattctgtcaatctctgttttgtgattagataatttaaaccatttatgttgaaagtagaattggccctctgtatctgtgggttctgaatttgtgaattcaacaaactgtagatcaaaaatattaaaaaaatggatggttgcttctgtactgaacatgtatagacatttttttcttaccattttacataagaccatttctataccactttatataagagatgttggtgtcagtggaatttggtattaatgggacattctgaaaccaattccctgtggatattgaggcacaattgtaatcactgacaaaaagggacttctaacattttgctatttgttttttacagccttataggtatttatttcttgtgttaatgtctccttttatgttgtttattctttgtaataaaatactgaaattcttttttattccttttgtatatattctacaactatttgctttgtgactactcaatatcgtaaggatataccactctaatttgaatatatatcagattaatttcaacagcatataaaaacgcttgtcctttagcgctcttttccaacatctttcagttgttggtgatatcacataattataacgttacatactgtgtgtcccaaaacataaagtaataattcttttagatgaattagtctctctaattttatagaaaacaagtgtggaattataaaccaggttacaatcatactagcttttagactaataattgtttttttaaatatattagccttatatcttttttggatatttatatttaggtttattcaatacatagaatattattaaaaaacaaaaagtggaattataaaccattgtaacaataatatttatcttataattgctcatatattcaccttgactgatataattacatttcttttttattttttttaagatggagtcttgctctgttgcccaggctagtggggccatctaggctcatggcaacctctgcctccctggttcaagtgattctcctgcctcagcctcctgagtagctgggattacaggcatatgccaccatgccaggctaatttttgtatttttagcagagacaggatttcatcatcttgtccaggctggtctcgaactctggacctcaagtgatctgcctgccttggcctcccgaagtgctggaattacaggtgtgagccaccatgcccagcctcccttgagcatttcttgaaaggcaggtctagtgataacagactgtcttagcttttgtttgtctagaaatgccttaattttctgcttacttttgaaaaacagttttgccagatataggagtcttagttagggggaaggaggaaaaaaactaaaagtaaaatttttagattatttattctgtaacttaccaaatgccaacaaacataatatggtcatgtcttatttctatcatttataatttaatacttatattaatatttgtttgaacattaagctaggctttgtgttccaatcttattgaatgccatctctagaaggtggtgtatttttattgattgaccattttattaagtggcagagaaatacattatatttgtttttgttagatatttaactttttaaaaagcatcttgcatttatccatattcatattgctataaagaaataatggagactaggaaacttataaagaagggttttaattggctcatgattctgcagagtatacaggaagcatgattctggcatctacttgcttctggggcagcctcatggaacttacaattacggcagaagtcaaagggggagcgaggcctctcacatggtgggagcaggagcaagagagagagaggggaagtattacatacttttaaacaaccagatctcataactcactaactattgtgagaatagcaccaaggggttggtactaaaccattcatgagaaatccacctcatgatccaatcacctcccactaggccccaccttcaacattggggactacaatttgacataatatttggtggggacacagatccaaaccacattattctgcccctgacccccaactctcatgtccttctcacattgcaaaatacaatcgtgctttcccaacaatcccaaaagtcttaactcattccagaattaactcagaagtccaaagtccaaaatctcacttgagacaaggttagtcctttccacatatgaaataaaatggctgtgaaataaaaagcaaattagtcacttccaagatacaatgggggatacaaacattgggtaaactttcttattccaaaagggagaaatctgccaaaagaaagaggttacaggccccatgcaagttggaaaaccagcagggcagtcattaaattttaaagcttaaaaataatctcatttgactccatgtcccacatccagggcacactggtgtgaggagtgagctcccaaggtcttcagcagctctgcccctgtggcttcataaggttcagccactgtggctaccctgaaggcctggtattgaatgcctgtggctttttcaggtgcaggatgcaagctgttagtggatctaccattctgggatctggaaaatggtggcgctcttctcacagctccactaggcagtgtcccttggagaactctgtgtgggggatctccacatttcccatctgcactgccctactagaggttctccatgagggctcagctactgcagcaggcgtctgcctggacattcaggattttccatacaacctgtgaaatctagacagaggctcgcagcctcaactctttcatttttcacacccagaggcttaacacctctgggtttggaagctgccaaggcttatggcttgcattctctgaaacagcaacttgagatgtacctgggtccctttgagccatgactggtgctagagtggtcaggatcagggagcaatgtccccatactgtgcagggcaatggaagccctgggcttgtctcacaaagccattcagtcctccttggcctccaggctggtcatgggaggggctactgtgaagatctctgaaatgctttccagtccttttctccgttgtcttgattatcagcatttggctgataacttacgtaaatttttgcaacgtgcttgaattccttccctgaaaatggtcttttcttttctaccacatgtccaggctgcaaattttttaatcttttatgttctgctttccttttaaatataagttccaacttctggtcatttctttgctcatgtgtgtgagtgtagattattagaaatagccagataacatcttaaatgctttacttcttagaaatttcttctgtcagataccctatattatcattctccatgttcaaagttccacagacccctacaacaggggcacaatgcagccaagctcttttctaaggaataacaaaaatgacctttccttcagttcccaataagtttttcattttcttctgagacatcatcagcctggacttcatcgtgcattctaccagcattttggacataaccattcagttagtctctaggaagttccaaactttccctcatcttcctatcttcttttgaaccctccaccctcttacagcctctgcccgttactcagagactaacagaagcctctttcacccctaaagaagaagggtgaaaggaagattctctaagacctgatctaagacctagtaataaggacaccaggctggagctgtatctatgaaaaacatgtcagagatgccaagtgaagcagacaaggaatgtggataaagaaagtaattccatgcttctcctctctttatttatttattttttttccaattttcctttcagtgcttcctatggaccaaaccaacatgggaatcaaggagcacagaagtctgagaaacacaatttgtagtgaaggagtgaggaaaagatctgagggcaaaatgacaaataggctcataccctaaatctaacaaagaaacacatggaaactgcacgtttatgcatgactactgagcgagaacaagataattgaatctgtttgcttgggctcacttagcgcgtagttgcatttataacttacaaatgcctaaccaaattgcaagttggatggagagtgaggcagaaggtcaattctgccccagcgacttaattaattgaaagcaagaaaaaaatgaaggcatatagcacatatgtagagaaagtaaaggagaaaaggaagctacctttttctgtgtagggggtaagaacatgctttcttttgcagatccacgaaggtgaaaatggaggagggcttaagaacagggaagagctggggcatggaggaggcaaagagaaacaggtaaaattaattccttcaaggaaaatgggggtggaagtaacagtgaaaagatatttattggctgaggcaaattcgtgggctcaggtgtaagctgttctctcaacacaacatatccattgaatagattcatttacttactaatcaatgctcaatacactattcttgggcacttcggttattcttccctttatttttcatttctttgattatgtttgtttagaaattttcccaaatgtttgtttattctttttccaaatgtttgtatgctttttgaataacttaaagttgtcaatttttcatctattgagatattaatgattttcttatgtagttgtatatatcctttatattacatagtgaactttttaatatatattataaacatttattccaattttattttgacttattttaattaatttttatattgagaagcttaaacatttaatagttatatttttgaaatttttactgtcttccacattttcatgtaaattttgatgaaacataatatacatatagaagagcacatatgttacaaatgtgtaagccattgaatttttacaaactgaaaatataatcagcatttagctcaagaaacaaaacatcatgtagtactcccagaggtcttcttgctttcctccagtcataaatcctcatctttggatggggtaattgttattttgatttataacagaatgtattaattcatcctgttgtgtttagataaatagtatcaaacaatagatacacttttatgtctgatttcctttgctcaagatatttatttcattaatttatactattgattatagctgtatatcatttagtttcattactgtatgatattccaaagtatgactatccaatttaggtatctattcaactgctgttgagtattggagtattttccagttggggctattatcaatagagtttctaggaacatatttttcagtaaatgtatttctcttgagtacatcctagcaggaaaattactggatcctagaatatgcctatgctcagctttagtttttccactgtttttaacagtataaaagttggaaaaatatctcttttcatttccacttcctcttttacttactgtttgatattatatcaggatgtatttttccaaagatgtccataacagtatttctcatcccacatgctctttgcaatatgactttgccaaccttccatcaaattgagtggtctatagccctttctggtaaatttgggcagagaaactacttcaaaatagaaagtgaagaaataaacatatatgacttctgagactatgtcttagaagttaacagaagttctgccttatcttcctaatcacttgatgtttagtcctgaggctccatgtaaaaagtccaactaccctgaggcttccatgctgtgaggaaacccaggacctgtggagagaccacgcaaagtggccctgatgggaagcatcaactgaattcccagtcaagagtcagactaatcaatggagacctccagatgattctagcccccaaacaccaccacctgttcagccttctgatgaggtcctgaatattgaggagttttatatctctaaatttaggagtgatttgttatacaggaagtataactggaacaatagtttaattttaaattcactaatccacttgtaatttaactttatgtatgaggtagtaattttatgcatgaagtagttgccttttttatttcatataattatatcactgaccccaagtattaaaaatattttcttataataaattttaatgctttaacttcttctttttggtatattatattctataaaacctatttctgcatttttttactgttccattaatcatttatctgtctacaaatatgtaagtatcatactgtaaaattatttagtttttattatatatatttttttttcgagaaggagtcttgctgtgtttcccaggctggagtgcagtggcgcgatcttggctcactgcaagctccgcctcccgggttcacgctattctgctccgtcaacctcctgagtagctggggctacaggtgcccgccaccacgcccagctaattttttgtatttttagtatagacagggtttcactgtgttatccaggatggtctcgatttcctgacctcgtgatctgcccgccttggcctcccaaagtgctgggattacctgcgtgagccactgtgcccggcctactatgtgttttaggataaaaggacattacccttattacttaataatttttagatattttctttaggagtcatacttgttcattacttcaggtgaatatctcattcttgacgaaacaatcaattttggttttcttaatgtcaaaaaatgttttgtttattttaataaagcattaaagccattatgtttaaattgaaaataatttttagtaagtaatgaacctaagaataatgtaacatattctgctatttaagaaagtataagattctgcctatttttatatggttgtgtaaaacaggagatttaacacagtcagactagatgaccattgaggttttctactagctttaaaattctaaattgatatacagtgaatttcccttccataaatagcagcttcacattaacattgtaacattggaataagatccctccataattgcgcatgtttagtagatcctcaatcctgggctttgcttccagtagtggttgctctcttatgcttaatttcattcttataattttcaaaattttgtaaaaccaaggctgagggagatagtaagcagctaattcatagagtaaagggttcctgtcaatgacatttatttgcttttacttttaatctttatacaactctaaaaaatgtatatattttttattaacaggtgttctgattatcacagccaagtattaggttttatacttcctttaattggtagaatgtgttattcaccaccccgtaatcaaaagtactgattctaatggggtgtagaggagaagaactcctttaataatccaagagttcttcactcctatgtgtgcagttaattaatttatttccctcgtggaaatcatagatttttcagttcactgtccatttccactcaaggtaaaaacataaaggtcagcaagaaatggttaatgaccagaaaggctgcaaactaaggaaatttagaaagtgtgaaattgtacaatttcataagtctgttatttaaaaacatatcaaagtttgacaaaatgctcaaatttgccaatacatgacatgtgagtgatctaaagtagatttttgcctggtgtttttttaggtataaagaaatatgtaattcacaggaatcagtcgagacagtacaatgttggatgacagacagcttttgaatatataaagttcagcatttccccaattgggtttaaacagacttcccctaggagcagtttctgccatagagtatttattaccttgaataatgtgacagaaggaaatggaacaaaggaaatgatttttaccaaataaaagcagccatcaactctcaaaagataaactgtccatattttaggaagaatacagttcagtagaaaatactggtgttaaaagtgggagttgaacaatgagaacacatggacacagggaggggaacatcacacaccggggcctgtcggggggtggggggaaaggggagggatagcactaggagaaatacctaatgtagatgatgggttgatgggtgaagcaaaccaccatggcacatgtacacctacgtaacaaaattgcacgttctgcatatgtatcccagaacttaaactataataaaaaaaaagatatatatagagagaaaatactggtgttttaatgacaatttggaaaagcagtttttatttgcactgtgcaaagcaagcacacatatttagtgtttcaactcaaatatccacagctagatgtctaaaaattgtaaaaatccacaaaatggtcttctttttgttagctctgcctgaataaacaaggaggccaaactccctaaacacagtttctcagtacaggcaggaacagtaaataagagtggctcttagagaaactaaggcaaagatgaaagctcagggaattccagtgggctactagaagctgtcgtattctaccttgctcttcgaagatagggagcctaaatcaccgtcatcaagcttcaaggaaaatcagctgctggctttgttcttgggaggaaacattggttttatcctaacccccaaatctgaaagtggctcaagattactattccatagaggaaaaagcatgtaacaaagaaaagctatttttcagaagctagagcagaaaaggagaaaacttgttgaaaattatttttctgtctctcattttttttttctcttaatggaaagtgtgtgtctcttttctgatccaagataggcttattaggtttgtaaaagagaaatagaatgcttctagggtgggatggagagaaaatatagatgcgaagtcaagtttaaggacctgcacattgatagattcaagtgccctccccctgcgtatcacctacttgtctaaaatttcaaatacccctttttatgtctaaaatcattcttaaaaatattaaagtctcttctactttaaagcaactggggtttttattgttaaattatattattgcttggcaaaatcacatggcttacatttattgtcaagttgctcaaatgcacttggcatcagaactgcagttttgtctaaaatctctgtggttgattttgaagatatacagccttgattgtaagactagtctttaaatgggctgattctccactgtgcagctgccgctccttttatggcttctgagtgtattatattgcttacagaaatggaatgttcagaggcaacaagagataacgtattagaagccatgtagatcagcatatatgtatcaattttcaatgtgatttcagagtactgctgcaaaattccgtgcaatatctcatattaggtacctgtagaagtcaacactcatataataaataattcaggaatgctaaaaattattatgcacttagacaagtaaccagtaaaattctagacataagaggaagcaatagtaatcaatgtcatttatgatatcatcttcctcatggagatattcatggctccttggttcattgaataaactctctggggtttagctttattaacataagttgtcataagaacacttatctcaacctaaattggaaaaatggaaatgctcaaattaaactcatatttaacatatgaaacttccagacaacattccgctgacagtgaatataattcaaatatattatattttcttatgtttagtagagcttttagctatctgtctcaaacatgtgaaaatgaatcattttatttttggccctgcaatttaaatgatgcagtgaagaagaatcttaagttttttaagtttctcagcaaaataaactatttattggtcaagaggctcataagaatgcttttcccaaaaagcttcattttttgagaaataaaaataaatctcataatttaatatttatttttcacaagataaatcatcttttaaaatatggctctgtattttgaaaagcccatctttagtttaacagtgtctgattctgactccgtgagcttcaaccctcacttagatcaagtcttgggcataagtcatctgttgtctagggcaatgtcttctcctaggagcaagagctccttatactgcgaaaagctttttcatacttgctatccttccctcatacttttccttactttttgattcaactcacatcatcctcttcagcagtcactaggacaatcttttgattccaggtggaatcttttgattcacaaaagaaattattttcaaaaggaaactccttatccctatggggttataagacagccagagcgaaatttctattagattaataaacttgtttacagtctatcatcaggtttccatgcagttataatagttgtgatcctaagacactgaaaccatgaaaaaaaattgatgaatatatagtttagataatctctctactggtattcacatgttgtttctctatatatatttgccataacccatatccactagtctaggaaatacagtttgtagtagaacagtgctgtcagcttagtaaaaagtcttaacaattctatttttgtgaaaaagatgcggtgagaaggattcgtttctttttatttgctatactaaagatattctttctttatagttctgtctttatatttatcagtgtgttggaatgatatatttacccaaaatgttaatattaaagattagtgaacataaaaataacccattcatttagtttattaaaagataatataccagattagaataatagaacattatctacaaaggccaaatcatcaataagtgtctaaattaggaaaaaaataataaggatgttcataagtgatgatgcaatttatgcttttgttattgacttaaaccattttatttattaaaatgtctgtatttcattgaggtacagactctaaaattaaaaatgtggctgacctatacaggagttttagaatttcacagccttgcatttcacagaagatgtctagctgctacttccataccctgactctgtaatgaacacataagttagactttcataaagatttatctttaaaaataatcatgtagattgaaccctgactaataaaattcactaattgtcttgccttagtgcagctattggtcagaattaaatatttagcagctccatctttttaaggctcttttccagtgtttctgtagggacattggtgatgtaattggttgctttggtaaggaagtaactcattgagtcactcagggttctattatatgacaataggatgtggcaacggttagggagaaacatttatctgctctttcattcacagagcaaagactggggaggagactgactgttagctctcttagggagaatattgcataattttaaaagaagatagctagtgggttatgagtatgataagtacaaacatttctatatgctttcctgaaataaatgattttatgtaatgatatataaaacctcactgatatttatgaataaatagtataaatagtaatttataaatagtaatgaataaaacttcaatgtagattaaactatgtgtctcatttagttactgtgatagcaagattatagaacattgcagatgacatgctttttcataaaacacactatggaacaacaacatctccctccaaaaacaacaacagcaaagtacattggcttattaatgcatttaaataactgagtaaaattgtaaagttcatacaaatgtcataataatgtagaatcccccaaaatatcttacatctgattattgcaagttcttatagcagaagcaagatttacaagggtctttacctgttttgatctgagaaaaatgttacttaggttttcctcgctatttaaaaagagaagtaaattgttttatttttcttccaaatgaaaaaattggtaatacgccatttctattctctgagaagtgagcatattttcatgtggtatgtgcttcctttagatatgcatcaaaacattgacataacatgcaatttaaaagcatctcttgatgcactacagtgacaggtttaattcatattcgttgcttacatatagtactataatgatgtaaggttaaaaacaaacagtctatgtaggttatttcactgatgtgcattttcctggggaaaaatttaaaatttagcaaaatggctaattcacttgcattattttgtttgcatcattgtctttttgtataatttaaatggacaattgataaagagcaagctcagccaaaactgcaacagatgttgcccgtcatacttgtgggctggagaccaaaagccctttcacctcttttacagacccttgagaataaagtaattgaggaatttgggaggctattgattgaaagctctgtggtatctccccatgtgcactgagaccaaaaaggcacatagagaatgagcttggtctttatttgctttgcaaagtgactcaaataaagagattagagggaaggggccattgtgtcccaaatttaggttgatacagatctttagttcttagtatttttattttcagattgccaccaaatgagaattttaaagaatagcaacctctacaaaagaaaagtagtgttattttcttatgagaattaaacagaagcaccataaacaacctgctagttcaaatacatatgctatagtgaatattttttgatttaaaaaaaatcctgacccacaaacggagggtttgaccattaattcgatccattactttgatgctgcaaaatgctttttcaaggataatgtagagtgaaaaatcagtgaactgctgtggtcttaaatatgagccataatggtatatggaaactcgtctttcttgtaaaagttgttattataaaacccggttacgtttttaaaaaataaatgttaatagatgaactaaataatttcctttgactgattcagatgaagaatctcaattttttggcatatttattggtaagcaggtaatatggcaaagtagaaaaaatagcactagtgagaagtagtaaaaggggaaacagtacatacctattaaaaaatagaattttctaagcaccaaatcagacacataaactattttaaatttattcttgtttaagaatacttaaaaatctctgataagagcagagatgtaaatgaatatctttttgacatacaaaaccaatatgtgaataaaactttgctgattttctatgtaatacaaatcctttaaaaagctaataaaatgattactatctacaatttaggctccctgcacatgatgaaatgctgaagcatattctaatactcttagaaagtgcttaaaatcttcaaaagtggatttaagtgctcaatcactttcgcttctttatggaaagagtgacgaatttttacatatagggtacccatgtgttgtttacttccaatctgtgaatttcgaaagcaacagaagtagaaggaaaaaaaaaaattcaggaaggcatatcctgtggatccgccttcttgacacataatttgtaggtcttgatgtggctgcattgataaaatgctgggcgtgtaatgaagtgaaaataaaggctgcccactgcctagctttcgaacaaacttagattggctatgtgttcacaaatcaatgcttttctcattgaaagataatacattttggtaatgctggagaagttagaagctagagaggtcactgcagggggttaaaggaaagctacaacagtagtcagaacagcaattattcctaaaataacttggtttgacaaaaggagtaacagtgttactgggctagaattacttttttactttattatgcatattagtaattagaagaaaatgttggcagaaaccaaaatttggaaagagaattttcttgggctgtctttctatgataataaaacatccaaggcaaaataattagtcagttttgtctatacggtgccaaataacctatatcaagtttacacaaagccaaatattgattatttatgaatgcttaatgtgaatctgttcatattcagaagtcaatctgagaaaaaataacaacaaaaaattaggtaccttaaaaaaatttgtgatatacaattgataaattagtaatcacttctggggaataatttcacttactatttgtgcatgtagtccctaaacagcccagaaatagctcaaatcttctagtttataacttaagaaaaatcacgtaagaaaatcccaaataactgtaaacagaaagcagagtagaggtttgctaaatctctggacaaccgcaacgttttctcaggactgctatgaagacatttcttttagtcttctcatttttttttaatacaaagtaatacttcatacacaaaattatgctaattcctggtcatgcttctatacaccctctttcctttttttttaatagaacaagtatctcatctgcttgtaattggcatgctgctgcctttttgagacctttgtccactgaatatgatatcatattttttttttgttagaggagagcatcttgctctgttacccaggctggaatgcaatgatgccatcatagctcactgcagcctcaaactcctgggctcaagtgatcctcctgccttggtctcccaaagggttgggattactggcataagtcagtgcacctggttggatattatttctattaacaccgagacaccttcaaataatcagtaagcaaccccaccaccaataataaaagtactttttaaaatcttcaacaactctacattgcccaacagctattgacttccttctcctctttacaggaaaacctttgtaagagatgtgtacacttttttctccatttcttcaccttttgttcaacttttttacctgctgtgaaatggcttccactgcctaaatttcaccaaaactgctctttccaaggtcaccagtggaatactagttgctaagtgtaaattactgtttacatttttttctttagctctctgcaccatttaactctatacaatcctctctgttttgaataatgctatctttcctcctgagattcagtggtggcacattctaccaacttgatcttacttgtctgtttacttcttaatactatttttattttagactcttctctcttgaatattagttcctacatgattgattctgccttagaacctcttcttatcttactctataactcttgcaggataatttcatctactcctagtgcttccatcatcatctctttctaatgattctctatattagtcaagaatatattcagttacaaacaaactaaccaacaaacacttttgctactgtggcttaagtaagagaggatatgctgctgttgtcattatacttattattattatataatgtaaggtctaggagggagacagggcagggcttatgccaccatctcaatgtttccctttctatctttcttgtctgtcatccacagcatctagtatttttgtcctcaggtttacattttagagttcaggctttaggtctaagttctgaactttataaaaggaggaaaaggaagaggagtcacattagaattttccttatgtcttactggccataactgtggcacacgctcattcacacctttattggagggtaagaaatcaagttttcattttaatagcttctagagtagatcatgatgaaatagggctaaatacgctatttgattcaactattctacaatgtttgctatcttcccagatatttcttctgatctatcttgatcactcctttgacctccagactatctatctatctatccacacatacacctccagaatatccacgcattcacacacactagcatgttcacaatcacatgttgtcatttggctgtcccttctacaactcgggcttgacactacagttaacacttctctgtcctaaaacccacttgttaagtcctgacaatcccacccctatcaattctaatactttctatttccactattaatttctgtttgaacactatcttatccactacaaaaactgtttccagaatttttttctccttaaagtattatctacataacaactgtaatgatctttttatatagaactctggttacagatagagatactatgtgtctgtgtttctgtctttctttctctctgttgatcataccagcaataggagacattctccctgtcatttgatagctaaatatcttctgtgtagatctaattctctgtgacagggttttaaggtctacaggtggagcaggtaggaagaatggccagaaggggagaaatagaataaaaactctgttttctttttcccttttgcttctggatttaactgctttttctggggagcctattcctttgaagttactgtgtactgtactatactattcataaattaatcataagtcatacttaaatcttcttttggctcctttttatcctcagtttgctcaaacttagagaaatgagtgattagcaccctcaatttttcaaaattttctaacctgaatttagttcctaagtgatccttgcatgtttgaatggtggcggaaatgtttctaactcctttccataattctcagaaacattctttctctgtgttccctaactcagttggggttgccagacttagtaaacagaatattttaagtggcaatgcaaaccccattgcattgcctaacacctatccaggttcctaaggtacaaactgggtatgactttgaaacttttctttgctcttcgctttcttttcgttatttttcctattcttcctatcaaaatgctctcagatgcctctaattcttgttttcttactgcccaaaccctcaactaaactgtcataatctctctcctgtcttatttctggaacttcttagctgctttctctgcctactgggcttacttcattccatttctctatactgtagccagaaaactcttcccaaagtgctaatctaatattacaattttatttgctcttttggatgaagttcaaacaccttacactggcacgtaaattcatctgtggcatgggctttgttcatttttctagaactttctatcagcactgtaaagaataaaagaattggaattaagcagtaggagagggaagtgatgcaaactatttcagatcaaagaaataatataggtgagagagagcttggcatattggaagatgtaacaaaaggtaaatatagatggaaaaggaggaaggagtgggaatgaatgtgggtgatggaagaatacagtcactgattcccaggcttttgcaatctagagtctttttttcctctgggaaacttgccatcagcttagaagaatgggttaggtatcccttttatggtttccaatagagtcttacccttttccactgcatcccgcactgcattctataggaactgccagttaagctctctgccaccctgcactccctccccaccagtttatgttcttcatgaagatagggccgtatctgtcttatttatttatcctcaccactttgcacattcctttgattcaaggtactcaggaagtatttgttaaatagatgaatgaatgcatttatctatcaggaaaaaaatctcattatgttattcctctgctgaaaacttgtttaaacttggggtctcagaaagcaaaatgtgagacaaaaaaaataatctgctatagttttattaaggaatgtaactatagaaagctcaagtgaggaaaaaggcaaaaagtgaagtgagggaagaaaggagagccaatataaaggtgaaagctggctaccacttagtatcaagagcagctgtctgcttaagttcatggatttcagaagctgtattaattacagggtttcacagccattcttcttgggggacataagggaggagaatatcttccaccttctatatttcactagtcaaagtttgtcccagtactgtttttagatataaggggctgttgtttggctcctacattttgtagagttccacaccatttacttccttctctggctgggccttcgcccacaaattgaagagttcattcacctgggggattgtctatacaaaatacatgcccggtcagaatgcatgccctccttttctgaccacacacactctgggtacctggaattcactgcccaaatagctgcaacgacaattcttcttcagcttgcacgtctctttccttagtctaccctcccatgacagactaaaaaattggtttctgtacctccaagcctgagaattagccaagaagcagctattggtgtggtgcatggacccagcttgaatgtatggtttgagtgttcatacaggtacatataaggccactcacagtgcaaagctgctgagctaatcaatggtagagagggaatgcaagtgggctcataagccctggacagtgtaatatgtttttatgctgtggtggcttaaaattcagaaatctagaaattctttgacacatttccaaattttgaactaatttgttacaaagcaataggtaactgatacatgtacaaaacaacaaagagtctgaacatttttatttcaaattgtccttcacattgttattaaggtaggatgatggaacatatttaagagcttgttaggttaattttcagttcttagtatttagtacctttagatgtgtggaatgacgcatccatttgtactcttgtcctctaaggatgggcctaaccttccccacattcttggttgcacttcagaggcaacaatcatttcctgtgacatgtcgtgcttcaattacaaaagggaagccatggagtgtgaggcaaaaagcactcagtgaaggcttgaaacttcatggtttgtttcaaacatgaatacagttgttcgcgtgtccctgtgtaaaattgttctgaacccacacaaagttgatctctgcagcagtagcttggttggagagaaaaaatggcaggaggtcccagagataagtcagtccagacagatctgcagtggtatagaagaagtgactgatataaaaccctttagtagtcacccatgaccctcaatataaagtccagaccctttaagatctgggtccctctttactgtctgtcttcctctaatgacacttctacatcatgttataggctccagcaacatcgaactacttttgattgcttaaatgaccacgctcctttttttccctctgcacttttgagtatccctttaatctttcaaaaatatttttcactccccttctctcttagctaacccctatcaacaacaaaccctttcagaagccactgtgataccttcataactctttctgatgttctcattcattcttccgtaacacactgcacttatgttattttcacattataatgtaaccacgtggttgcttacagtcacaaaaactaaaatctctttaagggcagagttggtgttattcattcctgattccccagtgacaggcattgcacttgatacttgaaacccatatttagaatgtaaaattttagtgagcctatggaatgattctgtagaaggatttggattgctaaaactctaggggaaaagtgtttgcatttccttttaaaaaatactgtctgagaagtaaaatacaacaaagccagtaatggcccaatgtcttattagtgtacaatggtgttttaaaaagaacgtctttcagaggtactagagatactatcaaatgtgatgtagcaattactatcttaactacaatacatggtgtaaatcaatggtgacattaaatcttgtctaaatgaccagaacatgagctacagctgtctttgtagcacatatttttctttggttgatttcactcccttaaggcttgtagtttgtgaacagaggtttttaatgacaaaaaaaatcagggatcattttatttcagtctttcaaaagtgatctccctaggaaagcctacagtctagaagtaaatacctagtggcttacaaacatattttcaatgactcttggagtgataatctagtagaatagaattagctttttatccatggtatacatatttttaaatgtctcaaagcagtaaaatagtgaatcctcatctttgttttgtgatttcagagatgcctaaaaaaccgcaaatattcaaaacaaatatgtttaatttcctgagtatttttaataggctttacatatggctattctcagagaaagtgatgatctaataagtaatcatagagctcaatttaaaaacattttggaagcattgatattaaatgtaattgctcttcttctgtcccaaagagattaggttaaacattaaaatccaaaagaaatatgatattcacttgtgtctttcttcccttaaataaataattacatagctcacctttatgaaagtactctgcataaacatcatcaactctaaatttatgaatactgtaaattctgtgaatctgtgattctatcactttttttttctggtagcctttctagtgaacacatcatgttcttactgtagacgaggagaggaggtggcgacaaaatgctcatttcacttgagttccttctatgatagagactgtatcatacaccagaatctatcccttttgtagttctaaacctattgaaaataagatttaaatacagtctttttttccatccaacttgcatgttactttttttttctcgatgcaggtaagtgaggttcgattaggtccttatatcttaatcgcttatatcttctatggttacatatacactttagtaaacgtcatttctttttccttttaatgttgtctatttacatgtgacacttgctattcccttatttattttacaataaataaattattaagctattcaaacttattttctgtattttatattgttgcacctattcttattcctatttatcttaaacttattagtaacctatttcaaaggaaagtaaatggaaaatagcattcacttatttgaataacaaatggagcaatgaagaattccaggtataataacattatggatattcagtttttggaaaaacattaatgtataagaattcaagttgtggcaaaatttaaggttacattctcagtaaaccacagagatagatagagaagtggaatccagtgatgtgactaatttagtttctatggcttccatatgcccacttgttatacgaatatttaaaatctgtgttgatttttcaaagtcaaaaaaccttagatgatgctttaatgaatcttgtatcatgggaagagaagggaggaaattttcaaatgccagcacaaacaaacatgaatgctatcattgtttatagaggagggaatcacattcttttatgctctcagtattctattagtaaataatcaatgtaagtcactctctccctggaatataattaaaagcctgctaccaaaatacaagagtgttttatgtatggatatagaaatacgtattctcttaggaataagtgatcctctttcccgttttccctaccccaataaaagagtcttaatctgaggttatgtgcactggtatattcctgtgagaaatgacattttaatgcataggatcctaaagagtttttctatgttagcttgaaacaggtgcaattaatttgtgatcctttcaattatcttgccctaaatgcatgcatttaactggagtatcagtgtagtgtggagcaggaaaattgtagcttcttgaaatctctgttgtattcagatagctggtgtagattcattaggaaaattaagaaaaccagacaggcaattttccaaaacatattctgtcatttgaggtgagttgactgccctccttttccctgccacttcactgcactagtgagggtggtttcatatgatgcagcacagttcccttttaagatgacagggtagaaaatctctaggggacttggactgccaaagccctcaagacctcttcaacatgtccaataaacacacagatcagtgaaccaagagataatagatagaagtctccagcaaaaacagaccattgtagattccatggtgggatcttaaaaggacagaaatattgtagtgactaattcaataatttgcttcatcatgtacttcagaacaaatgcaattaaaaaaactgaaaaattttaagaaatagatatttttggagtgttcaggaaggctttttttgaatttccctttgtttgggaaatataagtttaattaacttttttttttccatgaaataactccaagggaaaaatagaaacataagtagtagctgtcaatgtgcctgggatccctttgcttcatacacatgttcagggcctgtctttctctgtttctcccacttcctcaacttcttttacataaattgtacacggtagatgggagaggtgtttcttttcatttgtaacatatatattcttttgttaattcctggtctagtttaatttatttatcaaatattctattaatttgctcatttcgctattatcttagttctagagtccttatattcaaaatattatagttcaactccctggggaaacaaagacccaaagaggaaggatatttcaatatcacatcactgataatggagattctaggactagatcccaaggtttgcttccatgatgagaggtttgaataactgggttcagggtccaggtctgtcttttcacctctcaatgtcttagttctgcatttataaaataaggtgtggtggctcacacctgtaattccagcactttgggaggccgaggtggacggatcacgaggtcaggagtttgagaccagcctggccaacatagtgaaaccctgtctctactaaaaatataaaaattagacaggcatggtggcgcgtgcctgaagtcccacctactcggaggctgagtcaggagaatcgcttgaacctgggaggtggaggttgtggtgagccaagatcataacactgcactccagcctgggcaacagagcaagactctgtctcaaaaataaaataaaataaaataaaataaacaaataaataaggatggtaccagctgttttgcatactcacaaaaaatgtagagaataagatatgatgatgtatgtgacagtattgagtaatggtaagtggtggtcaggtgtttgcaatatttaaaaataaaaagtgatacaatcatagtacctggacagccctgctttcctgaaggctgctgccccgagttgaataacttcaaggaattttctatggtagagtctggtaatctcaaattataaaacagatttttcaagcaaaatggacaaaagtagatctgtttctcattggcaaactcttattacttagtctcagtggcaaagttaaagtttttcagcttagaaagggaactcttaatgtcatctaatttggaacacctacattagtaatactggcatattcctcctgtaggtaaaaccatagaggaagtgaaattacaatcccaggctttcctagcagtcatggagtcagagttatgggagtcagttaaatgaatcaaatgtttggtgctatcagggatgcatagttttttggctccatttccatgaatgtcaaacaatataaatttattaatcagttactgtgtgtcagtcattgtactaagtactttggaagaattatcttatggaatacttacagccatccttggcagagaacaactttattatacctatttggcagaaaaggaagcaaggcttaggaagactgactgtctatcacaactccagtcatatttcccatgcctcccctgcatgtttgctggcctccaaccactctgcacttctaccagttcttcgaacacctcagcatcctctcacttctaagccctttcactcactattgtctctgctaggaatgcccttctcacggaggttctcatagctatcccctttgctttccagtgttgacttcataaccactcatggggattttcctagctcatatttaagatttccaatatagccccacctaacattttatataccccaaacctacgttattcttttcttacttactagtagaaaacatgctagataattcacttacatgtgattttattgggtatatctcctattagaaaaaaagcttcacgaggatttttatctgttttgtacactactgtatccccaatagaccctacctgactctgtgaatgctcaataaatatttattgagtgattgaatgaaaccacggcccaaagggatagcttgagtggggaaaccatccaggccattaaacattatttattccttctgtgagcagtagaaagggccagtattactgacattgctgctgtgatcttcctcaggctatgaaccttccattactgactaccccccaattaatggatttttttctttcactttcagtcttctcttgtaatttgagaaacagcctttaacagtactgttttacaggaagttctaacatgagaagataacttaattaaggcaaataacacagtaaaattgcttaaaagaggaggaaaattttcatatgaaatcatgaaaaaaattggatttttacattttgaaattgacaataaatttatttcatcttatatttaataaaatatctcataattgtcattaagttctgtcttttcaaagaataatgaattaaatgctattttctataaaaatgtatgataatggtatgacataatggaattctttactttatttggactttgtcaatgtgactgtaagagattcatttttataaaagtatttgaggttaatttatttttttcaaggtcttgtcttgatcttttaatgtcttaatactttccatttagaatgttttgtgttattatccccgttgacttcatctttttctctttatcacttttaatttatctaactgctgtatcttcatctccgataccatgttcaaacatttcatgaaatccttcgtttatttttattgtattactgtgtattaatagatgctgggcagaatcaaccagagactgagtgctgaaggtagaggttagacagataagataatagcagagttaaagagggagggaggtgttaaatatattagtaaaaaaagttaagattttttttctatgcaacttcaaagcatagaatcagttgctgaatgttctaaaaatacaattcctctagtgatgtcttgtaaaatttttaaagggcaattcacttttgctcttattttatccaagagtgattatcatgtattaagctgctattatgtgccaggtgctatgctagcagttatatgtgtacattactctccgtgataatttagtaatcagaaaactgaatctcaatactcagctaccaaatgatagacattctctcaaatgcccccacaagctcctagctcttccaacacagggttaatagatgaggctactgatagttgttttttttcttcttctgttgttattttattattaattttttttggaagagctctgtatagaaggctgctccaccaaatcatttttctcattagtttgctgaaaattcccttattaaaggttcatttccccagatttatgactttaaaatttcaactgtcccctgctttatgccaaagaccagtttttaacagccgagtataataaaatagcaacggatttgacccttgaaaccttgctttcaagtatgagttatttaacctctcagtctacttcttcataaactgaggagaagaaattcatcagaagactttcaatgaaactcagaggaaaaaaaaagtgtgtaaaactgacatggcaagaatatgtaagtcattatgtgacaatctagacaaaacatcttaacctgcaaatggaaatctacttgaaaatcatatagcctagtctacctacctggtaaagattgcctgctcattgactggcaagttgaagaaggttaaaataatataaatagtaacctgaattggggtgttgtacctgcaagcaacagataactgcaaactcaaactttttttttttttttttggaaaaaggggacatttgttattctatataataataattaagatgggcagagcattccaggaatcggcttctacttcacattggtcctggggactaaccttttctattttaggcatcatgctctggtctgggagcaagatggccacacaaattccagcaatcacacttggccaccaacatcaggcaggcatgttcttgcctcagggcttttgtaactgctattcctactgccagagatagcctttccttgtggctaatttccccatgatagtcacgtctctgtccaaaacttactccactgacaaatgtaagttttattttgtgcacataggtactttttggcacactaaagattattcagacatttagtcaatttaaaaaaaaatagtcaatttactaaagttattgcttttataaaatcacattcttaaaaagtttgacttatatactttatgattctatttataagactagtaattataatgattacctttaaggaaactttggttaatatttgttcccttcaataatcttagttatgttccattaaatatttaaggtgtatttacaaatttgatacatttaatttgctcctcaagtactatgtttgtttatctcaaatgaaaaacattcccaaagtaaagcgataatttttataaacatgttgaggtttacatgttaaacaagtcagagagtagagctgtctaatagattacattctctttaacattacttgtattaccaagtacttgtattaccaaatattcatagatttttaaatataaatcgttaacagtatgggttttatgttcttgttccaaatattcctaaagttaattataaatttattgagggtttagagatgactatccaataaggaaataattatataatattacacaatcttcaggaatacctttccaagtaagttttaagggtgctttctcagcttggaagcctgaagtaaccgaaatttaataaaacctgttcacagcccagagttcatgaggcagaggaaaatgtgttcatgtatgtcacaccttgtttttgagtaatatcaacattaattaattaattaatttttattttttgagacagagtgttgctctgttgcccaggctagagtgcagtggcacgatctcggctcactgcaacctctgcctcccgggttcaagcaattctgctgcctcagcctcctgagtagctgggattataggtgtctgccaatgcacccggctaatttttgtaattttagtagagacagggtttcaccatgttggccaggtttgtctcaaagtcctgacctcgtgatccacttgcctcggcctcccaaagagctgggattacaggcgtgagccaccgtgcctggccaatattaatttttaagtgaaattaaaatatcacttaaaacccacatagaaatggctgtattcgttgagtgagttttctttttgtctgctacatgatatatgaacatacctttgctatataaatatgaagatcacaggacattagacaatcctacattctttccatatattcttgtctcttagggttgcacagcaattataggtattaaaataatatccatttgtgttctagtcccaccaccctccaacttttttgtcacaacttctatgtccacttaatatgcagggctttgctgatcacatatattgatacagggtctttttcccacattcctttttatcacttttcctggctttagttttcttcatgacccttttaatggcctgagatattatttattgacttctttatgtttgttgtatttgtttcgttcctctaaaatatgagccctaggaagtagagtgacttggatttcctcctgtatctccaattccttgaagagtgcctggcacataggggtcaatcaaaaataattgttgaaaagatgaaagaatgaaagaggtcagatgtgcttcccatgcctattcataaactaatgtatcggtagagggaatcagactgccacgactatcttaggttgacatgtattctggagctggagatgatttcaattccccgttatgtgagtgcaatggcgggtccccaaacacaatcatgattctgtaggtgaataaccaagaatggtcttaagtgattctaataaccagatttggggaggaagaaaaaggaaacagagtttgttttagggtgacaaacagacatacacatgagttggaggaaaagatttctccccctaaaagtattggcatatcccagacagcctcacagaagaaaccacatgactgattttaccatgccctctgtactagagaatgtagttaaggtgtctcttagtccaatctcatagctcacatcacagagataaaaaaagactaaaaccttaattacttttacttgaaatgtagaaggaaaccattcttattttatgtactggttgtttcactagatttttttcttagataaactataataaagaatataattttctattgataactcttctttaatggaatctttaatagcttaaatactataaggtataaagcactccatctcactttcaaagacattggtaattctatattgaataaaaggttactaagtaatgtaactgatccaactggctaatagagaacattaactgcctcaaaatccctgcaagaatcagatagaaactatattagccaacacaatatccatgtcatactggccttgcaagcagttgcttgagttagctgttcagtatagaacactggcctgggtagttttactatattctcgctttaatcaacagcacctaaatgcataaaactcctctgttgtaagtcaactcatctatccgtctcacacagttattaattcttagattaataacaacattgatacaattattatcccttaattatgcaattagaaagatgccatatagttcagacaggagacaaacaacaaaggggaattgaattaaaaagactaattcgttgactttctcattacaatacttgaaaagagacaaaaatttatgttgatctacacattgtctctgaaaacagatgtatatgaaaatggactttcatggtaagagttaaagaaaacatacagttctgatttcaaaaggaaccttaaaaaataaagtaactttgtgttcttttgataattcaggaagctttatcccagatggtttaaagtatttacatacagtcacataaggaagggcctgaacgagaagtatgattttgacttctaatctagtgctcctgcctccctaatatgcttggtaaaaatccatggtaaaaataaaatctaactgaaaaatagatacatatgtggatacctctcccagtaaagagctttccttcacttcggctaagtgtaaattatggtaacatattaattcaacaaatatttattgaatgatgccatgagtactactcagcatcatgaatagaataactattcaaaaagacaaaaatttctcttgttccccacaaatgtgtgtgtgctttatttgaaacagcacatatactcctatcatgtgataactacatatttaccaagaagatatgtagaaaacaataactatcaatgcagctattactgagtaacaattagatattcattatttacatgaccatagaagagattgcaaaagagtttaattacttcctagtaagatatgaaccccttagattagacagttattttgtatacctaaatacaaggaattaaaggaaagatagattttattaccttttcagagtgaaaggactgtagtgactaagagatctcatttattcagcttcactgggaagtagtagcttccatatatttgaatttcctagatcaggagatccattcactcattaatttgacaaatatttgtggagcacttcctatttgccaagtcctattctaaggacagagataaaggagaacacaagacagttttgccctgtgaagttatgcacttaacagataaacagatacatagatgtgatcaggacaagtgctgtgaagaaaattaatggtggtaagaatttagggagagccaagtctttgctattgtgaataatgccacaataaacatacgtgtgcatgtgtctttatagcagcatgatttatagtcctttgggtatatacccagtaatgggatggctgggtcaaatggtatttctagttctagatatctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcattaatgtcttcttttgagaagtgtctgttcatatcctttgcccactttttgatggggttgtttgtttttttcttgtaaattttttgagttcattgtagattctggatattagccctttgtcagatgagtaggttgcgaaaattttctcccattttgtaggttgcctgttcactctgatggtagtttcttttgctgtgcagaagctgtttagtttaattagatcccatgtgtcaattttggcttttgttgccattgctttttgtgttttagacatgaagtccttgcccatgcctatgtcctgaatggtaatgcctaggttttcttctagggtttttatggttttaggtctaatgtttaagtctttaatccaccttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaagttggattcctaagtattttattctctttgaagcaattgtgtccaacaatgatagactggattacgaaaatgtggcacatatacaacatggaatactatgcagccataaaaaatgatgagttcatgtcctttgtagggacatggatgaaattggaaattatcattctcagcaaactatcacaaggacaaaaaaccaaacaccgcatgttctcactcatagatgggaattgaacagtgagaacacatggacacaggaaggggaatatcacactctggggactgttgtctggtggggggaggggggagggatagcattaggagatatacctaatgctaaatgacaagttaatgggtgcagcacactagcatggcacatgtatacatatgtaactaacctgcacattgtgcacatgtaccctaaaacttaaagcataataataattaaaaaaaaaaaaaagaatttagggagagcctgagataggcactatttcaaacagtttggtcatatttgattcttctcagaatcaaaacacactttttcatgagtactttacaaaaatattgcaaatacatagaaatactttgtaagaattggcccaatatgaatgcttcaaaaacataggtaattttagtgttaatctgcaatgagaatgcaatttaatgataaccatttaaataaatatatcaataaaataaaatgtatatgttgcaaacagaatattctatctgaaaaaaaaagaaatattcatatcttcttacctcaagaccatactcctaaaatcctaacaatgttttttattgctccagaagttgaacatggcctaaaacacttttcttggtctagtccttggctaacagtcaagtatcatactttcacatgctctcccctttgtgctttctatgtctattaaatattgtttgggagagatgttacagattattaaaaattggaggaagaaaacatgcagtgtacattctcgtgaaaaagtgatagaaaataagcatgttatcaaattcataaacacgattactacagatcgttgtgatgaaggtgttatagagaaaaattggtttggttggccaaggtgtgagcaggtacctggagaagtaatagaagaccaggagggaaggaagggcaatatgtaactatccttggatagcttaattaaagaaggaaaggacgtttattgcccagactcatggagaagataattcaggtataaataacacagagtgcaaagtctctgagtcaaaaatgtttattattttacacaaacagaactgaggccagtgttgcttgatcttaggaactcagttgattttatgagggcatttgaaagaagcaggtaggagccagatggtaaaggaccttgtgggccatgataaaaatcttcagaatatattcagagtgcaatgggagctatggaaatattttaagcaggggaatgaggtcttccaattcacattttaacacattttcactggctcctatgtagagaacggattttgagaaataaggatggaacacagaggaaccactggcagcttataagatgtgtaagattgtaagaatccagctgagagatggtgtagacttgacataacacacagctgcaaagacacagaatttatgtcagcacaaaagcttgtgacctgctcatggagaccctttcatccaagccctaaacagatattgatcgaaaagcagaactacaaaaggaaagtcagatctttcttttcatctgtgacagttgtattgacaaattttgtctatttgcaactgtgtgttgtgtcaaaaatctatgttttaaagattgctaatgagaaatcaatgatgctaaacagttccttctgtcaataaaaaacacaaacattcacaaatagtcaagatgtgttcgtgttagagtcaacaatattctgaatatattaaactctgtatacccataattgcatggcagatataagaaactaacaattgatgggttctcattatcaaaaattgaatgacttcagatttatatcgaaaaaaaaaaagccctgtaaatcctgtagtgtatcatgcagatcccccacttcagaatgaggcagtcatttgttcatttgctggaaatgttcctaaacaaggacttacaagtcagttcttctccagaacttcccctaggccgaagtgaggtaccttgtctaaggtcctgtttcttccctggggagaccatatgcaatgacttgtctatgtaagagtttagaccttggtaccttcttgcttcaacttaggatcctgaagggccctcctctcttgaactctgttgtattggccaaggtcttaacgcaattggatcacaatttctcttctgaccaatcctttccttaatccatccaggcatttttataaagaacactccctgatatggttttgctctgtgtccccactcaaatctcatcttgaattgtaatccctacgtgttgagggagaggtctgtaataaccatgtgtcaaggcagagtggtgattagatcacgggagtggtttcccccatgctgtcctcctgacagttagtgagttctcacaagatctgatggttttacaaggcagttttccctgctcttgctcgctcttctctatcactcctgctgccatgtaggacatgcttcttccccttcctccctgaggtctccccagcctttcggaactgtgagtcaattaaatctcttttctttataaattaccccgtctcaggtatttttttttacagcagtatgacaacagaataatacacttcccaagaaactacctctgtgtaaatattcagttcagagtctattttccatggaagcagacctaagattgaaaataagcataaacttatctcaaattagttgtgagaagcaaaaatcgcttctgggtcctcaagataatctaagtgatttttcagaaaattactttcttcttcacacataatttgaattaaattggacattttgagctactgagacattctacttaaactatggaattagtattttaagtacatgttaagacattaattatttgtttaaaagtttgatgaaatgtgatgtttggctgtcctttatcaaattagtaactcatttaaattttgacccatattagaaaatttgtaattacactttgtataaaacctgacaatggcttgcaaaaacttttctggttgcaagtatttctaggaagaaagaggttgagagattttctgccagtgcttagtgtattgtgtggtctctgtctgctgccagaaattgcagtgcctacagaccttgtactctggttgggtaattttttgcaaagcattttagttcactgtctgtagttggagtcagtggcaaattgggagaagagttgttggagatttagagacctcccgacattttttattagtcttgctcatacatgagaatacaatcaaagtaaatatcttttatttgctatttaagacggcttcaactggcacccattatcccctcttccactttcctgttttctgtacagaaattattgagttaccactgatcaccatcactcaggaaggcaataagccatgtcattttcttttttttttttttattatacgttatgttttagggtacatgtgcacaacgtgcaggtttgttacatatgtatacatgtgccatgttggtgtgctgcacccattaactcgtcatttaacattaggtgtatctcctaatgctatccctccctcctccccctaccccacaacaggccccggtgtgtgatgttccccttcctgtgtccatgaaaaccatgtcattttctattaaaagatcccactaaataagagaaaaatatcaaaaattttacttactggatttaagaaataagcactacagcaatgtgattagaagtattgttttcaaaaaatgtataagcatatttttcaatttgatctaaaggcccatgtgatttaaaaggaagaagactttcattacatcaacaattgttcctagtcacaagtatgtccatctacagggtcaaaccatgctatctttcagaattgctagcaatcaaaagataaacctgagtaaagaagagcaagaagtggttgagttttcccccttcctgaaaggacaaaagaaaaaaacattgacttattcaatcttcaggtttgatgtttggactttttgaagtgtttgatgcaagtcaatgtttccatctgcttgaaaggagagacttgttttagatgctaatctggctatgttcaaataaaacatgggtggagaatctgtatgtgttttgagtgtggttactagtttcccattcacttgaaaattactaccagtgtccaagtttgttgtactactcaatctttcattaaaatttcctgtagtgctggctcagaattgacatttagttaacaaaatttgtggagtcattgtattatgggcacaatgttccagccatcagagagctcttttgtgggcacagtgtaaatataccctctttaatctatgatgtgattaatgaccaggctttgcatttcattgttgctttgcatcactatcaagaaaaataaagcattcacattactttccaaaggtcacagaaaagaagttattttcttgttaagataaactttaataaacatattttaagcttgcttatctcagaatatttatggtatagaattttagaacagtcacaaacagaaatttcaatgaagattcatatttaagctggacattttttttcttactgtgtgttgtgcctctgttgtatatggcttagaagggagaaatgctatacaaagtctttgaatgtcatcattgcaaatcatatatacagcagtagaaaatagactcttgggaataatattgctgtggtgggggagaggcagcacaggccaaagtaatttaatttatctaacctaaatcaaaattttaagactcacccatgaaagaagtatatgtattgcccccatttctactttttatttttcaggctgacttgtgttcttgtctcccactcaaatcaatgttaaatagaaggatcatagtctggaaattatttgttaaataatttaatagacactgtaaagatttttttttagttttctaaatgccacatgttattttcagtaacacatactattattttcaatatgtaggcatagaatcttttagaaaatagatgccataatctagcagaccagataatgttgggtggcagttcatgttgtttgaaatctaccattacaatctcacatggtatttatttattcaagatgaataataagcttcatttctcaagggcaatgcactagaaaatgtacataacattttgtctgctgattaacctaacagataataaaagaatatgagcatcataaaatttttaaaagtgtaaatgaaaaggtaatacaagaggtgggatttacaaatcaaaaaatagagagctaattgtaatccaccttctatggcattgcattagggataaaaatacaaaatcatttaaattaaaacaatgatattatctgtattcaatattatttatttattttttaatctcaagaggtgaaagtataaaaatagctaaatgcttgtgggaatattaagatctctaaattattttgaatttaaatgtaatttttactaatactattgagcagtggtaataattagaatgatttcagcaaggttggatagttgaataattaaaggcacaagattaattttagaagaggcctcattatctaaaattaaatattagaacccttgtaaaagataggagtaagaatggagaatagacggaaccatattttaaagttatttagcctcattaataccataatttcccttgaataaatataaaatccatttgtattaaatataaatttcaaagtttcatgatatatatttgttttttatagaaattaagaattgaatgatcttgtctgtaattcttgtactgcagttcagaaatagcttcccaaattattatcttcttaattacttttgaatgggcattgcatgcaaattataaaaacttaaatatattgaaatgtaagattttatttcacttttcttcctgggccaacctcttcccccagagcaattcttttttgcttttgcttttttcagtttctgagatatcccacatatctttatatagttttgcttaaatatttgacacgttagtctttccacacacattgttttgcatctttcttttattactcaacactgcatcttactaatcattctgtattagtacataaaacttttagcagcaagataggactccataatttatttaaccagttctaatggatcgatatttaaacttgtttccttttttaaaccattataaacaatgctgaaaatataattgtacatacatctttaaatacatctatacaatgatttctaaaagacaaacttctggtcaaagacatatgaattcataatttaacaaatgactacaaattaccatccagagaggctttacctttatattttcacaagcaatatgtgagagagcctatttcaaaaaacaatgggtcaaaatacagtgttttacaatttttgatcttagccaatgtgacaagtaaaaatatgaaacatcactgaagcttcagtttgcatttatgtgtttagtgtgattgagattgttttatgttcactcatgcttaaatgccatagtattttctcttctggaagctgtgtgttcacatcctatactgattgtaaatattgaaagcttaaaaatggatttgtgcatctgcaaaattggtgaattatttacaagcatctatttcccactaggtccgcatttccattattcacatatctttcatagttggttaagtacccttttgttgcttactgaagcaaataataaaatcagttttgagtttggaaagataacttatggaaaatatatttcaccacagcagtatctgattccagtggctgagaaaaagataatttaatagcaaatacataattacatattaaaattcaaaaaataggaaaaaggtaccattctaatggcaattaaataatttctatagttccagaatacaacacatacatatgacgttacacttgttttaattactttcccctgaggtttgcttggtaaaggtacacgtaaaggtggggcttctaaattagaaatagattctcatgaataagtataccatttatttgctacaactgggaaaaaaaaagcagcatgtctgaaagctgcctacttcaagttctggacaagagtaatggtatggaagaaaaagtatatctaattttgaataatatgcctgtggaacttttcagcaggatctagtcaccatctctttgatatattctctgagcttttttggacaagttttacaaaaaaaaaaaaatgaatagagggcttaaaccccaacacataactattgcttttctctgctttctatcagtttagcctagaagttaatattgtgtattattaaacactgaaatataaaataaaatatttttatgatttatgcttttctgtattttgttacactagaacattaatattaaaaatcagaggcttatttctcacttagacttcgaaaatttatatcatttaaatttttatattgtggctatttaattataagacaaaaaattccacttgaaatatgtgttaaatccttctttctctaaaccttttctccaaaaccattttaaaaaagatattctgactcttgtgtatgcaaaaaaaaattccagattaaaacaaatggtttttagttagtttgttggtgctagatataaatcatctatgacaacaacaaaaacataagacaaactcgtttggaatattagtcacattcatctaagagtatgaagaaaatcctaagtctctcattatgttgcaatgattcaggaaaagaaagagaaaagcgaaatgaaacctgaaaaaataaactcttatgcatgagcataactatttatattaaagatatctcctcttatggaataaaagatactcttatggagcatcttttattattttcaaattttccccagggctgggttcagtgactcacgtctataatcccagccctttgggaaactgaagcaggcagataacttgaggtcaggagtacgagaccagcctggccggccaacatgccgaaaccccttctctactaaaaatacaaaaattagccgggtgtggtggtgcatgcttgtaatctcagctatttggaaggctgaggcatgagaattgcttgaacctgggaggtagaggttacagtgagctgagatcgtgccactgcacatctgcctgggcgacagagcaagaacctgtctcaaaaagaaaagaaaagaaactttccccagaaaatattatacgataacccacaaataaatactatattattcaattttttactagatcctcagtatttactagaccctaagtcaataaatacttgccaaataaataaatacaaaaaaaaatgctttctaaattaccaatcttaactagatatacaaacaaaaagacaaagaatgaagggatcctatggtgaggtcatctcttactagataagaatctccatcgtattaaacatctattatactaaaaaccaagttggtattaggaatagcaagcttagttggggaaataaagaaaaataaagaacatttagagaataaaggaatatagcaaaaagatgtcatggtctgtggagattaaaaggcttaggtttcaaatctgactatgccatactagctgtgtagccttaggcaagtttcttcatctccctcaccccttgtatctttatctttaaaatagttataaagtgtaatctatttcatgcatgtggcaaaggcatatactgaacacctgcctcaaccccttgcagctgggtgaggctatatgtatagctctggataaaggactaggagtgaaggtgatgtgtgtcacttccatacagaaaaatgtaagagccagtgggcaatcctccttcactctttctttcattaattttaatttagtgtttagcaaactttttctgtaaagggacagggagtaaacagtttgagctttgcatgctctatgttctttgttgctactactcaactctgcctttacgatgcataaaatgcaaattcattacctaaaagcaatcatagagtatatgtaaagaatgagtattgttgttttccagtaaaactttatttacaaaattaggtggtgggttagaattggcccaaaagccataatttgctgtcttctctattcaatcaataccatattgattgtgatgaagaagtgatgaaagaaaagagtttagttgaatcaagtttaattcacatgcattgacagagcatatttatgtgcttggaactctggtatttgctataggaaagaaatttatgtatattgagcattttttatgtggcaagcgatctgatacatttttcacataaatacttaattgcatttaatctttatagcctggaatttttcagataagatcttgagacccaaaggaattaagtgaggaacccaagttaatactgttagtaattctgaaataagggattagaataccatcctatcggaccccaaattctgagttctttcatgttcattaaactgttatattgaataaccatgactcagagtgtaatcataaagatgttttctcctcacagttgcatctacaaaacccaagagctgttatttttctctcatataataaatttggggaggtagcctgggtggattatctattcactctaagataataataatatttaaaaatcctcttatcactttagtctctcaaatagtctcagttcagtaattaacatatcctcataataatattgttataatgtaataataaaattacagtgtaataataaaatctctgactatcaaagtgaaatatttgcctcaaccttagttcaagtctgctgagtaggaaaagtgcatctggaaagaggatagtgggtaggtggggagacacttctttcctttttaccttcccagatccttttcactgtacccaatacctcttcagctaaaaagaggcagattttttctgctggagatgtgggaattgctctcatctgcagttctgttttctccactgaatatgcctccggctgatcccttaacctccctcaagcctccttctgccaaggtgtgcttcttcctcctgatgatcttcttgagcagaatctaaaataacttcaagttctctctctttttctcacagacatgatacttatggcccacctcagggtttctcaagctctagaggtctgtttaaagtaatttgcattggtattgaggggaggtagacgtgtccctctctccctatatctctcatcagcctcaaactcctggctgtttcaattttctaagatttgcaaaaacaatatacaactaccctctcagctgtccctgcctagcggtcaaacacctccctatgaaatgtgggcgaaattagtgtctattattctagagaagctatagaaactttttaacagtcttatagaaaagcctaaaatactctatttttcctaagacacttgcagtatggttgtgaatacaaagctaatactctagaaatatttgcaagatttttatggatcggaagagacttaagggtcaataatttcattccttagctgaactgatgaatatttactaagtgtctaatatttggaaagtgctgggctagggcttaaataaaactgaaaccaaatgcagatatcattacagtcactacttgaatctctctgatttgggagaatttactacaccttcaaaagtcccattttcattgtttttgtaaatcttggggtctccatgttattttaaataaatatgccttcctggcagagcaatatcagtctttaaagaatggaataaattacagaattccaatgttgaagacaggcttacagttccttccatcattctgactttctatcatttgctcttagttccttttatgacattgttaccagtagaacgaacccgagttaccctgagttactgtctgcgtatcagtgcgggtccgcagcaaagtcagtcctcccctcctcagaagaaataagtcgactgaggggcctgagacaggagagaccgaggtaagtttcagagcagtagtggaagtttatttaaaaaggctttagaactgcaagaaaaggaaagaaaagaaggaaagtacaacttggaaggggaccaagcaggtgacttgagaaactaaacgcacagcttgacctcttgacttggggttttctgcgttgacatacttccaggatcttgcattacttcttcccatgcctgagatctcattgggaagctgctgatcagtttcaggtgttttctatctactaggagacagcctttccctggcgctggcagtgatcaattattactttactgtttatttatttatttatttgagatggagtttccctcttgttgcccaggctggagtgcaatggcccgatcttggttcacggcaacttccgcctcccaggttcaagtgattctcctgcctcagcctcccaaatagctgggattacaggcgcccaccaccacgtcaggctaatttttctatttttggtagagacggggtttcaccatgttggtcaggctggtctggaactcctgacctcaggtgagccacccgcctccgcctcccaaagtgctgggattgcaggcgtgagccaaagtgcccggcccaattattactttagagaaacagttaacaaccgcctgaccctcacctgatggtcgcccaacactcctggtgtgtaggggaagccctctcctgccctgctcatacttgactagcttgactagctacctactgtaacaacatgtgtaacaggggtgcatgtcactactctctaattgtactgaagtacaaaggcttggagctctcttttagagatcacccttaattatactgtgggtgaaaagaaagcatcctgcattttctgaaacttccacatagcttgggctatttatttttatttttatttatttattttattttattatttatttttgagacggagtctcgcactgttgcagattgggctgtttcttaatgttgactttgcatctttgtgtgtaatcttctcaggttcagttccttatctctggctttcttgattttcatcaacatcatatgcattgttaccaaatacaccaaaatggttttcacatgataaatatttttaaatgaataactgagattacaaaagtaaggaaaactcacagggcactggaaagtagaaaatgataaagtgaaactaaaatggtggggaatgcaaattggcaaagccactttagagaatgatttggcaatatctagtgaaggaaaaaaatgactctgtggtccagcaatttctttcttaggtatataccataaagatatgctcaaatatgtgtacaaagagatatgtaaaatatcctagcagcattgttcatgactggaaaaaacaaacaaacaaacaacaacaacaaaattcaaggccagtctaatgtccatgatagaatggattttaaattgtgctatatttgtatactggtgtactattcagcaataacaatgaatgaattagattgaataatacaagtataaataaaatttacaactataatctataatgtataaagcaaattgtagaagaatataaaatgttaaaaaataagcagaaaggtactatattttgtttaggtagacatgcatatgtaaaaaatgtattaaaaatgtgatatatgaaattctgataatcacataaaaaactgaaaattaatcatccaagggagggagggagcaaataggagagacatggtaaatgaaggcaggagtaggagtaaactttatatattatttatatgtttaattgtaaaccatgtgagtatattactactcaaaaatgcatagaaattattagtgactaaactcaagatggtagagaaaaaagagaatgtgattggttggaaatacaaaggatacaacaattatatttataagcatttagtatattaatctgaatgatgaatacaaattctttattattctgtataccctttgcacatctgaaacataatattataaaataaaaccttagctttcaaagccattgtttctgttaagggcttgacaatccaaatttgggggtcaacaaataagcattgacttttcattcttctttgtaactatactataataatctcaatttatgtcaaggaagtgtggatgactctaacttttggaaaaacaaattagcaggtagtataaagtgtgaaaaagaaaaacagattaatgtttcaagatattatttgacctcttttacacatcccttactactgttgacacacttgactttgatatatttcttaaatatttcttttcagaagtaatcaaattaagaggaaaccttttgatgatagtgtttgttatctctgtattcatctatttatcataaagatgatctaatattctatttttataaatacagtgttgattgtataatacttctgagcaatgctaatatagtttaaccttaaaaaatgaaacctgacatcataaaactcaatattagtattgcttccactttttagagcttgattttggcaggccaattttttttcaaatgttggttttcttatctttagaatgaatggagttctatgagaaagagcattgtgagaattacatcaaattaaaatattaataataaattttcagtgtatataaaatgacttattgtctggaacaaaatagttatttaaaaatcaatcattccattagacattaaaaataagcataagtatgcctacatttgtgattattctggatgttcttataaggtctctggatcatgattatcactccgtagtacatggatatagttatatgaacaaagaaggtagaatatatttggatatatatatatatatcccagacatgtttaaatattttagtaataaatctgtaatatgagctaattttcaaaaaattttgtcaatgtcttccaaaactaatttagagaaataaagaaatgaaaaattctaaaacaaatcaaaagcccatttaattaacagtttcacaaagttgtattatagttcctttttaataagtatatatttaaactttttatggcatacatatataaactaatttatataaatgagcattatgtattcatatattaaaatataaatgtataaaataagcacaactatacaaacatgtttgtacagatatatatatacacaaacacatgtgaaagtatgaatataacaacaaaaatataaattagggagtaaacctttgctttataagagatctcaacatattattttttaaaactgtaattactcttacaattattttgcacaatttctaaggtcaagtcttacataaaatgagtaacactaataatgtttcttaggtgttataattaacaagatgagtttcacttatagtaaaaaagagtacaaagaaagaaactaaggcctatacattaaactttcatttaaaaaatatttgacagaaattccataagaaatgaaaaataacaattattttggcttgaattttttctatttgagtgaacaaatagtgatgtattatactcaacatccacatattaaaataatccaaacctagtatttcaggaggaaattttagcagtgtttccactgtaagacaccttagattgagaagaaaagaaaacttatcttggtacctgctgagtatgttttaatcccatagcccatgatgcatttctcttatcctgacaaataggtagcagtgctattttttgttcttagcatatagtcagcttcttttgaaattcagtcatatattggatatgctgaccccctgccatagtgaattccacaggcaggagctccataggatgaaaagtgctattcaactagaggggttcatgaagaaagtcaaagtctctcaaattaatttctcaaaatgccctaagccccagccatctccccttcgatgttctttgcagctgcttagcacttctggactagttgagcctgagtgagttggctgcctccccctatggcaatatttctttttcaaagggtagttgccatggttgtataattttgtgcagggagtaggagactttgtgattggccaaactgtgctgaaaaagataacaaacacaaaaactacaagtttaaactgaggaaaactttgtcaaactctcagtggagagtggaagaaagaatgctttccacattaaaaatatcttgcattttttaacattgttgaactgcaaggggcttaggatacttaatgggtcttactaaatttggttagacctccccagcctcctagtgagcacatggaaaacagaagcatatagagagagcacaaatttaagaaacacaagaatggactaaaattcttggctcatttactgtcacaccttggattgtgtaaatgattggtaccttttggagcctccctttgctctaggttaatgcatcatcattcatcttaatatactcattactatcctctatctcttgtgtcaggcaattcttgccacctagaatttcctctcaaaatcctatgtctgagcaaagctttggacccaaatctcctatgatatccttgttaataaaatagtaaaattatgattggctaagggtagtattggacagattcaaattgtattcaacaatgttgctcagcaagacctgtatatgctgaggcccctattgtcaagtactttggtaggtgcttttgcttacattatctcaattaatttttttggtatgcatgttatttgactaaccaatttatcttatttgttactaaaatgtttctggttttgttcaaggtttcactgttcctagctaaaattccaggctctgttgcatcttgttatgttaatatgacacagttctggctaataacatggagatgtaagtccctgagagaaggcttcctttcagaaatttgtcttcagaaataaaaaaggcagacccctgtgaaggtaaggttttgtcttttgtccttaattgttttcttatcccttcttcccaactgggacaatgtatgatagtgataaggagaaggagcagccatctttgactagaccacataataaggaggtcagagtagaaagatactctaaacttaaattttggatggtgttttggggtatttcaagcggccctgagctctctacctccagcatttttattaaatgaaaaatgtaatcctatttatataagtcatttttggtcaagctttctgctactcccagtgtaatcattacttaccacacaacgtaagaactctgagctatgtggtaatatcccacagctagggagtaggaaaaggaggtagaatttaaagctctccttgcaattttaattcccattttatattgattcacttgttaatggtcttatatggcctaatatttctgttagtgatttaaataaagagatcaaagagttagatatcagatgtgctgtttcccaaagcctgaatgatagctaatatactataatctgagactgcaactgtcttgacatatttgatttcctgtgtcaagattttcaacatttgttgaattatattaaaataattcatagtttgataactttattagaatccaagtggtgatattgagaaggtagttggatacagtagtatggaattcagaagggagatctggtataaacttatttatcaatggcatatagatagtattttatgccatgtgacttgatgagattgcaaaggacgaaagaaagtgtagatagtaaatggaatagaattagagattgaagcctgggctttcataataatattgttgagaagactaatgttaagagaaggaacaatcaatgactgtaatatccagaaaaaaaaaaacaagtgatggaactatgtaatctgtggtttcaaatacagtcatatgccacataaggacatttgcgtcaacaacagactgctatacgatcatggttccatagattataatggagctgaaaaattcctatcacctagttacatcatagctgtcagaatgtcatagcacaacacattgctcacatgcttgtggtgtaatgtgctggcataaataaacctagtgtgctgccagtcatataaaaatatagcacatataattttgtacaatacataatacttgatataataagaaatgactatgttactggtttatgcatttaccatactgtactttttatggctagagtgtactccctccacttttttaaaacaataaacttaactgtaaaaaaacttctggcaggtctatcaggaggtgtttcagaataagacattgttttcataggagaagatagctccatgcatgtttttcacccttaatactttccaatgggacaagatgtggaggtagaaggcagtaatatcttaatcctttggaaacctaggctaatatgtgtgattgtatcttagattttaacaaaatataaaaattaaaaaaatctttaaaaatggaaagaaagtttatagaataaggatgtgaagaaaaaatagttttgcacagctgtacaatgtgttttaaattaagtatttctacaaaaacttaaaaagtaaaaacatataaagtaaaaagttacagtaaactaaggttcatttattatttaaaaataaaatattttaataaatttatgtagactaacagtgcagtgtttataaagcctacagtagtatacagtaatgtcctaggccttcacactcacaccactccctcactgattcatccagagcaacttctatttctgcaagctacattcatggtaagtgctctacataggtgtatctttttaaatattttatactgcatttttgcgcttttttagatttagatatccttagccatgcaaatagtcattgtgttacagttgcttacagaattcagtacagtaacatgctgtacaggtttatagccacagagctataagaatatcatatatcccaggtatatagtaggctctactatccaggtttgtgtaagtgcactctatgatatgtgcacaatgagattgcctaatgatgtgcttcttagagtgtattcctgttgctaatcaatgcatgtctatactgttaatttgccaagtaaagtaaaacattgaattgactattggatttgaccacatgtagaattttggtagggatagcatccatcctagtgcacctttgacactttcagtttgttgccttgttttaattaataataatgccacttttcattcttaagtatcatagttcaaatgataaattatatggtcatcctaagccactgatgatctttagaaagatagtttcagtggaattctgtgagcaaaatactggttggaatgtatgtaagaacaaaggaagaaagagtgggagacggcaaagatgcaaaaagctttttgctgcaaagttttgcagagaaatgggatgaaagctggaatgagaattaaacaatgtaattatgtacccaagggattcagttgatagtgaaaaattattgatgtaagagagaggaaaaatgtcctggagtaactgagaagggattcaacctctgtttaagggagggaatggtttagaatagataaaaatcaagataccactctccaagcgtattttgcatttctgcatgttttgtgaatgaagcactaatggccttgtattctggagcatgtttatagaatgtttatataatcagcaggcattgaagagagagagagtttctttgtagcaaaggacaggttggcttacatccctggaagacagagatatcatcttcctctgaagcaaatggcaggtatatttactgccctttataagaaattagagatccctaagcttagatgtgtcctcctgtaatgtaacccactacatggtcagttgtcatatgcccctttcatattgcctgtaagaattgggacttggataaccggagtaaaaaaaatactctgactattgttgttgctgtgggtaataaactgctttacatttctgatccaggaattatgtgtcttctaccactgtccactaatgtttttttgtggataaatttaaggggtacaagtgaaattttgttacatgagtatagtgcatagtggtgaattctggcctttagtgcctccattgcccaaacaatgtacatgaagtaatttcccatcattcactccctactcctccgaatctccaaagcctatcattccatattctatgtccatgtatacacattatttagctgccacttataagtgagaacatgtgtttgattttctgtttctgggttgtttcatttaagataatggcctccagttccatccatgttgctgtaaaagacatgattttattattttgtatagttggatagtatcccattgtgtatacatactacattttctttatctaggctttcactgatgggtgcttaagttgattccatatccttgctattgtgaatgcataggcttgcaatgatcatatgaatgccagtatctttttatatactgatttctttttctttgagttagatacccagtagtggtattgagggatagaatggtagttctgtttttagttttttgagaactctccatactgtttttcgtagaagttgtactaatttacattctcaccaacaatgcacaagtattaaccttttctccacatgcttaccaacatctgttattttttaactttttaaaacccattctgactggtgtaagatatctcattgtggttttaattttcatttctctgatgattattgatgttgagcattttttcatatgcttgtcggccatttgtatttcttctcttgcaaaatgtctattcctgtattttacccactatttatgaatcctgtgggggaacttgttgcttggtagtagggtaagatctcagatccttcaccgttctcaataataagatcttagataatctaggataatggatactatgcatttttatcttattattttacataaaattaatacaaatttttataggttttattatatgtaggttttatataatcaaatgtatcaatctagtcttttagcaattgtggattttatggcttgcttagaaggatttcttaaaatcttcttatagatgaataagactggactttattctattattatctcttatagttaatttttaaaggtaaagttaattttgaattcacataaaatgttatttttatatgaattttttcctaaattatagctactttatctcaaaaccactaaaattgatccttatctgattatctgaaatgtctttctcataatatattaaatccctaatgtagagatttgtgttagattattcttattcatgtatataatttttaattgatacatgaatatatttaatcctttttttcaacacatgtttagttagcacctgctatgtgctacacactgtggcattcgctattacatagtggttaaaaaataggcatagttcctgctccattgaaaacctcagcctagctgtaaacataaatacctaaaaaatcatcaaataaatatattatttaaaagtatggtaagtgctaggaatacaattaaaaaattctttggtagaatattgaggtaagtgggaaacctataaatgtcagtgttctctgaggaggatataatttcagcctacacccagagtataacaattgagcatcataaaaatgagtggaagagtattctaagctggtggaacagcatgctcatagataaaagttgtttcagaaaagggtcatgcaatgccttttgcttaccaaccaacaaatctgccatatagagtttaatcttttgattaaccaaattcaagtcaaccaattacattatatatcttataatgttgatatattttcaaaacgtaaattttcttttagaattaaggccaaattattgtatgtatggtagaagtcatcaacaactactctattggaaataactaatataatccacgtttgttgctagaaattgatttttggagtggactcaaatgcctaactctcaagaagttctaaaaccagaaggattttttttgcttaggagtctgaatgaaacttttaaagtcttgcaggtgtttgctgtcagaatgaggataagtcaatatgtgacagagcagaacaatgaatactgtgaaaggcacaatagcgggccagagccctgatacatgtggcctgaagcctgccaaagtcttgggctgaattttaagttcagcaatgcatttttgtaagttaaattactttaaattgaagttttctggttttactgagctaaatgcattataatactaattagaatattttcaacttaaatttgaagcctgaaaggtgagaaacatcggccaatggcttcaaaactcccactcttcttggcacaaaacaaacatatctttataacatttcttgaaattatttgataacaactttggagttgcttcttaggtatgcatagcaaggtggtattgggcatcacacttctgaagtcacatccctttactctcctgtgtataagctctggaaatgaagtagacctaaagtagttctatagtaaaattaagttcactaagaaactgggacttatggtggagagtggcatcaagctgaggtacacaatttagagtccttcctttcctgtgctcttgccctgtatccatatcccaagatttgggctctccttgtgcttgttgctgagtgggagtctgtattgttttacaaccccactatcattaattgcctggccacaaatatattctaatactacctttattgtaacttttgttagacttttttctagtgttaatgcttaccaggagattagatgtcttccttcttgtgtgccccctcctgtagggttatatttctatcttgcatggctatagaggtatagaaagaatactaattattaaaattcatattatatcgcattttcatatttttatatttaaaagatacactgataatcatgtcaatctattacttttctttggaagaaataattttttgactatatgacagtttttttaaacacagataaaaaatgtttcattattcttaaactgtgcctgcaaaccattgctaaagcaaaatagaagctttctcctttgtatagtacaattttattgtatctaatttagatgtggaaaaatgttaattaatcttaattaatgcagctgttgaaatgagggatacctgttagccagagtggcctgagaggtgcctttatttcatgaaacagaagactttggtagctacaatccacttaccactttttaaattattattttcagtttttaaatttctaaatttttatttatgaggttatatgctaggtatatatatatttctggagtacatggtgtattttgatatgggcatacagtgagtaacaatcacatcagggtaaatgtgatacccattacttcaagcatttattctttgtgttatgaacaatccaataatattcttaataatattcttagttatttaaaaatatatactaaatattattaactatagcctccctgctgcactatcaaattctagattttattcattatatctattttttatatccagcaaccatctctacttcttacccccactactcttcccagcctctggtaaccatcattctactctgtcatcattagttgaattatttcaatattttgcccccacaaataagtgagaatgtgtgaagtttgtctttctctgtgtggctaatttcacttaagctagtgacttccagttccatccattttgttgcaaatgacagggtctcattctttatcgggggaaccagcccccaaaatttcaatgtaggttcttttctattttccctaagtgtcggccggtctgagaaataaagagaaagagtacaaagagagaaattttacagctgggcttccggggatgccatcgcatattggtgggacgatgatgatgaccccgagccgaaaaaccagcaagtttttattagggattttaaaaggggagggggtgtacaaacagagtaggtcacaagaattactgatgagggtctatgccccactgtgtatgcattgtcttgataaacatcttaacaggaaacaggttttgagagcagacaactggtctgactagaatttaccaggctggaatttcccagtcctagcaagcctgagggtactgcaggagaccagggcatatttcagtccttatctcaaccgcataagacagacactcccagagcggccttctatagatctacccccaggaatgcattccttccccagggttatcaattattaatattccttgctgggaaaataattcagcgatatttctcctactcacacgtccatctataggctctctgcaacaagaaaaatatggctctattctgcctgaccctgcaggcagtcagaccttatggttatcttcccttgttctctgaaaatttctgttattctgttctttatcagtgtgcattgattttatattgtccaaatacacatattttacaatcaatttgtacaatagtggtccagaggtgacatatattctcagcttacgaatataacaggattgagagattaaagtaaagacaggcataagaaattataagagtattgattggagaaatgataaatgtccatgaaatcttcacaatttatgttcttctgcctcagctccagccggtccttccgttcggggtccctgacttcccgcaacaattcttttttatggctgcattgtattttattgtgtatatgtactgcattttctttatccattcacctgttaagtgatgcttatcttgcatccaaatcttggctattgtgaatagtgctgcaataaacatgagtgtgctgatatctccttgatatactgatttcctcttttgggtatatagccaaaagtgggattactggctcatatggtagctttatttttacttcttaactccaaactgttctccatagtggttgtactaatttacattcccaccaacagtgtacaaagattgcctttccttcacatccttgccagcatttgtttttgactgtcttttggatataaaccattttacctggggtgagttgatatctcattgtagttttgacttacatttctctgatgagcaataattttgagcaccttttgatatatctgtttgctgtttgtatgtcttcttttgagaaatgtctattcagatttttgcctatttttaaatcagattattagattttttttcctatagaattatctgagctccttagatattttggttattaatcccttgtcaaatggatactttgcaaatattttcttctatagtgagggttgtaatttcactttgttgattatttactgttcaaacgcttttaaacttgatgtaatcctatgtgtccatattggctctggttgcccatgcttgtggagcatatgtcaagaaacctttgcccacttcaatgtcttggagaggttccccaattttttttcttagtagttccatagtttgaggtcttagatttaagtcttcaatccatttttgatttgatttttgtatatggtaggagataggtctttagttttttttttctgcatgtgaatatccagttttcccaccatcatctattgaagagattgtccattccccaacgtgcattcttggtgcccttgttagaaatgagttcactgtagatgtatgaatttgtttctgggttctccattctgtttcactccattctgtttcactggtctatgtgtctgtttttatgccactgccatgctgttttggttactataacactgttgtataatatgaagtcggataatataattccaccagttttgttctgtttgcttatgatagctttggctattctggatcttttgtagttctatataaattttgggattttctttcctgtttctgtgaagaatgtcattagtattttgataggaattgcattgaatctgtagattgctttgggaagtatgaacattttaacaacgcagattcttccaatccatgaacatggaatatctttccattttttgtgttctctaatttcttgcatcaatgttttatagtattcattgtagagatcttccatttattttgttaattcctaggtattttatttgatttttagttattgtaaatgggattactttcttcatttatatcagattgttcactttgggcatatagaaatgctaaggattttttgtatgtttttttatgctgtaaacttgaatttgtttatcagttccaatatatttttgatggagtctttacatttttttcaaacgtaacattgtattatctgcaaacaaggattatttgacatcttcctttccaatttggatgccctttccttttttctcttgtctgattgccttagctaggacttccaggactatgttgagtaacaacagtgttgaaagttggcagttggcatttatgtcacattccagatcttagagcaacagcattctgtttttctccattcagtaagatactctacatgaatctgttgaacatggatttcattgtattaatgtatgtttcttctataccgagtttttgagagcttttgtcataaagggatgttgaattttatcaaatgcttgttcagcatcaattgaaatgatcatatggcttttctccttcattctgttgatataatgttcacattacttgatttacatatgttgaatcattcttgcacccctgggataaatcccacttggtcatgataagtgatccttttaatgtattattgaattcagtttggtagtattttgtttaggacttctgcatcaatgttcatcatggatattgagctatagtttgtgtacgtgtgtgtctttgtttagttttggtttcagggtaacagtggcataacagaatgagtttggagtaattcctcctcttccacttttcagaatagtttgagtaggattgacagattttctttaaatgtttagtaaaattcagcagtgacaccatcagatcttggcttatttttgttgggacactttttattataatttcaatcttgttatttgttattgatctgctcatgttttgtatttcttcatagtctaatctaggtgggttgtatgcatctagaaatgtatcaatttcttctggattatccaatttattggcatatagttgctcatggtaatttccaattatcttttcaatttctgcagtattggttataaagtctcttttttatcactcacttgatttatttggtcttctctctctttttcttagtgtggctaaaagattgtgggtttattcagaaaacaaacttttagttttgtaaatcttttgtattgttgttttgtttcaattatatttctttctgctctgctctttaatttcttctcctctactgattttgggttgtgttttctcttgcttttctagctcttttgtatcattaggttcttcatttaaagtttttcctctttgtgatgtaagtgcttattactgtaaactttcctctaggtactgctttcgttttatcccgtaggttttgctatatcgtgtttctgttttcattttgttggtgaatttttaaaattttatcttaatttcttcctggtctgactggccattcaggagcttattgtttaatttccatgtgtttgtatagtttccaaaaatttctcttcttgaattttacttttattttattggggttagagaagatatgagataaaatttcaatttactgaattttttaagggttgtttagtggcctaacatatggtctctacttgagaataatctgtgttctgaggagaaatttgtattctgcagcctttggaggaagtattctataaatgtctatcaggtccatttggtctgtaatactgattaagtttgatgtttcttcattaattttttctagattaattgtccaatgctgaaagttaggtgttaaggaatccagatattattatgtttgaatctgtgtctctctttatctctaataatttctctctatatgtgtgttccagtgttgggtgcatatatattttcaatttatatatcctcttcctgagttgacccctttattattatataatgacctttcttctctctttttatacttttggtcttgaaatctattttgtctaatatcagtatatctcctccaactctttcttggtttccatttgcatgcattatcattttgcatctcttcattttccatctatctgtgtctttacagacaaagtgtgtttcttataggcaacaggtagctgggtcttgagggattttgtgtttgttagtttttgatcattcagccactctatgtcttttggttggagagtttaatcagtttacattcaatgctattattggtaaataaggacttactcttgccattttgttagttttctggttgttttgtggtcttctctttcacctttccttccatactgtcttccttttagggaaggtaattttctgtgcttgtatgatttaatttcctgcttttaatttttgggtatatcttgtattttttttttatttgaggttatcatgaggcttgaaaataatatcttataatccattattttaaactgatgataattttacactgatagtataaacaaacaaaaacaagcaaatagataattaacaaaaactccacactttaacttaatccctcactttttaacttttagtcatttctatttatatcttattgtactctctatatcttgaatgttgttggttttattatttttgtttggtttgtcttttagtctttctagtcaagatatgagtaggttacacaccacaattagacttttgtaacactttgtggttttctatgtacttactattaccagtgagttttgtaccttcagataatttcttattgctcattagcatcctttccctcaggttgaagaactcctgctcgcatatcatgtaggaaaagtctggagttgatgaaatccctcagcatttggttgtttgaaaaaaaatattacttctccttcatatttgaaggatatttttcattggatatactattctgggataaaagttttttcctgcagcactttgaaaatgtcaggccactctcttctggcctgtaagatttccactaaaggtctgctgccagatgtactggagctcctttgtatgttatttgtttattttctcttactgaatttaggatcctgtcttcacccttgatctttgggagtttgattattaagtgctttcaggtagtcttatttgggttaagtcagcttggtgttatataacattcttgtaacttatatattgacatctttctctaggtttaggaagttctttgtcattattccttcaaataaactttctccccacatctctctctctcttctttaggccaataattctctgattttctcttttgaggctgctttctgtattgtgtaggtatacttcatgttttttagtcttttttcctttgtctatgtattagtccattctcacactgctatgaagaaatacccgagactgggtaatttataaaggaaataattttaattgactcacagctttgcgttgctggggaggcctcaggaaacctacaattatggtggaaggcaaaggaaaagcaggcaccttcttcacagggtggtaggacagagtgagtgcaagcaggagaaatgccagatgtttataaaaccatcagatcttgtgagactcactcatcatcacaagaagagcatgggggaaatcacccctatgattcaattacctccatcttgtcccactcttgacaggtggggattatgattcaaggtgacatttgggtgaggacacagagtcaaaccatatcattttattcttattatatattttcaaatagcctgtcttcaagctcactaattcttccttctgcttgattaattctgctgttaagagattttgatgcattgttcagtatgtcagttgcacttttcaagttcggaatttctatttgacccttttcaattatttcaatctcctttaaaatttatctaataggattctgaattccttctctgtgttatcttaaatttcattgaatattctcaaaacagttattttgaattctctgtggacaggtcacatatctctgtgtctccaggattggtcactggattcttatttaatttgttttgtgaggtcatgttttcctggatgaccttgaagtctgctgatgtttttcagtatctgggcattaaagaattaggtatttattgtagtcttcaccattagggcttatttgtagctgtccttttttgtgatgactttccaggtattcaaagggacttgagtgttgtgatctaagttgtaggttactgcagccatgtctccactagggagtgaattaatctgtttttatgctgctaataaagacataccaaagactgggtaatttataacagcaacaaaaaaaaagtttaattgaatttcagttccatggctggggaggcttcacaatcatggctgcaggtaaatcaaaagaggagcaaagtcaccccttacatggaggcaagcaagagaacttgtgtaggggaaattccctttataaaaccatcagatcttgtgagatttactcacgatgctgagaacagcatgaaaaagactagaccccatgattcaactacctcccacctgggagctataattcaagatgagatttgggtggggacacagccaaattatatcattccacccctggcccctcgcaaatctcatgttctcacgtttcaaaacataattatgcccttccaatgacttccccaaagtcttaactcacttcaggttaactcaaaagttcacactccaaagtctcatctgagacaaggcaagtccctttcacctatgagcctataaaatcaaaagcaagttagttacttcctagatacattgaggatacaggcattggttaaatacaccctttccaaatgagaaaaattggccaaaacaaaagggctacaggacccatgcatgtctgaaatccagcagggcagtcattgactccatatctcaaatccaggtcacgctaatgcaagagttgggttcccatggtcttagacagctctgcccctttggcttttctgggtacagccccttcctggctgctttcatgggctggcattgagtgtctggggcatttccaggtgcgtggtgcaagctgtcaggggatctactattctgggttctggaggacagtgactttgtttttacagctccactaagcagtgccccagtggggactctgtttgggagcttacaccccacatttcccttctgcactgccctggtagaggctcttcatgaggactctgcccctgcagcacacctctgcctggacatccaggcatttccatacatcatctgaaatttaagtggaggttcccaaacctcaattcttgacttgtgtgcacctgcaggcccaacaccacgtgtaagacaccaaggcttgtggcttgcaccctctgacctaacagcctgagctgtatgttggccccttctagacatggctgggatgcagggaaccaagtctcgagactgcacaaagcggaaaggccctgggcccaggcctttaaaccatttttcctcctaggcatcctggcttgtgatgggaggggctgccatgaagccctctgacatgccttgggagacattttccccattgtcttggtgattaacatttggctcctttttacttttgcacgtttctgtagctggcttgaatttctcctcagaaaatgggtttttcttttctattgcatcatcaggctgcaaattttttgaacttctatgctctgcttcccttttaaacataatttctaattccaaaccatatctttgtgaatgaataaacctgaatgcttttaagagcacccaagtcacatcctgaatgctttgctgcttagaaatttcttctgccagatgcctgaaatcacctctctcaagttcaaagctccacaaatctccaggtcatgggcaaaatgcttccagtctctttgctaaagcatagcaagaatcacctttgctccagtacccaacaagttcctcatctccatctgagaccacctcagcctggactttattgtccatatcactatcagcattttggtcaaagccattcaacaagtctctaggaagttccaaactttttcacatcttcctgtcttcttctgagctctctaaactgttctaacctctgcctgttacccagttccaaagttgcttccacatttttgggtatctttacagcagcaccttgctctaccagtaccaatttactgtattaatctgttcttacactgttaataaagacaatattgagactgagtaatttataaaggaaagaggtttaatggacttaccgtgccatgtggctggggaggcctacaatcatggctaaaggcgagtaaagagcaaagtcatgtcttacctggcagcaagcaagatagcttgcataagggaactaccccttgtaaaaccatcggatctcatgaaactcactatcatgagaactgcatgggaaagatcctccctcattactcaattacctcactccaggtccctcccatgacatgtgggaattatgggagctacaattcaagatgagatttgggtggggacacagccaaaccctattgggggcatcccaagcccagtaacactgtgggttttactgactcatataggtatggccttggtggttttgggtaaaatcttgaaagtttctctgcattacccggcaaagaagctcgttgtgttcccttactttctgccaaacaaatggagtctttctctctctctctctctctgtgctaaactgcctggagctggggaaggggtgacacaagcacccctgtggtcaccactgctggactgtgctggttcagaccttaagccagcacagaactgggacctgatcaaggcttattgtacccactgcctggccactgcctatgtttcctcaaggccccatgcatctatcattagcagagaatgaacccagctaggcttctgtcctgcctttcatggtggcaagttttctcagccccaggcaggttcagatgtgtcatctgggaggcaaggcctggactccagaaccttaggcatctaattggtgctatattctactgcaactgagacaacacccaagccacaagaaaaatgtctttccattctttcccctttgctcaagcagaggagtctcttcctcatgaccaccaccaccccaggccctcagtgagtactgcctggctattgctcatgttcactcaaggcccgtgagctctttagtcaaattgtggtgaaagttcatcaggcctggcactctccctttaggacagtgtgctcccctgtggtccagagcaggtccagtgatgctgtgtaagacccatgtccttcattcaggagccccaggagctcagttggtgttctaccccactgtggcccagctggtacctaagctgcaggacaaagtttcctgtagtctctcttttttcaagaagatggagtccctccccataaccaccacagctgggaatgtgcttggtcacacctgaagtcagcccatctcagagtcttaaccaaagttcatggcatgtaatatctggccaccactgcttattattcttgacctaagggctctttaatcatctagtaatgaatcctgccagggacgggtcattcccttggcggcaccaggttcactctggctgaaggtatatctacagatgcctggagctagggcctgaaatggggacctcaggaccctgcctattgccctatcctattattgctgagatgatatccaagttgcaagacaaagtcctcatttttttcctctattctcctcaaatggaagggcagattctctcccagagctgtaagctgaaattgctgggatttgggaatgggtgacacaagcactcccttggccaccccagctggtactatgcatcccaacacatgatcaagacttgtccaggaattacagtccttgtggcctagactgcctttcaactttatttagaatgccagaactctttaacccacggtggcattacttgctagaagtcaagttgcgaccaccatgatgggcaattcccctctggctagtgctagtctaaatgctcgcagctctgccaggtgctgttttccactgtgacagggaaacactgggttccaatttaaagtcccgtattcattgtgctctgccttctcttagctcacaggttcactctttgtaccacatggcaactgcccaggaatggggaaggagtggcatctgcaattcaagactgtctttcctacccctcatcagtgtctttttcagttatatggagttaaaatcggcgttgtgatcactcacctgatttttggttcttataaaggtgctttttttgtgtagataattgttaaatttggtgatcctgcaggaaggatggttggtagaggcttctatttggtcatgttgctctgtctccaaacatatgaaaatttttatgtgtacttttgcatttatcatggactttagtttttcttaaatttgatgaaaatttaacctaccatcaggagaaattttagacacaagaacaaaaaagataatcctacaatgtgttttgttgttgtctgagacattttaacaaattagacattacaaatatctggtttgccaaatcaaactttttgatacatcactattctacaattctgagtggtttaattgaacatcttacttgtctgtacactgactcgtgctggtgtttttgttacccaaggaatttagctagtgtatctgaatgctaaggaaagtggaactaattggtggcttgcaaagtaaggtgttaataagtaacactttaaatgtgttacttattaatagctgttaggcatatatggtatggaaatggtaaacaattgaatattaattttcttctttaaaatcattaaatcttaggtgcttcaaattttataactaaaaattttaaagatctacccagacctctctgtttcacaaatgggaaaagaaaggaaggcccagaaagaaaaatattttctttatttaagtaatgggggataaaaagtaattttgattttcttttatttgcaaatgtgctaatgaaaaaacagtatataataaagtttttttaatgaagaaaagtaatttaaactaaaaaaagttaccaattttttattggaatttttctaaatcgcttttgaaacaatattgctataatacataaataatgagactaatggtaaactctaaaatgtggtaacgccagataaacacatttggtaaggttattgcttcaattttgtgctatgtgaattatatatctccacaaactttttcaggaaaatcaattaagaccttcctttggccattttctaatttttccattactagataaaagagctattaggtcaaatagattatttttctagaaacaaattattgattattacttaaacatcactagcgtatatggattgtgctttaatatcttacttctgaaaatgtagatacaaaataaggtttttataaaatggcctaaaggaaaaatttttatctattatgtaagcaaaattcttggagtcaaagagacatggaagaacagaaaaataagaaatgtaaagttttcaatatgtagccttaaataattaatttattagttgagtttggtgttcttaggataaagatgcaaaaaagcagcttaaacaacatctcaataagacattattgagcagggatgctgcattatgtttgtcttttatgtcttgtatgtgtttctcctatgagcctccaggtgaggctccctcacagaactcattgtagactatttaactgtctatgatcttccttttgtatgtttattagccctttgtaattttttcactgtgaatttgccactcaaacaatttactcattttaatggggtgctggtcttattcttttctttattaaaacatcattagcaattatttcatgtttatatattcatgtaaatagtagatattctgtgtagtactaagaaaaaagattgggactttcgtttctagaaaaatggtgggttagattgttcagagtaatcatattaatgtaaatatgaaaatagtttgatgtaactcattttaaaataattttaattaataagacatccaacaagacagtaaatgcatttaagagaattagaaatccagggaggttaagtggaaccattaagacatttgccctaaaggcatttgccaatctgtgaataggtaaaaacttctgttttgatgacttttgatggcaaggggagcagaagttgaagtctttggtttcctagagtggaaacttcaatagaacccataacacatgaattttggattcccagaaaacataccttcagagggaaggagacataactaccaccagaaagtatttttctaaaaagttgctcagaacttggaggaataagggaaaaaaaaaaaaaaactcttaagcagtggggaaaaaaaaagctgtcctgtgcacttgtaattccaaggagacatattctaaccattgtcagatgacagaggtggaacaaccagtctctaaggggatccagactttccctcatctttctgtgcttcccttatctcctgttgggcttagaagccctccaaactctcccaacctctgcctgttacagtttcaaagctgcttccacatttttagatttcttaatggaaagacctcactccctgggatcaattatctgttagtctcttcttgcattgccataaataaatatctgaaactggataacttaaaagaaaagtggtttaattggcttacagttcagtaggctgtagaggaagcatggtgccagcatctgctcagcttctgatgagacctcaggaagcttataatcatggtagaaggcaaagttggagcaggcatgtcacatggcgagagacagatcaagaaaggggaaagaagggcaacaatcttttatacaatcagatcttgtgtgaactaacagagtgagaattcactaatcaccaagaggttgatgctaaaccattcatgagggattagcccccatgatgcaaacaccttcagcattgtggattacagtttaacatgagatttggaggagacagacttccaaattatatcactaatcctactcaaactattctgaaaaatagaggaaggaatactttcaaactcattcaatgaggccaatattactttgatactaaaactaaacatacgtcaaaaaggaaaactacaggccaatatccctgatgaatattgatgcaaaaatccttaaaaaataaacccaacaaactgaagtcaacaacacattaaaaatacagttcatcacaaccaagtaagatttaccctagggatgcaaggatggttcaacatatttgaatcaatcaatgtgatacatcatatcaacaggatgaaggagtaaaaccatattagcattttaattgatgctgaaaaaaatctgataaagttcagtaccccttcatgataaaaattttcaaaaaactggatatagaaggaatatacctcaaagcaataaaagccatatatgacagacccatatcttgtattttactgaataggaaaaactgaaagccttttctctaagatctaaaacaagacaaggattccaactttcactattgttattcaacatagtactggaagtcctagctagagcaatcagagaaaaaaaaaagaaagggcatgcaaattggaaagaacgaagtcaaattatctttgtttgcagattatatgatcttagtgaaataaggtaggcgcagaaagacaaatttcacaaatatcccaaatttatacatctacagtgaactcatttttaacaaaagtgtcaagactgtacactgggcagaggacaatctcttcaatagatggtgctgggaaaactgtatattcatatgcctaagaataaagctagacctctatcttccaccatatgcaaaaatcaaatcaaatcaaaatggattaaagacttaaatccaagacctaaaactatggaactactaaaaaaaaaaaaaaactgggaacctctccaggacattgaactgggcaaatatttcttgcctcttagcccacaagcacaggcaaccaaagcaaaaaagaacagatgtgattatctcaagttcaactgcttcttcacagcaaaggtaataatcaacaaagtgaaatgacaactcacaacatgacagaaaatatttgcaaactaccaactcgacaagggatttataaccggaacatattataaactcaaacagctcaacagaaagaaatctaataatccaattaaaaaatggacaaagggtctgaatagatgtttcccaaaagaagacataaaatggcaaacagatatatggaaaggtgtttaacatcactgcaccacagggaaatgcaaatcaataaggcaataaaataccaaattaccccacttaaaatagtttttatccaaaagacaggctctgttgataggaatgttaattagtgcatccactatagagaacagtttggaaggtcctcaaaaaactaaaaatagaactaccatatgatttagcaatcccactgttaagtatatgccccaaagaaaagtaatcaatatatcaaacagatatctgcattcccttatttatttcaggactattcacaatagccagattttaagcaacctaagtgtcatcaacagatgaatggataaagtgtcagatgtatacacaatgtagtactattcagtcaccaaaaagaataacatcttgtgatttgcaacaacatagatggagctgtaggtcattatgtttagtgaaataaggcaggcacagaaagacaaatatcacatgctgccaatcatttgtgggagctgaaaaattaaaacgactgaactcatgaagatagcgtgtagaataatgtttagttaccagaggctgagaagaatagtaagggagaaggggaaagtgaggatagttactggatacaaaaaactagttagatagcatgaataaaatcgagtatttgagagcacaatgggaggactacagtcaacaataatttattgtacattttcaaataatggaaagagtataattggattatttgtaagacaaaggatgaattcttgaggtgatggatactccatttatcctgatttaatttttacctattgtatgcctgtatcacaacatctcatagacctcataaatatatatacttactatgtaccaacaaaaattaaaatacaaaaattaagatgaggtcatactggatagagtaggttttaattctatataactggtgtctttttttttttttttttaatttttgagacagggtctcattttgtccccccagtctggaatgtagtggtgtgatctccactcattgcaacctccatctcaaaggctcaagccatcctctgcctcagtcccacaagtagcagtgaacacaggtgcatgccaccaagcctggttaattttgtactttttgtagagactgggtttctccatgttgcccaggctgctcgaactcctgagctcaagtgatccaccctcctcagcctcccaaagtgctaagattacaggcatgaaccactgcactcagccttgtctttgttaagaaaagaggtgacaggcacacagtggagaaggccatgtgaagactgaggcagagaatagaatgatgtagctataaggtaaggaatagcagggaaattaaaagaagcaaaaaatatttctatcctaaaaccttcacagagctcctgcccattgctgacaagttagttttggaccactaggtctagaaatgtgcaataataaatttctgttgcttttagtcacttagtttgtggcactttgtcatggcagccctataaaatgaatacacggggtatgctatttctgccagattttatctttcagtttctccaattcccagtcaggggatgtgtttatctgagacaaaaaggtgctagcttcttctgcaggacatcctcttaattaaagtcctcaaagctggatgcttggaaatggtcagggacaaatgcagttttctgtatgactttctgtatggaagacaaactgtttccagttgtgttccagctcagcctcacaggtttcagattattctttctttcccctcttcatatcagttttcttttcctaactgaatatcttgcaaacttcaggtttccacataggacccaggaacaatagccaccacttctctaattgaaccctgactaacacacttggttaaatacatatatatatatatatatatatatatatatgtttctataaacttattttgtttaaatgtgtaaaaatcatgctatgttacctcccaatagttttgtttttttcttctacattactatcttttaatcttagcttttaaaatatttattaaatactgactaaaatatcactggtacttttacctcaatgtcttatatgcctgaagaaaccaacaatgcttgcacctgtaaaaaataaatgggtaaaaatctaccagtgtgacaattacaatgttagtaattgtatgaatcagaacttactctactgctgaaaatagagaaaatgcttactttaatttaaaacattagctatttgtatccagcatcaagcttttacacaaagaataattctatgcgataccaaaagactcacaaaatcagtcaattatttataaaatagattatttttataaaacaagcagttatttttgtgaactgaataatttggtaattaaaataacctgatagttccattttaaaaattaggttagtgtggagatatcctagtaacattttcaagtattttaatcctgtgagaactacacaaacctaaataacctagaagtctaatgcaatatttttacatacgcaaatactaattcccaccctccatactcacagaagtttatgatatacacagtatttgctgttcctttcttttcagaaatagagactgatctcacaagatgagataggaaatattctgattaaaaacaccagaaaaagaaagaagtgtaaatgggaagatatactctgagtacgaaaatccacttaccagaagcaacttctgttttgaaaaacacaattctgtgttttactttttactgtgcactaaaagataaattgattcatacattccatagattatatatctgtgtggaatataaaagggtctatgtgtatattactacttagaatatatttgaatctgacatgacttctgaaagctgaatgtaacttacagtgattttagttattctttattgtattttattagatgctagttgctgcataaggaattttgtgtgtattaacttgtataatctacacactaatattactaagaaaacactggctttctgtgcaaattatattttaaatctggatcttcataagtttaggtaactttcccaaatactcactgtctgtaatttagggaaccagcattcacattcagttgtcttgactcccaagtctatataacagctatgcatgctgttcttcccctttactggccagataagagtcttgtcactcggaattatgacagagtaagagaaaatattagagacttcacaattttctttcaaaatgtctgcaaatgaatatgtaagggaattctccagaatagcatatgaaactgatgacaatcaaaagtgatgaagtcaagcatgttccaaagagaatctaataaaggacattaaaaaccaccaatgattatgattttggaactatgcagaacaggacaaagagtgaaggaggctgtctgaggtgctgaaatacagcatacaaacatgttacagactaagtataaaatcttgtattaattcaggcttccatactgagttcctcaggtaacacataaaatgatcactggtcacaatttggaagaaactaattataaacaatcaaataaataatagaaactaaaaaaaaaaaagccttgccatattgactttaaaaaatcccatgcaggccattatgtaataaatcatatgaaaactatataattttaatatagtagtatttttcaatctggtccaatattgttggctaagtaagttctgctgtctcaaatccattaagaatttgtgggaatacatgtgatcttttattaatagatgcttaaaaagacatataatcaattttataaaaattaaagtttagtatgaaagttatttgtcatcatttgaatacattttatttttaaccaacttggatctctcagactctgagaaatttatcaatataaacatttctgtcatatgtttctcatatttcttacatttttatctttgtattttggtgatttttaatttggatgatatagttttgggacatgtaaagttaaatatgtataactttattggagtaaaaatttacccccaatattttgcttactattttaaattcaattttttgagattaatattagttacctttctttctttttcttgtatagcatacctaacaaatgtttggcttttttgcctatttaattttgatttgagtgtgttgatttaagtttaagtaataacatattgtaatttctgtttcaagatagtgagctgagcacatgcttcactcttaccttcctgtaacaaatatctagaaacaatataatatttaaacaacaggaaaacaaaaaacaaataggctctttcccaggaccagatgttgtgacaaggtcccaaaagttagaaaacagataaaatttacaaggtaagcctcagccaaggacacacatagaaaattacaactgtgaatggtgctgaaagctaattgaagccaaacaaaaagggagacttttgagtgatcgggccacgtgttttccaaaacctcctacattctgtgttcattaggcttactagatattaagcaatggagtgttttcctcagcaaaactccctggcaaaaaaaagaaagttgcatattctttttaaatatgtgtaatatattcataaaaatggttttaaaaggagtcttagaaacatgctcaaaatgttgataatgtgagagtgaaattcaattatcatgaagcagtagctgtaaaacttgacaaaagaattaacaaaatatctctcaatcataaaatttaagaaaaattaatgcttctaaataagtcttgcatttatagataaaatggatgtagtagttcgttttcatgctgttgataaaaacatacctgagactgggcaatttacaaatgaaagaggtttaattggacttacagttccacttggctggggaagcctcacaatcatggcggaaggcaaggagcagcaagtcatgtcttacatgaatggcagcaggcaaaaagagagcttatgcagggaaactcccatctttcaaaaccatgagctctggtgagacttattcactatcatgagaacagcatgggaaagacgtgcccccatgattcaattaccttccaccagatcccttccataacacgtgggaattcaagatgagattttggtggggactcagccaatccatataattccattctagcccctcccacatctcatgtccttacatttcaaaaccaatcatgccttcccaacattccctcaaaatcttaacgtatttcagcattaactcaaaagttcacagtacaaagtctcatccgagacaaagcaagttccttctgcctatgagcctgtaaaatcaaaagttagttacttcctagatacaatggaggtacagacattggataaatatggccatttcaaataggagacatcggccaatacaaaggggctgtaggccccatgcaagtccgaaatccagtggggctgtcatatcttaaagctccaaaatgatctcctttgactccatgtctcacatccaggtcatactgatgcaaaaggtgtgttcccagtcttgggcagcacctcccctgtggctttgcagggtgtaaccccctctcctccaccggctgctttcatgggctggcattgagtggctgttgcttttccaggtgcatggtgcaagctgtcatggatctaccattctgggatctggaagacaatgaacctcttctcacagccctgctaagtcgtgccctggtagggactctgtgtgggagctctgaccccttatttcccttctgcactgcactggcagagtttctagatgagtgctttgcccctgcagcaaacttttgccttggcatccaggcttttccatacatcttctgaaatctaggcagaggttctcaaacctcaattcttgacttctgtgcacctgtgggctcaacaccacgtggaagctgtcaaggcttggggtttccaccatctgaagcaacaggttgagctgtaccttggtcccttttagtcatggctggagtagttgggttgcagggcaccaagaccctagattgcacacagcacagggaccctgggccaagcccacaaaaccatttttccttaggcttccaggcctgtgatgggaggagccaccatgtagaattctgacatgccctggagacattttgcccatagtgttgggaattaacatttggttccctgttacttaggccaatttctgccacaggcttgaatttctcttaggaaaatgggttgttcttttctgttgcaccatcaggctgcaaatgttttgaacttttatgctctggctcccttctaaaactgaatgcctttaataactcccaagtcaccttttgaatgcttagctgcttagaagtttctttccccagatgccctaaatcatctctctcaagttcaaagttccacagtctctagctcaagggcaaaatgctgccattctctttggtaaaacataaaaagagtcacctttgctccagttcccaacaagtacctcatctccatctgagaccatctcagcctgactttattgtccatatcgctatcaggcttttggtcaaagccattcatcaagtctctaggaagttccaaactttttctcattttcctgtcttcttctgaggcctccaatctgctccaacctctgcctgttacccagttccaaagttgcttccacatgtttgggtattttttcagcagcaccccactcctgggaccaatttgctttattagactgttcacactgctgataaagacatacccaaacctgggctatttacaatcaaacgaggtttaattggacttacagttccacgtgggtggggaagcctcacaatcatggtggaaggcaaggagcagcaaatcatgtcttaaatgaatggaagcaggcaaaaagtgagcttgtgcagggagactcccattattcaaaatcatcagatccggtgagacttattcactatcataagaacagcatgggaaagatgtgcccccatgattcgattacctcctaccaggtcccttccacaacatgtgggaatttaaggtgagatttggttggggacacagccaaaccatattaatggagataactaactagacctacatgtcaatattaacattaaaaatacctactatttattctgcatttacaatgtgtagttactgttctaaatattccacttatgctcacatatttaatcctcataaaaaccttatgtggtcagcactgtcattaatcccatttaaagacacaaggagcttaaataatgtgctatatttcatctagctaatatgtgaccaagataggatttgaattcaaatagtctagttccaaagtccaaggtttaaaccatgatgcttcacttccttcaaactccaaggtaactactacatacaaaactaaattgacatatgatcgaagtgacaggtgaaaacatagctttatatataattattagaaaacaagaactggagaaatacaggaactaagcccgcaattcaataacatagtttaaaaaaaaaacagtgaaataaacctctaaacaacagaaggaaggaaagaatatattttaaaccagaaattactgaaataggaaattaataagttaaagcagcagaattgaccaataaaaagaaaagcaaagttctttgaaaatatcaattgtctttcaaaagacaagcctttggcaaatatagttaagagctaactaaatagagaagacacagagaaaaaaacacattcagaatgaaaaatgttatgagttcaggtctacaggagcttaaactaacatttcagagaacactatacgcagcttcataccaaaaaaaatgtaaacctaaacatttttgaagaaaactataaattgtcaaaatttaccctagcaaaaatataaatagaataaaataaaaatagaaaatatgcatgaattaagacagtcatagaatagttcgtgtagcagagcattctccattttccttcaaaaaagcaggaaatcttactaaaacaataacattagaaaaaaatgaaaacagttgataaagatttacccttagcaaagtcaaaagctccagggcatgttacagaaacttttaaataaaatttcaagtgaaggataatttcaattttagagaaagtatttatgaaacatggaaaattatgggaagttacatacttttattttataatgctcacatttatctgatgaaaaactgaatgaaaacagcatagagtagaaaactcatggtcaattttacacctgagcaatatattaaggtataagcaaactaaaatatttctgtttgagagtgtgtgtgtgtgtgtgtgtgtgtgtgtgtgtgtgtgtgtatgctttacaaatatggctgaatactcacactcagtaagacctataatattgatctgaaatcttcggtcatgtaagctcagggaagtatttctctaccataggtttaattactggttttgatcattaaaaacaccaattatctttagttcaactagcatttgctgtccttactttaatgccttttttctttatgtgctttaggaaattatctgtattttttttctgcatgttactgattacatttcctagagtattattatatttcctgcttgcattacatgtttattttgcaaattttgcatttactcatttcttttcttattacgtgtagctttttaaaaaatctctattttaggaatgcctttttatcttagtttattgccttctcatgtcagcttccatataccaatttcttatatttttaggtgtttttaaagtctattgagatcacaatcacatgtgttctaaaatttatactttttatctgtaaaagtatattttatttttaatagaaattggaaaatatttttttaaatcttatatgtatgacaaagttaactactaacttcaaaattcccaagttcataacacatgtaattaacaaagtattacaagatagtccataaaatatttaaagggtaatatttattgttgtctctgttataaaggtttatcaaaaacaaaaataatgtgtgtattttgtaaagcattcgactgaaaacatgtttcctatagattattatttaatacaaacagctcttttacaaagctaaactaaaacaaataaaccaacaaacagaaatgcatattccaagtcaacatgtttttctggaacataccagatctacatgaatgtggcaagtatgtaaaacgatcaggtgcatagttcactgtcttctttattcatataaatatatatgtatgtatgtcacatctatctatctatctatctatctatctatctatctatctatctatctacctacctatctatcatctatctatctatatgttttagaagagccatatttggtgattttcaccatcttgattccaagatgaaagtgtaatttgtgagcaaatggacaaatatatcttattaatatttagtcatggtttccatgcatatatgcacacatctaccttaatttaattgtggaaattgaaaatagaaataccttcaggttaacataaattttagaagagaatagcactcattaaactgaaaggtaagcagaaataaaactgcacaacaaataacgtgtccaggattcaagtaaataaatgtttagaaaatatgcatgaattaagacagtcatagaatagtttgtgtagcagagcattctccaataatccattgagtctctattttactaacttgatatgtggaagattttgagatacaaacaatagttgttccagtacaggcctcataatcatatttatcatatttatgattaacttggtgtgtcataatctatttgaagtattctgaaatgttagtatttgtaacaggattttatgtattagtcctctttagtgtttatgtccgaataacgtttccttccttccttccttctttcctctttcttcctttattttcactatgtgtataggtatgtgtcaagcatatttatcttagtaagctataatataatacatttggaatcaatcaagtaaaatgtaatttcacattattgttttacttatttgccttccttaaatacttgagaaataagcaaataaacattttacatctgaaagagacttcctatatgtctgttgtttaaaaagttcaactttattgaatgtcatattcatacacccttcttttgttaaattaggaactcatttctacttttttaagtcattgcacaatttctgacaactaattcaaaagcctttcctatgatcatatttatgctagatgcattgaaaatagtaaaattttatataaaataaaatatattgtacatattctcaactaaatataactaattctctagattttaaaagtaacacaactatattacacttttttaaacaattaagaattaatgtttaataaatttacataaattttaaaccttctcatctgaatttatgaacttcacctattcatatttggctacaaaatttgtttgaactgaagaaaacaatatctattatgaaattttatttgtagtttgaaacattatctttagatctgataccactttctagaagatcaatgctatcttgaataatgttttcctgaaacctaaggcttcatttttatgactttctttctcagttaaaaattcagtgaaagtatttttttttaattccagggttctctgatgagcgatgttttcttatttttggactattttccacagcagcccactattgctaaattttttaattaggaatttaaatgttccaggtctttccttaagaatcagaataattagatttcagatcactagatctgagcttttctgagttttgcatgcaaagtcctgctgacagccacttatttcaatcactggataaaaggactcactccagttgctttgccattacctgttctgtttttgaagaaatagctgcaaattcttcatctatagtcttgcaagccggatgttcatattactcttttggaaaccctggaaacctggcaagcttcttctattttaattttctcagtgataattcctctctttctctccatgtagactttaagattctttaaatatatttcttaaggtgatttatgaagaaatgtctctatccagatcagtctatgcctaattttgtacaaagcatgcttatttacacaaaatttaaaagtggacccatgacgtacaagatgctttaatgcttttttttttctttttttgaaaaccctttcattgtgaatcaaatctctgacgtattacagggtattttcaaatttctttctctgtatgtatcaccactcatctgaaggatatgactaatcaggttagccaatttcttcttggttttcagtagttctttcactttgttcaagtcaatattgtggcaatcacttttttcacacattcagataccaggtattattaacggcattcagcacatttcctctatgctttggtgaatccaggagagatgaggtgactacatttaatggtatgagcttgagtacatgcttttggttccctggagtactaaacatctaatctcattaattttttcttatgttgtatacaaaggtgttgactgtgcatttcacaatatttaattaaagttcttagacctttcttttttaacatttctaccaaaagatatttcaatacatatgggaaggcaagtagaaatcacacagttggcaagtaaagaagccagaggttggtgttaaaattgaagccttataacccagtgtcccaaaacttttcataaccttctgatttaaaccgtattagccatgcccacttgacctatgactttctaaaatttctctagtcttcctttacagaacaactagatattatcaccacattgttgaaggcgtacatttttaaaaaaatatatatagtgtcctgtgaaagcttgatgacatttctggaaaaagacataacatttttaaagaaatgcaggcttttcctctctctttccctgaaatggcctcaagcataaaagcctaagctctgaatccaagtttattgacaaaagatgttctgtctgcttttagtcatcatcaagaacatcttctgaaccatgatgtgaaagatacaaagtggtggtcgggcctctcccgtcaacaccaccagaagtgatatctctttgcatttttgcctcatgctctggtgtagagtctcagacacgacccacccacaccagacactgcccacagaattttgaaacactattaactcaggagcactagcagtgacaaagacccactgtattccctaaagccaacccttctgtacctgctttcaatctaagtgtaaactcccttcctcatctctcagtttccatctccttcatttgtctattaagagatcacatcagggatattttgctctgactatattttgttaaatttgaaaatactttgagggcaagatctattcacaagatctaagttcttttcttttccttatatttttgttattttctattgttgtcctttattcttcctgacacaagacatatttaccttgatctgttggtagccaataaacaggatcaataaattctcattgaccaccttaccccccacccccagagattgtggatattattgaaatccaattagatttttagaggagagattgttgatgtgcacagactgtaagtaaattttttcatgcctatgttgtttatcaaattttttttgtagggcaaagaagaaaacttttgctctcagagactagaagcatgacagaaagctacccttaggtgatttggactggtttgaagtgcatgaaacaacaaacagggtatggacacctgtaactgctattgctcccgtggcttctagtatttccatccttcctaatgtgaagctcacagcttgggttataatgcaccatcagttgctaatttctgcctttggtgatgttactctattggaaagtgtatccaaaagaatgtagaagaaaagctagtaattacttccgaatggagctacatagatactgtgcttgctatagagttagaagaaccttcagtgtgaagtatctgggcttttcacacagcagaatttagttggggttagtgcaataacttcttcagtctcactatctggctgtttcatctcagtccataacatgtttttgctactgaaaattcctcctgagtcttggtggatttgataaatattgagaatttcaaattctgtcacaatttactttctgaaattcttctctgttcaatgcctacagaatgtatttatctctgtgcttttatagcaattatgacagaacttgtataacatttgtcaaatagtatcacgtttgttcttaaccattttaaagagagaacatgactgtgcagtaatggctgcttgattcagaggcatttggccttactgtatctgattatgcatccataaaagctcgagattttccaccttatgaccagcccatcatgttttgttaacactattgattgctttggtttggcaccaattgacctagcatgtcatcaccgtcaatgtcagcatctttcacatttaatacacaattgtaaatgtaagacttgctcattactgcagaggatcttaattacacccaaaagatcataaagaaggaggttataagtagtacttggaggtgtttcttttcacataataatttgggaactccttgatgttatgaatcttattcaccttcttatcagcagattgtggcccaggggaagtaatttttaatcatttactgaatggaattgaaatgttaagtatatatatttggtgagaaatatattttaccactaagagatatagctaaataattttagaacattttaaaatttataaattaatttattcaataaaattgtttgcgtctgctatgtgccatgcaaagagattttttcaaagcacttatttcagatcttggtgattttttaaaaaataaatattggatagaaacttgaatgctgctaagaagaatgctttaaaaatattgaggtcatcaagagatcttaaagctaaattaatttgtgtgggcatcaatagaattggaattttctctggccaaccagtgtacaagttggccactcgtaactggttctgacatttggcttaacttagtcttctttgtaatcaattatatccaaaattattgaaaaaagtgaaaaaggtaataaacataattaaaagggaacattatttcaggtgcctcattgcttttccagtattttttctttaatccttttttaattctttctgacctcagagtcaggttgataggcaaaagattgcctaggcgtggggcatttaacgtcagctttagcctttccacattattttggcgtgttcttgggggaaaaccttccagtgcagtgtaagtagaggtccatggatttatttcctcacttccaggagtttaactgcgaattgagaaagattataacctcaaccttcttgtatttatagtctcaacagactcagaaaagaggatgttgaggtgcagagtaaattttaattgagaatatggctatagaactagtatgaaatatttacctgaaaggtgaaaataaagaaagcatggttattttattaataatgctggttgtagaacaaagataaagttataattcctgttaaactattttcaaggattgttatctatcattaaaatgatgtaatgataaatttatttaaataggcagtatcctctttgatccaaacagctttccatatagaaataactcatatggagaaatatgtattgacagattcctttcaatcctagtattcaatgctcctaaagctattatgtcaactaggaggcattttagtagatataaagttcataagactgtcaaattggttctccacatctgagaaatctgcatgcattttaatagagagttaatatattaagacattccaatttgttctttccaggaagttggattaaatgaaggaaggaatacattatttttaatatatcaagtaattcagaaattaagcctttgatgttacagaaaaatgttataatgtttaatgccaagaagagtatctgaaaatgaaaatatataatatttcagaatttatttcaccaatgaaatcactgggcagcatatttccatataactttatgtataatgtataaagcaagctttgacatttttttaggtagttaatatcaaaagagaaactataaaattttgtctgcagctgtctatggaatctcattgataagtgataatgaagtcccaagccctgtattttctctaatttttaaaaaatggatatactggaaaatacatttaaagagatcttttggagtagccaaaatggtattaaatacatgtttttcagaattgttttaattgatcacaacttctatggaaccctttaaagttgctttttgaggcaaattttgagtaactagattgtcagtgtcctctttcatttacctaagttggcattaaataatgtttgtctgttttaaaagaacaatttactctcataaaagaaactattggtctgaggtactcaaaataatatactacaaattccgaaagagttcaaaaaacattttgaacaaaggtgttgttgtaagaatttcccttctgatttaacaatttgtaatattaccaaataccgcatattctcactcataagtgggagttgaacaatgagaacacatggacacagggaggagaacatcacacactggggcctgtcaggaggtcagcaggcaagggaagtgagggcattaagacaaatatctaatgcatgaggggcttaaaacctagatgatgggttgatgggtgcagcaaaccaccatggcacgtgtctatgtaacaaacctgcacgttctgcacatgtatcccagaacttaaaccaattttttttttgaaaatgtgggccgggcatggtggctcacgcctgtaatcccagcactttgggggtcgaggtggacggatcacctgaggtcaggagtttgagaccagcctggccaacatggcgaaacctcgtctctactaaaaatacaaattagctgggcatggtgtcgtgtgagcctgtagttccagctactggggaggctgaggcaggagaatcgcttcaacccaggaggcagagtttacagtgagccgagatagcaccattgaactccagcatgggcaacaagagcaagactccatctaaaagaaaaaactaaaaaaaaaaaaattgatggatttttagacgcattttctaaaatatcactgatgttactataatagtcaaatcacatgggcttgttttttgctattgttttgaaatttttcttgaataaatgtcagaattgcactatttttttttcaatatttcagacatgcatagcacttggagtgtaatatactttagggctttaaatctcagttgtcctacacatgtggaatgaaagaactgatgttcagccaactcgtcagttcttttttttctaatgtatcacatttgatagatgatattagcatgcatgacatattcccaaaaactctaattgtaactccactttcccttccaaagaaatgaaagaaagagagagagagaaaggaaggaaggaaggaaaaagaaaagagaagagaaaagaaaagaaaaaagaaaagaagggagggaggaaagaaggaagggaggaaagaaagacaggaaccgtcaacatttcatcaatagaaacaaaatacatgaagaatatctcataactggttgactcacgtaaattcttggagaacagcagaattcggagctagcaatctaggatatcaatacatgactcagattaactgaatgtcagcggaatctattctatgccaacatacagatatggagaatatacttaacgcatttgttcattaagaggtccatctttatatccccacagtgttgttgctgatgcgcagcttggctttctttcatctgtgtcatgcaagtacccacttcttttttcatcttgctttaggggtgaatgactgagagagtaacctgtttgatagtactgtatagactttttcaacctcttcgttcttgtagacattcttattatcctttcccatatatcaggatggggtgtttttccatccttttgcatatctcctgatcttataaggacccctgatgtatatagcctcacttggaaataattagtgcctactatgtttattcctggaaaataattcttttctgtcttctgaacacatttcaaagcaagctctctcttttaggttctttaattcagggcactcttttttcttctttttttttaatgttacctctttgatgttatctttgaaatcgtagcacttgtcgaaatacctggctttcagtaagcttcataaatgcttgtggattgagggagtgattcagtcttgcactgctgatctagctcatgcaggtctggaagatttttctctgattttcctcattcttgctagctcctattagcacttgcttgtctgaggtttttatatgtccttgttcactgcgttcattatagttcacaagaaaatctttaacaacactgttcaaaccctagcaatccatagaccaactcaggcactgcttacacactgctttatactatcctcagtttgaaagtctttaattggattattcacgttcagttttatcacagtcgttacaatttctcattgttttatataggccccatccacatggctttgttatctgcctggttgtggtggacaatgagatcttgactccaatctaatttatgtctgctaagaactaattataatgtgcagggaacaggtcaataaaatttattcaaagaagaggaggaggaggagaaaaagaaagatagttaaaatttgaacgataaatatttaaacattctaaaaacagaaaatggacatctataaactcagctgccacatttgcctctgatttatttttgagaaataaaatcttatactctaaactctcctcctctacttgccttccttctcaaagcaaacaactatcaaacttactatatatcttttctctgaagatttttattactgttcttgcatacatttgcatccataataaagtttaacattctttcctaaatcctaacatattagactaccttaaaaagcttttcttctttttcagctaatgttatgttttaatacattattattttgatacttgaagacttagtttacttgttttcacagtagtgtagtgatagactgaatatagaaatgggcaatagccatagtatgaacaaaaatagaactttgactcacaacctctgcatcagtcagcccaaaacagtaaattacttggtcaaataactgttcgcttctctaattttgttcctgtttccaactcaggaccaaccagaaaaagttatatatgctgcccttaccaattacatagatgctttgcttctagttagcccactttcagctttccctttccaacaactttcaatcacagaacacttcaaacattccccttcttctaccataacattttcccactcccctccctgcctttgagtctctgccaaataagcgatggtagctgactcccttgctggagcaatctctcagtaaatagcctttgcttgtgttcattttggaagtctttatttgaacagtagtacagtcatgtgtcaatgacatggatacattctgatgaatgtgttattaggtgattttgccatagtgagaacatcctggagggtagttacacaaatctagatggtatagcctgctacataccaggctatgtgatatagcctattactctcaggctacaaacctgtatagcatgttaatgtgctgaaaactataggcaactgtaactcaaaggcaaatatttgtgtatataaatatggctaaacatagaaaaggcatagtaaaaatatggtattataatcttatgagaccactgtcatatatgcagtccatcgctcactgaaatgtcattatgtggcccatgactgtcttcagattctacatccattctcacaaaattctaagtaaacttattctcacaaatattctaagtaaactcttgcatatatatgtatatatatttatgttcatatatatgcaagagtttatttagatatggacataaatatatatatatatatggatattatatatatggatatatatgcaagagtgtacttagactatttgccataaaatgaaatgatagtttagattagttattacttcagctttgtttaactcttcccaaattgctatccaagctttgaacaaatttactttttaccagtaagagtttctgtttcccaaatctttatcaataattagtcttatcagactttttattttttggcaattaccagggatactgcaggctagggcagtaataacaaaaaaaaatcaacagcttcatttaataaaaaatgttttattattcatgtagattacattgctgttctgagtatagaccagtttggaagggagattaatattgtcaaaaataaaatcagatcaaaaaaaaattgtagtttattgtgtatacaaatgaaacattcacaaactgggagacctcaaaccaaagtggtacgtcctggtcagagcagttacagtgcagcatgtaaagcataaatgagggcatacattgatttttattgggattggctatcataaacttacattccttttaggcaagtagaactgttgaaacttattgatctgtcactgatttgtttaatttggctgatttatgctgtcaaagaacagaaagattatgttttgtgttttttaaaaaataattagagctagcattttggggaaaatcacaataacttgagttttggctatgtggctataggctgttggccttgagatatctaaactatatcctccattttaaattttgtaaaccatatcttaacaatatggagtattccaatatatgaacatttactaggtctttaaaagtttgtgatgcagatttctgtgaaagtcttacatattttttggcaaatttattctttaatattttatgttttaagagattttgtaagtgctatctaaacttttgaaaactaactgctagtatatagaaatattatgttttgtataaacacctcgtatccagttgccttgctagagtcacttattaattctaatttgatagatcattctgaaatttttggtcatctgaaaatttaaatagtacttctttttctctatctttagggtttctgtttgagacagggtctcactctgttgcctgagtgagagtgcagcagcatgatcagctcactgcattcttgaactcctggcctccactaatcctctcaaactcagcctcctaaagtgttagaattacagtccatttgttaatcataggtttaaaaatatcttttcctatgcctgtcttttcaatgtgttgattttatcctttgacatactgaaaactttaattttaatgacgtgaattagacttattttccttaaactaattctctaatgccaatagtcttttgtttattttatttatttatttatttatttatttatttatttatttagagacagagtctcactaccattgcccaggctggactacagtggtgcaatcttagctcactgcagcctcaacttcccgagctcaggtgatcctcccaccttagcctcatgaatagctgggagtacaggtgtgcgccatcacacccagctaattcttgtattttttgtagaaacgttttgccattttgctcaggctggtcttgaactcctgggctcaagtgatctgccaacctcagcatcccaaagggttaggattataggcatgaggcactgtacccagcatattttcataaagccatatttaacctgatattaataactatatacttagtttattttgggtagtatttaacctaaatgtatttttaaatccatttattttcaatattaggaaacctttgactttcagatgtgtctcctttaaaaaatatattgcttaaaaaaatgaaaatgcatttcttttaacatatatgcttagtttatttatatttattgaaatatttaatatcttcagacatttttatttactttgttctttttcattagtacattttgttgataatcttttatacattttcttgtctgcttttgttttttcatgtatttcattcttatgtatgtacatatttatttttattcagtttttcaaaatttatgttccttatttttttgtaatgctcattcttaaaaaagtatcacaaatatttagcacatgtagatttatataaatttccttataatttctctctggttttaggggtatccaggaacatatttttaatcttttatatcaatttgatcttttgtaccaaagtttatacacatgtagcttggaagttatttttctgttgttccaattttatcttatttttataagaaaactctagttctaggtgatatgaatgatttcatctttgttgcaacttcttttttatctcagcaaatgattaatatttataaattttctatataactttaaaaaagatctttaaatatttggtttgacgtatatataagttgatattggctaatattagctgacatataagagatgataataactcattaactgagttgattaattttctatatattactaatttgatttagttttcttatttctatctttctgattgtgttatattaaaaataattgttataaatgtgcatttttaaattcatcctcataattctgtttatttttaccttatatatttggaggctatattgttggatgcatgaagttcagcattgttatatttttctacatttttttctttttgctgtttaatgctttatctctaaaacactttatttctaataatgcttttttttttacagatgcctaaacatcctttattacaaacagctatgagaattttgaggccaaggatatgattgcaacagtaaggtttgatttacatggataagctttcttccccatgaaaacactatgtgtcacttcacactttgtctaacacacacacttaaatctccaccgtatctggcaccctatctggcaccctatctgaatttctgttccttgtctgtcaaacgaattccataactttcttgtctccttttatttttaaagtaataatccaatttaaagcttcaatttcaaattaaatctaaattgtactttcttatattgaacaacttcagtccgttgctcaaggaatttcaagtgcaaaagttgttctaatctattctttctcattcggtaagtcctgcaggttccaggatgcctgaaaacatgtatatgtgacaagttcccaggtaattatgcatttggattgcgaatcacactgagtagctatacacagaaaacacagttttgctagtgcaactggctgcattttatttctttgctgttctggttcagttagattttttctgctgatggtggcttcccactgatgttctggtgatatagatgtcatctgtggctatttggaatggtgttcagtattattctgagctcactctcttaccaagaactgctctgttcagatttacataaactcatttggctccatcagtaggtaatgctaccaatggcatggcactgaagctatgtgggcaatcccatgtcactatctcattactcattattcaatttctttatgagactccaatgagaactgaaatgaggtgaagattttcccatgtactctccagacacacaactcctctgttctgctttgtgttgctgtaaatccactaatccgacatgccttttgcctcagtagagtacccaacgagtgagtgagatgcaagtctttctttctttacacttccaacatccactgtacacttgatccacttgggccctctcttgcccaaaaaaatcatgtcttgtttttcatagggtagatttattgctggaaagtgactgaccagtcaggaactgcctttccttgctctctttgcctacagatgtgcctatctgactagttctcaccagtgtggatagaagtcatacgtgttactaatatttctagttatggtttctagtgctaatcctaagaccacagggaaaattcagctcaatattcaattacacataagttaaagtttacaaatgttcctaccattatcacaaaaatgaagactttaattcttacttgcctcctatgttaaacatatctttagtaatactttaaactctcctccaaataattttatttttaaatgtctgtgcttattcaggtttatccatgcttattaattgttttgtctaactttgctatttgcctctcatgctttgtcaggcattgtttatatgtgacccatccaatatccttcttatcctctgtacttagaatggtgcacagcagagtagtccacatgatgtaattttggccaatgagatacaaacagaggatatttgttaaggattctaggaaatgcattttcctgataaaaagggacaaccttattggtatttgatgattctccttcacaacttccctctttcttcctgactaaaaatgtggatgcaatatctggagatacaagagctaactggaaagcataaggaagacagtcagttgttagaaaaagaaaaaagagagaaagaggataatagaaaaatgctgtaatttggatgacattttgtagttgcaaatctctgaaaatctctgaacttcctacatctgaacttattctcatgtgctgaaaataaacttttatggtttaacattacacccttgtttggggatctctcttacatgcagctgaattcaattctgatggataccccccttcttctttctatatacttcttactgcagaatatcctacaagggcatttttggtgcaagactagaagtcataaagtcttgttgtttgtttgttttgttttaatttttgtcctaacatatctttatttagctatgttcatttcataatatagaattacaggttgacgattattttccctgagcttctagaagctattttgagctgtctttttaaatctagaaaactaaattttcattcatatcttttaagcttagctgaatatctaatggctgttttcttaataagtgtattgtcagtagaagggaaaccatacgaggctattctaccatgttgcagtaacaaaaatataaccactacagaattatatttgataagatcatgttctgaaattacttttgataactccccatcatgaggatgagatggtgggtggttgaggaggtgagaaatataataaatacaattaaaaagacagaatttttattaaatttgagttcttggggttcagttttttgagcctacaaaaatagattaatattgaggcaatctgtaggtgatccactacaacaataaaattaagacttttagtaaagccaatatttttagtcctaaatcaacaatagcataataactgatattcaacataaaaaatttattaaagatatctggttaatatgacgcaaaataggctataactgaagcattatgataaaattattccaagaaacaataatcttccagttttgttatcagaggacaatgataatttataattgtataccaaatagaatattagtatctagtggatttatgaaggattttagagaaaattgtgtaaatgatgaccttttattaatgcttcaacactattaccatagctctactgagagtcatattatttttatgttttccagtataggacttgtcctacttcaatgattatgaagtaaacattaaaattgtattagaaactgtttagctccaaaaattgtttttctattttaaaatgtaaatatggatattcttagggctatgctggtaactgtttttccagaaaaaaataataaaaggctaatttttatatttgttgatttctatcatgtaaatagttccaccatagccaatttcaagtttccagtgtgagatcgctgagcacaaagtttgtaaagagcaccactgtatcttttgagctggtacaggccacaggatatactcatgttcataccaactgtaaatctatttttaatacttttgttctagaaaggatttcaggtggctcatataatgtccaataaaacaagataaagtaacagtaaaatgatacacaatatttacataagaagatttagataaagctagaagttaggttagtaagggcttcaatactttaaaagcataaaatattctacatttactaacattggttctagattttcaaacaacagtgtagccatgtttagtttttggagtgagaatgcccttaaagtaaaaatgaacttgttgctcaggatcctatggttagagagaatcttatcctgagagccataatgaagaggactttgtgtaatgttttaaggtacattctgaaccataatgcagtacatctgacagtgtactttgtaggaaaagccataggcatttcacataacagaaagtgtagggggaaatggaggtggggaggatcctacatcatatggcctagttataacatttcataataatctggtttaattttatcttctaacatctgtgattcaatggataacatatttttcaggaataggagctctgctgagtttaagatttgtctccctgagtaatacctgttaaaaccattctgttttatatgtgacttataatgaaattagataattattaataatgacctcactggatgctcacaaaaatatttacaaaaaattctggcaaaacactgggctaaaggaggagaacagccactgtggagaaaggcacaaaacctcacccagggcaaaagcacaaaactgcacctcctctacaaaacaaaagccttaaactagggaaagaagcagagacagcaaccaatgcccttaaggcattgctgaaaactttgtgattgggggaagaaaaaacagaaatgaaaacctttttctgtgttggaagggtaagaatacctattgggtccagaactggcactgggataggatcagtacctctgaggccacaccatccagactcagaggcatagcgcttttctataacttaggctaaatcagtacaagagagaaccatcataccctcgaccccacctctcataacaccagtgttgaataacaagtagcaatgcaatactgctaaaagagataaaagagcacagagagatcctttattaggtgcaatgtaaaaggatgatttaggatgaaggtaaaatagatactggaggaaacctctctgtgaaccaacccctactctaaagacatgatgacactagaggactttgaagttacagtgcactgagaataaaaatagcaatgacaaatctcaacactgatcaattagtgactagattgacccaaattcatgcactaaatttctaaaataggacaaggcatacccatttctagccataaaagctacttacgtcagtatctattgtcctgtacaaattgtctggctttaaataaaaaattatgagtcatacagaaaagacagaaaaaaacactattaaaagacaaagaaatatgacactgatactcaaactatcagaagctattagagaggaaattcaaagtatgcatgattaatatatagaaggctacattgaaaaaaatatgaacaacatgcaatataagatagataatttcatcaggatgatagaaactatagaagaatcagatgtacatgctagaagtgaataccagagtaacagagataaggaatgtatttaacaggcttatcagaacacttgacacgtcaaagaaaaaaaaaatcagtaaacttgaagacgggtcagcagaaattacccaagttagaaggaaagaaatgaaactcattagtcctagctaaagtttgtctaccaataaaatgaatctccctccccaaatctacaaaaaacctataattaattagtcagtttagccatgtcattttatatgctacagtttggatgtttgtctccacccaaactcatgttaaaattgatttgtcattgtaacattattaagaggtagaactgttaagagataaatgggatatgagggctctgtcatcatgagcaaattaatgacattattgcaaaagggggggttattattacaagagtgagttccttataaaaaaagaagctgtgttgctttttgttctctctcactctctctttgcccttccatgataagatgacacagcaagaaggctttttctggacagtgacccctcaatcttgggcttctaggccatcagaactatgtgccaataaatttctattaattacaaattactgagtctgtggtattctttcataacagcacaaaacaaactaagatattacacaagatcgatattttatttctatatactatcaataactttggaattaaaaaaactaccatttataataccactaataagaaaatatttagatataaatttaacaaaacatgtgcaaaatctgtgttctaaaaactacaaagcattgattaaagagtacaaagaatgaatacctaaataaatagatttaatgtgttcatgaactggagactcaatattgttatgatgtcaatgaaattctaatcaaaatctcagcatgattttattgtaaatactgaaagactgattttaaaatttatacagggaggcaaaggaaatagaacagccaaaaacatttaacaaataagaataaagttaaattattgaaactacctgatttaaaaattaaaaatgcaatagcaatcaagacattgtgctattgatgaaatgatagattcataggttaatgaaatggaatagagctttcagaaatagactcaaattaatatagtaaacttttagaataatggtaaaaagggtaattatggagagagaagagtaattttttaaacaaattgtgcagaaaaattgcatgtccatgtgcaataaaaatgaaatttaacccatacttttcaacttatataaaaattaacatagctctaaatgttaaaattataaaacttctagaaaaagacataggagacagcctttgttatattgtgttaggcagaaagaattcttggataagacatcaaaagcacaatcaataaaaaaagaaaaaatctgataaacctatcaaaataaacaattttgctccataaaatatactgtgaaagaaaaaaaaacataagccatgtattaggagaaaatattttcaaatcatatacctgctaaaggatatatatcagaatatataggaaattttgaaagtcaacaatgagaaatcaaacaacctccatcccctgagaaatgggccataaatttgagtaggcattccatcaagaaagcatagagttggcaagaaagcatatgtaaaagtgcacaaaactattagttcttatgaaaataaaaattaaactcagaatgatataccattacacaaatattagaacatcaaaaacaaaaacaaaaaaattaacttacaatatggaatgctcattgcaatgtggagtattggaactctcatactttacctgtgggaatacaaaatgatacaagaatttggaagttttttgtaagttaaatgtacttgtcttatgacccagctatctcactcctatatatttgcccaagagaataaaaatttatgttcacattataacgtatacattaatatttatagcatacctattcataatgttagaaacaagagctcagagtcgcgaggaaaacgagcactcaaatgaaggatttctcagcaaggcaaatttacttctgtggaagggttttgctcacacttttggccactgcgagagcacatcgaacaaaggagggctttttattcccaatgctgttagtccctgcttctgtgtctgtccccattggctggagttggaccgcacaatctaaactgaccctattggctactgtttaaaattgaatatggctaattaggcaagaagggagaggctgtccattatggtacaaggcatgtttgggcatgtcagggcatggcaaaggtgggaagggtggtttcaggggaagagctctttcggcggtaggggcagtttacagaatgggtagccaggagtaaagaggaacctttccaaataaggaagagacatgagttacagattgggactggcaggagaagttgtttacagagcaggtagcttaggagaagggacaaggaagttgatctcgagaacaaagaacaaggaagtcagaaattaaaactttgaagcagaacttactgtatctgacaatagtcactgaaaactggaaatgttcttcagttggtgaatgaatagacaaatgaaatattctctatcttaactgtggtgataaatgaatgactgtatttttcaaaactcacataactttatattacaaagagtaaatttattgtatataaattgaaaataaagtttcaaaaattatttattaatatatatgtgtacattatattcacaataaaatatgtataaataattcatctctagttagaatgatataccaaaaaataagatgtttactattagcattcaatgtggcaaataaaatgttgcaatataatccttagggtattattccattcttgcattgcaaaactgcagatgggaggactactcggtaagtgtagtttaagttcatagatcatattatttcaataattctatctaattaattgtagggtagttctaaatttaaaatatcattagaagttaatgagctggccaggcacggtggctgactcctgtaatcccaacactttgggaggccgaggtgggtggatcacctgaggtcaggagtttgagaccagcctggccacacagtgaaaccctgtctttactaaaaatacaaaaattagctaggcatggtggtgtgtgcctgtagtctgcagctgttcgggaggctgaggttggagaatcgcttgaactggggaggtggaggttgcagtgagccgagattgtgtcactatactccagcatgggggacagagcacgacttcatctcaaaaagaaagaaaataagttaatgaacagataaaattttctcattattcacttgatcatttttatttaaagttatagtagcaccacatgattgctactgtatatggatttagtcagtttttgttggccacttgaatggttgaaactctaaaacatcatctaagaagtgaaaatgtagtttggaaaagactatgaggatatacggaaacaggcaattgaaaacattaaatttaagcagtgaaaagaaaaaggttcagtctatgaatatactctagataaaatctggtagatagcagtacagcataaaaacttgggcagtcatgtgggtggtagagataataaattcatgtggagaacattttcttacattggcgtctcttttgaagatctcatatccagaccgtataagcaggccccctggaatttgaaaatatcttaatctaactgtactctccttctcctcttcttttgccacaaattagttaattatgccatagtagtgatgtggtccttatacaacaaattgaattaaaactatgcatatccctgaaactggagatattttgaaaattttctcacaaattaactgagatgtcttttctgttatgccattaaaaaataactactttgtcaagaactttgaaagatttaagagttttttcctgcttgtaagttaaaaagcccatcacagttttgtggtttctggcaaaagacattagactcctgggtcagagattaaaacaaaacaaaacaacaacaaaaaacaaaacaaaacaaaacaaaacctgttactcatagctcagtaggcagcataaactgcatgttggcatcattttcccctgtcccctaaatcccatgggagcaatgtgaaatggccagatagaagtggtgcatgcagcggatttgcatgatagccagggaactctgagctaagtaagccccaatctttggaaggagctgcaagcaaacctgttcattattttccctgtagatatgaccttttttatattagagagctgtgggggccaagggctttgaaagatttgttgaaaatcactgacatgaggcagattcattaataggagaaaaggcataccaatttatttaatgtgtatacacgggagccttcagaatgaagacccaacatctcaatgaggcacagaagctcatatgccatcttgagggtacggaaagaatgaggacttgaatcctggtcaggcaggttatgggagggggagaagaattctattgagaggcaataaaggattactaggtagaatgattatattggggaacagaaattaacatgtaaatagttttgttttttttttaatttaaatgttccttaaatcatccttggagacagacattgtcttgaaaaagggtatcttcagatatggttacattcttggttttctttcctgtaatggataatgagataatggcgggtgtgggcagtgtgggggcagagtaagaactattgttctccttggtgtgtcagtcctatctttaggtaggtaggggacaggtcccttctagtgcttgttgatttctaagggtttttaatataaaatattcattataccacagagccaaattttggggttaaatatgttaattttcttcacagcaaaaaaaatctctctgaaccaggagacactattcctatcctcttttgaggctgtctgctatagaaaatccttataaaagaattctgaaacaaaagctgtcaaatcttctgctgaaaagatctgcggaaacatgagagacagatgaattatctctcaatataaacattgagtgaaagtagttaaaacattattctccaagcgttaaccaagaagaattttttaaagccaagtaggccattgcaactctaagtcattcccaatcatagctaaaatctaaaacaatgtaatgaatatgatagcaaacaataaaaatatttcgagtctttattatccatacctggacactattctaagaccttgtaaaatgcattgcctcatttaactctctgacagagatactattattattattcctttgacctcatataatcattattctagtctgtctagcatgtcctgcaaaacacgtataagtgatcctgaggagatatgtgtttaatagcttgcatgtcgtggacaaatttaaagctataccattttgattggatgtggtacaggagtggagacactcaaaatagttgaatttgtatagttatttcctaaattttccagatagcccatataattcatgtattgtcctttatatacatcctagaaagtaatttttctttatccagttctctactttctccatgtatgttcaagcatcttaacattttattaatctgttcctatatgacccattcttgctgcatttaaatttgtgcctccaattctaagatgagaatcatcctataatggaggtccagatatttagagtttgtgctatcaaaaattatttttctaagaaaattatttcacctgaagttatctagttaataaaacagaaatggtgatgatccagaatatttttgatgaagagatataaaacatacctagccctactatacaactatgggaccatcacagtttaaagtgcctgaggccaacataagtgagggccttgaattggtagttttgatttttccatcagctatattttggcagccagaactacaaagcctacaccttaaaaatttttcaagactataattctatggcttgagtactttgcgatcaactatttctagctttgatcatctaagacttgtgtggtcatcagactgccaagaatgattaatcatatttaaagtattttgatgggggtgataggaagtaaaacagaagaatagactttatcttccggccatgaaatttcatctgtttaccactggtttgttatgtggtcttcctggaaaccatttcatctgattcaaaatgccaacaaaatttaaagcagcgcttaactgcgctttactcaacataactaaactgctatgatttaaatgtgtcctcccaaaaatcatgtgctggaaacaatccctaatgcaacagtgttcggaggtagggcctaatgagagctgattagaacaagagggctccatctgcatgaatagattaataccattatctcaggagagggtttttgttgttgtcgttgtttgtttttttttaataaaagggaaagctctctcttcttctctgtcattctctcttgcccttccaccttctgccatgggatgatgtagcaagaaggtccccacaagatgctgaacactcagtctaggaccttctagcatccagaactgtaagaaataaattcccgttcattacaaattacttatccagtggtattctgttacagcagcacaacaacctgacacattcccagtgcactacaaactaggaatcttctgccagggttaggataggcctgttgaaaatgccactgaatgtctcatgatgttctttatttccagtcttacatttcccacagcaagagtgatatttcatttttttggagattaacagtaaactaataaatttaagcctttgtattatttccaaatgtttaattctacttctttgcaagtcattcatgtactctgttttctcatactccattggccttatttcacagatcttggacctcaggtagcgtaacagtgtagaaagctgctctttcaaccatcccatctctaaattacaaatcttctactaactctgaggacttatagccagatgaatgatctcaactaggttttcactgatgctgacacagctgcatatgtacagataacatgttctctacccatcaagtctccatgaaattttcacataatatcactatcttctagtgcatctgcttccatagcagatttccattctcggtattactcataagcctagaatgaccaccacccctgtatcccagttaacaactaagggaatatgaaaatgagaaagaccatgtctagatgctttacgaatggtataaaaatatactaaccaatgtttagaaacatatccacggaaatgttatttaattcacgaacctgataacaagtgtcaagactaaaaattgaagaagtgccatcttgagatctaccctgtaaatagtcttcatactctcattccaccttctttaccaagtctagatcacccacaagagcagaggttactgtggaaagttagacttcaacgcttctactttgaaacaatgtgatattctccagttttgcttctttttatctattcttgtcaatggatccagggaattatttctaagttgtaacttgtaaattcaaatcatattactcgttgtcttaaaactttatagtgagtatccttaaatagcactactctctctttgtgcctcctttgtctctaaactactttcaattctcaaaggtaaggctgttttgggtatccatattttgcacatgtgttctctttgtctaaactaacctgtatatatgcccctccaccatcctctcttctcactaacacatttttcaagtctagtatagaacaggacatcataaaaatgcaagccctgagagagtagtgagcaagtcttatttgctgttaatccctattgtctagcaaattagaggtgatcactatatattgttaaatgaattataagctggtttatcaattttcatttattcaaacgaagagttgtcacgtttcagaaatatacttcaaagcacttgttaaaattgatatagacatttctttgtgggataaacttcaatgtgaaatttcaataggaagtttttcttgttattatacaagtaatactccagtgtgtgtaagtagatgcctataattctttactcttggacaacttgaagagttaatttacattcaaggctagagagctttctgctgataggtgccatgagagtgtcagaacacttcaactgaactttatcaaactgagtggcagattggtttatctaaattgaggacttcttttcgccctaccttttaattgtggatcattcttaaggtgttttattataattgtgcacagcttgtgctgttttattgattaaactgctgtgaagctcttggtgcaagtacagcacaaactatgtgatataagccttttaaggttattgttatgcttgtagtcagatggctgcagttgtgatggctgtgattgaaaaacaaatgaaatgtttttgggaaactgtaatcacattagtcttgacatttcactacttcctcctgggtaactaataggttcttttcatttctaaaaagaaacttctaattaaatattatttttcttcttttttttgttagaaaaggtctaattctatgaagacctattaggctgtatgaagtttcacctctttcttcatatttgagttattactgtgcatgccatgtgtatatacatacacatatttcaagaggcttaggatttaatgtaaggatttaataacttaattcaagaggtctaggcgtatttaattactattagacaaagaatatgtacttataagtaattagatttcattagaaaacataaagaaccgaaaattgtgattcagaataaatctgatattgatgattatgaaattaccaagttctttgagcatggataggaagcaaacgaaagagatggagtgtgaggtccttcgacctcataatactgtgagatattatacaattaacacaccagaacagcaaaaccttaggcagctttggtagtcagattgtcagtttgaatccaggctttatcatatactatttctgtgatcttgagaacattttttaacctcttaagtctctgtttccttatctatataaataggataatagtaatagctaactgatatgattattgtaaggattttataacttaatccaagtaaagtattagaacattttaatcactaagtgttggctcaactaaactcatcataaatagatagaatgcctactggtacgaggtaccataaggcatagaaaaaaagcaaggtaatttctgtctttcagggtatttccgtgcccattcgatgcatgacacagttctgaatgccaacctggtagaattaaaagtaccagcatcatttccctcgagcagaaaaaaatgctgctggaagccttactaagtcaataaatggtaagtgtgttgcatatgaatactgtgtgagtttaaaaaaaaacattcatactgagtcactaatgctgacgaataagttaaggctgtggctggtcagtattttcttgagaaccgatgttaccagttgctttgtattcagggattatgtataaatgtcattgcactactctttttagctcatgacatgtgcaagtgcatacacatagtcaactgaaaaagaaagaattaattttctctggtgggcaaagtctcaggatatacctattatgaatgaatctgaccagaattaattatttgggtcttgtaacatcaatattcaatttgccaaagttaggacccctctcaggagtaaaatagccatgatttatctctctaaattaaaaaggttgaatggcattacctcatatacataattcattttaattaaatgcatattcttaaataccttcttaatggatatccaatgcctcattaatcttaaatgtaacaacttgagatcctttgggaagtcatgtgatgactcaaaattcacaaacataatgtgtaatgcccaggtagaatgtctattaggcaatctatgcaggttgagtatatgccaggtatgatactcatttacaatgctgttagctcaggaaaatgttaaacagataaaagacatagattcaaaaaagctgttttttctaccatctatttttaaaattctctttcaaataacactgagatactaatattttaatttttcttctaagaggagagtttatgagggtttgagatagactgagttaacccaagtcaaataaggtttcttttgtgtaatggaagtttcctgtgcatgttagactatgaacttaccaaaagcagaaatttctctctgctttgtttacttctatgtcaccagaatctagaaaattccctcacatatggaagtcaataaaaattccatgattgaatgaataatcttcaaatacactacagtgcattatgactgcctgagaaggtgacatgtcagcattgacctacttgatgtcctcaatcttttttacattttttgagactgtaatatttcaatggaagtaattagagtacacttttctggcccatagttgtgtcttccatcacaatccctgatagaattcacactgattgtgagacattaagctaaagaatgtgataaatgtcttcatgcaaacccaccaccattacgagagagaaagatgtgatgcatgaaaacaaaacaaaatacaattcttagttttatgagctctcaaaaatagatgaattactaattagacatccaagaaatatgctttgcatgtttcatttctttagtttcttatattgccagaagatgtgaaatcgcaatatactatctctcattattttggcatagcatacttttataatgtagtttctttacaaaacagatacttctaaaagaagaaaaataagtctctgaagtttctctagtacattaattcatttgagggaaagaataaaagagagtgagatgggacacacccacagacacatttccagaaaaggctacaaagcctgcagagatggaatcaaacatatagcttttactgactacaaaatacccttgtgaaatttgagaactgcatgaggcattctgctttttgaagcacttttacttcattaatttagggaatgtgcacaataaccttgtgagttgaatcagaaacacggtcccattttgcagataatgaaattgtgacaccaggcagtaggaggaatttgtataaggttatgtgagtaatgaatagtatattgcagagatgggataaacaaattgcagtcattaaatatgtacactagtatggctatgaataaaagaaagaagagggttttggtagagaaggaatatagaattggacaggcagtagagcaacctgatgatatgtcactgaaattttttgagtcttaagcaaaggttcacagaggaactaaggttgaatatagaatcttgtagctcatcacacacaaagaacacaacaatgagattcagagagaagtttttataaatgaagctattcaaatgataattctttcaatcaaattttccttcagtctattcagatttttaaaaagtaactaatatttatatagacttacagtgtgtcaggaacagttcttattgctttgcatgtattaattcatttagttatcctgaccatctgttttgtagattagaagattgaggcagaaggagattaggtaacttgctcaaggtcatatagcagaaatttgtgcccaggcaatctggctccagagaccacactcttaagactacactactctgcctctagataactgagctactctctttttttttattctactgaattaagaatttaaattgaattggggcaatattacagcacaggagttaaacacaaggaattgaaggttgaccctctttagttctagtgcttgctctgaaactgattagctatgtaatttttaacaacttatttaatttctctaagacagttttctgttgaatggaaggaaaaatagtatgtatagatttactagaagaattacatgaaaggacaaatacaaaaatgtttagcgaagtacctgacttttagtaaaaagccatttaatgttaaaattattattattgactgaatcaatcatttgctttaatatcaaaaggtttcaaccatgttgagaagaacagattcagtgggaaaattttctatgagcatcttttgttataactgctgttaccggattggttatcattagcttctttttcatactgctctgagatttttgaaatgacattttaaagtgtttgtgtaggaagtggttcatgtaaaaattgtcagatcactaagacccaagaacagagaaaatcctgatgcatccctaaaattcaataaagatatttaaaaagcacatttattgaagttagaaatattgaattgatttttttaaaagatgcttcaaaaggccttctgaataactttcgatgagtttaaaagagtgaattgaagagtagtgagactgtgagactaaatggaacttttgttaaatgctttggaactctttaggaaaaaagtagaaatattcattaatttttttattttaatggaagtatcagttacaaaaaataaaataaatatacgataaatatttagtttgacaagtttttataaatgtacgtatctgtgtaatcaccatcctgatcaagatacagaacattttcatctctgcaagaagctccctagtgcctctttcaattcaatccccacctcaaactctaccctcctccgacattgacaaatgctttctgattcctttttggcgttcatatagactatatgtcatgcttcttttactccacataatagtttttgaattcattcattttgttacattatcagcgggtcatgttttttcttactgagtattatgacattgtgtattaggtcctccttatccatggtttcaatttcttttttcttttcttttcttttctttttctttttttttttttgaaacggagtttcacttttgttgcttaggctggagtgcaatggcgcgatctcgactcactgcaacctccgcctcccaggttcaagagattctcctgcctcagcatcccgagtagctgggattacagacatgcaccaccacgcccggataattttgtattttttagtagagatgtggtttctccatgttggtcaggctggcctctaactcccgacctcaggtgatccgcccacctcggccttccaaagtcctggaattaacaggcatgaaccaccacgcccagcctcatggtttcaatttctatggtttagttacatacaatcaaccaagcctaaaaatattaaataaaactttccagcaataaacaattcataacttctaagttgcacagcattctgagtagcatgatgaattttgtgccatcttactccatcctgcttgggatgtgaattatcctttggtccggaatgtccatgctgcatagtctacttgccaattaatcattcagtggccatcattggttatcagatggactgtgatggtatcatagtgcttttgttcaagtaacccttattttacttaataacggccccaaggcacaagagtagtgatgctggcatattgctgtaagtgttctattttattattagttattgttgttaatctcttactgtgcctaagtttataatttcaaccttatcacaggtatacatgcataagaaaaaaacatagcagtatatataggatttggtgctatttggggtttcaagcatcttctgcgtgtcttggtatatacctcttgcagataaagcatgatttttcttactatgcaaataagtaatgctacttataagtatagttataagtaatcatgccttatcttcaggagatacattccaggacccccaggagatgtttgaaagcccaaatagcaccaaaccatatatatgctatgggtatatactatattttatagtagaaaatgtcagcaattttatcttcattcacttgttgcagaaaaatgtttctccagtatttggctataatgactactatgaatattcttgaataagtcttttggatatatgttttcatttctcttgtataaatacaagtgaaattgatgagtcatggggtgaatgatggtttaacttcataagagattgacagtctaaaaagctatacaaatttatgttcctaacaactgtgtataaagtttccagatgtagatatattagcattttctattttttgtgcacttttcataattgtgattttctaggagattgcctattttatctaaatcgtctaattcttagcattactttatccacaataccacctttgatatctgtagaatctttggtaatttcctctcttttgttcctgatattgggaattagtcttattagtctctctctctctctctctctctctctctctctctctctctctctgtctgtctctctctctgtctctctctctcacacacacacacacacacacacacattgttattaaccagtctttctaattttttatcaattttcttcatttttacaagaaactaatttttggcattgcttgattgtatctccattttatttactcttgctgttattttttttcatttcattttgttctaataattttggaattgccactcttttaacttcttgagttaaaagctttgaatattaccttggaccattttcttttcaagtgtagccatatagctgtattttttagctgtatatgttactcgacaccgttgattgtggctgattgccaaaagtgagattaactctccactcaaaactgtgtgataagttgagactggtgacatgacaatcaccagtaggctgtgaaaagagttattacctatataggaggattttctgggtaaagtaggacaggctcaagacagtttaggtaacttgagggaagcagagagagtgagttaatttttagtatggctaagaggtgggaatgggaagatttcatgcctgtgcaaatgggtctgagcttcagtgatatgaatgttctgctagtaccatggaagcaggtatgtaaactttttaattggcttggctagatgtaggacaaaagaggaagggggaggataggcttgtaagctgtcagtagtgaaacatcaaaaatggagtctttctctttattatagccatatctatctccattccactaattctatgttgcatttcattattatttggtaacgtattttctaatttcctatgtatttcttttttgacctatgagttattcagaaatgagtatcttaatttcaaatattgaaattatttgaggcattttctttgtattttatccttattgatttctaatataatttaattagaaatctaatttaacaccattgtagtcagaaagcaagacttcgtatttttcagtcctttgaaatttattgagatgtgttttatagcccaccatataatatttgtacagttaaaaaatgtatattatgattctgataggtgttgttttctataaatataaattaggtacaggatgttgatagtggttttcaaatattctttatcataaacagcatttctttcattgttctgtcaattactgacaggagcatgttaaaacttccaatgcgattatggacttgtctgtttctttctttagttatattttcacttcatgaatttgaatctttgttattaggttcacatactctgttttaggtacattagtatgtctctaataatttgactttttatcattatgaaatgtctctacttctgattatactccttaatttgcctgataataatatagccatgttgactttcatatggttaccgtatttatggtgtatatagacatagaaatagatatatatgtgcccttttacattcaatctatgccttatatttaaaatgtttcttgttttccgaactttgacgatttgaatataatatgcctgtgtgtgcgtatgttttttggttttttttgttttttttttggtgtggggtgggtggtatttctcttgcttggtactaacttcctgaatttgcagtctggtgtctgtcactaattttagaaaatttttggtcattgttactttaaatgtttctttttctcttttctctttatgacattccaatttcatatatgttatatcttttggtattgtctcacaattttgagatgtcctgttctattttgttttctattcttgtttctctttgcattacagttgcgagtgttctattgttctgttttcaagtgcactgattctttccttggccatgtccagttttttggtgagttcgttgaaagcatactttaattctgtgtctgtgtttttctatttctagcatttcctcttgactcttttttttatagtttccatctccctgcttacattacccatctgttcttgcttcttatacacttgtggcattagagcccttaacatattaatcatagttattttaaattccctgtctgatgattcccatatctgtttcttatctcagtgtggttctgatgaaattgttttctttctccagagtgtgtttttacttcccttttgggacttgtaaatgttgttgaaagccagatatattgcattaggctacaatttcccttccctccctgggtcacctggaagatgtctcttcgattgtcactgtgagaagctggtggaaattctggaaatctcactgtgagaagctggtggaaacaaagtaaatatgtccttagtgtgaggatttatgttaatctgactaacagttagcctgtgtttagtgtcgattacagcagtagatacccaagcgttattgtatttttccctgttatctttgggcttccctatgtactctttttcagaaagcctgttttgcatctcattcggctgtaatgcactatctttacactggatccctgttggcataatactcaaatataaagggaaggggataattttgtaatcttctcattaatctgctatttagtgggcctgtatctccaaggtatgaccttcacaagtgtttctgaaatagcatagcttttattccccttcctcctactcctgttctagtacagaattttcagtctatttcctcgaaaccctgaactccgttgaccatgtttcccccaactccctttggtgagacaggaagtctagtgactggaataaggaggagaaattctcttctgaagtttgaagtttgcactgtggctaagtcctttgcctaaaagattaggggaaatattgtgatgattgtacccaagggctactcttgcccttccctgacagtcaccaggggggatttctcgtggattgtcaaagtgagaaactggtggaaatcatggagaggaaatttaggaaagtttgtcccccattccaccccaagactgtgtctcctaggagtttcttactctccaactagtccataataagcctcctacaatttatcccaattcccagtaagtgtttctgccagtttctggcttcagtagtttctgcttcaggtaggcagattgcagctgtatcttttcagatgtgcctgattttctggattgaaggatggtagtttgccctgtgatctccaattttattatgggtccgaaaaagtccctgattttcagtttttctagctttttctagttttaaatataggagtggctctttgcatgtcaaaactgaaaccagaagtctgcagtatttcttgtactacataaaatataggtggttttgtttttttcatctaatctgacaatctctccctttatttagtgtatttggtccatttacatttaatttcataatggatatgtttatatttaagtctactatcttggtatttgttttacatttgttctgtctattctttgtttctctgttcttcctttcctgactccttttcagagtcaggcattttttagcatttcattttatcatagggaatccccaagataacagggaaaaatacaataatactggggtacctactgctatatctctctattggattattagctatagttttctattttatgttttagtaatttttataaagtattaactgtctatgtcatcataatctacctttaaataatattatgtggcttcatggcaaatgtataagcctttcaatagtattgtttcatttaccctttcctccctttttgctcctgtcacatattacaccattctatatgcagaaacctcacaattcattttattattttgttttaaatggttattagtcttttaaaatgtatatatttatgtatgtgggctcccagctttctgtagctgttgatttacccttttatagaaatttctctcagatattttgtcccaactccattcttcagtcaggtgttgctttgtcctaggggaaggccccatctgcctcaaggaggtcctctcagtttctttacctttttaactcagtctttggccaactactcctgaatttgtttagtgtgcctgtgtctccaagctataaccttcggaagtgtttctgaggtagcatagcttttgttcccctttccttctactcctgttgtggtgcagaatttttagtctatttcctcaaaaccctgaactctgttgatcacgtttcccccaaatccttttggtgagacaggaagtctagtgactggagtctatgaagagaattggtaggtgaatacatattgccctgtggctggggatctttgggattctaattcatcatattagctcacatgtagccacaaaaagtttgatatacatttatctggtttattctgtcctcaatcaattatttcttcttgttcttcaccaggaataaatgcagtagtgatatgttttcttatagaaagggcttgtcactgtctggatattagctcatttagatttctttgcattcttaactgtctgcatttttttattgttgggtagtttgttcagcttatttccagctttatagttctcccaacattattacttttaaaattctaactggaagtagaagtcctcttactgttgtataaaacatctgcctacttgacaggtgccatcagccaatttgtagataacctattgcaaatgcaagtaaaagcattttacaactagtcttctctttatagacatttatgcagaataactatatttaaggcatggatgaagaattcagggctatagaaagatcttatcaatatatctcagagctactgttgtggtagcagcaggggttcatcacaggtcatgcaagttgttcggcttgactaatgaagaatatggcttcttttactgagttaatcataggtcctaagtcttctggtgtcatcaggctcaagaagaactgtatgaacaccaaattgtgagtagcaagggagaagtgaacacattagtatctgcagggatgtgaacagaaataaaggtcagaataatatctgtttagaatttctaaatgtctatgtccttctgtggtgcccaccactgggagagggggtagaaaataacaaaccctaataataaacactctctagtcttaaacatgcacagcatgatgatggccattcaacccagtcatggaactactaattggatgattatcttttgtatagatgctatttctatatactttccgaacctcaagaacctctgttgcttagtgctgaggagctctccccatcttcacactccttcacatggaaaaagtgtgtgtgtgagattgtgtttattgagggggatgggagcttatatattttttcaaagtgaactttatttttaaagcagtttagggcctgggtgcagtggctcatgcctctaatcctagcaatttgggaggctgaggtgggaggattgcttgaggccaggaattggagaccagcctgggctacttagtgagaccctgtctttatagaaaaatgatgataaaaattagctgagcatggtggcacgtgcctgtagtcctacctactcaacagggtgagacaggaggatggcttaaacccaggagtttgaggctgcattcagttatgatcctgccactgcactctagtctgggcaagagagcgaggcccagtctctaaatataatgaaaataataatataaataaggtaaataaatcagttttggatttacataaaaattgtgaagatagtatggagtgtttgcatatatctcaaacttagttacccctgttattaatatcttacattagtatgctatagttattacagtgaaaagagtttaattaagcccatactttactcagattttcttcatttttatctaatggaaggatcccgttctaggatccccaaccaggacaccacattatgcttagctgtcaatatctccttaaggcttctcgtggttgtgacagtttcttaaactttccttgtttttcataatcttgataattttgagaagtgttggtcatgtatgtttcagaatgttcctctattgggatatatctgatgttttttaacaggttataggtttttggaaggaagattatagaggcaaagtgcccttctcatctcatcaaaccaaggacatacaatatcaatttgacttagctctattgatgttgaccttgatcacctggaggagaaaacatttgtcaggtttctccactataaagttactcttctaatttctcactttaaattctgtactcttttgaagagagtccctatgtgaagcccacacttaaggagtcgatagtttcacttttcctcctgagatttgtcctcctttcccatcttatttattcaatcaattatttttatcagtatgatttcatagatatatattgaaactttgagttacatctaatatcattttatatattttcttgttcaaattgttctaactttggtcattgcaagttgtttcacttgctttttgtgttcccttttttcctttcttttttgcactttcttattttctgaagcagaatactccagactcctcttctgtatttctgtatttcacttgctttttgtgttccctgtttttccttctttctgtatttcctaccgcattcccagtattagccattttttttggtccaagaagccctggttatttttcatggagaatgatattagaaaccaatatctgggtgtgaagtgagttgtttgtccctactggggtgtaacatttcttctaggccctctcagctgacagagcaaggaaatatttagtatatgctaactcttgtatatacaaatatctttatatatgtatgtgtttggaactgtgtctttataagttaaatatgaatgtctgttgatgtcttcaactgtaacccattaccgcatcaattattctgatctcatcacattgcttatctgtaaattcccactccgaaagtgagaagactggatcccctctattcaccatcctttaacttaattgttcaattctatattgaattgtgttttatggcctaccatagaatataagtacacatatatgagttagcaactctgatactatagcagtgttggaattgtattagtattagtatacctatactaaaactattatactattagtattcctatactaatactattatactatactaaaagtatacctacgctaatcctattatactattagtattatatacatacaatacctattatcatagcagtattagaattttattagtattagtatacctatactaatcctattatactattagtattatatgtatactattagtatattatatattagtatacctatatacctaatatacctatataatagtatacctatatattagtatacctatactagtacattatactattagtatagcatactaatagtatatgtgtaatactaatagtataataggattagtataggtatactaatactagtacaattatatacaattacatagtattagtatactagcaatattagtatactagtactattagtatgctaatactaatagtactgatatactagtactattagtatgctaatactaatagtgctgatatactagtactattagtatgctaatactaatagtactgatatactagtactattagtatgctaatactaatagtactgatatactagtactattagtatgctaatactaatagtactgatatactagtactattagtatgctaatactaatagtactgatatactaatactaatagtagagtattagtatgctaattctaatagtacaagtatattattagtatactatagcagtattagagttggtaaactctacctgtacatatattacatggttggacacaaaacacaaacttatcttgataaatttcaaggattaaagcatacaaagttttgtttcttgtcttcaatggtattaaattagggatcagtgagagtaaggtattaagtaaattccaaaatatttataaattaacctgaataactcatattaatgggaaaaaaaatcacatgagagattataaaatatttctcactgaataataaaggaacacgacataactaaaatgaagaagaagaaaggaaatgaaagaaagaagaaagaaagaaaagagaagagaagagaggaagggagagagggagagaggaaaggagggagggaggaaggaaggaaggaaggaaggaaagaaggaaggaaggagcgaagtgagggaaggaaactcccatttttgtcgcttagttctatgctgcagcactctttcaacacttcgccaggccgccagtttacaactccatcttagctttcacttcctgcttctgctgactgtagatcaaccagagatcaaaatgtagggttttctcaagtctttctgagtatgagttctgtcctgggcatgcacgtatgcatggctttccaaatagccttgcccttttggatgtcacaatttcccccaaaaatattctcctcagcttttccttccaggcttttgacacactttatttatttatttattttttgcctcaaatgtaatattttgccccagttggcagcaagttgtttatgtgcttttgagaaatgatgggtgactctattttgagtaattctgagtaagggaaaacaaagacatgttacttgtgctgggccttcaggcagcttttaaataggtcaaaacggacaaacgcaattctttaaggacaaattctgatctgctctctctataaccagggaacagtgtttcatatttggactatgggcttccatcttcaagatcagctctgaattgaataggggagtgtagtaaggacaggtaaaaatgctgtgaagttttcttgttactttacagttgcctttttcttctttcagcattcacttgattactgtaaagctttgactactctttagtgttttgacaatattaattctgacagttttacttaattttttgatgtttctgtggatgaatgggactgtggagttacttttgccatcatttttgctcttagtactctatatctttttcggccaggtggctgtgtaatttttttgcccactttcaaattaggatgtttgtattctgattgttgatgtgtcagttttctgtttatttggaatataagtcttttatcagatatgtcttttgcaaccattttctctcaggttttagcctgttttttgattctctccactgtctcacggagaagaaattttttatttacttgaagttcaacttatcaatattttctttgtgaatcatgctttaaccatatttatataaaaatgtattggcaaacccaggtcacccagattctctcgaagctttatcgctttccatttcacatttagatgtatggtacattttgagttaatttttgtaaaaggtgtcaagtctgtgtctagattcttttctttgcatattataggtccacttacactagaaacttttgttgaattgccttttttgggggtactgtctaacattagtttatatttatgtgagtcttattgcgactttctatttcattccataatatatgctcttgattattatagctttatagcaaaccatgaagtcaggtaacgtgaggttttcaaatttgttcttaatattgtgctggatcttctagattttttttctccttttaattttagaatcaatttttcaaaaactacaaataacttactgggaatttgactaggattgtgttgaatctatagctcaagatgtaaaaaattggtattttaagaatattgagtcttccaatccataaatataaaatatatctgcatttatttattgttaaatttattttatcaggattttatggttttctctatatagattctgtgtatattttaatgaatgtgcatgtattttatttttttggaatgcttattgtaaattttgctttttaaaaaaattgatctcaagttccacatattcactgctgttttatatgaaagcaattacatttgtatgttgaacttgtatcttgtgaccatgctatataaacttatttcctggagttttttggtttgtttatttgggggggattttcttcatagacaatcacgttatctgctaggtgaaacagtttttgtttttcttcctctcaatctgtataacttttattttttcctgttatctaactcccactataaattgaataagactggtgagagaggatatatttacattgtccatgatcttcagagaaaaccatacagattctcaccattaaatataatattagttgtaaggtttttgtagatattctttatcaagttgaaaaagttctcctctatttttatttgctaagatattttatgataaataaatcagatttttttcaaatgctttttctccaccaatttttttttcttgagcctattgatatggtggactgtagtgattttgtaattgaactagccatgtatatctggaataaatctgatataatggtggtgtataattcttttatagattgttggataagatttgctaatattttattgagggttttgcacctgttattaaaacagatattggtatgcaattttcctcctgttaaatgtttatttagttccattatttcggtgatggtagccccatagaatgagttagaagtgtttcctctgagtctttggaagagatgttggtaaatggctataatttatttattaaagagaattcactggtagattttaccagtgaaattatctgagtctgctgctttgttttttttccttaggttattaattatttaacttctttaataatataggccaatcatgtaatttcctcaattttatttaatgatataggtcaattatttaatatttttaatgatagtggccatttaggttacttatttctccttgtctttatcttagtagtttgcatcttttaaaaaggtggtctattttgcctaagttacaaaattttgtgggcatagtggtgtttatagtatttctttattattcttttaacatccaggtggtacgtagtggtgatctctttttctcttctgtagtcagcaatttgtgtcttctctctcttacttttggttggactacctggctggaaatttgtcaatgttattgatctttcaaagaactagcttttgttttttgtgtgatttattctattgattttttagtttacaattttattgaattctgatgaagtttatattatttctttgtgttctatttgctttaggctaatattgcccttattgccctttctttgctagtcttctcaagcataagcttatgttattaatttaagaggtaccatatattctaatatacacattttaatttctgtcaaagtaatgctattgctgcatcccacacattttattaagttgtacttttattttcatttagttcaacatattttaaaatatcacttgaggcttatttgaccaaaatgttacctacagaaatattgtttaatttccaaatatgtgaggatttttaagctattatttgttattgatttctagtttgattccagtgtggtttgagaatatactttgtataaatttctattcattgatgagtgctttacatgagcttgagaagaatatattctgttgttggatggagtattctgtaaatgttaactggattgagttaactgagagtgttgtttaggtaaactgtatacttactaattttcttgtctgcttgttctatctacctgttacagaggggtaaagaggtatccaactaaaatactggattaatctatttctttttgcagttagtcagtttttgcttcaagtgttgatactctgtgtttaggtacatatacattaaagattgttcagtgtcctcttgaggaaacaacctttttatttttatgtaacgcccttctttattcttgattcttattgtaaagtcggctttgtctgaaatcaatataggcccttttaaaattagtgttagcatggtgtattttttgccatctcttttcttctaacgtatttgagtttttatatttaagtgaatttctcataaatctcgtggtggtgtttttctttttcccctctaattatttctatcttttaattagtatatttagacaattcacactcaaagtgattgtttttatgttggatcaatatctgccatatttgtaactatttctttatgcggtgctatttctttgttgcttttttctaatctttttttccccttctttggctataattgagcatttcattttctctcatatcccatatcaattacatttctttataaattttagtagtggttacgctagaatttgtcatatacatgtttaactaatctaaggtcactttcaagtaacactataccacttcatgaatggtgcaggtaacttataatagagcattcccaattcctccctcccatcgtttatgtcattgctgtcattcattttactaatctatatgctataattcagtgcatggctactattataatttttaaaaattatatcagttaagattgaaaaaaataaaagattgcattttacttttctttattctttttccaaggcttttccttaaaaaaaatggattgaatttctactctatatcattttccttctctccaaataacttcttgttcttacatttcttgtgggtcaggtgtgttggcaatgaattcccttagtttttgtttgtttaatagagtccttaatttttgtttgtctaagagaatcgttagagaatttgttgagcatttgtatttttccttcagtttaaataattttactgcatatagaaatctaaataggtggcttatttctttcagcaatttaaatatttcacttcactcttcttgcttgctttctgagaggaagtctactagaattctttttatttcttttttttaaaaaaattatttcaatagtttttggggaacaggtagttttagttatatggataagttctttaatggcaatttctgagattttggtgcacctgtcacccagggagtgtacactatacccaatgtgtagtctcccatccctcactccactcccatccttcttcctcagtccccaaagtccattatatcattcctatgcctttgcagtctcacaacttagtttccagtgtaagtgagaatgtgctatatttggttttccattcctgagttagttcacttggaataatggtttccagttgcatccaagttgctgaaaatgtcattatttcatgtttttaatggctgagtagtattccgtggtgtatatatactacattttctttatccactcattggccaatggacatttatgttggttccatatttttgcaattttgaattgtgctgctatcaacatgcatgtacaggtatacttttcatataataactgtcaggcctctgagcccaagccaagccatcgcatcccctgtgatctgcacgtatatgcccagatggcctgaagtaactaaagaatcacaaaagaagtgaatatgccctgccccaccttaactgatgacattccaccacaaaagaagtgtaaatggccggtccttgccttaattgatgacgttaccttgtgaaagtccttttcctggctcatcctggctcaaaaaacacccccactgagcaccttgtgaccccccactcctgcccactgagcaccttgcgacccccactcctacccgccagagaacaaaccccctttgactgtaattttcctttacctacccaaatcctataaaacggcgccacccttatctcccttcactgactctcttttcggactcagcccgcctgcacccaggtgaaataaacagccatgctgctcacataaagcctgtttggtggtctcttcacaaggacgcgcatgaaaataacttcttttcctttgggtagatacctcagtactggaatttctgggttcaaattgtagttctactttaaattctttaaggagcctccatactgttttttatagtggttttactagtttgcattctcactagcagtgtagaagtgttcccttttcaccacatccatgccaacatctattattttttgatttttaaattatggccattcttgcaggagtaaggtggtatctcactatggttttaatttcatttccttgataattagtgatgttgataatgttttcatatatttgctggccatttgtatatcttcttttgagaattgtctagtcatgacctttgcccactttttgatggggttattagtttttatcttgcttatttgtttgagttccttgtagattctgcattttagtcctttgtctgaggcatagtttgaaaatattttctccctctctgtgggttgtctttttactctgctgattttcactcgtgtctgtgtgaagagaccaccaaacaggctttgtgtgagcaacaaggctgtttatttcacctggttgcaggcgggctgagtccgaaaagagagtcagtgaagggagataggggtggggcagttttataggatttgggtaggtaaatgaaaattacagtcaaaggggggttgttccctggcaggcaggagtgagggtcacaaggtgctcagtaggggagcttttgagccaggatgagccaggagaaggaatttcacaagttaatgtcatcagttaaggcaggaacaggccactttcatttcttttgtggtggaatgtcatcagttaaggcaggaactggccatctgggtgtgtacgtgcaggtcacaggggatatgatggcttagcttgggctcagaggcctgacattcctgtcttcttatattaataagaaaaataaaacaaaataatggtaaagtgttgggaaaattttgggggatggtatggagagataatgggtgatgtttctcagggctgcttcgagcgggattaggggcggtgtgggaacctagagtgggagagattaagctgaaggaagattttgtggtaaggagtgatattgtgggactgtgagaagaaacgtttgtcatttagaattattggtgatggcctggatatggttttgtatgaattgaaaaactaaatggaataagagaaggagaaaaacaggtattaaaggtctaagaattgggaggacccaggacatctgattagagagtgactaaggagattcagcatagtcctgccagcaaagattatttatttgcttcaagagttaagagtggcagtttggggatagcactaggagatatcagctgtggtggcttggagaaacagtgtaaaacggcagtgtaaacaagagcagggcatgtatgaggtagttgagaatggtgaataggagtatgactagacagaagatagtagggatgacaagttttttggggcacagtccaagttggtctggtgtctgaaatgagactggggcctaataaaaaggagcatctatacaagagcttaaatgggctgtaccttgtagcattctgaggacaggcccgaattctgagaaaggcaagtggtaaaagtattgtccagtcctttttaagttggtggctgtgtttttaaaagactgtttgtccgttctacttttcctgatgattgaggatggtaagtgatataaagatttcattgaataccaagagcctaaaaaactggttgggtgatttgactaataaaggctggtctgctatcggactgtatagaggtgggaaggccaaaccgaggaattatgtctgacagaagggaagaaatgactgtggtggccttctcagccctgtgggaaaggcctctacctatccattgaaagtgtctactcagactaagaggtattttaatttcctgacttgaggaatgtgagtaaagccaatttgccagtcctgggcaggggcaaatccccgagcttgatgtgtaggaaaggaagggggcgtgaggaatccctgagaagtagtagaataacagatggaacactggaaagttatttccttgaggatagattttcacgatggaaaggaaatgagaggttctaagaggcaggctcgtggcttgtgctatagcatagcctgcctttctggtgtgtggcgattaggcctggtggaactgccatcaataaactgagcgtgatcagggtgaggaacaggaaagaaggaaatatgaggaaatggggtgaatgtcaggtggatcagagagatacagtcatggggatcaggtgtggtatcaggaataatgtgggaggccagattgaagtccaggccaggaacgatggtaattgtgggagactcaacaaagagtgagtacagctgaaggagctggggagcaggaagtatatgcatcaggtgtgaggaagaaaatagattttggaagttatgagaactgtagagagtgagttgagtatagtttgtgattttaagggcctctaaaagtatcagggcgtcagcggccaccacacacagacttgagggctaggcaaaaacagtaaggtcgagttgtttggataaaaaggctacagggtgcggttccagttcttgtgtaagaattctgactgcacacccctgcactttggctgtgggtaacgaaaagggttgggatgaatcagggagagctagggtgagggcagtctctaaggctgtcttcaaggaatgggaagaggagtggggaaaggatttaggatctatggggtcagctagatttccttttgtgagtttatataatggttttgtcaggatggcaaaaccagatatctaaagtcgaaagtatctaaccatgcctaggaaggaaaggagttgttgttttgtagaagggattggggtttgggagattagccagacacaatcagtagggagagcacatgtgtttttttgagaattatgatgagataggtaacagatgaggaagaaatttgggcttgactgaagtaatgggggctgcctgtgaagacttgcagcagtacagcccaggtaatttgctgagcctgatgggtgtcagggtcagtccaagtgaaagtgaagagaggctgggatgaagggtgcaaaggaatagtaaagaaagcatgtttgagatctagaacagaataatggattgtggagggaggtattgaggataggagagtatatgggtttggcaccatggggcggataggcaaaacaattcggttgataaggcgcagatcttgaactaacgtgtgagccttgtctggttttaggacaggtgaaatggggaaattgtaaggggagtttacaggctttaaaaggccatgctgtagtaggtgagtgataacaggctttaatctttttaaagcatgatgtgggatgggatattggtattgagggggggtaagggtgattaggttttaatgagattgtaaggggtgcatgatcagttgccgaggagggagtagaggtaccttatacttgtgggttaaggtggggggatactagaggaggatgcgaaggaggttttgacctggggaaaagggcagcaatgaggtgtggctgtagctaataagggaactgggcaggtggggataattaaaaaagagtgcataaaagaatgttttctaagttggcaacagagttggggagttttaagaggtttagaagcctggccgtcaatacccatgacagttatggtggcaagggaaacaggcccttgaaaagaaggtaatgtggagtgggtagcctctgtattgactaagaaggggatggacttaccctccactgtgagagttacccagagcatctgtgatggtcctgtaggcttccgaggtgattgggcagtgttcagtcttcagctgctaagccaagaagatctgggaaggagtcagagagccttgggccagagttccagggactctgggggtggctgccaggtgagttgaacagtctgattttcagtggggtcctgcacagatgggacgtggcttacgaggaatcctgggctgtgggcattccttggcccagtggccagatttctggcacttgtagcaggctcctgggggaggaggttctggaggaacccctgacagctgtggttcaggcatttggagttcttatgtgctggagatgtggctggggtttgtctcacagtggaggcaaggaattgcaactcagaaatacattgctacttggctgcctctcctctattattgtacaccttgaaggtgaggttaagtcttgttgtggggtttgagggctggaatttaatttttggagttttatttaatgtcaggagtggattggttgataaaatgtatattcagaataagactgtcttttgaccttttagggtctagggccgtaaagcgtctcagggttgctgctgaacgagccatgaactgggctaggtttttcatatttgatgaaagagcctaaatgctaactgatttgggagaggtcagataaagaaaaaggagcactaaccttgactatgcctttagcttcagccacctttttaagaggaaattgctgggcaggtaggggagggctagtcacggaacgaaactgtaagctggaccgggtgtgaggaggggaggtgataaaaggattatagggttggggagtagaggctgaggaagaattgggacctagctcggcctggtgaggagcagcctggggaggaggggagaggtcagatgggtctgtagaaaaggaagattagaaagactcagtaacacttggggttgggactgagagaacatgtggaaggggaaaaaggataatttgggacgagtcacattgagaacagagagtagggagggaccgatgtgtaaaagaatgactggatgtcaggcatctcagaccgtttgcccattttaagacaagaattatctagatcttgtaggatggaagaatcaaaagtgccattttctggccatttagagccattgtcaagtttgtattggggtcaagcagcattgtagaagaaaataaggcgtttaggttttaggtcaggtgtgagttgaagaggttttaagttcttgagaacacaggctaagggagaagagggaggaatggagggtggaaggttacccatagtgaaggaggcaagcccagaaaaaagagagtagagacacggagagaaggggttgggtggggggttcttgccctccagagaagcggagaaggggtagagacatggagagaaggggtcggggggttcttgtcccctagaaaagcagtatttgctgctaaggttgaaggagaaggggttagggggttcttgccccacagaaaagtggaaaaggggtagagacatggagagaagggttcggggggttcttgccccctagaaaagcggtacttgccactaaggatgaagaaggggttggggggttcttgacccccagaaaagcagagaaggggtacagacatggagataaggggttggggggttcttgccccccagaaaagtggtatctgccactaagggtgaaggaccaaggcaggcatccccgtgtggtcaggcacctctgaaatgtgggtgaataatcaggcaggcatccctgcgtgattaaacaccaagggaagactgtcttcccaagtccgtgactggcaccgaagttttgggtccacggataaaacacatctccttcgtctctaccagaaaaggaaaggaactgaaattaagagaagggaaagattgaagtgtggcaccaagattgaaaggaggaagaggttgagagatagtgagagaggtcggagaagagagtaaaaagaggccacttactggatttaaaattggtgagatgttccttgggctggttggtctgaggaccagaggtcgtaggtggatctttctcatggaacaaacagcaggaggacaggggattgatctcacaagggaggtcccccaatccaagtcaccgcaccaaatttcactcgtgtccatgtgaagagaccaccaaacagtctttgtgtgagcaacaaggctatttatttcacctgggtgcaggcgggctgagtccgaaaagagagtcagcaaagggagatggggtggggccattttataggatttgggtaggtaaacaaaaattacagtcaaaggggggttgttctctggcgggcaggagtgggggtcacaaggtgctcagtaggggagcttttgagccaggatgagccaggagaaggaatttcacaagataatgtcatcagttaaggcagaaacaggccgttttcttttcttttgtggtggaatgtcatcagttaaggcaggaactggccatctggatgtgtatgtgcaggtcacaggggatatgatggcttagtttgggctcagaggcctgacactgattatttcttttgctgtgcagaaactttttagtcatgttccttttatttatttttcttattgttgcatttgcttttggattcttggtcatgaaatctttgcctgagccaatgtctagaagagttttttcaatgttcttatagtatttttatggcttcaggtattagatttaagtccttcatttatcttgagtcaatttttgtgtaaggtaagagatgagtatccagtttcattcttctacatgtggcttgccaattatcccagcaccatttgttgagtagggtgtcctttacccattttatgtttttgtatgctttgtcaaatgtcagttggctgtaagtatttggctttatttctgggttctctattttgttccattggtctacaagcatatttttatactagtacaatttgttagtatcatctgtaatttctttcagcagtgttttgtagtttttcttgtagagatctttcacctccttggttaagtatattccttaatatttttttttcagctgttgcaaaaaagactgagttcttttcttttattattttatttgagatggaattttgctctgtcacccaggctggagtgcagtggcacgatctcagctcactgctctgggattcaagcgattctcctgcttgagctgccaagtagctgggattacaggctcacaccaacacaccctgctaatttttgtattttagtagagacagggtttcagcatgttggccaggctggtctcaaactcctgacctcaagtgatccacctgcctcagccttccaaagtgctgggattacaggcataagccactgtgcctggccagaactgagttcttgatttgattcccagcttggtcattgttagtatacagcagttgctcctgatttgtgtgcattgatttttgtatccagaaactttactgaattcatttatcagatttaggaggtttttgcatgggtctttagtgctttctggtatataattctgaaggggtggcctgcccctccacacttgtgggcgtttctcatcggatgggatgagagacttaagaaaagaaagagacacagagacaaagtatagagaaagaaaagtgggcccagggaactggcgctcagcatatggaggacccgcgccggcaccagtctctgagttcctttagtatttattgatcattatcgggcatttcttggagaggcggatgtggcaggacaatagggtaatagtggggagaaggtcatcaggaaaacatgtgaacaaatgtctctgcatcataaacaaggtaaagaaaaaagtgctgtgcttttgatgtgcatatacataaacatctcaatgccttaaagagcagtattgctgccagcatgtcccacctccagccctaaggcagttttccccatctcagtagatggaatatacaatggggttttacactaaggcattccattgctcagggatgagcaggagacagatgccttcctcttatctcaactgcaaagaggccttccttcctcttttactaatcctcctcagcacagaccctttacggttgtcaggctgggggatggtcaggtctttcccttcccaggaggccatattcagactgtcacatggggagaaaccttggacaatacctggctttcctagacagaggtccctgcggacttcctcagtgtactgtgtttctgggtacttgagattagggagtggtgatgactcttaacaagcatgctgctttcaagcatttgtttaacaaagcatatcctgcacagcccttaatccatttaaccctgagttgacacagcacatgtttcagggagcacagggttgggggtagggttacagattaacagcatctcaaggcagaagaatttttcttagtacagaataaaatggagtctcttatgtctacttctttctacatagacacagtaacagtcggatttctctttcttttccccacacaattctatcatcagtgaagagttacagtttgatttcctcttttccaatttggatgcccttatttctttttcttgtctgattgctctggccaggacttccagtactatgttgaatagaaggggtgagagtgggcatctttgtcttctttcagctctcaagaggaattctgtcaactcttccccatttagtatgatattggcagtgggtttgtcatatatggcttgtattactttgaggtatgttccttctatgtcagttttgctgagggttttattataaagagatgctggattttgtcaaatgcatttttctgtttctattgagatgatcatgtgatttttgtttttaattctctttatgtgatgtatcacatttattgacctctgtatgttaaccccttattgagtttatttgtatcttctctctccttttcttggtcagtctcagtaatgatctatccattttgtttagcatctcaaagaactagctttctgtttcatttatttattttgttgttgttttaattacatttagctctgttctgatatttgttatttattttcttctgctgggttaagtttggtttgtttttgtttctctagttccttgaggtgtgacgttaggttgtctatttgtgctttttcaggttgtttaatgtagacatttaatggtatgaactttcctcctagcactgcttttgctatgtcacagaggtttgataagttttgtcattattttcattcagttcaaagaatttttaaatttccatcttgatttcattgttaacccaaagatcaatcaagggtaggttgtttaatttccatgtatttgtataattttgagggtttgtttggaattaatttccagttttatttcactgtggtctgaaatgatacttaatatgattttgattttcttaaatttattgagacttgttttgtagtctttcatatggcctatcttggagaatgttccagatggtggtgaagagtgtatatttctgcagttgttgagcagaatgttctataaatatctgttaagtccatctgttttagggtatagtttccttttttcttttcttttctcttttttttttttttttttttggaaacagagtctcactttgtcacccaggctagagtgtactggcatggtcttggctcactgcaacctctgcctcccaggttcaagccattgtcatgcctcagcctctcaagtagctgggactataggtgtgtgccatcatgcttggttaatttttgtatttttattatagtagatatgaggtttcaccatgttggtcaggctggtcttgaactcctgaactcaagtgatccatctgcctcaggctcccaaagtgctaggattacaggcatgagccacagtgctctgccattaagtccattgtttctttgttgactttctttcttgatgtcctgactagtgctgtcagtggagttctgaagtctcccactattgctgtgttgctgtctacctcatttcttaggtctagcagtaattgttttatgaatttgggagctccagtgttacgtgcataaatatttaagattgtgttattttcctgttcaactaataatttttatcattatataatgcccttttttgtctttttttttttttaactgttgtctctttaaagtctattttgtctgatataagaatatctactcctgctggcttttagtttccatttgtgtgggatatctttttctacccctttaccttaagtttatgtaagtccttatatgttaggtaagacagcagatggttggtcgactttctacccattctgccaatctgtgttttttaagtggagcatttagactatttacattcaactttagtattgagatgtgatgtcctattctattaatcatgttaattgttgcctaagtgccttgtatttctcattgtgttattgttttataggccctgtgaacagaacctttaaggagattctattttgatgtatttcgaggttttgtttcaagatttagaaccccttttgcatttcttgtagtacttgtttggtagtagtaaattctctcagcattcatgtgtctgaaaaagactttatctcgccttcatttgtgaatctttgttttgctggatacaaaatccttggctgacaattatttcgtttatggaggctaaagataggatcccagtctcttctgacttgtaaggtttctgctgataaatcagctgttcatctgacagatgttcctttataggttatctaatgctttttctcagagctcttaagattctatcctttgtcttgacttcagataatctgaagactatgtgatgaggcaatgatatttttgtaatgaatttccaaggaattcattgagcttcttgtatttggatgtctgggtctctagaaaggccaggggagtttccctcaatttttctctcaaatagattttccaaacttttaaatttatcttcttctccaggaacaccaattattcttaggtttgtccatttaacataatcccaaatttcttagaggcttttttcatttaaatgtttttttctttgtctgatttagttcaaaagccttgtctttgagctctgaagttctttcttctacttgttctagtctattgttcaaactttcaactgcatttcgtatttccctaagtttgtctttgaattccagaaattgtgactgtatttttttaattacatctatttctctggtaaatttttcatccatatttttaattgttttttagaatttctttaaattagttttcatctttctctaggatgtccttgagtaccttaatagttaagcttaacaatccattcaaccttctgaattctttatctagcaattcagagatttcttcttggtttgaattcactgctggaagctagtgtgatcatttggggtgttataaaaccctattttgtcatacaaccagaattacttttctgattccttctcatttcagtagattatttcttcaaattgttcttgaatttatttttggtgggattggtttttttttttaatttaatttttttccctcataggaaccagactttaatgtttatattagcctaatttgattcttcatgcttgtaggggtgaagactctgttacttagttatagagagtctttgtgtgttggctttctgtgatgctggttgtagctgttatattcttgatgtgtaggtgagttcactgactgttatggagttggaatggcagggatctcttgaagctcctctcattctctcatggtatttatttatttatttccccagtcttttatttagtgagttggtgattcgggcctcaggtcaataaaggaagtatccctgggtaggcatcagttgtggctaaggcaggtaggtagatgtaatacccaaaggtgggccaaggtcttagccttggtgaatgtggctggtggagctctcaattacatatggtgatgttttatcaggatgaagaatgagaactacctcaactcccctaccaggtcagtaggaaagctattcatcttacagcctcatgtctgtcctaatgtttcagctattcagattaaacaggcacctcttttcctataggaatgttgatgttccaagtagggagaaattgtgattctgcctcttgtgcaggcctgaatctggggagtggtcctcttgtggggctgcacttaccctgggttgttccagaaaggctatctataggtgcctctatgtcactttcctgtggagaaagccccagctgtgtctgcagtgcagtaccagggagaaaaatgaccccttctccaaagcccgccacaatcacagaagctgtctgcctgttagaatatagacgcagaatttccctactgcatccagcattgcaacgatgtctctgctcctgcaaagagatccggaactcaagacctgctcttcagattcttttgttccacaggtgatcccttaatgtgatactctcccccttcctttagggatggggctttctgaaagtctgattgcagtggttgttattgtcttttggttctagccatccagaggggctagcaggcatgggctggtgctggggaatgtgtgcacagtccagtgatatgaccattctttaggtctcccagccatcgataccagcacctgctctggtggagatgtcaagggagggatgtagactctgtgggtatccttagttgtagataggtttagtgtgctggctttcttgaacgctggttttgttagcagtgaagtttttacttggacagactcaggacctctgattagccaggatgttgcaggcagcaatactaactgttgttttctccttcctgggagcagggttattctgacatgagttgctggaatggcctgagttggttagcctccagccaggaggtggtgcttttaagaaagtactagctgtagtattagcagtgggatttgagcttgccctaagttggtcaggggaagtattctggtttcccaggtgatgggtggagccataaaactcccaatagtttttgtcttttgtgttgggagattttcgcctgtctcactgagttttcagggcatgctgttttccttcaaaggatccgtgaattccttcagttttcctggtacagtcctgcagtagttcttggaacaaaagtttgcagtgtgaatttctacaaactgctctatccatccaaatgggagacacatgttaaccctgcttcttatctgccatcttctccaggaagtctactgtaatttatattcttggtcttttagagggaagttttatattttttcctttctcttgtttctgtcaagacttttgctttgtctttgataattttcagtttagatgtgatatgtctaagtgtagatattttggaatttatcatgtttgctcttctctgcttcttgaatctgtggtttgatatcatttattaattttggaaaatcatagccattactatctcaaatatttcttctactccactcatattctctttctctcattgtcttactgatgttccaattagtgcatgtatattttcaattaaacacacattaaaatttttgtaattgtcccaccgtttttacatattctgttcccttgtttttattattttttctatttgtatttaaatttggaatgtttttatcaaactatcttaatgctcattggttctctattgagtcatatccagtcttcagataaacctactaaaagcattcttaatttctgttaccatttttttttaatttatagcctttagttttgattatttccttagactcttcaattaactgtttacaataccaatatgttattttttaagttttttaatttcattttttattatattttaagttctgggttacatatgcagaacatgcaggtttgttacataggtatacacatgccatgcatacacgtgtgtttgctgcacctatcaacctgtcatctacattgggtgtttatcctaatgctatccctcccccaggaccccaatccccaataggccccgatgtgtgatgttcccctccctgtgtccatgagttctcatggttcaactcccacgtgtgaatgagaacatgcagtgtttgattttctgttcctgtgttagtttgctgagaatgatggtatccagcttcatccatgtccctgcaaaggacatgaactcatcctttttcatggctgcatagcattctatggtgtatgtgtgccacattttctttatacagtctatcatcatttgggttggttccaaatctttgttattgtggatagtgctgcaacaaacatatgtgtgcatgtgtttttatagtagaatgatttataatcctttgagtatatacccaataatgagattgctgagtcaaatattatttctgtttctagatccttaaggaatcaccccactgtcttacacaatggttgaatgaatttacactcccaccaacagtgtaaaagcattcttatttctccaaatcctctccaacatctgttgtttcctgacattttaatgattgccatttaaactgacataagatggtatctgattgtggttttaatttgcatttctctaatgacagtgatgatgagctttttttcatatgttttttggccacatgcgtgtcttcttttgagaagtgtctgatcatatccttcacccactttttgatgtttttctttttttatttttgtaaatttgtttaagttccttgtagattctggatattagccctttgtaagatggacagattgtgaaaattttctgccattctgtaggttgcccgttcactctgatgatagtttctttttctgtgcagaagctctttagtttaattagatcccatttgtcaattttggcttttgttgccattgcatttggagttttagtcatgaagtctttgcccatgcctatgtcctgaatagtatggtctggggtttttatggttttaggtcttacatttaagtctaatccatattgagttaatttttgtataaggtgtaagtaaggaaggagtccagtttcagttttctgcatatggctagccagttttcccaacgccatttattaaatagagaatcctttccccattgcttggttttgtcaggtttgtcaaagaccagatggttgtagatgtgtggttttatttctgttgtgttaccaatatattcttacactgtctgctttttttattagaacccttaatatattcatcacgttattttgattactctgataattccaaaatctgtgtcattttttgaacctggtttgtatgtttccttagctcttcaggtgtgcttttacttgcctttgatgtaacttgtaacctttgcctaatatattagataataggaactgaggtaaatatgtctttagtgtgaggttatgtgttaatctggcaagaattagaactgtgtttaatattttgtaaagctgtaggtgtcagaggcttcaaatcttaatactgctttctttttccttctctttttttttttttctgatgtctttgaactttcctaagtccttatgtagagtctttttctttcagctccttcatctattatccattgttattatactagagtcctgctggtgcagggctaacatgtggagaagagtgattgttttataatctgactaaaactcagatttgtagtgagcctatgtccctgaaacttggccttcacaaatgtgaagcttttttccctttctttaggtgagaccggaaggctagagaaggatgaagtctgagaatacccttctctcaggtgggataagactgtggtaaattattttcctctggggagtaggcttgtgttatggggaatgctctggtcatatttcacaatgattattctttcctttcccctcttagatccctgagggatttctcttggttcttcctcttgagaacctagtgggattccttaagataaaaaccataaaagtgtgcggcttctccccactgcaaggttgtattccccaaagttctcactctcatcatagcccacaatcagcctgcagcactttgtcaattttgccatttgtgtgtttctacagtttatgtttttatttgcttctgattccagcaagtaaatattagctgtgactctctgtgtttgcctgtatttccagattttggggtgacagttcaccctgtgacttcaattctatcacgaattcaaaaaaaaaatattgctttttagtctcttcagctttttttcttgtaaggatgggaataattacttttagctctttatgcattggagctgaaactggaaatcagtatatgtgtttttgaggtataagaatagcacataacttttgcagttttctctgcaatgaagtggagttttaagcagatagtctaaatttgggaaagagtgaaaggattggaaagagttgtatgcgtggcaaaacaacaacaacaacaaaaaaaaattacgtggtctgaagcaaggatccttgtattattttactagaaattcctggctactgactctctctcaatagttctgtgtctacattgaatttctatgtaatctaactgtgttactaaaaaaattctcagtaaatataaattccagaattaaatcaacagtaattaagaattgtattgttttgttacttttcttggattaaacacatagctgatatttctaaagcatctaccttacaaagataaacagtctgcaatatgttttccttagtcattttaatttcatgactttgagttgctaaatcaaggaataaaggcttattactgaaagtggtacatcagtgaacataaagggaataataaactgctggttctaaacttggcctagtttttctttgtcctaagcagtctctactccaataacatcagatactagaaaggaactcataagaataaaaggcttgcactatcttcatagtccattttttgttgatgacactcttcattttcacagatgcaaaagcagattggggatttccatggcagtgttataaagatattcaaaatctgcatgtatagttaaaatgctttgtgggtctctccaggacaacagtagagtgatgttatgcctaaattcaaatcttctttagcaaagggtgtgtggatgttaaactgtttactaaagacatgtgtatgttaaaaactgagtgaagaaatatataaaccaaaagataatcaagaaggcacttaatgaatttatgctaaattttagagtttatgttggagataccaatttagttatatgtggaatgtgaagactagtgtagatcaaatctggaaaatttgtccatatagaatttcagtttagatattagaaaataaaagtgtaaccccatttaaaggaatattctaaagataaattaaaatatattaaacactcagatatatagtgtaagaataaattgactatattattgattatattgtctactttggtacatatgatttgtttagcagcgattgggtaatcaaaatttttattctcatcctgctggctcctattagacagaaaaacctaagcatgcttgatatatagcattctgctatttaaagagtgagaagaaataataagcataagtaagtgggtttttatattttcaacaatagtgaaaatatctgcaatataggagagttatcaatttatgccctactttgttatctcttgaatttagttcagttgatctaggagcatcagtcaaaataaaataaaatagtatttttttttttttttgagacggagtctcactttgtcgccaggctagagtgcagtggtgcgatctcagctcattgcaatctcagcctcccgggttcaaacgattctcctccctcagccccctgagtagctgggactacaggtgcgcaccaccacgcccagctaatttttgtatttttagtagatatggagtttcaccacattggtcaggatggtctcgatctcttgacctcaagatccacctaccttggcctctcaaagtgctggggttacagaggtgagccacagcacctggccttaaaacagtagtttaaatggtaaaataaaaagaaatgggtcaagattttagaggatacataattaaaagtctagaagcatcaaaaaggggctaaggtctgtatgaaggctgaggtggtagttttttaaagtactgatagttttttattccatgaaaggatacatggaataaaaataggaagcaaagatatttttaacatttaaatatgtgaaagaactctacaatgaaagaaaaaaattttatgatccagtgatgctcttgagaatcttaaaaagattgtataagtaggaagaaaagccttgtgatatagtttggatgtttttgtcccctccaaatctcatgttgaaatgtgatctccaaggttagaggtgagcctagtaggaggtgtttgggtaacaagggtgccttggtgctgtcctcatggtaatgagtgagttttcactctctgagttcatgtgagatctggttgtttaaaagagcctgtcacctccccactctcttgctccttcttgccatgtgatatgccagcttcccttttgccttctgccataattgcaggctccctgaggcctcaccaggagaagatgcaggtaccatgcttgtacagcttgcagaaccataagccaaataaatgtattttctttaaaaattacccaggtcatgtatttctttatagcaacacagactaatacacttttccttcctgtgttgagtattaatcctaggtcactataaatatttttgttggagaagtatattttaaacaaatgttcacctatatgtcatattttctagtacagttttctaaaattgcatatttaaacatagcttcaattgctgtcttcccacccccatttttacagttttgttaaagcctgatcttagcagggggttaatatacagtctacatagctgctaaaagatagagttgctcaataaaagtaacaacagcagcttactaaaataaaaacaaaatatcaaaggaaactatttcgtaagatgtaaagctatattttcattttgcacaagagtgtattttctaattttccgttggtgctgaggaacatgacttattttttatctaatattcatttactgattgtaatgataggtgggggtcatgttgagagatggtggtactgaggggagatgagacactttacaaagaacgatgaggaattttgtgaaacttggcaaaataaaaattcatggttctacacaaattgtcactgcatattttatacctttattttcctaccatgaatgaatggaacactctgattaatttcacattactttacatgttgtaacattaagagaagaatcacagaaaatttgcctattgaaagcacaagaataaaatttttatcttgattattttttagagtcttaaaagtggaagaagacagagatgataggtattgaagccaatgctgctgattggttctaaccttttcccaaccttctcacacaatgaagggttctttgagagacagactagagaggattctttataaagtgtacaaaatggacttgtataaatagttctttcaaagcaacaaaaaggaaaagttacaaattgatgatacctaatctttcaagccctttaaaatcctcaggagtttatttactgacaacaaaaaggcttgacgttacatatttttgtggattcttgtgtcctctaaaaatgaaatagtacatttttatgcagctaaaatgatgaatttaactttaaaagtatttgaattttgatgatttgtattgatatattttctatgatattatttgtaagtaaaagatttcttcatacttgtttgttgaacaatgttcaacagcagcctggttatgaatggtataaagttgttcatcagttattttatttctaaggctgtgatgatgatttgatatctgggctggatcctttactcatctatctggtttaagatatagtttccaaacttgcaaaaaacttgtgtagaccatatgtattccatcagagagtttaagcgtttttgtttagcagcttcatcaaggcttttagcatttttatgggttttatgttaacaaacatttattgagtttctgttttctgcaattatttttttctagaacttagtgcattaataaagagagatataacctatttcttgcccacacagattttggagtcttgttagcaaaactaaaccacagtttattacacagtgaatactatctacatttgtgtccagattagatttctgaatatggatattagcataagaatggtttatttatatatgtgctattcatatttttatttagagtctcagaaaattgtataaatctcaaaaaattaaaaaattataatataaaaacttatcttacctagatgtaccaaatgtaagattttgctccttttgtttattttattcttctctctctgtcaacccattagtcccttctgaagcaggtatgaataaattacagaaaaacaaaatacgtcatataaatagttctgaatctggctcctaaaaacacaagaattcttttgataaccacaataataattataacatcagggaaatgtaacattgatacattatttttatctattacatagttcaaattatgtaatattcaaatatccctaattgtctgaatgctttcctttttaaccattttttaaacccaagatctaatagcaagtatgcattgtttcattggcacctctattttatctctttcagtccagaacaaatcagccttctatttgtctgtataacattgacatttttatagagaccaaagcagttgttctgctttatgaatctcaattcggatttttatgattatttcctcaagaaaataaaacattttttaaaagaatatttcttagatgatgttgttatcttctcagtgtgtcactttagaaatgctatgcactattgaaatgccatatcaggtgcgaagtatacaatggagctgtaagttcctgagcactggaaaactggaaagtagatatattgaagggacatgtttaattcaaacctcagtatgatccacattactgaattatttgggtatatgcatatttggacatataagtgatcacttaatggagatcaacagtgaaaacaacattgaaatcgctaaatagttgaaataaacacaaaggaaagtgacaggcacaatgtcacttttataatcttttgatttggcctttattttctctaattaaacacattgaaatgaggtgggctccaggcaccactgacatcttaattctaatatttttataattacaaatacaagagtaagtcaagatagtgaaatagtgaacacacatgcttgcttcctcttcccggcctcaacttctggaaattatagaaaacatttaagtatttaaaaggctcaaactcattaacaacctggaaaatagaaagaagtgtgtggataggtgaaaggtgttgttatgtgtctttgctgaccaaaaattacaaataattttagaaaataaaggctgatgctctaataatattttccatatttaaaacaataacaatcagcacaaccaaaatcaaaccaaaccaaaacaaaacaaagtaccaaaatctctttgatcctacagtcttctccacttagtccatttttcagagtataacttctcagaatagttgtctataattgctgtttcacttcatagtctaccattctgtctccttgccctacccagtcttttatctacagaatttctctaaaactattttgctcaaggttttcagtgaccatcatcaagtaatgaactgtcacttggctgtcttcattttatccaatttctcagcaacgtttgacagagtataattttttctacttcttgaaatacattcttcttatgtatatggggacaccgtgttttacagtgttcttctttcttcactcacaactccttcttctccattttggcaccttttctttctgctctggaatctacctaatttcctccatcacacagctgtgattctgctccaagccattatcatgacgactaagtactacgacatcctcttatgcccagcacatcatttcacttttcaattaaattcctctgaagacaacccatgaaacccagaatgaatccaagctccatcaagagctcacaaggtgtagcacgctcccactcaaacacttgatcaccatgcttcagatacaaatggccttccttttttttcctaaaaactcaaacttcgtttctaaataagagcctttttatgagctatctcttctgccctaaatgttctgctcaaaccttttaaaaaccatctactctttcttattcaagtcttaccctattactttgttggaaaagtctgcactgactacttaatctaaagtatgtttcaagctctgttctaaatatgttgtatataacattgcatgtaatagtctcaatagccctttgaaatagttaacattcttgtttctaatttatatgtagggaaactgagaatcagaggactgaaatcagttcctcaatatggtcaggttaccacatggaaattggggctctctttgaggcagatttctaaacactagctactaactactcttaaactgccagtcgtaattgctgtcatgccaccttgtcttattttcattgatatctgcttgtttctttatttgtttctactgcttgttatgtattgagcataattttcgtgacaaatttctagtttttttcaatgtcctatcttatcacctaaaataatgtctagaaaaaaaaaaaaatcctaagaaagggatttataatggattagcaaattccattagtaggaggaaatcccaatataaaacatataaaagatgacatataaatttggagagtttcaagtgtgctgactgaaaaacaaggagtagttcttggaaaatctctgggcctatggttaaggaaaggtgtataattggagtgctcaccccggctcgctcctccttacctctcacctacttttttggcacaaacatagtctagctaatacattacaatgcctctcattacaatgactgtgagtatttggtctggccacctatgcaatctggttaaaccagtttaatctgaaatagaaaaatgacttttaaaaattataactttgaatatagtattccgtataggttgaatgtctcctccaaaactcattttcagacataattcccaatatggtactatggataggtgggatctttaacaggtgactggatcacgagggctctgcactcatgaatgaactaatccattaatggattaatggtttaaagggttaatggatagatgggttatcataggagaggaactggtgactttataagaagagagagacctgagcatagcatattagcacactcaaccccattgccatgtgatacccagtgccccagatacttcagaatacccaaaagaatgaaggctgtcaccagatatgccccttcaggtttggtcttcttagcctctgtagctgtaagaaatattttttttctttataaattacccagttttaggtatttttataagcatcagaaaagggattaagacacattcttcagttgacccttaaacaatatgggtttgaattgcatgggtccacttatgcgtgtatgttttgtaatgaaaattacatcaaatgtgccttcctgtcctgcttctccttccatatcctctgcatgggaattcagcatccctaacctctgcattccttaacggtcaactatatatcttaaatgtgttttcatatgcaattttatttaatactgataataactataggaaataaacgatattatccttgttttaaagatatgaaaatggagaattccagaaattaaattacttgataagcttgttggtaaatggtacatctgggacttagacttgccgtcaaatcctgtgctttcaattcttaattacaatgcagcggcccctctcgtgactaatttcttatttactgttttcatcttggatgtctctttatgattccttgttgatagttcatagtcagctttttatttgattttctatttcattaataaattttggctaactcttcagccacaatgtcttgtgaaatgaaattgatcgtataatgaaataaatgtaattgacttacattaatgtagcattattttagagagtaaatttgtaagaatattgaataatattgaataatataagaatattgaatatacaaaaacattggatgatatgagaaaataagaaaatacagatcaggtctttgtttttaaaaagttacatgatgtaatactaggcaatacattgtctcaaattatgcatatttggggaataaaataatgaatattaattttcaacattccatttcaacattcattttatttccccaatatgcatattgcggaatatttgcagagtaggtataagattatatcatttcataaaacagctataattaacagaattttattcaacgctaaggaattagacagacttttaaagtagagctatacatattacaattttgtagtacaaaaaaattggtgatttttatttcccagtttaaattacagattcccttttcttgaaccacagatattgtagcagtaagtggaatctacatatttttctatgtgttatacctaatgtgaatgtgtctgtactacacagcactcagtaccatgttacaagcaacatggtgataataggtgtagagggaaagtatggacttttagttcagacacacatgagttaatttgagaactacttctgtctttcaagctctctgactctgagctagcatcttaaccttgctgagcctgtttccgtttgtaaaatggggatcgtaataccattgcaaatgattcctgtgagaaataaatggtaaaagtaacatgcactgtgcttagaacagtaattgttctacaaaagaaaatcaagttagtcctctttttccaccatgagcagcatattgccataaactagtatgaatttgcgtgtcaggaaagcacttaatttatgggttaaaacgggtattttcatttatctacctacttctttatctctttctcactgtatcatctatatatttttgtaggaattaatgtttcctttgtattaaattttaattgaaatgctactatgtaaaccaatacaaatgctcctattgtcaagtgggtttcctagaaacagatttggatctcagtgtggggtgcagtctgaaaatcactgggctaaataagctttttgggtcatgtgtccaccccagtgcaacaaagttttacaagctagtttcttagatttcatctgcttgtaggcacagctgacatcacatttgcaataatgactcaaattgtattggctcaggtatccaactttttaatgaacaattatggcaacctttccaaatgaatcttcaggtataaattacatttgataatcatgtgaataatctatttttaaaagaagaaaccaattcagttttatttcaaataatatactaacatttcctagctactttatacatttcatctgtttaagcagaagcatttaggacttcaaggggagaggaagataatgtctagaaaaagatgtcactgctttggcaaaacctgagtttttaaggctcatgaagtgaatataaaaatgtggaaacactcaggttatgtttagtgcctcatttctgtagttgtgtcctcgggagactacaaaccttccagagaaatgttgtatttgtcatggctctgtgtctcctatggcatggaagcaatatgggatcaacttctgtgggtgcgtctacgtaggtgcctctgggcaaactcacacagtgtcttaaactccttatcatggtgtagtgaagacagtccaaacccctgtgttgtcttgatgtttaggaagtataagaagtctagttaggctgtacacggtggctcacgcctgtaatcctagcactttgggaggccaaggcaggcggatcacctgaggttaggagttcaagaccagcctggccaacatggcaaaattccgtctctactaaaaatacaaaaaaattacctgggggtggtggtgggcacctgtaatcccagctactcaggaggctgaggtaggagaatcactagaaccctgggggaggttgcagtgagccatgatcatgccattgcatccagcctgggtgacagagtgagactctatctcaaaaaaaaccaaaaaacaaaaaaaagaagtccaatcaataagaaattttgactttatgctagcaggtcatagagtgagggtagctccaactacgcagaatggaaagatccatggttatgaaaacaagtggcagcatatatacagaacatcaggtgaaccaagttatataccagacaataaagtacagagagtcagtgcagttcatgggccaagggaaagaaagttccttgccaggaggccatcgatgaattccatatctctcccctgattttgaaattcacaaaatcctaaagggaaagatgttagcaaggggtgaatgtacatggttgaaaagtcttgcaatactgttttccttcacagttcctgaactttggaggggagagggacttgaattgttctggaaaaccctttgactgtactgagtatctttgaataggatagagtaacttatatggtgaaagcaaccaaagagccaagttgtgttttattttaggaagtagaaatagttacatttattacaaatatctcagacaaagtataagttttggtcacattgtactcatgaagacactttctcagcctattgctttgctcatactgtggtcttccactagacattgccaccacacagcaggaaatcagtctcctaccagtcaccaatatagagccaaaagtcactgcagtcactcactgatatggtttgggtctgtgtcccacccaaatctcatgttgaattgtatccctaattttgggggagggatgtggtgggaggtgattggatcatggggccggatatcctccttgctgttctcatgataataggtgagttctcacaagatatgcttgtttaaaagtgtgtagcacttccctcttcaccctcttcctcctgctcctgtcatgtaagatatgttggcttccccttcaccttctgccatgattgtaagttttctgaggcctcctctgccatgcctcctgtagagtctgcagagctatgagtcaattaaacctctttcctttataagttacccaacctcaggtagttctttatagtagtgtgagaatgaactaatacattcattaagtgagaatcaacactagtataaagctgttgatctttggtactgtggggagaggaagaatacctatccctcctttagtttactttcagaaaaagggatcttatagcaacgttgtgttgttactgtgcaaaatttacagaatgtattgaaatattgtggctcacacctgtaatcccagcactttgggaggccgaagcaggtggatcacctgatatcaggagttcaagaccaggctggccaacatggcaaaaccctgtctctactaaaaacacaaaaattagctgggcttgagggcaggcacctgtgatcccagctactcgggaggctgaggcaggagaatcacttgaacttgggaggcagaggttgcagtgagccaagatagtggcattgcactccagcctgggcaacaagagtgaaactctgtctcaaaaaaaaaaattgttcttttaaattttcttaaccacagccctctcattctctccccaggacgaggaatgaatccatgcatacacaaggctaaccttaagatggctttaagtgatggccaccacattcaaaattattattggtatttaataagtaaaattttcttgttgaatatactttagcattcctgcctctgtctcccagcatgagtttcccctaggaggtcctttagacttctaaaccatcttacaatttgctacacttggaatctagtttcatttaaataaggaccacaggtacatctccattgctgttggtgtttggagttatgtgatgaaaaagttataatgtatggagaaaagtcctagatgtgtaataagaaaacccacatatttcccatggtcttccatatatgaacagtatgacatttgataagtcatctatctctctgagcttcagtgttttcatataaaatgaagcaattgtaatgctctgtattccttacaggtttgatgagaataacatgataaaaattatatgaacacactttgcaaagtgatatacacgtgaatttttttctttttaattactgaccttagttcacagcattcctcatatgtggtcgcagttatctaccaatgcaagtagttgttcttccaaaggattgaaggaatctaccacatttgattgggtccaaaaaaatgtgtatacctttagtgtatagttgtctataattgctgtttcacttcctagtctaccattcactttcataacacaggtgatgttttaattctactttctaaattttgatatttccacttgtacatatttccatagttaactaggaaaaaagaaaatatctttgttgtagcttaaaacaggtaattattctaaatatgttttcacagcaatttgaacattcatgagcaataagactgctgaaatccagctatgcattatgatagctttttagaagtaatattactaggcagtattgtagtgactcttagttctgcttggaatactacatttgcatggggcttttctattgaaatggaaggtgtgcacattacaatttttcctacattaaagaacagaacattctgcctcgttttcatctccttcaaataccgtctatgtactgagaccccactgacttaaaaaatataataatccatagggtactacatcacatgaactccatcaaaataggcctaaatttgaaagacattgctcaaatttttctctgttactgtgtctctcctgtcatgtttattagtacagaaaggattttcacataaatcatgaaattttcaaccctttccacaaaaagggcaatctcccatattatatctgtaatcttgtcagtcttatcaacttcacagtgggttatctaattgctaaacaggatcaatctacacctaccacatgttgacaacatagttgtaaatacacaggctcattttgcttacattcaaaatgtcaaagttgtcactaacagaggtgtggttgattgcagaaagggccacagtcatttcttcctatatatgcctttttgctgactttgttgcttctctcaccaagagatggagtctctttcccctcttcctatatctggactggtcttgggacttggtttggccaataaaatgcagcagatgttacatgccatttccaagcctagccctcaagagccttgaacatttctgttcactatcttggaacactacccaatgcaatgtgaataagctgcgttggcatgctagagagtaagaggctatgtgaagtagagctgtattgccttagcctagaccttgctagaccagccaattccaagttgacccatgagctgactgcagatgcatgagtgagccaaactaagattagtagagctgtcaaattaacctgccgattcatgagccatataaatagttattacaagccactgaaatttgaggtgttgtattatatagcaatagacaactaatatagaaggactcatactttatctatgaaaatatattttgattgttcagacaccatgactgaaatttaattttctacaataaatgtattaagaaaactgttattaaccttaataaaggtattaaaaccaaatatcaaggtatttgacaaattcaagtatgaagaaataataaaaatggtaatttacatattcatttgaaactagtcaaaatcaaaacagcaattgaactaatttatttctgtttatgaaataatcataagaacataagaggaagaagaacactatgaaaaagttaactaaaaaaatacctaaaaagttgactttttaaagaaagcttactgttctctgcacagtaaactgttaggaaacaaggatactttgtacaggacttttctacctatactgtaaaatgtccacttggaactttgagcttctttattctgattagaatataaagtgtcacatcttacttctaacacatgaaactgctttccacagtctaatgtttatgacatcttggtaggtgactcagatgtccaatggaaaattacccatgatctatttaataagcatttcctcccacagtttgctgaacacaaagctttggttcacaaacctaggagtttataaaagggcctgtgaatgagaataattattagagaaaattgtctcattctccatggaatctgcacttacccctgtcactcatcctcatgtgaccatatgtgcacagatgatgatgtggttgattataatagtgttagttgattgtgataataatgtgatacattcttacaagagaaagaatgaaaatggctgcaagtgtacactaatgtagccacagccatcatggttctcaaatcatggtgatttgagggaaacaaaagttactaacaatatcttacattgttttggaactttcttaacatagttcatatcctgtataaagctagctatctgataagctgatgaagagcaattacatttacttacattctcatgtgtaagaccagaaattcacttaaaaaaaccattattacctgagagctactccttaagaacttgcacataatggctcatttgcaatagcttcaggagaagggggggtttcttgaaacatctttttccatggattattatggctcattgtggtcttttattttttgtcagttgatggatatcatgaaagattgaattaagggactgacagaaaagaacttctaaaaatagctttcacccctaaaaagacatcctgatgtgaaaacaagatagggagtttccagaataaaaggttctcaatttgagctatatcttgatgaagcaaaatcaactaacaatacctaatatgaagctgcatcaaagactaatgacaatctcaatacattctcatttaaattgggaaaaaatatgacaggttcttaacagagagtgatttttttcctcccaggacatacttggaaatatctggagacatttttgactgtcataggttgggggtgttactggaatctactgggtaaaagccttaaaatgcactaagcaccttaaaatgcacagaacagctcccctacaataaggtttagtctaaaatatcaatagtactaataatgagaaatctcaactcagagtgtacattcttgttcagtgcaaattctatgccttgattttagcatttgataagctttcacgttttaaagagagaatattgtgaagattttctcccacagtgtgggttgtctgttaactctgttaattatttcttttgttgtgtagaagctttttagtttaattaagtttcatgtatttatctttgtttttgctgcatttgcttttgggttcttggtcatgaagtctttgcctaagccaatgtctgtaaaggtttttccaaagatatcatttagaatttttatcacttcatgtcttagagataggtctttgatatatcttgagttgatttttgtataaggttagggatggggatccagtttcattcttctacaggtggcttgccattagcctagcactatttgttgaatagggtgtcttttttccctactttatgtttttgttcactttgttaaagatcagttggctttaagtatttggctttattttggagttctgttccattggtctatgtgcctatttttataccagtaccatgctgttttgataactatggccttatagtatagtttgatgttgggtaatgtgaagtctccagtttttttttttcttagttctgctttggctatgtgagttctttttttggttccatatgaattttaggattgttttttctagttctgtgaagaatgatgctggtattttgatgggaattgcattgatttatagatcacttttggcaatttggtcattttcataatacttattctacccatctatgagcatgggatctgtttccatttgtctgtgttgtctatgatttcattcagcagtgttttgtagttttctttgtagatgtctcacttccttggttaagtgtgttcctaagtttaatttttttattttttttttcagctttgtaaaagggattgaattcttgatttgtttctcagtttggtcattgttggtgtgtggcagaactattgatttctgtacattaattttgtatcctgaaactttgctgaattcaaatatcagttctaggagctttttgattgagtaattagggttttctaggcatatgatcatatcatcagtaaccagtgacagtttgacatcctctttaccaatttgcatccccttgatttctttcttttgtttaattgctctggctaggacttccagtaccatgttgaatcaaagtggtgaaagtgggcatccttgccttgtttcagttctcagggaaatgctttcaacttttccccattcagtataatgttggctatggttttaaacaactcaaacaaatcagcaagaaaaaagcaaacaattccatcaaaaagtgggctaagaacatgaatagaaaattctcaaaagcagatacacaaatgcccaacaaatatatgagaaaatgctcaacatcactaattatcaaggaaatgcaaataaaactacaatgtgataccacctcactcttgcaagaatgaccataataaaaaaaaaatcagaaaataatagatgttggtgaggatgtggtgaaagggaacccttttatactgttggtgggaatgttagctagtacaatcactatggaaaactgtggagattccttaaagaactaaaaatagatctaccatttgatgaagaaatcccactactaggaaatcccactacccaaaggaaaaaattcattattcaaaaaagtatatatatatatatatatatatattcaaaaaagtatatatacacatgcatatatacctatataaatacatatgtatatatctacatatacatatatacttatatacgtgtgtgtgtgtgtgtgtgtgtgtgtgtatacataccccatggaatactactcagccataaaaagaaattaaataaaaacattcacagcaacttggatgagattggagattgttattctaagtgaagtaactcaggaatggaaaccaaatatcatatgttctcattcataattgggagctaaggtatgaggatgtaaaggcataagaatgatacaatggactttggggactcaggggaaagagtgggagagggtgagggataaaagaccataatttgggtatagtgtacactgcttggttgatgggtgcaccagaatctcagaaataactactaaataacttattcttgtaacaaaatactactggttccccaaaaacctattgaaataaaacacaaatttaaataaataaaattataaaaatataaattaaaaaatataaaatagaggtagtattatcgtattagtccatttacatgccgctgataaagatataagcaagactgggaagaaaaagaggtttaatggacttacacatggctaggtacacctcacaatcatgacagaaggcaaggaggaacaagtcacacgttacatggatggcagcaggcaaaaagagaaagcttgtgcagggaaactcctatttttaaaaccattcgatctcctgagacttattcactatcatgagaactgcacgggaaagccccacccccatgattcaattacctcccaccaggttcctcccatgacacatgggaattgtgggagttacaactcaagatgagatttcggtggggacacagccaaagcgtatcaattatatagtgtttaagaataagtaggctcaggaatcaactttctgttatcaaattgtttctactaattgtaaaatatatgactgtggacaacttttttttttgtcttatctcttagttttctaatcgtcaacatctgcataatattaatgaccacctcatagaagttattaagataacaaaataattttaagttaaatgtataaatgtaccagcacatataggcacttgttaaataatagttgttattattgtatcagaataataaaagttggtgaaaagtatagataattctctagtgaatgtattatatttgaacttgcttctgtatgaaggttcatcatgaaaataataacttaccattataacaaacaactgtccatttattttaaatatccaatggtaaataccacttgagttcatttttttctaaatagactttcctttttagagcagttttaggttcatagcaaaaaccgagcagaagatacagagattaagcatatattctgctcccacaatacatgacctcccccagtatcaacatcctccactagagtggtacatttgttacaattcatgaacctacattgttacatcattatcacccaaagtccatagtttacacgaggatatactcttggtttcatacattctctgggtttggataaatgtataacgacatgtatccatcattatattatcatacagaatagtttcacttccctaaaaatactctgtgcttcatctgttaattttttcctcccctccactaattcctggcaaccactaacatttttactgtctccatagttttgcctcttgcagaatgccatattgttagaatcatatagtatattgcctttctttcacttagtaacgtgtttatattgcctccatttttatggcttgataggtcatttctgtttagtgttgaataatatgctattatctggatatactagtttatccattcagctatcaatggacatcttagttgcttcaaatttttggcaagtaagaataaagctgctataagcatccatgtgaaggattttttgtgtggacctaagttttcaacatctttgggtaaacaccaaggggccccattgctgggttatatggtaagagtaagcactgctgtaattgcatttcataaatgttgatgaattgtgtttttattttcatttagtttaaaatatatttttaaaattgtttttaagagttctttgactcatattttttaaaaacgtgtttgatatctccaattatgtttaatattttccagatattctgttattaatttctaatttaactctattgctgtctgagagcagatattgtatgatttctattctttgaagtttgttaaggtacgtatgttttattgcccataatgtagtctatcttgtgaatgttccgtgcgagcttgaaaagaatgtgtattctgcttttgttggatgaagtagtttatatactttgttggatggagtagtttatatacatccattatatccagttattgatgtgttgttgagttcgattttgtccttaccaattttctgtctactagatttgttcatttctgacagagggataatgaagtctctaactgtaatagtggctttatcactttcttcttgcaattcttccagtttttgcctcacatattttgacattctattagtaggtacatgcaggttgagaattgttatgtctttttggaggtttaacccttttatcatcatgtaatatccctctgcattcttaataatttttgttgatctgatgtctaactctgaaaataaatacctattcccactttcttttgattagtgtttacatggtatagctttcttcatttatttactttttttctacatatgtctttatatttaaatagctttcttgtagactacatagagttgggtcttgcttttagatagaatctgacaatgtttgtcttttaatttgtatatagaccattgatatttacagtgattattgatatagttggattagtatctaccatatttgttttggttttctatttattgcccttgtcttcattcccatttttttctttcacacttttttgctttttgtggatttaattggggattttatgagattctactctctctcctttcttagtatgttcattgtatttatatattttatgtattacatgtatatgtgtgtgtgtgtatgtaatatttattatgcagaacatgagaggtcactccaatttgggggtagtggtttgccctgtaacctcagttatcttgcagatataaaaacagttgttaatttttcagtttgttcagctttttacttattcttaggatgaactgtcaacttcatgctgaaccagaactggaaattcaagttcggtttttaaaatagtgaaagtaaaatagcaaatgaagagtggtataatcacacccccacataaacccacacacacatacacatgtgcacacatatgcacacacacacaaagctgttaaacgtatcctgtttggagctaagagtataataatgaaatatgcaataacgagtatgttggcttgcttcaacaaaaatatattgagtatcttctacttataatgctggatgctttatggaataaagggagaattactcagaaactatcctcttgccattgcttggaagagctcttgcaaaggcaggctaactctcagcaactgcgtttgtggaacagagagaaatctgagcaatcccagggttgggaaccttgataagctgaatggatggcctctgtagaaaaataggcaccagaactgacagttgctttaataaaacatgtgccatatgtggtattggctttgaattctggcagtgggtgacaaacaattacaagggtctggaagatatggtgatccacacatgacaaagaatttgataaaactatttcctataaaaatgtagaagacctgtgatgtagctagtaaacttgtaactttaagtgaaatagttgtgaaacaagttttactatctagattgtcttggtagcaattcactgcatttcaaagaatctcaataaatacctgttgaatgaatgaatagatgtctaccattactctctagttcaaatttctaatcttcttaattcgaatttttatagcaacctcctatctagtcttcttaatattaactttagttgcactgcacaattcctttttgaatctctggaaaaataatctaccataaaaggcaattattgccttgcatctaacacttttggatatattatatatcatcattttttcagttgaataattaggcctctgattaccttttccactttctactgttttcccatctataattcacccttcagatagttcaaactatttgcatttttacaactcctcatctataaatgagagcttttcatcttttaaaatttgatttgcaaataacacaaggtgaaaggtgtggattgttgttatgttaggtcaactccccaagttccctttattcaccaacctacatggcttaggaaaattctactgagaatgtttcctgatggaaatacacatattgagtcccagacaccactggaatttccttgctgatctacagccaccagataagctctcaaaagttaaccagtctcagtttaaacactagctctcctcagttttgcctgaaacatagtagcagcttaataaatacttatagacttaaaaatgatgacttaatttctgaatatgaagatcaaaagaggaaactattacatcagtcagatgtcacagaaaaagtattatttgaaatggctcaaaccttaatgtacatatgccatacctaagatcttattaacatgaatattttgattcaatcgatctggagtgggcatgagataagtttccaatcagccttcaggtgatgccaaagcccttagtccatggaccacatttggcttaacaaagccttaacaactgaatttcccaatataagaacagtattaaccaagccacaggaatagaaggttattggttacttttagccaattacagtaaattatttcaattggttacaattggttacaactggttacggtaaattatttcaatttagtggcaacaggatttctagaggagaaatttatgttgcaatgttgtaaaggtagattaagaccatttctgtggtttagatatggtttgccctcaacaaaactcgtgttaaaatttgatccccattgtggcagtattggggggtgaggcctagtatgacatgtttaggtcacaggtctggatctcttatgaatagattaaagcccttcctcaggcgtgagtgggttcccactcttgtggaaacggatttgttgctgtaagagcaagagagttgttaaaaagagtctggcttctttggtttctctttcttactacctctttcaccacgtgatctttttgcacacaccaccccagacttctacatttgccaagaatggaagcagcatgaagccctcatcagttgcagctgcccaatctttgactttccagccaccagaatcatgaatcaaataaacctcttttatttataaattacccagtcttagatattctgttatagcaacacaaaatagaccaagagagctatattatagaagatcttgaaagtgacagtgagaaatgcatacctagtagaactcacagtaacttttaagttttgttttttcttaaacaatgcgtttggagctatcatgtgtgcacgtgtgtgtgcatgtgtgtgtgtgtgagagagagagagagagatagagaggaacagagagaagagagagggagagagagagagaagagagaattcattttggttttctgaactgtgaaaaaaattcaagtgaaaagcattttagcaaaatatcaagagatagtcagacataaccgtgcctgaggtatgagttgctgaaattcattattgatgtttagtatcacaagagtatcttcaagtcactgcaatgccatatgtgaagccaatgcaatacttctcctcacacctatctctcacaaacttgaattcaattaattaccagtttggcttaagtttggtttagaaaaatattttatgctgtttttgtacctgtttggttgagacatatttcgatttttattctttcttaacctagttggctgaattatgaaagaaaccccaaacatattaaaaaaagcccagcacaaaacctaattcagttagtgcctcaataaacagttttatatttgctttggttagggttaaagagctcaacaaatataacttttggatttgctttttggttagacacttgaatgaaaatgctggttggaacatccagaatgtttttaaaagtatccaagtacacaatgctaaagtctaaaatctctagactgagactagttaactttgggagtttatctagtggctatagttcagcggggggaaatctcagtggtgtctgtgactcaatattatgcccatcaagagacattcttagtagaatttgcctaagccatgtaggttggtgaatgaagggttggcatcatgtaacaaaaatctactccctccacactgtgtggtttagttgcaaaataaatcaaatcattttttaatttttattttattttattttttattatactttaagttttagggtacgtgtgcacaatgtgcaggttagttacatatgtatgcatgtgccatgttggtgtgctgcacccattaactcgtcatttaacattaggtatatctcctaatgttatccctccccccttcccccaccccacaacaggccctggtgtgtgatgttccccttcctgtgtccacgtgttctcattgttcaattcccacctatgagtgagaacatgcggtgtttggttttttgtccttgcgatagtttcagctgaagctaaactcatctatttaatgattctctgaaaatttcttcaatgggaaaacagaatgtggaaatcaccttagcaaggttgtttgctatgttacaggaagaaaaagattaacaatcttcattttattggttttatctgattctgaaagcagaatcaggatgtatataattgacaaatgcatcaaaactaggatggaattggcacagatagattacgctcctttacttagtttctatactataagcatatcgaacatacaatgtcatcttaaagatttttgaatactgcatgcaatcagcgtaacatgatgttcataaaatacccacttattagatgttgtgaaattgcatgaaaacaaattacctatcaaatatgcttttcttggtattaagccccaaataatttttcctaacactttctaggttcctagaaaaagtcagtgtgggaggggaaagagtgcagattttagaagacagcctaactcagttcaaagtccagtttttcattcattttgtgtatgatcttgaaaaaattatttaaattctctgcaccctgatttatttatctttaaaagagaaataataaaaacattttgcaaaggttggcatgggggtgggaaataaagtgcatatggtacctatcacagtttctgatgcctaacagttttcagtagatattaaccgttattgggatatagtcttcacccctttagctttcactatgatgaagtcatcaattcatcccggtaggacattacttaaaaaaataaaaagtcattccaacctcccctttcttcttggtttattcaaagacacatggaactgactttgggtgggaaggttaaatgctaaaaagggcaataagcatttaagcatttgaatcagggagtgttgtgaaaactcagtagataaaataaatcttgaagatgatgaataaaactgtttccttcttgctggagatgggtaaaatatagcacctcatgttttaaatgcttttctatgggtaaaacaaaaccagaagcagtaaatatactacttaaattctacttccaaggtcagaataatgatttttttttaaagtttctgccactgagaaatttatttcgggggaaaaaataagagtatggttcagagacccttataaacctttctaaagataccaggatcatcatctcccacatatcctaaattttaagaacataaagaaaaatctctcctaagtaaatgcttgatgcctcttctagctaagctactagttttagataaaatttaaagtagaatagtcatatctaacattgctataggatttccccccataatcaataagcacatgacatttatgtttattttacattatcagagcattttttattatttaaataattacagatttgtattttttatgtttttgcctttatgccattttatttcaggctaagatttattcaaggctgaatttttggtcaggaacgcaacaagcaattataacactactattttataacttgttttctaggaacacattgtgacaagaaacatgaaatgggatttcctgaaacacaacaacataaaggcaagcaaacaaatgaaaagtttataagaaacaaatgctatgcagcttctatagaaaatgacaatttcatatgcaaggttattaagagatacacatgcaaatttgggctagtttttgatgctgtgcctttatttatacttagaatttgatataatttttggttcaatttgttacaatactgtcattaaacctgaatactaatttctccacataagcaaactctaaacattcaatattaacatcatgcaactgaagtacctttattttaaattgttgaccatactctttctgatatataagttagaagtaaaaaataaacaaatcaaaacaaaaccaaaaaggaaacctggaaatctttaacttgacaattgttgaaacacatgagaatttggaaatatataacaaaaataaagttcgatttattttttgtctgctagagtaatttcacattgaacagaatcaagatacatttagaaaacatcactctacttaacaatcatttaactgaaaaaatgcctgatttacagactgtaatgatgaaattaacttggaaaacatttcggtcatgtgaacctgaagagaagtagtagtcattttttttagtttttttattaagttaacatgacttaaaaatcattgatttataaattttgcatactagagtgaaagataatttataatctagtcaaataccaaatattatgttgttctatattaaattacaaagtaattatttagcttttctaaaacattttcggtggaaggtttactgcctccatttttaaaccgattttttgaatgtttgtcctagtattgaattgacattaaactctattacttatatctgttcatctcatagaaaacagaatactataagcattgtgtacatgaacctcaagcttttttttttaatttgtgaattctaattctgtttttgaagatcacaaaataaatattttgtttaccatatgacaggtcttcactggctctaatgtgtccacaatttttttttcaggatatacatcctcggaaaagcaaaatatgaataattttataagttttcatttttggtagtatagaattatttatgtcactctatctctatccctgaaaacaactaaaaaaaacaaggttaatacgatatttatagcaactttattcataattaccaaaacttggtagcaaccaaaatgtctttcagtgggtgagtggaaaaataaattgtggtatgtctagacaatggaacgttatgcagtgctgaaagaaatgagctatcaagcacgaaaacacacagaggaaacttacatgcatatgattaagtgaaagaagtcaatctctaaaggcaacatactttaccattttaactatatgatattctggaagaggcaaaattttgaagacagtaaaaagatcagtggtttccaggagttcatggggaaggagggatagattggcagagaacagaggattttgagggcaatactctatataatactattaatataatgatggatatatgtcattatatatttaatcaaacccatagaatatataacacccaaagtaaaccttaatgtaaagtatggactttgggtgattatcatatgtcaatataggctcatcaattataataaatgtactagttcggggatgttgatagggatctgtccatgtttggagacagagggtatatggaaaatgtctgtactttctgaacaattttgctgggaaccttaaactcctataagaaaataagtcttaaaaaaagtcaccagactgagaggaaagtaagaaaactacggagatctaaaacaatgtaaaaatggggattttaatgctattgttcataagcttcaattttgcagttgtggaatcatgatgagataggctagagataaagtatataggagcctcttatggagagaagaccccagaaagtgatttcatttacttatttgtgtatgggtaaatgaaaaataaatttgcccatccttctttcccatgtccatgctaggtggataaaaatgaaattcttgcaaaggagtaactacaaatctgcccccacaaatctgtggctcatattataaaacatgtataaacagaaactccttaagtagagaatttaacttgaaactgttcaaaatgcctctaggttctgaagaatttaataaagactctctaaaagaatgcagtttcaaactagccctcaaagaattcgtgcagttgaaattccaaaacaagagtgccgggtcaaaatttacaaaacacagaagaaaacaatgcactatgagtaagagtcagaaaaaaaatatatagccctagtagactcaaaccagtgaaaaactttgattttgggggatagtcaaacccagaatataaaataataatgtttaatgtgtttaaaaaatagaaaattcacttgaaaatataaacagataacagaagcttataaagataaaaatcaatatgcaaagacatttacttttaaatataaaatataacaattaaaaataaaatataacaaaaataaaataccaataaatttgaaactcctacaggaagaattagagaggagagagacttataaccttagcaatccactgtaaaagaaaagatatcataggggaaaaatattcttcgttattgaagataatatttttcaccaaaggacatggtgagaaggttttagaagaagaggtttaatgcaggttgggtgagtggaggatatatagagcattgaaaattgatagcattattgatatagtcatcaatgacagatgcttggaaaagctttgggtagggcatgatacagtttaaaaaaaataatgtgaaccatggtaaatttagtctttgggaaattcattaaatggacctaataagattcacctggttcctggaacgatggcccaacaatgagaaggcaatctctgatcatttaccttagtgactctcaatcctggcaatgcagtaggaaaacctggggagctttcaaaaacagaaatgcctgggtccccttccacatgaactgaatgaatagctttagggaaggtttcagggcttccacgttttaaaggcttttccacgttttaaaccttagagaaggtttcagggcttccacgttttaaacattaaagtttaatgtgcagcctgtttgagaaccattgctttatgttatagtcagctggtgttggtagctacagttaacacagcaagtgttgacagaatttatgatgcatgagccatgtgctattttacttgagttggaggtaagaatgtggaggtgttctttagtaattctaactcaccttcccatggaagagtttgggatctctttggaaatgatatcttctctgggcttagaattagtcccagagatacagtcagggaccttttctcaatcctttgtacaataaattaggtgcttaaaaaatctactttgtgataaatagtccaatgtgggggagttaaaaatgaaaaagatttttgaaattttacttactgccttaggtttataggatagacatttcagcaaaagatttaagatgacaaggacagaattttcagtaaatatggcatctccagtcttttatagctcctctccaggagagaatctcaagggtggcaagtggtcagcttgtctaatgtagatcatatcagattgtgggaaagcctgagttaggattttctcagactcttggagccacagccatatcaccaggaaaatcctgcatagttacctcatagcttttatggtgagaggtagttttcagactaatatttgggaattggtaaaatgtcactcatgccaacattacaatattactgtactaatctcaggacataaggtaatgaccaggtattacacgtatggaattacactttatctctgtaaaaataacttctcagtgggtgaaactgtaatttatttactgaacgatggcctgggtaggggggtactaagcatgtcattaagggcatggtctaacaaatgttaaggactccaatgaaattggattttatatcacacaatttttatgctattcgctaaacttttctcaaagggatatgttgtgaacattgtgttgtacagattttacggattattaaaaaaattactaaggcaacattgggaaccagcgtggttgcagtctagaaaccgaataaagaagtttcacatacctattttatttttaaatcttagttttaattcatctgtcacctgcatgcatacttatttggccaatagcgtttaatatagctcatcatctatgtatttatttgactttctagtagtagcatagtaaaaggctgatcagattgcatgaattcaaatattgaccctaccagttactgtctgtttacctttggcaagtaacatattctgtacacttcagtttcctcatctgtaaaatgtagaaactaaatttgtatatttcattgtgtaattctgaaaaccggatgagatgaaaatgtgtctttaaaactttcagtaaataataactcattttattgtaactgaaatatttaata

SEQ ID NO: 91 - DNA, 282643 bp, Homo sapiens
tatatccaggtagagcattttacattctggacatcttcttttcctgataaagaaaagccccaaagtctccaggtaattggcagtttatttttataaacaatgtctacaaataggtgataatttaaatctagtttatttggtatcattgcatgagaattcacatcctgtccaggagacgccttagtcctggcatgactttccatggcatgatagaggtccacatactctttctgactctgccaaattggtttttctctctccaaagaaattagttcataacacacaattgaaattgtaggattcatcttgaacccttgcggtggcagtcttgaaaaatcccatcttggcttggcagttaagttactggcttgaggctctacatatggtgctactccatgaaacatgacttttattttttatttatttatttttatttatttatttatttatttatattttttttggtgagacggagatttactcttgttgcgcgggctggagtgcaatggcgtgatttcggctcaccgcatcctccacctcccaggttcaagcgattatcctgcctcagcctcctgagtagctggggttacaggcatgtgccaccatgactggctaattttgtatttttagtagagacggggtttcaccatgttgcccaggctgatcttgaactcctgacctcaggtgatccgcccgcctcggcctcccaaagtgctgggattacaggtgtgagccactacgcctggctgaaacatgacttttaataaagatatttttgaagtgtgatgaattgatgatacattaaaatatatatttcgagtcaggttgatttattccacaaccattcagtagacactgtccatatgctagtcacagaaccaaatcttgacttctactctccaagtagagtttgcagtgcacctgaactggttttgattcctccttgtatgaactttagcagctttagatatttcttaatatctttaatctccagtttcctcatttatgaaattaaaatattattaccttattcacaagtgtttttttaattaggtgaaataatacttgaaaattcctagcatgttgcaaagttaatccattcaataaatgtgggggttgttgatgtttggaaatcgtcttgagtataaattccagatttttatcgtatggtctatgaaattggactgtgttacatagaaagcaatttgttttttaatttgttacaaattatttaactcataggtggtatgtagttaaccaagagagctttttatgcaggaactaatgtaagtaatttagaggtattactccctgaatctttatgagttatataaaattgatctctgtcttttacagataagaaaattgagtcttaagaaaattctgttccacagagtttctcttaccattacacaagactgttgtgataactaagtgtgctagagtagcaaatatgtacagcacaatgcttagaatatcatagaaactggaaaaatatttctatatttctaacttctgtctagtaatagtctcagaattttttttttaatctagaagtgtttggtctgtatccagagaagcaataagtacccataaggtttgcaaagacatttgatatcaaataatgagattcatgacaaaaaacacttttacttcagtgtggtactaaaatatgtacacttctttcaagggtcacacttctgaatccttaactaatgctacatccctaggagcttaaagatgtgaatccttaagttagataaaaaataaaaaggcaaaatttattacaaaacatatttgaactacattttccactgggataaagttacgggttattgtacaattatagtttctccaggcagtaggtctgtaaacacaagttgtttagagcaaccagaaacaaaaatcatatttcagtggtatttcaagtaaaattcccccttctccttcccaacactgtgaaaaaggactatgtcttaaaggagaaatttcaaatgccactggagacttttgaaatagtggaggttacatgaagagtgctttaccataggatctttaaacacaggtcctgaatggtgaccacagtatataaatggagagatagagaattaattcttcgtacagtggagcagaaaactcacatctgttctttctacaacccagtacaccccatttattaatgctgttctctgcactgtcaggtctaagcaattaacttgcacagactggcttctgtggggatagatagatggtgtgtttatcatgaggaatatactcgttttagctcctttaatagagaaaaagaaataagatgtctcctgtgttctgtctagactgaggacattgtacacttgcaatcatggggtaacagagatattacagccatgaggatacctcagttatcctgacttgattattacacattctatgcttgtgttgaaatatcacatgtatcccataagtaggtataattgttgtgtatccataataataaaaaataaaaaattaaagttgcaaaaaagccttgggaaattttagcaccaaagtaatattcaaaattttaagtaagagatataagtttagaaggatttttaaaaaatcaactaggaatagatcattttgagtgacagcctatatagttattttagtttcttggtgaatgattcatttctaaatacattggttaccaccatcactaggggtatttttctaaatatattggttacccacatcactgaatctggaaagcagaaaaaaaagaaaatgattctgtcattgccattaaacatagcaacaggaatagatatatattcacatctgctcctcctctgaggtactattctattagttccaatggttttataaataagatgatggtgtattttgtatggattccaggtttcgtggtcaggaaaaatggcatataatcctattttatcctacattttctattttatatttcagctttattttctagctcttccacagatagaaatgtgtatttcttcctagttacattaattttgattgagagacaaatgcacaaagttagtcactttctctttcttctaaaatacttttgttcacaggcttccacgagatcacacaaattcttgttttcattctatttcagtagtcattccttcatctctgtgatggagcagtccaggataccaacatggagtaatccaaggctccaacctcagatctcttttttacccacactcacggctttaaatattatctatatgctggtggctcccaaatttgtgaaacacattttgggattctgcaaattgcccaattaacatctagtttacatgtaaagtaaacacctcacatttgctatactcaaaattagacccttgattctttcccaattcttccccaccccatagcataatcctcttctcttagtgttcccaattccagtaattggtccattcattcacccagtgctgacctggtaaccttgaaaacatatttcttttttttctctcatctaatctgttatcaaaatctcttcaaaaaagatcccaaatcctactacttcttatttattttgccatcaccttacccacttcgacctatgcaatatctcgatcaaatcacttacctattcaaattctccagtgatctcctatcacatttggaataaaatccaaaaggcagcacatgatctaatgtcccacatgcctccagtgaccttagagtttctctcctaccactctctccttactttccccgcagaagccacactggcctctgcttgctcctgcttcagggcttttgcatcagctgtttgcattgcttagaatgatttctcaccacataactgtcctgctcattccctcactttattcctatctctgttaaaatgtcacctcctcaggaaaactttttctaaccatctttcagaagtgtatctccattatttttgacttctaagcatttctcactgacattttaagttcatttgctcattgactgtacttacattaaaatataaaagaaggaactttatttcatttctttactatttcaatgtacagaattatacctggtgtatattagtgctcaattaatatgtgttagatgaaaaagtgtacaacgagactattgtatctgcaaaaattttatttccgagaaggcctcttttctgtcacgtagcttcattaacagttaaagtttggttaatgtttacttactgagattattaacaattaataaaacgtgatttataaagtattccaagcttaattctcttagtctgtagtgaaaaatatttatagtattatgaatctctttcatttggtgctgtgtagacatagcctgaaactgataatttaccaagcgctatgaagttttgttgctggagcagatcgcgaacaaagcttctgagaatataattggccaggttgcctttgaagcttttcaaacaataaataaaatactatatggcagagagaaagagaactatacgtaataaaaaaacagaatagagattatttgtaaaggttggaagacgtcatgtgttccacaatatttgttcattgattcccttcctcagtgctttctagagtttctgatttgaggggataatttacgtgcaatttttctctaagtaaatgcgctatcctctccaaccgagacttaggattgtgtgcaacacagccagtttatacatagagaatgtcgaaatgaagcatgactaagaaggaactctctccagaaatatcttgataaaccccattgctccttccgctgcattttgctttgtgacattcataacttagtgggaattaatttgtaagacaaattacatcctgacaaatacaataaatttctgtctggatgacttgacagaatattgaactacgtatttgttagaaagtaatattaaaaataaaccttaccaataagtcctatttctgtctcatactttttctacttcttttttctcaaacatggattgagttcattaagaaaacacaagaaattttaataacttcaaaacacatgaagcaaaaagggacaccctcttggctccaaagattcatgtctattccacatgaaaatatattcaccccatctgtaggttcccaaaagcctcaaaccattcagcatcaactcaagtccaaagtcttgtttaagtctcgtaagctcaagagtcccagatctcatagtgtaaatcaggtatgtgtgcaactcttaatccatcatggggcaaaattcctctccatctttagagttgcaaaactagaaatcaagttacctgtttccaaaatatgatgacaggaaaggcaaggatagttgttatggatattcctactcaaaaagggagaaaatgaaaaagaagaaagaagttatcagtttcaagaattttgaaatcgcagcagggagattccattaggtttcaagggctggggataatcctctactttgaacagctctttcctgtgagctcacagctcatcctctgaagccattcttttcgtaaaatgagcagtacatatttgcagatgagttgttttatgggcccgtttcctgactatagaattttggaagtttagcagccttctttcattctacccactctgtgtcccttttagtccagtttgtcagtgcttctgctgttacaacattcccagaatcttgtgaatctcaaatgtatgtcatagatatttattctattagacaagaggctcctccccatatgttaaactggataataatatctcttattttggcttcttttgaaagactaaagaggatctatgggtcaagtcatatgtctaaactctttaaagagccttctctgtaattgaataccgtgaactttggatattgccaaggcattagcaaaaggttatccagtcacacccttggttttcactccagagcacattttcatgatgatgagtttccgaattttttattcttttgcaatctgtattggctgagagtttcccaaatcatcaagtctttcttcttcttttttttttttttgcttaacagttctttcttcaatttatttctttcctgtagcattttacaacaaaaagcaagaaaaaaacagactgcaccttcaacattttgcttggaaacctcttcagctacacatgcaagctcattgctttaaagttctgctttcacacaactgaagagcataattcagctaagctttctgcttctatgtaacaaggatcacttttccttcagttttcaataatctatttctaatttccttctgagcactcaccagcagagacattaacatttgtatttgtactaattttctttttatgacaatgtattttttctctaagaagatataggctctctctaccatgctccttactttattctgagccctcaccagcaacagctttaaggcccatattgctagcaatagtccacacaaaacagcagaaacagatgccagacaggagagatgctaagatgctggcttgaaatgtagagaaaagaaccacaagtcaaggaatataggtgaactgtaggaggtgaaaaagacaaggaaatggattctcccttagaacctccagaagaaatataggcttgctaatacctttattttagcccagtgaagctgatcttagatgtgtgaccttcttcactgtaagataaatttgtattaagatattatgtttttgctaacttattatagtagcagtagacacctaatagagttcatgtaactgattttgtgttctatgtttattatttcttagtatatatttttgtccctgacagaccatctaattcctaataaatgattcccttgaagtgacccccttatagaatttgaggtgagggttgtgaaagaagaaataaaatagaatagtgatttgtaaagtaatagtataggttcaaggagcaggctgcctgtgttggaatcccaaatctacattattgctatgtgaccatataactttatttaatttctctatgctttagtttctttatatgttaaatgatgataataattatatctaccttgtgggcttgttttgagtataaatgagataatctatgtaaagttttggcatagattggacacacaggaaagtttaggtaatatttttctcccatttagtacgtatattttcggacttaaatattttttttcacaggatatagccatacgatctgtttccctgcaccaagctagatatatgaatttttacaaagtgaaaatacaaatcaataatatataaaattattccagacctgctttaggtggaggagactggaaaatagacagcatctcaatatccaaaagtgggggaagatgtggaactcagatgggaaaaaacatccaagggagatttaaatgatgaagataaatttgagggatttccaagacttatcccatcttttcccctgtcaaaaacatagatcaaaagcatttcattggtaagtgaacgtgtccatactttccaagtttgtaagtatgttaatcacatagcacatagcataggcataaatctaaccattatgcattctaaaaaaaagagtgaacaactcttaagtgtcagatactctaaatttgcttttatttcccctaattcaatgctgtatctttttttggtgtattacaagcctacacagaaagtacttgataaactctacttttcttatagaatataaccaagccatcttctcatgttatctcttccccactcagcctactttacagccattagaaatgaagtttcagtctctgaatgtcatattttttcaggcctctaagatttaacacaagccatcttctcatgttatctcttccccactcagcctactttacagccattagaaatgaagtttcagtctctgaatgtcatattttttcaggcctctaagatttaacactgttcttttcccttccaacgtgattttgcaaccactttacatatagaggtagaacccatttcctctctcctaaatctaatagccttgtgtcttgcgttagtcaatagacacaggttgttatacctgtgaataaacctggcctagtctgctggagtatgagagactacatgaaacagagactaataatctgaactgaggctctcctggaccagccgaatgatttaccatctgcatgtagctgtctaaaaggtttaatcaagtaactctgtctcagatcaatagaaataattagctgatccataaacttatgagcaatacaatcccttttgttttaaaccactaaattttgcagtggtttgttatgtaaaaattactaatagatatgcctgtctatctcattagactgtaagtttctttaagacaaggagcatgtcagattcatattggtgctgaaaattgtcttgttcaatgttgtacatatttgtttagtttttatttaacttttgcatgctagtaatattttcttgaccaatattttctacttctgaagtcattttttatcattacaaaacaacttttggggcgaatattaccttctattttcattcagactgtggtagaatcttgtcagttgtttctactttttatcctacagttaaaaataagtcactcattcaacatttgcataaactttccttgtgataaatatatgttttttctctgattttggtcattctcttttctgttataaagactatgattgactttcttctctggccactttatgctacgctaagcttttaaaatatattcaatttcttgccttgtatttcttatcttgtctacttcacagatattatttctatttattttcctttgcagatgtcatggtaaacaatatcacaagtctattctatctttcccacttcctgatttcttctcctgcattctcaacacgtattatttcattctctctgaatctgcctgcaaacagaccagatcatcttctaatgccttttgaaaaatgtgtcttcaaggaaaatgtttatcccatacaggatacctgggatctgatttttatcttttagctatattagtcctcttatgatttttgtatgagttttattatctgaatgcttgcagctacataaattggatcctatttccccatccatttcaagactgctttaaggctcacactcactaaaaaagaaaagctacattacacagctacaacttgaatatgcagagtcaggttcgtaggaattaaagagtcatgtagcattaactatacaatataaagtagaggaaaaacttgtggacataatgttccatgttgtcattctctactaaactttgttcctatttgccccctgctgaaagtaacattaagtgcagtataagtcatatttattagtcagtacatacaaaaatactaagaactcataggctatggtctctataatacctggaaaaatggaagagtacaatcaactattcttcatgtaatatttgtattatgaggttaagtacctaagaggacagtttggatgctacaaaatttatcagggcccttagaaaaataaagaagaacaaagtttctgtagagaattacagtggctcctgttgccaagaaaatcctaggaataatttttattgtagcatcttttcacaggaggaactatgtttatgattgttgggtctcagattaccagggcattatgatggaaggcactatggtgatggtggatgaaaaatggctggcagaggctccaactccttttagctaatgagaatatcagcaaagatcttgcaggctggctttcacttatgttctagagagtagattaggggtcaggataaaaagaagcagatggttgctggaatagacttcatgattctcagataaaaacagctcttataacttactttttgtggagtaaattattttaaaaagttatttcttttgagattgcatttgagttaaaaaacattttttacttatctgcttctcactggtacataagtgtaaaaagtaatcaatactttaaacagggtaaatttaaattataaaacaaaaataataaatttaatttgagtttatgcaaatcaagatcaatattcattattttattattatgaaaataacaagtcaaattctaggtagagaaagaatgataggaaataatgaagatattatttttgtttatttcagagttgaaaatattactgagatcagtactgatgtctaggcaaaaagaagacttctattatctttaaatcataatgtattagcttaagccttcaaactaaaataactctgacgcagatgagctgagatgtagcactattactcctagttaaaagatgaagctgacatcatcacaataacctaaaactgagaaaacaaaattgggagtaaatgttctatgctctaaataatggttagtgcttctgaatttcgactacttggtgaaaaattggatgtcagagtggcacaactttgggaggacctaaaaaaattacaaaaaatgaaaatgtttaggcaggagacacatttctgttttttgcttcttgtttctcttgacctccaagtctttcatgtcttcattcttcattctctcttcctcctttgcacacttggatcctctggtgtttgcaatcttttcagccctctcgtcaacaccttctcacctacagcaggttattcttgacttacgtctatttttttttctttttgtagcctaatggatgtgagagggtaaatctttttctctgctcagggaatacatttaaattttagcaagggttttcttgtaaaaaaaaaaagtcaactcaaggaagtgactagtttggcgatgggaaggaagagttttagtcagtgtcatgcaagtaagtgacatttttgttgttgaaaggtaaggccttgagatttctctgaaattataaatcattgaagcaattgctgcacttaagtcagatcaatgttgcttttccaatgtttttaggtgaatttatctcagagatatacaacagaatcctttggaattcagatagtgtaaggtcataatgacgacttacaatttagtatagtattaaaccttgaacaacatggaagttgagtgtgccagtcctccacacagttgaaactctgcctataacttttgactcccccaaaacttaaactactagtagcctactgttgactggaagccttactgataacataaatagtgaacacatattttgtatggtataagtattatgtactatattattataataaagtaagctagagaaggaaaatgttattaagaaaatcgtaagaaagggaaaatctgtttacaatttattaagcggaagtagatcctcatgaaggttttcctcttcatcttcatattgagtcggctgaagaggaggagaagaggaggggttggtgttgctttcaggggtggcagaggcagaagtggaggaggtggaaagggagacaagaaagaaagtcacgcttggtgtaacttttattgaaaaacaatgtggcataagtggacctgtgcagttcaaacctgtgctgttcaagggccaactgtacactaagatcttatttgaaacccattgaaaaagaactctacatggcatattcaagtctaaacagggaccctagaggagatagatagatagatagatagatagatagatagatagatagagacatagagagatagatgatagatagatagatatagatatagatatagatatagatatagatatagatatatagatgatttagatatttaagacagagtctcgctctctcaccaggctggagtgcagtggcctgattttggctcactgcaacgtttgcctcccaggttcaagcgattctcctgcccttcagcctcccgagtagctgggactacaggcatgggccaccacacccagctaatttttgtatttttagtagagaccaggtttcaccatgttggccaggatggtctcgatctcttgacctcgtaatctgcccacctaggcctcccaaagtgctgggattacaggcatgagccaccgcgcctggccgagaatatttttaaggcatatgaagtgattcggtgggatgaattagaccagttaagtggtcttttccaaacttaatatcaaataatgtgaaatatgttctatgctgccttaactttataaagtggccttagacctagcagagcaattaggcactggactttggccgaataattttttaaaagcacaggccatacgttgttgcattaacagtagttctcaggcaatattcagacaatctcactgcttcttggatagtaacttattctcttcttttcatctccatgttttcagtatgttaaaaatgtgttaatttatcatttattttcacttttgtagaaatagacaaggtagtgaaaggatagtaatatctaaattctggtgaagaagaaaatttataatatacttgtttatgtaggcataatattcatgttaatatgggtttatgatttttgactttaataaaatatttttgttactttgaaaaactaattcagtactctctcatccttctaacagagttatatgtataaaggtcatgttacatccccagaaaatttaaatgtcttagactaagtaggtgttactactagtgttaaaacagaacggaagaaattaactacattgttaaaatgcaacagtaattaaagcaaacatctaagtgaaagtatttatagatcctactgatgagtttaacaatgtttcaaacattcatttttaacacctgtgctattaactgtggtttactaaatataagtcttaccaaatcattcttctcaatcactgtgatctaaaacaaggcttcatcttgtggtaattataatagcttcattcttcatatcacaattattttgaagtatattccattctaagaaaattaatataaacatatacatatcaggataattgttcacaatttaaaaaactgtttcataaaaagactcatgatcacatctttgaaaaaaatataagctctttcaacacacctaagtgttattttacacatcattaactgcttgatagagaggaagaagttgggaacagaagagagaaatttagagctaatgtaatgaaatcactaatatttgaatataaaaacaatatttacttgaaatttataaaatgggccaataaggaaagatggttttattacctggaaattttagaacaacatctatggtataaagtaaaataagtctttagtttatcttattaaaataatttaaggtaggtaggttttgaaatttttcatatctatcctcaagtcagaataataggtgattatatattttttttcattgcacaactgtcagcagcattaaattctgaggtatgagtttttatagatgcctatggcaacttaatactcctacaatcacaggactgggaaacacagatcaacagcacactgtggttgtaatcaacatgcagattaatgaacagagccatattcaccagggaacactagaacaaagaccagttgagcattttaattgctaagttactgctaagtctcaattccccatcaatctccatccattatgaccattgatgcatagcagacattaagaggaaaacaataacataatgattcataagtgctagggtgcaaataaatggttagctctgggaaaatcatggctgtgattattttgtggctcagactacctaaaagatctaacccgttatttctaattttcattgttctctgaacctgacctgactatatttaatgagttggttttaatggaactaatagcacagtaaaaggttagttgaacaatcttttctttagctacctccacataggcttgaattgttccttaacttacttagaaaatcacagccagagaaattagaaataaaaggattcatgaaattatctaaaatattatcatcttgtgagggcaaaactgtttcacagtatgattatgtattgttggtggagttataactaggtacattcaatggccttagtctttattttctttaacattgacagcttagtttctatcttggggtttcaaataaatcccctagaagtcgacttccatgcaaactacagtactgttttctaatctggaagaaattttccacagttgctttgaaaggcataaaaattattatgatgtagattcagcactgtactggagaatttacctgtgctctttgaatccttacaacaactttttgatgtaaataataaagtttgtgccacattctctacacctttctaaatcctggacactaagtctggactgacttttgggcatttttttaatcaatcaatttagacatttttagcttacttactgattatacatatgccaaatatcaacctactattttttggcttatcttaaaggcaggaacctttcacttcagtggaggatagctctttaaacttgttttagtttacttcccttgaatctctgctcccttcttggatagacattctctaaaagctactgcagttacatggcctctatccagtggactttccctgggaagctagagcatatcaccaagtcagtattcaggaaaagttataccttgatttatataggcttttcctctttcatggactcttcctatacaattttaaaaatttgatcgtcaccacaaccttgtcaattggttagcgcagatactagccttaatttgcaaatttagaagctgagagtcacaatgctgaagtaaatgtctaaggtttcagaccaaattcttctgattccggtgttcttgcagtgttttataagtcagtgtggaacatattacaaaatggtctgcagagaagaaactaccgcaaaccaccattcttgcattcaccctagtagaatgaactctacttcctttagtcctctaagaaattagtatggaattttaaatttctactagattcccctcacaaggtatctcctatatgagaatcagaatattttcatgtccctgggatgctaatgtttaaggtggacctggcaatgatgtgagagtttagcacagaaattagtagtcaggagacgaccttcagcccaggttttaacaaatatttgctctaagactctgggctagtagcttagcctttcttggtgttatctataaatggagagcactttttaggatcacgtgattggaccaggcccctttgaaagttcaacaaaattaagcaaccttacataaatttttatttttatgaattattagttctttcagctatctcttcttgccaatctttaaaaaattatcttctattacatttatgctaacttgagattaatacatcttttcaagacctatctgcgtcttcgtacagtgtatgatgtccttctgtgtgctcctctctcagagactaagttggatcactggccatttaaaattgatcatagtgtagaaggtggctggcaagatggcagaataggaacagctctggtctgcagctcccagcgagatcaatgcagaagtgcagaaggtgggtgatttctgcatttccaactgaggtacaaggctcatctcactgggaacggttagacagtgggtgcagcccaccgagggtgagccgaagcagggtggggcaggcatcgccttgcccgggaagggcaagggggtcagggaactccctcccctagccaaggaaagccatgggggactgtgccatgaggaacagtgcattccagcccagatactatgcttttcccaaggtcttcacaacccacataccaggacattcccttgggtgcctacaccaccagcgccctgcgtttcaagcacaaaactgggcagccgtttgggcagacaccgagctagctgcagcaattttttttcataccccagtggctcctggaatgccagtgagacagaaccattcactcccctggaaaggaggctgaagccagggagcccagtggtctagctcagcagatcccacccccacagagcccagcaagctaagacccactggcttgaaattcttgctgccagcacagcagcctgaagtcggcctgcagcactagaacttagtgggagaagggacgtctgccattactgaggcttgagtaggtggttttcccctcacagtgtaaacaaagccatcaggaagtttgaactgggcagagcccactgcagcttgacaaagctgctgtagccagactgcttctctagattcctcctctctgggcagggcatctctaaaagaaaggcagcaaccccagtcatgggcttatatataaaacttctatctccctagtacagagcaccttgggggaaggggcagccatgggggcagcttcagcagacttaaatattcctgcctgctggctctgaagagagcagtggatctcccagcacagtgcttgagctctgctaagggacagactgcctcctcaagtgggtccctgacccccatacctcctgactgggagacacctcccagcaggggtcgacagacacatcatacaggagagctccagctggcatctggcaggtgcccctctgggatgaagcttccagaggaaggaacagacagcaatctttgctgttctgcatcctccactggtgatacccaggtaaacaggatctggagtggacctccagcaaactccagcagatctgtagcagaaggacctgactgttagaagaaaaattaacaagcaggaatagcatcaacatcaacaaaaaggatgtccacacaaaaaccccatccaaaggtcaccaacatcaaagaccaaagatagataaatccacgaagatgaggaaaaaccagtgcaaaaaggctgaacattccaaaaccagaatgcctcttctcttccaaaggatcacagctcctcgccagcaagggaacaaaactggatggagaatgagtttgacaaattgacagaagtaggcttcagaaggtgggtaatatcaaactcctccaagctaaaggaggatgttctaacgcaatgcaaggaagctaagaaccttgaaaaaaggttagacgaattgctaactagtataaccagtttaaagcagaacataaatgacctgatggagctggaaaacacagcacaagaacttcgggaagcatgcacaagtatcagtagctgaattgatcaagtggaagaaaggatatcagagattgaagatcaacttaatgaaataaagcgagaagacaagattagagaaaaaagaatgaaaaggaatgaacaaagcctccaagaaacatgggactatgagaaaagaccaaatctatatttgattggtgtacttgaaagtgatggggagaatggaaccaagttggaaaacactcttcaggatattatccaggagaacttccccaacctagcaagacaggccaacattcaaattcaggaaatacagagaacacctcaaagatactccttgagaaaagcaaccccaagacacataatcgtcagattcaccaaggttgaaatgaaggaaaaaatgttaagcgcagccagagaaaaaggtcgggttacccacaaagggaagccaatcagactaacagcgaatctctctgcagaaaccccagggatgtggatgaagctggaaaccatcattctcagcaaactaacacaagaacagaaaaccaaacaccacctgttctcataagtgggagctgaataatgagaatacatggacacaggtgggggtgggcatcacataccggggcctgttggggggtggggcctgggggagggatagcattaggagaaatacctaatgtagatgacgggttgatgggtgcagcaaaccaccatggcatgtgtatacctatgtaacaaacctgcacattctgcacatgtgtcccaaaacttaaagtataataataataataaatactcagagaagttccaaaataggatttatatatagaatttatatatttgtatataggatttggaactatatatatgtatataaacatgaaaatgtatgtttatatatgtctataaagagtgaaacaattaaacttcttctattaaaaatattgatcatagtataataatattatgtactttcattttcaacctgagagtcattgaactataaacaccatgtcaagtatcttcaacccatggaattggatttttagattattttcctgcttgtatatttatacatttttttctgtgctcctatttttaaccttagagtctctgtcctttgctgtatgtgctatacctttgaattaagaaacatctgtgaatttaattaatgtgctgttgattcccacccttttccaagtcattaatgaggaggttaaaacagaacagactagggtttatttcacgtcccaagagacttttttggaaaaaccttccccatagcgtttttatttatttgcattggtttagagaatttatgctgtatggaagtgaatgtatttcagaaatacaatatatgaaatgttaaaggaatattttgatcatatgtttttagttatgtctcataattttcatacttctctgatagagattgtactctgtggttgagtagaatatatattttggaggaaatcaatgagttggcacatgaagggggtagatcttgcagtcagtggtattaccctcaacattctacaaacacatgaactctttggaatgcagaatagcctgagatttcttccatgaagatgtgggaggcaggaagatactctgatcataagcatatacaataatcaatgaaccattaaagtttatgctattagaattgctgttagctgagcagatactttataaaaccagaaatttatatttatggttcttatatttatttttaataatacatacacaatacacatataagtgttgatcaaaattgacaatgaggagagcaattagccaatataccaactatcttcttagttttcaagagcaaaatgaagtactgcagaaaagataggatgtaaagtgcagatttataaattgctccctttcaaaaacacaactgaaagttttgaatgccaaaaaaaaaattagcttcaaaatcagagaatgatttttttcttccatttatattgcttggactacctgccaaacacactataatttgcagcaaaaagaaggtaaaatccaagaaatagtttggacttccacaaacaccactgcctacacagacaacacataaaacatacttttcaagagtgctctactgcttctgcaaattaaggaatgactgggtgaggggcatggacaacaacagaaagaaggttatattccatttggaagctaccgtcctcagagcattattaatgtcatactgacattttaatgagagaatttctggagaatatatgtgaccagagctttccattaatttttttctgtcttcactctctaataattgcagagtgtattcaaataaagaatagaatttctaccttacctggaaggacaatatctagcataaagagctgtattagtttccttgggcttctatctaactccaaccttcgattccttctccacatggcctcatctctttctctctgtgtgtctctcctctgtatatccttgccaagacatttatcattgaatttagggcccacccagataatccaaacttttctcatttaagtatccttaactgaattacatttgcaaaagccctcccctactttccaaataagatcacattcccaggtttgtggacatatctattgaatgctaccattcaactgactataaaagcacaaagcagaagagtgaaaaagaatattgcaaagtcatgtttcttttttttttttttttttttttttgagatgtagtctcactctgtcaccgtggctggagtgcagtggcgtgatggctcactgcaacctccgcctcctgggttcaagtgattttcctgcctcagtctcctgagtagctgggattacagccacacaccaccacacccggctaatttttgtacttttagtagagatggggtttcaccatattggccaggctggtctcgaactcctgacctcataatccgcccaccttggcctcccacagtgctgggattacagccatgagccaccacgcccggccttccaaagccatttttacaactaaaggccatcaacagcagggaactgccaggacaagatgtgtagtcacatgaaattaatagaatccacacttttcaaaataaactttttattgaaattgggagtttgtcccaaggtgggaaatcaaatttattagaaaccttaattaggtggtaaatgctcccaattcagtaggttaaacataactttcagatagaattttaacaaacgtagagacaaagaatatgcagatataaaattccataactgtggctgctggtggtcttagtttcttctttatctccttcaggttactggataggtgaaaccttaacagccagctctccaactcaagtttgaaagagaacagaaaatttatactcaggtgtaacagattatagatataaatggaatatacctactctttcgcaagtaaataccagttgctgattaatttgcacactttcagagagatgtaagtagagacaaagtcaccccaacattgaatctattaaaaaatactgcaacacaaagaaggaaagcaacaccagcctgcaaaagaaaagcatagagctcacattaggaaaacatatacttctagacatttttgaaaatgagattcattgaattcaacaaatactgagcttcctatttgtgataagcatgtaccagtgactgggatgacagcaatgaaagaagaaaaacagataaatacaaattgggaagttagaaaataaaaatagaataagtttggcttagaaaagtgctaagaagagaaataaaacagaataagtggagagtaagaggtgcaattttgcatggggcagttaagatagattgcaagtggtttacactctcaaatggattatatgaaacaagaaataaaactctaaatgaagtgaaaaaggagttaagagaactaagaaaaaaactaaaagggcaaaacatataaaattaatcattcaaaaaataggcacaggaaactgctaaatcaatgctaccaatagaaaaatacggacagtaataaagacgtttaaagaataagccagaatagagagaaaaatgacaatgctaaaaataaaatgaatataaacattggcatgtgcagtgtggcaccagcaggtggacactaattggtcttaaagtgttgattcttaagtgtcttctattgtactgctacaaaagaataccatagactgatgtcttaaaaaacaaacttctatttctagagactagcagtctgagataagggtgccagaagagttgggttctttgtgaggggcctttgccaacttatgtcctctatatcctcacatggtcttccttgttgcctgtgtggagagagaagaaagaaatcttgcgcctcttcctctttttataagaggactaattctgtttatgagagctccaccctcctggcctaattgccttccaaaagctccccttccaaataccttcatattggagattaggttccaacatatgaaatttgggggacacaaacattcagttcataacactaagatttcttccgcttttaatgtttgaggcaacaaggacttgaaccagtgtgatggttagggaaatggtaagaccaagttggaacttttgtgttaaatgctatccttcaagacttcttgcacatgtcaatttatatatacaacctttttgctctgcttcatctctcactgaagtaaggctcttgaacaatattgaaaagatttttttttaaatgggacactacttgagggcaagattggagtctcctatatttttatcctctggacagagcatgaatcagaataagtgttagagtaagtgctgaaataagaactataaaatatgtcaaatactggatgaaaaaaataatactttgatttttatttcaaagcacactctcatacacagctgcactttaaatgaaggatagtaaacttaactaaatgcctcacctttgcagtaagaaaactgcctttgaatccccaataccttttactagatgcctaattcaaggaaaattaatttgcctattagtccttcagttttattatctgtaaattggtcttttgtgaggaacctggcatataataaacaccccataaacaataatcctgacagtggctatctactatttttatcttaaagctgggaaaacagatattcagagagttttggtgacctgttaatgtcactgagtaggtaggtaactcaggaaaggctagaatccagatgcttagatttctagtttagttttatgtacacattatggggggaggcaaggaagaagaaggaattgatagtgaccataatattgtatatgtatttgaatgatagaatcttgatttttaaatgtcatagaggaatcttaacataaagactttttagggaaacaaagtatgggatggataatgagtttgatttttggaaagttgaattggaaattttgccactagataataatagagatggccatatcatgctcaatggcttttcattgcatgagcaataaaatatgaagccctttcaatggcctagaaaatgtaggttaactgcatcatatctgtgtatattgtgttatatcttccttctttgatcgcctttctccgttttctgcacacctctttcttgacattttgggattatgccgggcctgtttttataatctgtaacaggctgctctatcttcctaaattgcttttcttcccaatgtttgcataaatattctttcccccagcttcacttcatgaagattattttcaaagaccatctcctcagaaaggtctttcattataaccgtctctataatgcccatcacctttactatctctcctcttatcttgctttgtttttcttcaaagcagttgtcacaaactgaacataagttactctgtgtgtgtgcatgtgtgcatgtgtgtgtgcacgtgtgcagaggcatgtgtgtctgtttcactagactgtaaactctatgaggataggggctttgccttgccatcactatatctccatacctttagtacctgacatttactaagtgctcaataactgtgtgttgaataaataaatatgtaaataaatacgtgaatggcacaagcatttaagactaatatcctccaccaagatgtagtgttggtgactgagatgccttattcatgccttacatctttgcttttcagttgcttgcttaactcatacagaaaaagtataggccttctctgttcacattgtttttcacaattcttaaaatatggactccccagtagggaggaagcacagtagcacaacttatcatgcacacacacacacacaaaatctaaccacccaaatcccatttcatttcctttttgtgcatccttcttcagttaaattttttaaacagtcaacacattactatattaaaaacaaatacaaaatcttttaagtaaagactgggttaaaaatctgtttgtgaatgtgaggttgcttattatgctttctctgctctctttaaataggactcagtcagctcaattagtttatcaaacactggaaaatccctaaggtgtctaaatataagcagcatcatttcctgaatatttaattcctaaaaacaggacgatagtcatagtattcacattctctaatctactgtgttctggaaatcttgtaatcaatgatatagcaagagaaaagtacccttgattcccagacatgtttcaacatttacaaaatgtattgcttagaatttcatttttcttctttcacttcaggctggcatattttcagaatctagatatttgttttaagaaaaaacttttctgaatactccaacaaagcaggaatagcatctgtcttattcagaatttatcagaaggcctggcataaaagaggatttaatgtatatctgaggagtaaaggagtaaataaatgtatactacatgaaagaataaaagcaattcagcttaatattaaaaaatatttttaacattttgatttttctaattgtctattgcttttctattccttttttataattacacatatttaattttattgtacctgagtttttattttaccccatatcaaattcttttagaagcaagattatacctcaatcaaattgatatggtttggctgtgtctccacccaaatctcatcttgaattcccgtctgctgtgggagggactgtgtggaaggttattgaatcatgggggtggatctttcccacactgttcttgtgatggtgaataagtcttatgagatctgatggttttataagggggagtttccccgcacaagttctcttcttttgcctgctgccatccacataagatgtaacttgcttctccttgccttccgccatgattgtgaggctgaggtcctgtggaagtgtaagtccattaaaactttttcctgtataaattacccagtcttgggtatatctttattagcagcatgaaaacagactgatacagtaaacattaaccttttctgccttcacccatatttttatgttaccaattatttgggttttaatttagtaccttgaactcttaatactttaacaggaccaagtttaaaattagcctactggataccttttatctttttaaatccaactattgacatatatgtaaattttattctgtaacaagtcttcattgttctttgtgttattaaaataattataaataaatggtttaatgggaacattagtgtatcaattaatactttgagttgttcaaaggaatgctttcaaatcccttacttgtgggatggagaaggccatatttctccctgaattttattattatttctgcataaactactgagggaatgtttgactctgaaactcagatcaggagtgattggtattcatttgtattaaatattttagaaagtgacaataatttctgacttccaaaaagaatttccccaggcatgtaaaaagcaattaaaaaacccacatagttgaatgatctaacacgacttaaaattcataataaaagtttttagggaaaatacataaattttaacataatatatatttgagaataaattgtaaacactggcttttaaaagactccaaattgaaccttctttagtgtctatgcttaagtgatgtgtgcttatatttttaggacctcatttacctgaaccactcctcacccatgatcaatagtggctatggtggaggtaatcctaccctgttgaccatacttgatatttctagaagtgacagcaaatacaaatgtggccagttagttccccaggaatttaggccccaaggacatctgtgttttctaccatgatgtgcacagagagagaaaaagatacagagaagcagtgaatagagaggtagagatgttgagacagttatgctccctggttctcatttctgtgtattagatatctattgtaatgtaagaaattactccagaatgcagcaacttaatacagtaacacttacaattttatagtgtttgtggatccaaaatccatatagaacttaactacctgtctcccagggtctctcacaaagctgcaatcaagggattggctggggttgtagtcatctcaaaacttgatttgcagaatgtccacttgtagggtcactcacatatagctgttgtcaggcttaaggtcttctcttaaggttgttggtctgaagcatcatttccgtgccacacggacttctctacagggctacttgctttcttcagagctacttttccacgagctagggcttggagggagagaggaagagtgagagagagtgaataaagcaaaagtcacaagctttttgtaacctaatttgggaatttatatcccctcacttttgctgtattttattcattagaaaagagttactagggccagcccacactcatgaagaagggattgcccaagggcatgaataccaggagataaagatcattaagtgctattctagtggctgctactatagcctggcctctagccaccaatgattcatgaccctatcatattcaaaggacactcagcccctcctaaggtcctcaaaagtctcatcctattacaacatcagctcaaagcccagaagctctttgtataaatcaggtgcaggtgcagatgaagattcttagatacggtttcttaagtatagctccttagagttcctatcatctgtaaatctttagatcaacaaaactaaagagaaaaattgtctactcatacgcacgccaaaattatggctatttgtaacacggtagctggcttcccctgagcaaaaactgaaagagaggtgttaggggagaaactgaacaaggcaaatgtcacagtatttttgtaacctaataattgggagtgacattttttcacttttgtcatattttattcattagaaatgagtcactaggtcagcctgcacccaagagaagagaatttaaaagggcacaaatcctgagaaacaggcatcatttggggccatttgcaggctgcctgccactctctcataggagtctggctgcatttgtgtctggattatatcaagacccttctggcttgtacaaaaaaattccactacgtttttaaggcagctgaagttgatgtctgaagcttgaaaacaaaaagttatataagttcaatatctgttcttaaactagactcatcttttctttgcattaaaaaatagtcaacctttcttggagcatcttatatgtgttaaaaatttctcattatcaggaagattctctcctattttttcacagtcctaaattaccttatttcttttaaagtccctggatatattcagactactttagttgacatctctgcagtatttgacactgtcagctacatcttctttcttgaaacactcaatccctctggcttctgtgaaatcacactctcctggattaactcttatctgtttctttcatgggaacttctgatctctcttcaattttcatgtacatcaggatttcattctttttcttcttctttcactgtatacagtccttgaatgaatgcaccaaacagggtttcaatgacaatcaaagttgatgacctaaatctaaatctccttcctagagttatatccacctgttcaacacctccatttcatatttcacaagtacttacaacttagcttcttatcccaatttctttccaacctcaatatgctttctttatgcttcctcatttgctcaagctggaaactttgactttgttcttgattctgtctttcttactcacatcccactcatctaatcctgttctctgctcttgttaattttcccttagtatctctctttctgggccaattttctccaccaataccatacttctaaaattttatttttgtaataaatcaatatcatctttcttgtaatgtagaatatacaaaagtttaagaatgtgggatttgaggccaggcacagtggctcacccctgtaatcccagcactttgggaggcctaagtgggcagatcacttgaagtcaggagtttgagaccagcctggtcaatatggtgaaagcccatctcaagtaaaaatacaaaaattagctgggcatggtggtatgttcctgcaatcccagctactcaggaggctgaagcaggataatagcttgaaccagggaggtgaagttgcaatgagccgagattgccccagtacactccagcctgggtgacagagcaagactctgtcttaagaaaaaaaaaaaaaaaaagaatgtgggatttggagtaagactacctagttttgaatcctggatctactacttacctacttactagctgtgtgatcttgagcttgagcaggttgcttaaactgtctatgattgagcttcttcctttgtaaaatgtataaaataatgttatttacttcactgagttttccacaagattaaatgagataatgcaagtaaaacatttagaatagggccaagctcatagtatatatgaaataagcattggttattactaatattagctaatgactgcaataacctactaagtagaattcctttttcactcttagtcatcaatataaaccattctaacactttggtaaagtacaaatgtaatcatgtccttctttactcttattaaaacttgtaaatggggccaggagtggtgagtcatgcctgtaatcctaacactttgggaggttgaggcgggtggatcaactgaggtctggagtttgagaccaacctggccaacagggtaaaaccccgtctctactaaaaatacaaaattagccagacatggtggcacatgcctgtaatcctagctactcgggaggctgaggcaggagaatggcttgaacccaggaggcagaggttgcagtgagccgagattgcaccattgcactccaccctgggcaacaagagtgaaactccatctcaaaaataaataaataaaacctttaaatgattatcaattgctgtcagatccaaaatacttaaagtaccttacaaggaccctcacgatcttgaataattactatgtgttaggtaaataccaggcgtggtgaattcagtgacgctgtcctgcccacattacatgtgtgctggtcatggacccatctatgttgtctgactttcagttctccaaactgatcacactttgtctcagttctaggcctttaaaaatactgctcccctacctctactgccattcttcctcttatctgatggtgtaatttctctaatgccctggttttgttatcaaacttgcttttttctaggagagtctttcctgaccactagtttactctcactcactgggtagtacattggaattagccctactacaattttctatttacttttcagttttactaatagactgcaagcttcttgaggaccaaggttgagtttgctaatgagttttcatttagcattccatctccagtatgtacctatcatcatgccccatacggagtgtgccttcaacacatgactgtttaatacatctctaggcatatacttaatagtcatgtattgaagtgtgccttccatacatgactgttaaatacatttctgaacaatttgggggtgttgggcagggatctagatatacaagagactgtgaaccaatctgggaaaaaaatttgccctagagtgaagttacagatgctggtttcaaaggcatctgactagcaagggagagaagggaccactttgaatacagaatagagttagtcttttaaaatctcatccggatcagtaccctagagtcatctctgttttctttaacaagaaagcaaaagataccagagagagagagggagagaaagcaaatgaaaggtattactaaaatttctgagggacccgaaacaccaaggcaaaacagaattggtgattgaagtttagttagcaatcaccactttagcagggacatagaccatgctgttcttgcagacatcagctccctggatatctggcatcagaagcctcagaatagactccaaaagataccaacagcattgagaatgcccctggtgtacactagctatggaaataatctttcttatgttggcagatacagaagacatctgtgcagcaagctgagccagaaaggaagagactagtaattgttgcagaaaaatcaagaagactaatcttgcatctcccttgaaatatccaagaggtatttctggaaatgcctggagggaatttgtgtatgaggatcaagaagatgaaaagcaggtagaaggagaggaaatcaattgttatttttgactattaacaagactctaattttatcttcaatgtgctaagatctatgtcttcatacacataaatatataatttcagctcttttatacattttttttgactcttaggtggattttcttaagattagctaaaacaagcaaaacatcttgttagctaaagcgtcttgtttagattacatgtgtatatatgttgtttgaatgctttgtgttagtcagtctttactaggttatgctgcaataacaaacaatcaaaaatctcttcagcttacaggaaaagaaaaggggacttatttctaatttgtgtgtctgttgtgggttatatttaactttattttacagtttgttttcattctagaatccaggctgactgataagccccttacatagacacactgtccttgagaaaaagcgaaaagaaaagatgaaaagcctagcagtgacatctaaagcttctgcagaaaacttaacttcatattttactggaatacttgacacctgtagggaggaacactgcaaatcacatggcacaggtaggaatggttaatcttctcactgcacttgcagagaataatcgagaatattaatttagtaatttgtatgtttccttaattataaattaatgtgttctatttcccaagattaatttgtcctttgtatacatcttagtagatgttgtgtactctagctctattgttgctgttcagttttctattcagcatggctattttactacctcattttaatagttgattaggtaatgccaaaatagtcaaattcttataaattgtgtctccagtttttcttgacactttgacagctacatggccaaaactattttcaattgatttcctatatttgtttttatttaaatgttttttattagttacctattcttccttttgcctgttaattctaatagataattttgaatattgtgcaagaaaaataaattgaaaccattaaaaattaattttaacttttctaatttttacaattaatttatatgcttgagggaaaatatattgacattgtatgcattttaaatacaaatgcagtttagtttctaatgcttttttaaaaagatattggtagaatgcattttttatgtatgtatggatggatggatggatggatttatttatttattttataatttttgtttttgtttatttcttctaaaaaaaaaacacaggatacatgtgcagagcttgcaggtttttacatgggtatacatgtaccatggtggtttgctgtacctgttgttccctaagttccctcctcttgccccctaaccccacttatgagtgagaacatgtagtgtttggttgtctattcctgtgttagtttgctgaggatggtggttcccagcttcatccatgtccctgcaaaggacacgatctcattcatttttatggctgcatagtactccatggtgtatatgtactacattttctttacccagtctatcattgatggacatttgggttggttccatgtatttgttattatagtgttacaataaacatacatatgcatatatctttataataaaatgatttatattcctttgggtatatacccagtaatgggatttctgggtcaaatggtatttctggttctagatccttgaggaattgccatactgtcttccacaattgttgaactaatttaaattcccaccaatagcgtaaaagcattcctatttctccacatcctcaccagcatctattgtttcttgactttttaaatgattgccattctgactggtgcgggatggtattttgttatggttttgatttgcatttctctgatgaacagtgatattgagcttttcttcatatgcttgttggacccataaatttatttttttgagaagtgtctgttcatatcctttgcccactttttgatggggttgtttgtttttttcttgtaaattttttgaagttccttgtaaattttggatattagacctttgtcagatgggtagattgcaaatttttttcctattctgtaggttgcctgttcactctgatgatagtttattttgctgtgcagaagctccttaattagatctcatttgtcaattttggccttttgttgcaattgcttttggtgttcttgtcatgaagaagtctttgcccatgcctatgtcctgaatggtattgcctaggttttcttctagggttttaatggtttttggttttaaatttaagtctttaaatccatcttgagttaatttctttatgagatttaaggaatgggtgcagtttcagttttctgcatatggttagccagttttccaggcaccatttattaaataggagatcctttctctgttgcttgtttttgtcaagtttgtcaaagatcagatggttttagatgtgtggtgttacttctgaggtctctgttctgttccattggtctatatgtctgttttggtaccagtaccatgctgttttggttactgtagccttgtagtgtagtttgaagtcaggtagtgtgatggctccagctttgttcttttccttagggttgccttggctatatgggatcttctttgattccatgtcaaatttagagtatttttttctaattctgtgaagaatatcaatggtagtttgatgggaataacattgaatctataaattactttgagcagtgtggccattttcatgatattgattctttctatccatgaggatggaatgtttttccatttgtttgtgtcctctcttatttccttgagcagtggtttgtagttctccttgaagaggtccttcacatcactttttagacgtattcctgggtattttattctctttgtagcaattgtgaatgggagttcattcatgattcggctctctgcttgtcttttgttggtgtaaaggaatgcttgtgatttatgcacattgattttatatgctaagactttgctgaagttgcttatcagtttaaagagtttttgggctgagatgatggggttttctaaatataaatcatgtcatctgcagacagagacaatttgacttcctctcttcctatttgaatatcctttatttctttctcttgcctgattgccccggctagaacttccaatactacgttgaaaaggagtggtgagagagggcatcattgtcttggaccagttttcaaagtgaatgcttccagcttttgtccattcaatatgatattggttgtgggtttgtcataaacagctctttttattttgagatatgtttcatcaatacttagtttattgagagtttttaacatgaagggatgttgaattttattggaggccttttctgtgtctattgagataataatgtggtttttgtctttggttatgtttatgtgatggattacatttattgatttgcatatgttgaactagccttgcatcccaggatgagcccaactcgatcacggtggataagttttttgatatgctgctggattcggtttgccagtatttcattgacgatttttgcatcgatgttcgtcagggatattggactgaagttttctttttttattgtgtctcttcccagttttgatattaggatgatgctggcttcataaaatgagttagggagaagtccctccttttcaattgtttggaatagtttcagaaggaatggtaccagctcctcctttgtacttctggtagaatttggctgtgaatctgtctggtcctgggtttttttttttttttttttttagtcttagaacttctttcttttttatgagactattaggtatgtgttaaatacttacatattctctgatacctttttgatcaccagcactaactttcatttactcatgctttcactcagtatatttccattatcaacagttcaggatttttaaaattattgttttttcacatattggacaatttcattttcttaatttaatttataaaaaagaatactttttacttccctaaaagtaaggcatatataacacttactgatgttctggagaatcaaaatgatcaacaatttaatatatccatgaaagtctgacctactctgtgaagtggagatttctcagtgtttttatttacatttccatgcctctgatgcaaacaatttcaccgacatttataattttctttgcatatgtattgagtagcctactttatttaagtaagaaataactcccatcaaaagggttatcctttcctggcgttggggctcacacctgtaatcctgccactttgggaagccaaggcaggtggatccaggagttcaagaccagcctggccaacatggtgaaaccccgtctctactaaaaatagaaaaatttgctgggtatggtggtgggtgcctataatcccagctactcaggaggctgaggcaggagaatcacttaaacttgggaggcagaggttgcagtgagctgaaatagcaccactacactccaacctgggtgacagagcaagactccatctcaaaaaaaaaaaaaaaaaaaaaaaaaaaaaagaagaaaaaagaaaaagaaaaaaaagggcttatccttaaacaataaggacatttattggctcatataaatgaaattcctcaataggactggttgtaaggtagactcaatcaatctgaaatatttggatatctttcccttttcttgcttttgctttatcttcatactggtggcaagaagcacaagcatcacatccatacatgataacaactggaagatggaagatattgtcccttttggaagccctttcaggaagaattttttaaagttctggaaagaaactactcagaggctctggaaaaatccttgtggtgtttcattggcacaaattagattacatgtcattccttaaccaatcattggtaaggggaatgtgattatccttaatacaatcaggcaccatttggagatggggactggaggcaacagtccttttggtacataatttcaaaacaaacaaacaaaagaggataacagaacaaaattagggtccacatagtaaataaagggaaagggttaaatgaatgcttagcagcctacaataacaacgttcaatttagtgtgcactgaatatgtttgtttgttgcctttatcattatattgagaacataataaaaaggcatctatttttgttagagattgactaacagagagaaagactagtttttctataaatgtttaagtcggccgagtgcggtgactcacacctgtaatcccagcactttggaaggcctaggagggtggatcacctgaggtcaggagttcgagaccagtctggccaacatggtgaaacccccatctctactaaagataaaaaattagccaggtgtggtggcacgtgcctgtaatctcagctactcaggaggctgaggcaacagaattgctttgacctgtgaggcagaggttgcagtgagccgagattgtgccactgcaccccagcctgggagacagagtgagactccatctcaaaaaataaataaataaaaatgtttaagtcatttcctctgattccttgaaggattttgctcttggtacacactctgtctcttacatggctcctgccctaattcatcgtaatttcaatatctacatagatggtcgtataatgatgtggctgcttagttctgtgaactttctccaatgatcttgttttatactttttcttggtcatcttttctaatgtcatagttcagaccttatcattataaaaaaaatcacaccctgttcttttcttttttttattattatactttaagttctagagtacatgtgcacaatgtacaggtttgttacatatgcgcaccctgttcttaatcttaatttcaaacatcatctttttctctcctatcaaaatctatacatttttttggtccatctcattcccttttgtattctaaaatcagaaaacatagtacctagcatggtctcaaatccattgattctatccatttatactttctcttatctgtcttatatctttgctcttctttttagtctgctcaaattccctcatcaattcttatggtcactctattgcataacagctgcaacttttgtgtttctttctcactttcttatacctgttttagccaagtacagtcctaattaatcctaaccaaattctaccctcgctgaatgtctgaatccacacaactgatcaaagctgtatgaatctgtagccaactatcttactttaaattcatgattactaattttacctgtgcctttaatattgcctggccatgagattacatgtatttctagtttgctaaacgttttactctccttgataattatttaatatttttacttttcttctgaaacctccaacctccatccctatactcactcttagctcatgattttgctttctattttactgagaattaagaagctattagaaaagaaatattactggaacccaccaacaaatctactcatgtggacaactgggtccatatgctgaaccttcttttctggttactatggatggcctgtctgctcctagtaaaggtcaaccttttcactggtgtactcactcaagctctcttgccctttcaagaccattattccaggccaggcgcagtggctcacacctgtaatcccagcactttgggaggtggaggtgggcagatcatgaggtcaggagttcgggaccattctgatcaacatggtgaaaccccatctttactaaaaatacaaaaaaaaaaaaattgccaggcgtggtggtgcgcacctgtaatctcagctactcaggagactgaggcaggagaatcgcttgaactcgggagacggaggttgcagtgatcggagatcgcaccattgcaccccagcctgggtgacagagcgagactccatctcaaaaacaacaacgacaacaacaacaacaacaaaaactctcttattttctctgtatcttcttattttctcctcataagcgtacaaaatttactatttttattaacttaaaaaatctcagactgatcctatgtatgctactgccttctatcccttttcttcttcactttgcagcaaaactcctcaaaagtattgtctatgctcattacctccagcttctctcttctcatcttctcttgaaattatttcagtcagacctttgctcctccccactgaaattgttcttgtcagtataatcatgacagtctattcttattgtcaaattcaaaggttaattcacattcttcctctgatttggcctttcagcattatttggcacagttggtaactaccttatcttttcaacattttatttccttggctttcacatgatcctggtttcttcttactgacctcttcttcctttttacatttgtcagtcctcccttatttcccaaacctcccaaatttggaatgcctcagagctcaggctcctaaatattctttattcaattaattctcaaaatcccaagagtacatcttcaattcaacctccctgaattctagaactatgtagcaaactgcccactcagcatctacatgtgagtaggatcagggttaggaaataaataaatgacatgtccctacgaaactggagtagaactaaaaaaatgtaaagatcttaatatacttggtgtgatggtacattatctggaaactgaagaaatagctgtattttaaaaccagggttggtattgggcagaagtagaaaacctgtactgttaagggatgaatctgacatctggaccttagagaattttctgagatactttaaggagggcatctagatacctatctgattaaaacatcactcttttttttttttttttttttgagacggagtcttgctctgtcacccaggctggagggcagtggcgcgatctcggctcactgcaagctccgcctcgcgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaacatcactcttaatagagcctctagtgcctattcagcatggctaatggtgtggggagcatcgattgaggagcagagctggtctttggaaagaaactgaaagtcagaaggatgctgtggaaaagcctttggaaaaatgcattgttggatattaaatgttttacctggagagtcacacatacccagtgtctgtgagctgattagaatcgatcaaagaaagtccttcatgaaggagctaactgtacatttctgtttaaaccaaagctgacatcattcttaggaaattggaatgtgtcaagtgaaaaaagtgtgtattgcatatatgcttgagctaattaaaagacccaattggctttattagctgtaacaggtctgctattgaaaaccttattagagccaatctttgggctcttggttgagagcttgtattacccgggaactagagacttggcagggatgggacagggaaaaattcaatgccatagacttgagaggtaaatattgtattgtgtttagatcacatcattggaatgttagtggggtgcaaagcctcagggatatagatgcaacagagattaatagaaagtttttggagactggtactaagaattatgtacattttcaaaaaccacaaaatgccttcctttctacagcagaatgtctgacatcagtcaaaaagttactcaataacacaagtagatgctgagacgtatatgtcaactttgtaaacacacatcattggaagtaccttagtatatgtgtcaaaacttgagggacttttgcattgaagtaccgtggagtgcagtatgaaaaatcaccatcagttagggcacattgccggaggagctatttacaataaagaaaactgcaggatccaggaaaggccagaaggttcctccacttctcactgctagtaaaataaattactgaagaagaaatgaaagagacagcattcccaaataaacaaagatgggatagttgtgttgtactgagactgaaggcaacaattcagatttagggagctgacatggataccatcatgattacgctccctaaatataatcacacacaagcagagtgtcaggaaatgggagtaaccagatcatccacctctggctgaaatgttgcccagaagataccaggtggtctcttcagagactatacgagtcacctggcttccagttagcaaaactggctaaatgttagcccaaatagggcagttgtgtttatccacctaggctttgaactcttagcacctagggatctcaagttgaatttggaggtagattaagagagaacatataaaggagttcctaggattaggtaaagtagaaaagagcagggttgaaacaagaatggagatcttagggaccatacagccataaagataactatgtctcgatagttgagaggagaatgttggaaaatgagaaatgggttggagtaatgagcaattttagtaccatgacagaaaaaaacccttaataaaaacctctctttgtaggatatagaattgctggagtaggttgctgaaatgggcggtatatatacacccttggacccttgccctgagaggagaggaatgacagccaagaactcaggctgctgaagtggcttactttcctggctccctatgatgcttcctgggcaagaaccactagagacagaagctgacactcaggaagcagcaatgggaatattttgactaggttgtgagatgtgtccaggaggggagaaggaaacctttcgtgtatataggtaactgggtagctcaggagacagtttgaaacgcagttacagatgcccggaaagtcagaagagtgggatacacctaggaatgacaggtaaatgctctacattgttatcttccagataatagaggcattctctagaaggaatactacaagtcatgttttctttttcttttttcaaagaaatgtgtaacagtacattgaaacatttatcttttcagcagcagacacagaaattcctttgagaaaagtgatgtagttttctcagcctttggaggaaggcaggggaaggaggagagaggcagagtccctgctgtagcgggaagggtcgagtgggagatgtgatctggtgactgcagccaggaggaaatgctgggcatccaaggcaggccttctgatgatcacatgttacccactgcaaagtaacccatcactcattccaacaatattcattagagctataggctttgtgtgtagctttctccagaaagctgttattggagctagtttggtggtcaaatttgagttcagatagatacaggtggattatacagaagtggtaaatgtctaacagctgagttatatatcattttcattgatggataaaatttgactttatctcaaaagcatttttaaaaattcatgtagttctgtatccagggtatcttgagaaatgtatctgaaaacttggtgccaaaaaaaaatctcataaaagtgtgcaaaatctgttctgtatagatcagtgataagtgaaagataagtataaatgagagataaatcaaaagtatcagacattcagtgacttaataattagcaattaatttgataacttcaatggaagaaaaatttagcaattaacactctcatatttatataaaaagtaataaactaaatcccatatttttaatgctaggaaatatattagtgcacacataatttagagtacattctcacttcttaggccaaatattacttcatcagagcaccaaaaaaagattactgatcctgtctttatttaaaatgttgacattttgcttatcaatttgatattttctcaatactaattttatgttaatttatatttttttaaatattgcatttaatattatttaccttggctactgaattttttggaaccttcttaaattttgtgtctaagacaattgtcacagcctcttcatcatctttgatgctctgggtggcagcaacattatctatatgggtgctgagataagcagaaattgcaaaaagtctgcagcattggcacctgtagttggaggaactgcttaagatattctgaatatttccctaattatttgagataagctgcacttttgatgtgagtagttctaatgaaagttagcaccctctaaggcaagtcctgatgcatatctggaaaaaaagaaacttttaaattattgctagattacacatttacttgaaagagtactttgagattcatttaacaagtttagaaagttaactcctgctctgaacatggtaaaagagatgtgtaaccaatgcagaagagacacgatagacaggtatggaataaaaaactcctactaaagtgagacagatgctaagggcttcagttttgcataggaggatacaagtaaaaggcccttgggaatgtatgccttttccctttgaactctgttactcttttcatctttaagaagtaagcttctttgaactctaccattttaacccaaccaatatatttttttctattttaactctattatgtttttatacccttccattttcctatacagctccatgtagacccaggcccatctaattcttgagtcaatcacagaagcatcaagaaatacaatctcagcttttccctaacccctacaacctctgtcgattggctttagatcaagtccttgtcctacacttgagaccctcagagccatctattttctgtgtagctcatgtcctatgttcctctagctgccaacaatatagtgagtcaagtgtgttagatataagcccaagatgttcacctagttacagtgtttcatattactatggttccagttataagaccataggaccgagcttttttttgactctaaagattcactctatttcaccaatttctgcctgtaggatcaaagcttcaatgtaaactaaatctctcacttcagccttatgctctgtctttgatcttgtttttatgaattttcccaggagcttgatcgtgcctcatctctccagtatagacaatttcttctacatatgctcagatttctaggaatgacattgtcatgtctttgttctttcgggtcccaataattgggctaacacctgacttcccctgttgattggttgccttggagcttgttgctaagggaataaaatagctgatgtacgtcctctcagacaagacattttcatataggtccagtgaaccaagtataaaaatacaaacgtttgttgaatgtgaagctgtcctcacagggttaacaagaattctggacagaaatatagtgataattgggcattaatcaggcggcacattgacctacttctttgtaactgcaagtcacatagcattagatactgaccatttgcatctccattgtttctacagatagaatttctggcattaaaatcacagggcttttatttaagataaatagggtctctgacattagaatcataaggctttgtttaagaattgcttaagatctttttcagatcctgaattgcagcaaaacagctgaggccagctattttgaagaccccaagagaggaatggatttgcatgaaaatatcatttcttcaactccctgtctcaagacttcaccctgcactctttgacaaatgttccccacactttgcttcattccaaaaccttggacccaaattccttggggagtttaaatttgaggtttcctcccatctcctcatttggtgatcctacggattaaacctgtttctccgctgcaacccagtttcttggtgcattgacttgctttgtgcattgggcaatggagttattacagttacacatggtgaagaaagtgattgatcttgtcccagttggcatttttcatataatattgaagacacaaataaaaaaataaactgagcaatacattttgctagtttgttttcagggaaaaaaagtgtttttgtaaattcttaatacgatttgcttgtaggatttataaacagattctagaggcaatgccaaaaaattttaaacctatttcgacatggcaccagattgctattaggatttagctatgaaagctggcagtctgaaatgacaattctcatttttaaattctaccatgttaattaacagctacataaaaatattttccatgctttccaatcgcacttcacagattcttgtgctaaatgatcaaatttaataaaagtttgtgttcatattctgaaaatgaaaaattatgttggtgtaatcatcattactagtcagaggtgatctggtcacagttaaacacctgcatttaaattaatgaccttcatttgtaaatgtatttacttagattttaaaaagaaatttttcttattattattatacttcaagttctagggtacatgtgcacaacgtgcaggtttgttacatatgtatacatgtgccatgttggtgtgctgcacccattgactcgtcatttacattagatatatctcctaatgctatccctcccccctccccccatcccacaacaggccccagtgtgtgatgttccccaccctgtgtccaagtgttttcattgttcaattcccacccatgaataagaacatatggtgtttgatttttcgtcgttgcaatagtttgctcagaatgatggtttccagattcatccatgtccctgcaaaggacatgaactcatcattttttatggctgcgtagtattccatggtgtatatgtgccacattttcttaatccagtctatcattgatggacatttgggttggttccaagtctttgctattgtgaatagtgcctcaataaacatgtgcatgtgtctttatagtagcatgatttataatcatttgggtatataccctgtaatgggatggctgggtcaaatggtatttctagttctagatccttgagcaattgccacactgtcttccacaatgtttgaactagcttacattcccaacgacagtgtaagagtgttcctatttctccacatcctctccagcacctgatttttcctgactttttaatggtcaccattctaaccagtgtgagatggtatctcattgtagttttgatttgcatttctctgatggccagtgatgatgaacattttttcatgtgtcttttgtctgcataaatgttttcttttgagaagtgtctattcatgtcctttgaccactttctgatggggttgattttttcttgtaaatttgtttgagttctttgtagattccggatattagccctttgtcagatgggtagattgtaaaaattttctcccattctgtaggttgcctgttcactctgatggtagtttcttttgctgtgcagaagctgtttagtttaattagatcccatttgtcaattttggcttttgttgccattgctttcggtgttttagtcatgaagtccttgcccatgcctatgtcctgaatggtattgcctaggttttcttctagggtttttatggttttaggtctaacatttaagtcttcaatccatcttgaattaatttttgtataaggtgtaaggaagtgatccagtttcagctttctatatatggctagccagttttcccagcagaatttattaaacagggaatccttcccccatttcttgtttttgtcaggtttgtcaaagatcagatggttgtagatgtgtggtattattactgagggctccgttctgttccattggtctatatctctgttttggtaacagtaccatgcagttttggttactgtagccttgtagtatagtttgaagtcaggtagcgtgatgcctccagctttgttcttttggcttaggattgtcttggcaatgcgggcttttttttttgttccatatgaactctaaagtagttttttccaattctgtgaagaaagtcattagtagcttgatggggatggcattgaatctataaattaccttggggagtatggccattttcatgatattgattcttcctatccatgagcatggaatgttcttccatttgtttgtgtcctcttttatttcattgagcagtgatttgtagttctccttgaagaggtccttcacatcccttgtaagttggattcctaagtattttattctctttgaagcaattgtgaatgggagttcactcatgatttggctctctgtttgttattggtgtataggaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccccttatttctttctcctgcctgattgtcctggccagaacttccaacactacgttgaataggagaggtgagagagggcatccctgtcttgtgccagttttcaaagggagttcttccagtttttgtccattcagtataatatcgactgtgggtttgtcatgaatagctcttattattttgagacatgtcccatcaatacctaatttattgagagtttttaccatgaagggctttgaattttgtcaaaggccttttctacatctattgagataatcatgtggcttttgtctttggttctgtttatatgatggattacatttattgatttgcatatgttgaaccagccttgcatcccagggatgaagccaacttcatagtggtggataagctttttgatgtgctgatggatttggtttgccagtattttattgaggatttttgcatcaatgttcatcagggatattggtctaaaattctctttttttgttgtgtctctgccagcctttggaatcaagatgatactggctttataaaatgagttagggaggattccctccttttctattgattggaatagtttcagaaggaatgataccagctcctctttgtacctcgggtagaatttggctgtgaatccatctggtcctggacttttttggttggtaggctgttaattattggctcaatttcagagcctgttattggtctgttcagggattcaacttcttcctggtttagtcttgggaggttgtatgtgtccaggaatttatccatttcttctagattttctagtttatttatgtagaggtgtttatagtattctcttatggtagtttgtatttctatgggatcagtggtgatgtcccctttatcatttcttattgcgtctatttggttcttctctcttttcttctttattagtcttgctagtggtgtatcaattttgttgatcttttcaaaaaaccaactcctgggttcattgattttttgaagggttttttgtgtctctatctccttcagttctgctctgatcttagttatttcttgccttctgctagcttttgaatgagtttgctcttgcttctctagtaaattgtgatgttaggttgtccattttagatctttcctgctttctcttgtgggcacttagtgtcataaatttccctctaaacactgctttaaatgtgtcccagagattctggtatgttgtgtccttgttctcattcgtttcaaagaatgtcttcatttctgccttcatttcattatgtacccagtagtcattcaggactatgttgttcagtttccatgtagttgaggggttttgagtgagtttcttaatcctgagttctagtttgattgcactgtggtctgagagacagtttgttataatttctgttcttttacatttgctgaggagtgctttacttccaactatgtggtcagttttggaataagcatgatgtggtgctgacaagaatgtatattctgttgatttggggtggagacttctgtagatgtctattaggtccacttggtgcagagctgagttcaattcctggatatccttgttaattttctgtctcgttgatctgtctaatcttgacagtggggtgttaaagtctcccattattattgtgtgggagtctaagtctctttgtaggtctctaaggacttgctttatgaatctgggtgctcctgtattgggtgcatatttatttaggatagttagctcttcttgttgaattgatccctttaccattatgtaatggcgttctttgtctcttttgatgtttgttggtttaaagtctgttttatctgacactaggattgcaacccctgcttttttttgttttccatttgcttggtagatcttcctccatccctttattttgagcctatgtgtgtctctgcacgtgagatgggtctcctgaatatagaacactgctgggtcttgactctttatccaatttcccagtctgtgtattttaattggagcatttagcccatttacatttaaggttaatattgttatgtgtgaatttgatcctgtcattatgatggtagctggttattttgctcattagtttatgctgttttttcctagcatcgatggtctttacaatttggcatgtttttgcagtggctggtactggttgttcctttccatgtttagtgcttccttcaggagctcttgtaaggcaggcttggtggtgacaaaatctctcagcatttgcttgtctgtaaaggattttatttctccttcatttatgaagattagtttggctggatatgaaattctgggttgaaaattcttttctttaagaattttgaatattggcacccactctcttctggcttgtagagtttctgctgagagatccgctgttagtctgatgggcttccctttgtgggtaacccaacctttctctctggctgccctgacattttttccttcatttcaactttggtgaatctgaaaaattatgtgtcttggagttgctcttctccaggagtgcctttgtggcattctctgtatttcctgaatttgaatgctggcctgccttgctaggttggggaagttcttctggataatatcctgcagagtgttttccaacttgggtccatttaccccgtcactttcaggtacaccaatcacatgtagacttggttttttcacatagtcccatatttcttggagactttgttcatttctttttactcttttttctctaaacttctcttctcacttcatgtcattcatttgatcttcaatcacagataccctttcttccacttgattgaatcagctactgaagcttgtgcatgcatcacgtagttctcatgccatgattttcagctccgtcagatcatttaaggtcttctctatgctgtttattctagttacccattcgtctaatcttttttcaaggtttttagcttctttgcaatgggtttgaacatcctcctttagctcagagaagtttattagcaatcgtcagaggccttcttctctcaactcgtcaaagtcattctccatccagctttgttccgttgctggtgagcagctgcgttcctttgcaggagaagacgtgctctgatttttagaattttcagcttttctcctctcgtttctccccatctttgtggttttatctacatttggtctttgatgatggtgacatacagatggtgttttggtgtggatgtcctttctgtttgttagttttccttctaatagtcagcaccctcagctgcaggtctgttggagtttgctggtggaccactccagaccctgtttgcctgggtatccccagcggaggctgcagaacagcaaatattgcagaacagcaaatgctgcctgatccttcctctggaagcttcatctcataggggcacccagctgtatgaggtgttagttggcccctactgggaggtgtctcccagttaggctacttggggctcagggacctacttgaggaggcagtctgtccattctcagatctcacactacatgctgggagaaccactcctctcttcaaaactgtcagacagggacgtttaagtctgcagaagtttctgctgccttttgttcagctatgccctacccccagaggtggagtctacagaggcaggcaggcctccttgagctgtggtgggctccacccagtttgagcttccaggcagctttgtttacctactcaagcctcagcaatggtggacgcccctcccccagccttgctgctgccttacagttccatctcagactgctgtgctagcaatgagagaggctctgtgggtgtgggaccctctgagccaagcatgggatataatctcctggtgtgccatttgccaagaccattggaaaaccacagtattatggtgggagtgtcctaattttccaggtactgtctgtcatggcttcccttggcttggaaagggaattccctgaccccttgggcttcccgggtgaggtgatgccccgccctgctttggctcatgctccttgggggctgcacccactgtccgacaagccccattgagatgaaccccatacctcagttggaaatgcagaaatcaccaatcttctgtgtcgctcatgctgggagttgtagactggagatcttcctatttggccatcttggaacttcccctgaaaagaaaagatttaaccagcatatttagctacacaaagaatgaatccacactttaaagccaaacaagtaatagaaataaacttgcattgatctttgagtcacccttggctcttctctttctcttatacaccatatcaaatctggattaatattttattgctgttgccacaaattactacaaaattagtagcttaaataacaacaaatttcttatcctactattctgtaggattgaagtctgacacgggtctcaccgaacttagatccataagtctagacagtatgctctaaggggcaacctatttccttgccctctttggtttctagagtctgctcactttcctgggaacatgcagcccttcctccattttcaaagtcagcagcaatgcatctttgtttggtagaaacttcttcctctgcctcattcttctgcctcatccacttctaaggacctttgtgattacattgagccctctagaattgtccagcatagtctctttattttaaggtatgctcatgtgtaaccttaattctatctgcaaccttaattcccatttgctatatacccaaacatattcatatgttctgttctgaggattagacaggaacatttgggaggcctttattctgctttccacacagcaaattgctaccaaaagcaaaaatttttactatttttttaaatacattactgtgccaccacttttcctaccacaactgctgtcactgtggttcaacatcatctcttgcctgaattattatatcaatcttataactggtgtcaacaaaaagagccaaactgtaaaatatttgaagagatttattctgagtcaaatatgagtgaccatagcctgtgacacagccctcaggaagtcctgagaacatgtgcccaaggtggtcagagtgcagcttggttttatacattttagggaagcatgagccatcaaatacatttaagaaatacattggtttggtccagaaagagaggacaatttgaagtgtggggaggtgcaggaggtgggattccaggctaaaggtaaatttaaacattttctggctgacaattggttgagtttgtctaaagatctgggttcaatagataggaatgtctgggttgcaaaagaggttgtagagaccaaagttttactatgcagataaagcttttagctaagaggcttaagaaagaataggttgtaaaatgtttcctatcagatttaaagtctgtattgatgttgagaagtataatgaggtatgtttgaacagcacttcccatcagggcctgaaacagactctcaggttaaattttaagagccctggctgaggaggaagtgcattcagatggttgggaggggggcttagaattttatttttggtttacagtggtcttattgctttatccttgcctctgtaagccataaataaaatctaagctttccaaccaactgaatggaccccctctgaaaaactaaattctggattttaacaggaagtgggggtcagacatgcctcattatgcctcctcctctttggagcttaggcacaaatgactagtattgacattaaaatagggatcctcagactgacaaaacagactctttgtagtaataagataccaaattgcaacgtcactctggtatggcatgacgtgacagatgttgcagactctgaaagaaatcaaaatattttactcccaaatatatttcgttgacatattttgaaatggtcctccaatgttgccatctgtaggggaaacttggaatctgtagaggatctctattagtgcagctaggtctttcccatatctagaagggatttagagtctgacaccttctaagatgctaaaaaaagacagcatctattctctctgaagcctgttacctggaagcttcatctacataacaagaaccttggcttccacaaccccccccttatcttaactcaagcatttctttctagtgatttcaagtctttagcttaactctttcaaccaattgccaatcagaaaatctttgaattggccaggcacagtggctcacacctgtaattccagcactttgggaggtcaagatgggaggatcacttgaactcatgagtttgagaccagcttgggcaacatagggagagcttatctctacagaaaatttaaaaaaatagaaatagccaggtgggttgatgtgcatctgtagtcccaagtactcaggaagctgaggtgggagaattgcttgtgccttagaagttgaggctacagtcagccatgactacaccactgcacttcagttttggtggcagagcaagaccctgtctcaaaaaaagaaaaaagaaaaagaaaatctttgaatctacctctgacttgtaagccccccactttgccatctttctgggctgaaatagtatacacttattttcatgcatgtccgtgtgaagagaccaccaaacaggctttgtgtgagcaacatggctgtttatttcacctgggtgcaggtgggctgagtccaaaaagagagtcagtgaagggagataaggttggggccgttttataggatttgggtaggtaaaggaaaattacagtcaaagggggtttgttctctggcgggtaggagtgggggtcgcaaggtgctcagtgggcaggagtgggggtcacaaggtgctcagtgggggtgctttttgagccaggatgagccaggaaaaggactttcacaaggtaatgtcatcagttaaggcaaggaccggccatttacacttttgtggtggaatgtcatcagttaaggtggggcaaggcatattcacttcttttgtgattcttcagttacttcaggccatctgggcgtatacgtgcaagtcacaggggatgtgatggcttggcttgggctcagaggcctgacatttatatgtgttgatttatgtcttgtctataacttctgtctccctaaaatgtataaaaccaaactataacctgactgcctcaggcacactttctcaggacctctttagactttactgtgggccatggtcactcatcttgacttagaataaacctcttaaaatatttcacagagtttggctttttcataacaccactgcagactattttccacatagcagcctggttaatcttttaaaatagcagtcataatttgtatcactttcaaaactcttctaatgcttcccaactcacttagaataaaatccacagttcttagagtgatccagtacaccctccaaaatcaagttatgtccctgtcctcatccatatcactctctttctactcaccctgcttcaaccacactgacctctttgtctcacacatccatgtaaagagaccaccaaactggctctgtgtgagaaacaaggctgtttatttcacctgggtgcaggcaggctgagtccaaaaagagagtcagcaaagggtggtgggattatcattagttcttataagttttggggtaggcagtggagttaggagcaatgttttgccagcaggggttagatctcatgaagtatattcttaagggtggggagaattacaaagaactttcttaagggttggggagattataaagaacattgatcagttagggtggggcagaaacacaatggtggaatgtcatcagttaaggctattttcacttcttttgtggatcttcagttgcttcaggccatctggatgtatacgtgcaggtcacaggggatatgatggcttagcttgggctcagaggcctgacactcttgatgctgtggcaataggccaagcttattcccatccagggtccttgcacttgttattccttccacctagaatctttttcttcagatgtctgtatgtttcactccttcagaattctaactaatgagatttttccctgaatatctctatctaaaatagcacccttgtactgtcccaaactccctgtgttattttgctttcttttttttttattctcagcactcatcactgtcacacacgtccatgtgaagagaccaccaaacagggtttgtgtgagtgataaagccttttaattacctgagtgcaggtgggctgggtccaaaaagagactcagcgaagggagataggggtggggccattttataggatttcggtgggtagtggaaaattatagtcaaagggggttgttctctggtggacaggggcagggggttacaaggtgctcagtgggagaggttctgagccaggagaaggaatttcacaaggttaacctttcagttaaggtggggcaggaacaaatcaaaatggtggaatgtcatcagttaaggcaggaactggccattttcacttattttgtgattcttcacttgcttcaggccatcaggatatatatgtgcaggtcacaggggatatgatggcttagcttaggctcagaggcctgacattcctgccttcttatattaataagaaaaataacataaaatagtgttgaagtgttggggcagcgaaaatttttgggaggtggtatggagagataatgggcgatgtttctcagggatgcttcgagtgggattaggggcgaagtgggaacctagagtgggacagactaagctggaggaagattttgtggtaaggggtaatattatggggttgttcgtgtagcaggacgagccgcagacaaaagctctcagacaccgagttgtagaaggaagggctttattcagctgggagcattggcaagctactgtcttaaaatccgagctccctgagtgagcaattcctgtcctttttaagggctcacaactctaaggatttcacacgaaagggtcatgattgatttgagcaagcagggggtacatgacaggggctgcatgcaccagtggtcagagtggaacagaacagagaagggagtttcacaatgttcttttatacaatgtctggaatctatggataacaatggtttctaagtcatgagttgattttgaactactaggtttaggccaggcaggccaggcctggttttgggcctggcaccaggctgcctgtctttgatttcacttctttgtttttttcttaaaacaggtattgagtataaaacaatataaaacagtatgagaaggtctctttcttccctcatttcccccctttgagactctcactttttattagtgggagttctcactcttattttcactatatgtgtcttcttgtgcaatagattgatagtgatttatatagtacacttgtgctgaagcattctggtgaactaaggtaatgatgaggctttgtatcatttgaagaagtacaggtagcaaacaagggagcagtaagcaggttcttattactattataacttctattataagagttttaaatcctcctagtgctgggaactaatttttaaacatggcttcagggtcgaattcatgctacacttgtacgggcacatgtgtcagttttgtcatatttttaactatgtctttaactacttgccttgcttatctatatgtagacagtaactagtaaggttaaatttcttatagacctctctttcagctgctagtaagtagtcaaaagccaatctattttgatagatggcatttcttatctgagtttcttgctgggccaaaatagtcaaggcttgaccggttttattagtgattatttctaaaacagcttgcaaccatatgattcggttgagcatgtaaatgggggtatggtaaccctatgagctgtcttgtgtctaagtggcaggcctatagtattgtataatttttttttttaggaggtcatttatcatctttctaattacctatggctatgcttcattttccgtgggaagcatagacagggaagcctaggagtttgcctgtttttatgggcagtaggaagaaagatggtttaatggtgccaattacacagctacttatccactgatcaggcagcttagcataggctctatgtccacatatctagtataatctggtgggggcagtctagtcctggtggaactctgggtgggcctagacaggctgcaaccttggaaatttagtgaatggatctctttctgtgtaattggaactccaccacataactgttatttttttgggggggtactattatacagtttttgtcctaggcaactaagtcatcttacagaatcagtgaattattttctttttctagctatgcagtcttgtctaataattgagacttttagaacctagaaatgatcagggtgattcttttgtgccaggaattcatcaggaactgggtctgcaggcactaattctcaggcttcttatggccattgatctcttattgcagtttttctacaaacataacatgaagtgacatttaaagactgggctacgtgcttggctaactgcacaaacaaatttctggtttttcctggagtctcaggtactagcacatttaattcatcatagaaagtctgaaatactggttctggagagcgtctttgaacctcatcttttactaagatatttactctaggacctagtcctttcctattgatgcccagagatatgtgttctttttttctaccttgggtttaagggatttgtaattattaattttaaggggttgcagcttccactcatacaggaggggctgccttctcctttttggagctaaacaggatctttttcatctttttttaaagtagtctagatgacacaagaccagtaattacacacacttgtgcatgagcatcttattctatgccaattgctattgatagtggcacaagcattaaattttagggttatatgcttggagacccctctttcttctgtcctagctattacttcacttgtgtcacctagaaaaggaccagtccttaattttattttaaaaattgtgattatgggaggcttaaaattggtcataatacgcatcaggttggttatttcctgggctacatactttggatagaatagcattatacaaacaagtttcttttagagtcctggtacacttataataactataaaataataggactgtagcaatctttttgtcctaccttagtgacttgatgtatatactgggaacagttctcagtctgaggaaggtcagttgaagtccttactgtagaagtccaaattttaaggaaaatgagtctcggaatgagtttcctcatgctttggccatgcgtggcccagtcagcttccgggtgtgactggagcagggcttgtcaacttcttcagagtcactttgcaggggttggcaaagctactcctctccacgtacagctcctagtctactgatgtttaaggatggtctcggaggttgggcccactagaataaactgagtccaatacttctacacagttatgtttgactgggctcactgataccaggagcaaggtggcagggtttagggtgttgcaaacttcaatggttatgcggggattttcaaagagcaaggtttggtatctagttagtctagcattcattagctaattgtgtcctttggtatttattaaaatcaccaccgcatggggggactttatgtttaggttttgcctatgagttagcttatctgcttcttgtgctaatagggccattgctgccagggcccttggacatgggggccagccttggaaaccccatctagttgttttgagagataggccactggccttggccagggccctacagtctgggttaaaactccaactgctattttttttttttttttgacacatagagtgtaaaaagttttgtcaggtcaggtagccccaggtctggagacgacctgagttgtttttttttttaactcatgaaaagcttgttgctgttggttgtaatacatgtagtattacagtattacaataaaaatttatatttttattgactgtaatctactaaaatattgacttaaatcctgtaactatttgatttcaagctttaaattgatctggtattccttgcggggctccaattgcatctaaatagatgcgagagttgaaaaacttataaggggcttctcttgcttctcgatgtcttatttttttatttttcctcttgttgatgaaatgccagggtgaaagggatagccaattggaccaaagtacaagtgccactctagttatttggcagagtgcctagtaaaggtccatcacaataccaccacacatccactcagggatgaacaagagatgactgattgataagctcttgaaaattcttaagctcactgcatcccttcaggtctccaaggaatgctaagtctcctccctgccatgagagacatgaagtgaacttagtgttgggagacagaagctggatggccctcgggggctgactcgaagggacttcgggatatagcagagagagcttggcatgacttattactccagactgtagaatcctggaaaagagctaccatgccacccacgcctggtcgactggaggaccaccttagtggaagggggacaatcagggcctctggcctgccatgtgcacaagcataacaattgcttttttttaacatgcagatggaatatttgatccatttcaaccaggcatttgtatcttggtatgctctcttaattgccaaagtttgttttaagtctttaacttctatgatcctctagtagaatgaatgtttcctttagcacctatttttattagtttttagaccaaagaaagctaaacaccattttatatttaataatgcttcttgtatgatttttataccagataagttaaattttacctttatattagtgtgttattgatgttaaacttaattttaataaaatcttgtagacatatttatccaacttttcatgtttcaccataaggtaagattttatagactctttttaactttttataatttttgttaaagagcaggttggtgctttaagaaaaacttgttgcatttttactttaatgtccagttcacagaaaaactggatggtacatttttaactttagctaatatgtttaaacacatatttttttttttttacaattaatgttttaaaacttgcttaaacttttaaaacaataatttttttaactttttaatgtaggtaaaaatctacattcttatgcctccttatgatcttttaaccaaaggtatattttactttttttagacaccttgcacataaactatttcttcaatagtactcaggaggccttattacttttaaattatacaacattttttgcataaatttgtcttttataacatttgttctttcatgacttttgtagacaatttttcgacatgtcttaactttctgacttattaaaaacatttttttttttctttaaacaaccagttaatttctttcaggacaagaatttaccatataacactctttttatataaattctgcctccccctttttttttttccttttttttttttttctgaagataaccatttttttttaaagtgaacttcctttatgtctgtggactagactatctaaggccacaagattaggagttactataatacatgtgacactgttaacttttagcaaacttcacttttgttgaaaaccttgtaagtttgggatttcaattatcctttgctattaataagagcttgtttagtctaaattaacttagaataggtatagatggcctctttttctctctgcttgtctttctttgcctcttccagccgcttatgctgctgttctcttaactactgtgggggggaagggggtctaaaaccagctgtaactgtgtatgtatggaaactggtctgggtgctttggcttacaggttaccttgtgccataccttttaaacaaggaaactgtctaggcttccttctgatggccaacccacctctaatgctggccagtctatttcacacaaagttttaagttttcctggtgccatagtaacactgtaatatcccttaaatcctttcttgaaatttttcaacatagtggcttgggcttactttgatcctgatccatgcttctttgagacaaaacaccatgatcacaccacaagcacaccacaaaacaaagaacaagtaaaaaagggcacccacacacttttgcagtttacaccaaaccaaaatcaaaaccaaaatcagagtatccagaaatccaagccaggtcaaaaactgaaaccaaagtatcaagcaatctaagtcaagtcaaaaacaaaaaccaaagtgccagtacaggcacaccgttggtgatcaggccacgcttccactcaaatggagtgggcaagttcccaagaccagtcctgtcaagcaattcaaaccaagtcaaaaccaaaaccaaaaccaaagtgctgataaaggcatgctgtgggtgatcagaccacgcttccactcaaacagagtgggcaagttccaaagactagtcttaccaagtttcagatgtccagactccaagtgccagttccttcccggtgttcagccactgtgttaatcctccatgggggcctgctactcgctgctctggtgaggcgttccactgggacaattgcctacctgggagcgctacttggattgcatcactcaggctggctggagtcccctgcagggatgctccacaggacaggcctaagctgcctaaggggctgccttggccgtccgtcagtcaccttgcttcccggtcagggaaccaagaaatgtagcaggacgagccacagacaaaacctctcggacaccgagttgtagaaggaagggctttattcagctgggagcatcggcaagctactgtcttaaaatccgagctccccaagtgagcaattcctatcccttttaagggacacacaactttttaagggctcacaactctaagggtttcacagaaagggtcgtgattgatttgagcaagcagggggtacgtgacgggctgcatgtaccagtggtcagagtggaacagaacagaccagggagtaatttcacagtgttcttttatacaatgtctggaatctatggataacattagtttctaagtcatgagttgatttttagctactaggtttaggccaggcaggcccaggcctggttttgggcctggcgcctggctgcctgtctttgatttcacttctttgtttttttcttaaaacaggtactgcatataaaacaatataaaacaatatgagagggtctctctcttccctcattagaaggagcatttgtcatatagaatgattggtgatggcctgtatatggttttggatgaattgagaaactaaatggaagacacaaggtctgaataagagaaggagaaaaacaggtattaaaagacaaagaaatgggagcacccaggacatccaattagagaatgaccaagggggtgcagcgtaattactttcttgttggtgagttttttggactctatcaaactttatcagtccttcagacccaagttgattctctagctgcagttgtcctccaaaactgcagaggccttgacttactcattgctgaaaaaggaggactctgtatatttttaaatgaagagttttgtttttacctacatcaatctggcctggtgtatgacaacataaaaaaactcaaggatagagccccaaaacttgccaaccaagcaagtaattatgctgaacccccatggtcactctctaattggatattctggtgttactgggggtccttgctcccagaactcccaagatgatggctagcacttacaaaatggcggcaagcctcgtgttctgtgacctggggttcttggcctcacaggttccaaggaatggaatcttgggccatgcggtgagtgttatagctctattagaagccatgggtcacggaagagaaccgtggaacccagtgactagtgttcagctcgattaggacgaacccaggcacttagctgtgcaggaacaatggcaagcctttagaccgatcgggagcggcaatgggtgcctcgctggatcaggagcacagcagacaccctgctggattgggagggatggaagtcagtggcgggtctgcgatagcagcaaacagcagtggtagacggcgagcaaaagctcagcttgagctgtaacaaacatggaccaaaagagagtgcagttgcaagatttaatagagtgaagacagagctcccatacaaagggaggggacccaaagagcgtagccattgccacctcgaatgcctgggtttgtatcctgatcattgtccctcccgctgtgctctcaggcaatagatgattggctatttccttacctcctgtttttgcctaattagcattttagtgaactctctttgctatctgattggtcgggtgtgagctaagttgcaagtcctgtgtttaaaggtggaagtggtcaccttcccagctaggcttagggattcttagtcggcttaggaaatccagctagtcctgtctctcactgggtcctcccaattctttgtcctttaatacctgtttttctccttctcttattcagaccttgtgtcttccatttagtttctcaattcatccaaaaccgtatccaggccatcaccaatcattctatacacaaatgctctttctaacaaccccacaatatcaccccttaccacaaaatcttccttcagcttaatgtctcccactctaggttcccacgccacccctaatcctgctcgaagcagccctgagaaacatcatgatctctccatacctccccacaaaaatttctgctgccccaacacttcaacactattttatgttatttttcttattcatataagaagacaggaatgtcaggcctctgagcccaggcctgcatgtatatatccagatgacctgaagtaactgaagaatcacaaaagaagtgataatgtgataatggccagttcctgctttaactgatgacattaccttgtgaaattccttctcctggctcagaacctcccccactgagcaccttgtgacccccacccctgcccggaagagaacaaccccctttgactgtaattttccactacccacagaaatcctataaaaaggccccacccctatctcccttggactcagcccacctgcacccaggtgattaaaaagctttattgctcacacaaagcctgtttggtggtctcttcacacagacgcgcgtgacattcaccacctgatatatagcattttatgtgtttccttacaacagaacataagctctgtgaggacagataattttgttcattgctatatcctcagcatcctgaagagaacctggcacaaagtgtatgttcaataaaaatttgttgaataaatgaagttatggcaatgaagaaattcattatatggaaactttcctctgtggttcttcttgaaaaattttaaacaagttctgactaccagctttcaaataggtattggctcttatatatatatatatatttttaatcaatcccttaatattttgtccactcactaaggtagagtctaacatcttgctttttatctaggtccctatataccacagttcacattcttctttagttgatggaaaaaatgtccagtagataaatctgaatttgtgtgcagacatgttttattgtatttgcattacactctggtataattaatcctaacctgaatcactggagtaaattagtttgttattatgattataaatgaattttatttgtttttcttcgatataagatcattttggatgatctagccaattccttcctatcagatgaatttagaaataaataatctaggaaaattgtcccacaatttaaaaaaaaaacagatctgaaacaagacttatgatcaacattccagtttgttctctaacacatttagtgtgctaaacattctgggaacctattaataatctataagggagttatacatattttatactaaagtatgtctgaaaaggctatacctttataggtaataagctccttacaaaaacactttcatgaattttttatatttatttggaaaaacaaaaatcttctctcactttagaaggtcagatatgacacccaactattaataaaatagcgtttggtcttggattcagtagttgggtagcttccaatcaatgtcgaaagatagttatctgttataatttaatcaagcaagacattgatatataaagtatagtacagcctcttattcttcacagataaattaaatgagtaaaggaataaaatgcttacaaaaagaatctctacctgaagaatgacgatattagataatagaaagactattaaactcaatgtgtattttgataacctttttggatgagtggggtcaaccagcttattcacatttctttaaaccttagtttattcatctgtaaacaatgtgattggactagctatctctaaagttctttccacctccagaatttctcatttctcaatttggcttattgttattatttccacaagatatattttctttacaccttgtatttccagacatccctacaaaaatgtaaagatgaaaaacaatgaatgctaataaacgcaatgctgataaaatcttaagacatcttaagaaataattattttcctaaaacttaatcaaattattcaaaaatggaaagaataatgcataatttaaagtaaagttggcatgtgtaatggaaaaataataatccatgttttactgtttatcttttgatatgaaatatctgaaggctgcttactgtgatagggaaaagttttgttgacttagtttagtttgttggaaatgattttgaagttaatatctgtatatattctgtctgtaagtggaaggatttggaggagccctgttaagaaggcagtgacatataaaaatctctttacagcaacaacaaaactcacttcaagagaaggaaaaactttccttatttttctttttgtatctgctcactgccttaaaaccactgcttcattgttgaaactttatcagattaattaacattttgagattttgtgattaccattacatgttttcaacattaactcagcctgtatgtcaacatgagctagttctaagtcttgtgactaagttaaacttaactacagataaagttataatatcttgtgaaatggtagttttaaaggtgtcatcctaaccttttatatatcattttattttaacaaaaattgtataggaacccttctggatttctgagtagttctatgagttttgactcagtgtatgagtttcagttattcacacatattctttctctttctatcagcattctagaggtgctttgaatagattacctgctgcttctcatttcctcattctattgtgatagtacagagagctacatacatacatacatcgaagcacatagaatttttttctgagaaaatgtgaagccaattacaaaatacattgaatttctgcattaagagcctattcctgaatcatagtgacatgagcaattagaaaaaattgcctgaaaatgaagtactcttgagaatataccttagagctcctggctgttaataatttcttaagtagatgtggacaaacagtgaaagattgtgacatccttatgaggaacagtttgtccattacaatattttatgctatcaaactctttggtaatttccatggcagagtaaatgttacacaaaaagctctccagaattcttaagaataataaatgaatttctgtaatacactttctttttttttttttttttttgagacggagtttcactcttgttgcccagcctgcagtgcaatggcgagatctcagctcactgccacctacacctccgaagttcaagcgattctcctgcctcagcctcccgagtagctgggactacaggcatgtgtcaccaggcgcagctaattgttgtatttttattagagatgggatttctccatgttggccatgctggtctggaactcctgacctcaagcgatccacccgcctcggcctcccaaagtgctgggattacaggcatgagccactgggcgtgtcctgtaatacagttttaggtaacagggacagccaagtttataagcttcacaatcagataatgcaggttcctattcattttagcaattagaatagtgtctacaaactaagttcagtagcatgaacttgagagttagtctggattcaaatcctagccctacctcattttagctggtgaaacttcttaagcttcttcatgcaaatataacatcaatagctctcagttccattgctgtattcttgaactccatgagagaaaacacaaacccccagcaatatttttacaatttaatttttcctggtagtcttgcctttacatgcagaagctgcctctcaagctatttcctcagtgacccttccctgtccacctacataaaagagatcctccttgagcccttcaccctaaggcatttatgttgtcctctttcttttcactctgagtttctgtcacaaatatctctaacagttgacactgcgtattgtgcttcaagggttagaggacaagaaaactgcaccactcaacttgaaaccatcaaactcctcttaataagtactttatgagtacctattgttaagattaaatgaggtaatggtcttggaaacagctgacatgtagttaaggtctttataaaggctaactattattatgagacaagtttattgcattggctgaacttaataagagtacaaagagaaaatagctctattttatttttccaaatatggtcttttaagaggttaggtcattctcctgtgctcaccccagtataatgagtcaggaaaatgtcaccttttttccaagtgtgttggggatgtgagaacagatttaaaaaaatcgagtcaagtataaaatcatcacttcaatctgttgtacaatttaaagcctgagcccaaaccctgcaggtcaacagcaggtaaagttctgctttactgttttccttactccactttctttgcacgaattttgctccttctggctcctaggatgctgatgggtcaagatccattcaaagtttatactgaatttaattgattatgaacatattgtgaaattaagttgattagcataaatttacataacactttatattttatcttttacaataaagatatgcattaattggtgaaattttaattctgtccctcagcaacatttcacaaagagacagaaggagagaaagagaggagagagagtgagagagtgtgtgtgtgtgtaccggattgccatgtaaagcgtattttatgccataggttatgatgtaagagatttcagtaatttaaagaccattggattattggtgctggatattaataccttctgtctttggaacatagggctttgtctctcctgggatgtctttcgtctcttcagagacctctcacagaacatactacattgtgttctctggatgaggtgctctcctgttgaccacttattatttccttgctactgtctccaatggtacatccctggcctcttcatcctaacaggcagccctttctaacagcctcctttccagctgaactgggctcatgggacacactcactcttgcccaggcagcagtggaatgcaggctgccttcactgcaaccttgttcattcaactttctacctttagatttctgtagatgaaagtctgggtctagtctctggctcccaaactccaggagactcaagttagaggaattctctcatactctattctagcgctaggagggcttatatggttaatagactcattaattgtcttaccagagaaagaaattgtaatctcttttgcttattgtcaaacaccatcactatgaaggttgtcatgggtctcctaacttggcacatgagctgaggaagcgagagaagagagggaaaggacatagctcactttaaaattattaattatcttcaaaggatacttgatgttatttctactcaatattttggaaacacttgtatagattgaaggtagaatttgttaggagtcataggttacctctgtgtagtttctgtggagatatgtcttaaactctgcaatcattatcagtaagttattgattactaactgctctcaattttggggcctttgtaaatctccaagacaataggaaatgtaccatttactgtcttgttgaactttattattcttctgcattacctccttttccttgaagctcttttcagggacttttatactgtgctgatggccaggagattctgagtgagcactcaggggattctgaatattaaatatatatatataatatatatgtgtgtgtgtgtgtgtgtttattttaatatatatattcccctgtttcccttaaagttgtgggaaaatactgccatagtctgagacttttgattggtccaaatgtgggtacctaatttaagctggatcaacgagtctcttttcgagtattttttgaagaacgtggatttagaaaatgtgcttctaaatcatcgtgtctctctagtaaatgagtaagattttctaaattaggggtggctagttattattataatgcagtgaccccaccatggtgccctgatgaccttgcacatgcctgcccaggccacacagacaaatgcttgtgccaagactcagaatagcaactccagcaattctgagtcttggcagaatgccttccaagtctcccagaacaggatgcgaggcctataaggagctactacgaaaccgtcacccccttgcttccccatctttactaggagtctgtcatgagacagtttctcatccacactttgctgctgatgccttgcccttttctcctcccctaggaatagagctgcagattgtaaaaacacttaactgctgtctagaattggctcttcatcaacagggtatctcacaactcacactgtagtcatctggtcccctcatgcttcagtgtcttgctttttggtgagtgctacaaaaccctggggagctggcacctttgacttaacttttcctttcactgtcaatgtaagtcataaactgtgtgaatttaaaagtggcttgctgtaactttacctgtcgaatcagtcaggctttggccttggccttgatttgccttgcacatgcttgcaagttatatgtcctgtccactggcggtggggaaggggctgtttgatcaatcttcaataaaagagaataaaatagagacaagaaaagagagtctaaaagtgttctggttgctgcccctccaaccttgctatatcttaattatttaagcctttcctaattctgcatattattagtttacgttgtatttctgtttctggaagtcaaataagtcttgactcatctacatgaaattcccctacatttctccaaccctggtatcctggtgtcagcagttactaaattgatttaaatgagtcaaattgttctgtgactccattaccccaattcctactacagaacacatgctcttttaatcaatgagtgctcattattttcctgttcacatctatttctggggaattgttgtggacagtgatggaccaattacttatctaggtctgttctcagatgctactttcaggaggatttggagtccttgattccaacccagaacaaattaatcaattcatatcggtaaacggtgaattgacaaatacaaattaaaaaaagataattatctctgtcgaaaatatgtagacattttcctcccttctattttcttaaagcatttactttagaaaacttttaagttctttcttcttttggtttaaacataaataaatccttttaatagctaaataagtctcttgccacttttaaaactcaggaatgtctttcttaagtacttgggaccatttctttgaaatgtaaacatcaagtgagatagtgccaacatctcccagtgtctgtggaaggataggagcctaacttccaggagctctttgctccaacatccaaaattaccttctgtcataaagataggagaaatttgttttttctttgtataaagtcaattaattaacacatatagtatcttaattaccaggtgaatttagggtgaattatgtgtattaaaaacatggcattgtctagtcctcttatttaaagactagttattgtttatcttgaagacatatatataatgggctgtatctacctgcctagataaaaaggtaagatttttttctgtctttgcagtctcttggtggattgcctgtgatactcatcacattctgatttaatgtttctttcagtagcaaatttcttttttctttactacttttgtggtaatcttttctgtgttaggagaagactttgtttttatctatatttcttcagtaatgagtctgagcaattacgttttaaaaacgtcacagatatctttttaggcacacctagctaatgctttgtgtcttgtataggagtggatgaggctgcctacctcccagcaacaattgatctaaattccacttgtcaagcatgagtacagtccttctcacaaagcagaacggatggtcttttgtactagataagatacgaaggacaatattaagaaaggataaggaaaaataacttataaatatgctcactatgtaaccagctccaaatctcaggaggcagcatagtacaagaaaggcatgaacttcagccagccagtctgagcagggttctctttctagcttctctacctactgtgtctgaccatgggcctgtcacttaaccacacacagcctcagtttcttcacttagaaaatcagctttccctatgtatacactctgtactttactgtacctatctcactggtgtactctgatgatgagataatctgaagtgtttcattcagaacctggtgaatagttagtgctcaacattaaattgttataatttccagcgtgccaacaagtttcttgcttctttctaatttcacaatcagaacttcaatattgttttttgtctcaaaggccattcaatcactaagcaccattcttaagttgcaaatatccctggagtaaggtaaccttttgaactaattttagcaccttgtaagtaatagtttcaaatgcactcgctatctaaaagtgaaatgtcttgagcgaaaaaggagaagggatgggattgatgacttggttggtgttacaacggtggagattggaagagatctaaaggaggatgtgaactggagatgtgaggtccatccttataatggaaccaagccagatagtataaaacccccaaagaatcggctctttgacaacacgaatgaagatgatatactcctctaggcattttgaatgcatctggtcatttaatactcacaacatccctgtagtgtacagagtagtgcccctgttagagatgagaaaactcaatatatttagggcaactagtgcagctacaacccaagtacccccaaatctcagtagcctaacacattaattataataatgtatttctcactttctgtaagtcagaagtaggacaagagtctctccttggcaaatttctcgcaagctgggaccctgggatccaggaaccagtcatagtgttactggaaaagggtcccaatccagaccccaagagagagctgtttggacttcgtgcaagaaataattcaaggtgagtccatagagtaaagtgacagaaagtttattaagaaagcaaaggactaaaagaatggctactgtataggcagagcagcccagagggctgctggttggctattttttggttatttcttgattatatgctaaacaaggggtggattattcatgaattttctgggaaaggggtgggcaattcccagaactgagggttcctcccctttttagaccatatatggtaacttccagacattgccatggcatctgtaaactgtcacggcactggtgggggtgtcttttagcacataatgcattgtaattactctataatgagcagtgagatgaccagaggtcactttcttcgccatctcggttttggtgggttttggtcactggcttctttactgcatccttttatcagcaaggtctttttgacctttaccttgcgcccacctcctatctcattctgtgacttagaatgcctaacctcctgggaatgcagcccagtaggtcacagacttattttacccagccgctattcaagatggagttgtcctggttcaaacacctctgacaattgtgagagtcagcagtttcaggattcactttcagtcacacacagcctggaaaaaggaagggagctgaattgccccgaagattttagagactgggttgggaaaagatatacaatatccgctcatgcttcatgggcattttaaccctaacctaactgcaaaggagattgggaattgaaatcttcttgtgtacccctgatgaggaaacaagatctgtgaggctataacctgtttttaccaccctaggaaagttagggtgtcagtctggaacctctaataagggcaataaaagtgttgtaatattcatgaaatcagtacctcatacagaatcatgtaggaaaccctcaagcggggggaaaaaaaccccaaaaatatttgtgttgctgaaaagaacagtaacgtttttcttagaaaatctgcagattgttagatttactatttctaagatttgttcatgttctaagcataggtgaagtccaagaaagcaatgagctatgttctgagtgagtaatcttgccagtagcaaataattccctttatttagagcaataatgttctctatgttgctgtagatgctactctgcaattttgttagtcttctgtaaacataaatcctgagtacattatgggagcatgagagaggcaggattaagtaacagactgggtggatgtgtctcttagcctggagagaaagaagagatgtacaccagctgcagacctcccaagggaaacagagaaagattggatttcttcacctagtattctagtgtaaataagactgagcccatacttccccagtaattaaacatttgctttcattctgaaaatcaaaggtacctctgagaacatctaagacaaattcttaatgactgtcatttgtgagctttgggaaatagcatatcacacttggggatatggcctcgaaatagctggtggggaaactcctatctcatcttattctgagtcactggtgctaattttgcagtgagatcaatttctggaaagcttactatggaagtcaggaacagataactgttgcataattactgagattagagcatattcattttcctcattgcgtgattttaatttagtccatcttaccacaaatgagaaacgttgtcaaagagtagtttgtcatttcaaaattaagggcctggtgttttgattgaggggcatagatgaatggaatggggggccttgatcacagtggggtgttcctacaagaatttcaaataagatgttaattgttttaatattttacttttctcttatttcaagataatgcaggttcatctgaaaaatttaacataaaattaatataagcattattcataaatctatctcacagataactactaaaagcattagttgtctattctcacaattatttttgcttctgtatgtccctctttctctacagaaatgcaccacactatatatactttgacttctgaaaggaaaattcacctaatagtttattttggacattttccttcaataaatcttctgtgatctctttaatgactgcatgaaatttcatagataataatattatttcccctgcctgaaatattctttgccctggtttttgtgggactatctcattttatattattcacatctcagaaaatgtcaacatgctgaaaccctgactattgaatccaaaggagccagctagtcatcctctatcatatcactctttaaattttctgtacaccctttcatcattgtctggtatctcctttcatttatttttctcttctttttatatccttccttctctatttcattgtttccttctttatttttttattgtcacttttcttaactcaactataagatttttttcttcttaccagaacagcttactgtaattatcagaccataacgtttatttgttactcgagttttctgcttcctctttggtttttggtgtctggagatgtccctcaccttctcacaagtttaattgtgtattttaaaggtattaaggatacattatgtgtatcaaaacatcactgtgtaccccataaatatgtgcattattgcttgcccattaaaaaataaaataaaaaatatcagttaattataaacaaaatttttagatactttatagcaataaggatttttttggggggataattattctattttggagagtgtgctttataagactctgttccatttttacattgtcacctgatgtagagttaattgtccatgtttttctccagatgtgttttaaaaattaagtaaatgttaagaaaatacacatgcacttcagaaattggtggtaggttgtctagaatctactgaaagagattcaatttctctctgggtcattgaataaaatttatttcatataggtaagacatgggctccttttcaaaacctcaatatttaatatttctttataacattattgaagaataacaaattcttagatgagcaaacaattggggaataaggtaataaaaatgtattagaaaatttggagagggccaagatggctgactagaagcagctagtgtgtgccactctcatggacagaagaaaaagtggcgaataaatactggctcttcaacgggtacatctaggtggacaaattgggattgttcaaggaaacaatttaacccatggagaacagaggaatgagacaggatgattgcttacctgggaatggcacagagaccggggaggcctgtccactattggaaaatggtgagtgagtgagagtttttagggacccacacttctgccatgcgactttgcaaccctggactcaggagatcccctgtgagtcccccaggtggggcttccagactgacccagagagctatgtgaattctgggtagagacactgctcctgcatctgtggaattctgagatccttgcatccctgggcatcatggaattagcagctacagatccagcagtaggggaggtcaggctccctctcatgtctctaggaaaggggtcaaatctatggggctaagcagcaatgaactgcaagcctcatgctcactgcaccttacaggataaggaccactgacctgggatcctagtgtgaccacatcagccccacctggactctcaagctggtagcagctctgcacttccctgggacagagctcttatggggagagtcaggctgcctcttttgctgccctgcagcccttgccacttgctgtcctcaggctctggagggtgagtagtgattagggactggcatggattcccagcacagtgcagctgccccaaggaaacacagccagactgtttcccacgcaggtccccattcctgcttctgctcactggctggggcctcttgacctgggacctcaggacaactaccttgcccctgctggaacacttcagtcagagatggctccacatttctctgaggaggaaatcccagagacaacccatagcccctccaccattgcagctgcatgatggtcccaccctaaccaccctcaggctggggaaggagcaaggggcctggttgctacactggcacttccagcataccacagccaccatacagagaggagtgcagtctcttccctgtgagattctattcctcattctaccaggcagggatcctggctcaggactgcagaacacctgccccactcttggcttaacatacccactggtagttgctttgtgtttccctgagtaaaggctaccagaggcaagcaacagcccctctgccactgccacagcagcagttctgaccatgctgccattcatcgggggacaaaacaaaaagcctgggggcttcattcacatttctaggacttgacaatcaccatacagaagagttcagtctctcctccctgtgagttctcaatctcctgatccttaacaagtgaagccccaggtcaggccagaggcacagccacccaacccatggctgaacattctcgttaccagtggctccatgtttctctgagttggagctgcagagttaaccaaaagcccttctgccatggccactgcactggtactgcccatgctgcccttggactggggaaggagcaaagaccctgagtgctttaaaaaccatactgccagcaagctgcagtggcccaaaggagaaggaaccactctatctcaaacatgacatccctgaagccctgcttatcaccaggcaggcctcccgttccctggcttgggcccacagtacatctgcttcctcctaggctgatcacagtgattgataacagctctgcatcttgctggggtggagacacaagagacaaataaaaggccctctaccacaaccactgccaaggagtcttcttcctctgcctccaagctggtggggaacataaagcctgagctcatcccagagctgcaatgtgtagcctgggagtgccaagccaggatctgcagccagcagtgaagtgggagaggagcctacactttcagcacattgagagggagcatggttgcaatgatgagaaatacagaggagccaagtggctaagcaagagcctatatactgggcagtatgcttatgtaccatctactggatcacagcccaaacttcaacacccaaaatacttgaataatatacccccccgtgaaaccaaggacaaggattcagctacaaataaagactctgcactaagccctggccctctgaaaaacatccagaaaggaagtctactcactgcattcaaatgacaaagcagttaaaggaacatcagcctacagagatgagaaagagccagtgcaagaactctggaaacttaaaaggcctgcctgtcttttttcttccaaatgatcatcctagttccccagcaagcattcttaatcacactgaaatgtttgaaatgacagaaatgtgattcagaatatggataagaataaagaccatcgagattcaggagaaagccaaaacccagtgtaaggaatctaagagattacaatgaaatgatagaggagctaatagacaaaatggccattataaggaaaaaaacaaaatgatctgatagagctgaaaaacactaaaagaattttctaatgcaatcacaagtattaacaccagaatagaccaaggtgagaaaagaatctcagagctcgaactgagctctctgaactgactcagtcaaataaaaagaaagaaaaaagcataaagaagaatgagaaaaaactttaagaaatatgggattctgtaaagagaccaaatttataactcactggcaaccctgaaagagaaagggagaaagcaagtaacttggaaaacgtatttcaggatattgtcaaggaaaagttctcaaacctcactagagaggccaacattcaaattcaggaaatgcagagaacccctgtgaggtactacacaagatctgtttcttggccacctccaatataggcccccaatctcttctagcttgtagagtttctgctgaaaggtttgttgttagcctgacttggttccctttgtagatgatcgggggcctatattcagtattcttaaagacagaaatttccaatcaagaatttcatatccagccaaactaggcttcataagtgaaagagaaataagatctttttcagacatgcaaatactgagggaattcattaccaccagaactatctcctgaaaaagcactaaatatgaaaaggaaatactgttaccaatcactacaaaaatgcacttaaatacacagaccattgacactacaaaataaccacacaaacaagtctgtataataatcagctaacaagacaatgacagaatcaaatcctcacatatcaatattaaccttgaacgtaaatgggttaaatgcctcaagtaaaaggcagagcgtggcaagcttggtaaagaatcaagacccaatggtatgctctcttcaagagactcatctcgcatgcagtgacacccataggctcaaaataaagagatagagaaagatctacggagtaaatgtaaaactgaaaaaagcagggattataaccctaatttcagacacaacagagtttaaaccaacaaaaatccaaaaagacaaagaagggcatcacgtaatggtaaacggttcaattcaacaagaaaagctaactatcttaaatatatacgcacccaacagaggagcacccagatatataaagaaagctcttagagacctataaagaaacttagatttcaacactataataatgggagacttcaatacctgagtgacaatattagagagatcattgagatggaaaattaacaaagatgttcaagacctgaactcaacaccagactaaataagcctaacagacatctacagagctctccaccccaaaataacagaatatacattcttctcatcatcacatggcacatactctaaaagtggccacacaatcagacataaaacaatcctcagcaatttaaaacaagataaaacaaaacactgaaaccatactaagcacactttcagaccacactgcaataaaaacacaaattaatattaagaaaatcactcaaagtcatacaatttcatggaaattaaacaacttccttctgaataactttcaggtagataatgaaataaaagcagaaatcaagaaaacatttgaaactaatgagaacaaagatacaacttaccagaatctctgggacacagataaggcgatgttaagagggaagattatagcactgaatgcccacatgaaaaaagttaggaagatctcaaattaacaatattacattacgcctagaggaactacagaaacaagtgcaagccaatccaaagctagcggaagacaagaaataaccaaaatcaaagccaaactgaaggaaactgagatgagaaaaaccaaacaaaagataaaaaattccaggagtttgttctttgaaaaagttaacaacatggactgttaactagaataatatgaaagaaagagaaaagattcaaataaacataatcagaactgacaaaggggacattactactgaccccacagaaatacgaagaaataatcagtgactactatggacatatatctgcacacaaactagaaaacctagaagaaatgaataaattcctggatacatactacctccctagactgaaccagaaaccaggaagaaactgaatctctgaacagaccaacaatgaattccaaaattgaacaagttttacaacacctaccaatcaaaaaagtccaggaccagacagattcacagtcaaattctgccagatgtatgaagaagaggaggtaatattgctactgaaactttttattgcgaacttttttattctaaaaaattgaggaggaactcttttctaactcattctatgaggccagcattatcctgtgagagacacaacaaaaaaataaaacttcaggccaatatccttgatgaacatagacgcaaaaattctcaacaaaatactagcaaaccaaataaatacacacatcaaaaatctaattcaccaagatcaagtaggctttatccctgggatgcaaggttagttcaacatatgcaaatcaatgaaagtgattcatcacataaagacagctaaaaacaaaaactgcatgattatttcaacagatgtagaaaaggctatcaataaaatataacatcacttcatgttaaaaaccttgaacaaactaggcactgaaggaacatgattcaaaataataagagctatctatgttaagcccaccgctaacatcataatgaatgagcaaaagctagaagcattcgccttataaactggaacaagacagggatgcccactctaactggatatcctggccagggcactcaggcaagagaaagaaatgaaggtatttaaatatgaagagaggaagttaaactattctttcttacagatgatatgagtctgtaatagaaaaccccataatctctgctgaggaactctgtgatctgacaaacaactttagcacagtttcaggatatgaaatctatgtacaaaattcagtatcatgactattcaccaacaacatccaagctaagagccaatttaggaacacagtctcattcaaaatagccacagaaagaataaaatacctaggaatacaggtaaccgaggaagtgaatgatctgtacaaagagaggtgaagaacacatttgaaagaaatcagagataatacaaacaaatggaaaaacattccatcctcatgaatagaaagaatcaatattgttaaaatggccatactgcctaaagcaatttatagattcaatgcttttcctatcaaactaccaatgacattcttcacagaattagaaaaacctcttttaaaactcatatggaacaaaaaaagagcccaaatacccagagcaatcctaagacaaaagaacaaagcttgaggcatcacattacctgacttcaaactacattacattgctacagtaatcaaacagcatggtactggcacaacatcagaacaacaacacagaccaatggaacagaatagagaccccagacataatgctgcacatctataaccatctgatctttgacaaagttgacaaaaacatgcaatggggaaaggactctctattcaataaacgctgctgcaataactggctagccatatgcagaagattgaaactggacccttccttatacaatatacaaaaattaattcaagatggattaaatacttaaatgtggaacctaaaactataaaaaccctggaatatactctaggaaataccattctggacatagggcctggcaaagatttcatgacaaaacaccaaaagcaattgtaacaaaaacaaaaattgacaaatgggacctaattaaactaagagctcctgtgcagcaaaagaaactattgagtaaacagacaacctacagaatggaagaaaatattggcaaactatgcatctggcaaaggtctactatccagaatgtaaaagaaacttaaacaaattaataagcaaaaagcaaaccaccccattaaaaagtgagcaaaggacatgaacagacacttttcaaaagaagacatacacatggccaacaagcatatgaaaaaaatactcaacattactaatcattagagaagtgcaaattaaaacaatgacataccatctcacaccagaatggctatcattaaaaagtaaaaaaataacagatgccaccaaggttgtggagaatctgctggtgggaatgtaaattagttcagccattatggagagcaatgtggcaattcctcaaataacttaaaacacaattaccaatcaacccaaaaatctcatcattgggtaaatacagaaataaatagaaatcattctaccataaagtcacatgcacacatattcagaatattgattgaataatattaaacaatattcagaatatgtgtgcatgtgactttatggtagaatgatttctattttgcacaattcacaatatcaaacacttggaatcaacctaaatgcccatcaatggtagactggagaaagaaaatatggtacatatacaccatggaatattatgcaaccataaagaagaatgagatcatgttgtttgcagcaacattggtagagctggaggccattatcctaagtaaactaatgcaggagcagaaaacataccacatgttctcacctataagtgggagctgaacaatgagaacacatggacacagaggggaacaaccgacaaggggcccacttgagggtggatcgtgggaggagggagaggagaaagacatattgaatactatgcttattcccttggtgacataataatccatattacaaactcccatgacacacagtttatctaacaaacttgcacatatacccctgaacaaaaaataaaatttaaaaataaaaaaggaaaattacagataggtcagactgacagttgttgcagatttcttgaactattgtttacatccatcattacattatacttattggacactcagctcttgttatttaatgtatcaataaataaacctacaattagtaactgtatctcaaaattgtatcaataaagaaacatacatttggccgggcgtggtggctcacgcctgtaatcccagcactttgggaagccgaggcgggcggatcacgaggtctggatatcgagaccaaggtgaaaccccgtctctactaaaaatacaataaaaaaaaaaaattagctgggcgcagtggcgggcgcctgtagtcccagctacttgggaggctgaggcaggagaatggcgtgaacccgggaggcggagcttgcagtgagctgagatcacaccactgcactccagcctgggcgacagagcaagactccgtctcaaaaaaaaaaaaaaaaaaaaaggaaacatacatttaataactgtaaaaaattttgatgttagtgatgaatattttaatatctcgtgattttatcttagacaagtgaaacttggcctctctgtgctgttgttctctcatttggaaaaatgatgaagataaacaacatatttaccaatatgacttaacaaatggcagtgactgttgtcagtggtcaaaagtattcacggtatcttgtaactttatcatgacatagctctgctatagattatctgttttataacattttatattcttgaaatatcatgtgagttttaatgctattagtcattagtatttgtttctataacactctacagatttctttattttacagttctcttgattaaacaatgtgtttgtaagtatttctggagaaacattgtttacatgagaccaggaaaaaaacactaaaatttaagtttctgaactgacaatttggctagcctttctgaaagacatacttgcagaaaagatatatatatgtgccctccttagtcaagcatattatttgcaaaataactgagtaatatactgttatattaatggaaaatgtcagcaagaaagtcctttacctgaaatttatgactccaaagtttttacacatatatgaagtttaaaataaacatattttcggttactatttaggcacaaataaatccaggaaaagctttgactagctagaggttgcctaaacagaaagttaacattattattattattattattattattaattactgatttgagcaagttagaaacacctagaatgtcctttgtgaattatttggccagcatgttcatggttcaccaccataaaaattaggtgtacatactagggaagtggaaggcagttttagcctcccccaaacatattctccaatagtttactcaaaagacaatccaagaaaatatttcatctaaacaaatcagtatacttgccatgaaagtgcagtttcaaaacatctccagtctattctatcttcccttttcccctttccaaccaatttctacctctaaaccacaattataagaaaatctgggaccctagtattgattgcaagattttaattcaatgtcaaagattataagattttaatttaatggcaaataaccttatcagttcatagaataaacaggtacatatgaacttgacagcactcactaagataccatttttttgcacagtgaaaaggggcggtgggaacaaataggaactacaaaagagttaggtatgtgtatgtcaaaaaacacaactaataaacttattgacatacttgtgtgtatgtgtttacttattgttaattaggaacaccttatacttatctattaatattgcaagtgtttcaaaatccttcttcaatatatatggagatatatttctacaaggatatttttattttcataactcacagtcatacattcactgttttgtttatattagtgtacaggctataattataattgcaagagatatagataatgtcaatagcccttggaaaaccagtcacttaaatctctattaagaaatattctattacgattttatagatttcaaaatacagaaatgtccctgtaagctatgatagtgtctctgtggaaatcagtagtcatagtgagaaattaacctgtctgttgagaagcttctgaaaaaaccattcctctgaatgaactttctctgaacttaaaacatccctcctataatctactcacatctgaatattaatattttgttctctgaagaggatgtaaaattttttgtgattattatttttgcctcttttcaatcagttaacaaatatttgttcctttgctaatggcgtgcaaagcatttggttgggtgcttagggattgcaaagtagcaagatgctggagttcggcaaaattataattcagttggaatgccaaggtgcctctaaccttagaagaaaaataatagtaaaaagcaatggtgcttcatgacctacgattaattaccctatctttagtggaagttcaagttgcactgagtactgaggaggataagtttctcttgttggagatattgggcagcactctcggatataacataatttgtagggattttgaagactgggaagaatgcttcactatgttagatgtaagccactagctctgtagcagttggcattgacaagggacttattgagtgtatgcatttatcctccaggaaaatggaaatgtagtatttgaatttcgtagatcttaactgtggtaataataataacattaattaatattagtagttaataaaattagtaatatcaagaaaaataataaactactcttggaatatttactatgtgccagacaccataataagcagtgtatataggatctaaattgagccacccattatctaaatatggggggaagcataatggctaaagcaataaggctaaaaaataaactttgaagtcaaacagacttgttttactcataactcttccatttactgcctgtgtaaccttggtaaagttacccaacccttgaaatttttgtttcctcacttctaaaattggaattattttgaatacctacctcatggtactaatttcttttctttcctttttctttctttctttttttttttttttcagacagagtctcactcagtcccccaggctggagtgcagtggtgcaatcttggctcacatctgcctccacttctcaggttcgagcaattctcctgcctcagcctcctgagtagctgggaccacaggtgcacaccaccatgcctggctaatttttgtatttttattagatatgggatttcaccatgttggccaggctggtctcgaactcctgacctcaagtgatccgcccaccttggcctcccaaagtgctggaattacaagtgtgtaattccactgtgtccagccatgacattaatgattttaagtaagataattaatgtaaaagtaattaatccagtgccaaacccagattacttacttaaaactagctattgatatttttaataactatatgaagtgaggattattgtttccttagtatagatggggagactaggagagactacccatgtaactagtaagcatagagctggaatttgaactgcagtgtatctgactttagagagtttgttctctcaatgattacattattatgtttttgtttttcttcattcatttaataaacaatttttggtactgattaagtgccatgtcgatggccttcagctagaaatgcaatggtgagaaaatataaactctccctgttctaaaggagactacaaatgaaaggtgtaggcattaatagatatttaattaaaaactgagggtactcagaaggaagaaaatatgattccctgagaagataaaataaaccaagttcactaggattgtgaagttaaaaaatatttccgtgacaaaaggaagatctaaaaggattgtgagattaaaaaatatttatctgagaaaagaagatctgaaagataagactaaaaagatggcaagggtcagataatacaggaccttgtaggcaaaaataaggatcttgggatttttcctaaggacaatctaaagttattgaattttaagcagaaagtgacctgatcagatttattactggaaaaaccattgcctagtttgaagaatagtgggaggcatccaatatggatgaaggcaaagcagttagtaggttaactaataattataataatattaatttatatttttaatacattataaatattacccaggaagtagatgagagtagcttggataaggactggtttcagatgagatggtaataagaatagaagtttaaaatatatttgggtgattaacttaaataatttaatgattaaataattatgaaagaatgagaggtaataataatgactcctaggcttctggttcatgcatctgcaggacgtgtggcacctaaagtgtgaaagagtatcaaagtttagaaggaagataatatgctgaaccttggatatgaggagtttgaaatgcttttggcatccaggtaagttgagcaggcagttagatgtgtagtccagagaagagacttcagctggagccacaaagatggaagtcaccagcatctagatggtatttaagggcatgggtctgattgcttagagagagagaatcagagagaagagaagacatccagccatgaaaaattgcaccattaaataactacatctaggagaatggacataagcaagagattgaaaagagaacaaagatacagttgggaaacaaagagtgggttatgtcacagaaacccagaaaagagaaggatgatattggggacactagacattatggactgggcaatattgtcaggtgctgtggaaactttaataagacaagaagagaataatattcataaattttttggcatgagggtcagtggtgtggtgacatcaggggaaattttcactgtagacaagagtgaaagccattttggaatacattgaggagtgactggagctgaagaaacagagatagcaattatgaacaattatttcttaaagttagacgtaaagaagagtgtggagataagctggaggcaactttggagtttaaggatgactttgtgtaattttatgttacagagatggatccaggcaataggaactggcacacaaataggaattaaagacaataattaattgcataaggatcatcagaatgcaaaagtgaagaggtcccaaagcagattattaaaggactgtgcttagaagggagaaaccatctcttctaactcaagagggaaaaatatgttatatgctggcataaataggtttgtaagttttgtgttttgtgggagcaatttaagaaagtccctgttggatttcagttttctctgttcactgttgtctccctgaaaatcaacttgtctgccttttaggatttagaataaagttattatttatttatttatttatttgtcttttgttaccatatacgcctataaacaactgaaactactgaatgtggtatttaaactattttaatgattgaacaatttacttatacaaagttagcctgaagccttagggtaaaggttatatacgaaaatcaataataaaggctagatctaactggtttaatggaaagaatcaatatgttgtaaaagagcttttgaaagtggaatttgtacactgaaaaagggaagtttgcttttagcaaaaaaaaaatccattattttcttaatttcttaaagagtagatttttaatattttattttttacatgtacatatgtgtataaatgcatacatatttaaatgttttaaaatcatataattttgtgaaccttttgtatcctaaaaattttcttttttttttaattatactttaagttttagggtacatgtgcacaacatgcaggtttgttacatatgtatacatgtgccatgttggtgtgctgcactcaataacttgtcatgtaacattaggtatatctcctaatgctatccctcccccatctccccaccccacaacaggccccagtgtgtgatgttccccttccagtgtccatgtgttctcactgttcaattcctacctatgagtgagaacatgcggtgtttggttttttgtgatagttttctgagaatgatagtttccagcttcatccatgtccctgcaaaggacatgaactcatcattttttatggctgcatagtattccatggtgtatatgtgccacgttttcttaatccagtctatcattgttggacatttgggttggttccaagtctttgcgattgtgaatagttccgcaataaacatacgtgtgcatgtgtctttatagcagcatgatttataatcctttgggtatatacccagtaatgggatggctgggtcaaatggtatttctagttctagatcgctgaggaattgccacactgacttccacaatggtttaactactttacagtcccaccaacagtgtaaaattgttcctatttctccacatcctctccagcacttgttgtttcctgactttttaatgattgccattctaactggtgtgagatggtatctcattgtagttttgatttgcatttctctgatggccagtgatgatgagcattttttcatgtgtcttttggctgcataaatgtcttcttttgagaagtgtctgttcatatcctgcacccactttttgatggtgttgttttttcttgtaaatttgtttgagttcattgtagattctgcatattagccctttgtcagatgagtagattgcaaaaattttctcccattctgtaggttgcctgttcactctgatggtagtttcttttgctgtgcagaagctctttagtataattagattccatttgtcaattgtggcttttgttgccattgctttttgtgttttagacatgaagtccttgcccatgcctatgtcctgaatggtattgcctaggtttttcttctagggtttttatggttttagctctaacatttaagtctttaatccatcttgaattaatttttgtgtaaggtgtaaggaagggatccaatttcagctttctacatatggctagccggctttcccagcaccatttattaaataggggatcctttccccattgcttgtttttgtcagatttgtcaaagatcagatggttgtagatgtgttgtattattactgagggctctgttctgttccattggtctatatctctgttttggtaccagtaccatgctgttttggttactgtagccttgtagtatagtttgaagtcaggtagcatgatgcctccagctttgttcttgtggcttaggattgacttggtgatgcgggctcttttttggttccatatgaactttaaagtagttttttccaattctgtgaagaaagtcattggtagcttgatgggatggcattaaatctataaattactttgggcagtatggccattttcacaatattgattcttcctacccatgagcatggaatcttcttccatttgtctgtgtcctcttttatttcattgagcagtgatttgtagttctccttgaagaggtccttcacatcccttgtaagttggattcctaggtattttattctctttgaagcaattgtgaatgggagttcactcttgatttggctctctgtttgtctgttgttggtgtataagaatgcttgtgatttttacacattgattttgtatcctgagactttgctgaagttgcttatcagcttaaggagattttgggctgagacaatggggttttctagatatacagtcatgacatctgcaaacagggacaatttgacttcctcttttcctaattgaataccctttatttccttctcctgcctgattgccctggccagaacttccaatactatgttgaataggagtggtgagagagggcatccctgtcttgtgccagttttcaaagggaatgctcccagtttttgccaattcagtatgatattggctttagtgaatctgacaattatgtttcttggagttgctcttctcgaggagtatctttgtggcgttctgtgtattttctatgggtttgtcatagatagctcttattattttgagatacgtcccatcaatacctaatttattgagagttttcagcatgaaggttgttgaattttgtcaaaggccttttctgcatctattgagataagtatgtggtttttgtcattggttctgtttatatgctggattatgtttattgatttgtgaatgttgaaccagccttgcctcccagggatgaagcccacttgatcatggtggataaggtttttgatgtgctgctggattcagtttgccagtattttattgaggatttttgcatcaatgttcatcagggatattgatctaaaatcctctttttttgttgtgtctctgccagtctttggtatcaggatgatcctggctttataaaatgagttaggaaggattccctctttttctattgattggaatagtttcagaaggaatggtaccagttcctccttgtacctctggtagaattcggctgtgaatccatctggtcctggacttttttggttggtaagctattaattattgcctcagtttcagagcctgttattggtctattcagagattcaacttcttcctggtttagtcttgagagggtgtatgtgtcaaggaatttatccatttcttctagattttctagtttatttgcatagacgtgttcatagtgttctctgatggtagtttgtatttctgtcggatcaggggtgatatccctgttatcattttttattgcgtctatttgattcttctctcttttcttctttattagtcttgctagcggtctatcaattttgttgatcttttcaaaaaaaccagctcctggattcatggatttttcgaagggtttttatgtctctatttccttcagttctgctctgatcttagttatttcttgccttctgctagcttttgaatgtatttgctcttgcttctctagttcttttatttgtggtgttagggtgtcaattttagatctttcctgctttctcttgtgggcatatagtgctataaatttccctctacacactgctttaaatgtgtcccatagattctggtatgttgtgtctttgttctcgttggtttcaaagaacatctttatttctgccttcatttctttatgtacccagtagtcatttgggagcaggttgttcagtttccatgtagttgaggggttttgagtgagtttcttaatcctgagttctagtttgattgcactgtgttctgagagacagtttgttataatttctgttcttttacatttgctgaggagtgctttacttccaactatgtggtcaattttggaataagtgtgatgtggtgctgacaagaatgtatattctgttgatttggggtggagagttctgtagatgtctattaggtccgcttgttgcagagctgagttgaattcctgaatatccttgttaactttctgtcttgttgatctgtctaatgttgacagtggggtgttaaagtctcccattattattgtgtgggagtctaagtctctttgtaggtctctaaggacttggtttatgaatctgggtgctcctgtattaggtgcatatttatttaggatagttagctcttcttgttgaattgatccctttaccattatgtaatggccttctttgtctcttttgatgtttgtttgtttaacgtctgttttatcagagactaggattgcaactcctgactttttttgttttccatttgcttggtagatctttctcctccatccctttattttgagcctatgtgtgtctctgcacatgagatgggtttcctcgttacagcacactgctgggtcttgactctttatccaatttcccagtctgtgtcttttaattggagtatttagcccatttacatttaaggttaatatttttatgtgtgaatttgattctgtgattatgatgttagcttgttattttgctcgttagttgatgccgtttcttcctagcctcgatgttctttacaatttggcatgtttttgcagtggcttgtactggttgttcctttccatgtttagtgcttccttcaggagctctgttagggcaggcctggtggtgacaaaatctctcagcatttgcttgtctgtaaagtattttatttctccttcacttatgaggcttagtttggctggatatgaaactctgggttgaaaattcttctctttaagaatgttgaatattggcccccactctcttctggctcgtagagcttctgccaagagatcagctcttaatctgatgggcttccctttgtggataacctgacctttctctctggctgcccttaacatttttttccttcatttcaactttagtgaatctgacaattatgtttcttggagttgctcttctcgaggagtatctttgtggcgttctgtgtatttcttgaatttgaatgttggcctgccttgctagattggggaagttctcctggataatatcctgcagagtgttttccaacttggttccattctccccgtcactctcaggtacaccaatcagacgtagatttggtcttttcacatagtcccatatttcttggtggctttgttcatttctttttactcttttttctctaaacttctcttctcacttcatttcattcatttgctcttccatcactgataccctttcttccagttgatcaaattggctactgaggcttgtgcattcatcacgtagttcttgtgccaaggttttcagctccatcaggtcctttaaggacttctctgcattggttattctatttagccattcatctaattttttttcaaggtttttagcttctttgccatgggtttgaacttcctcctttagcttggagtagtttgattgtctgaagccttcttctctcgactcgccaaagtcattctctgtttagctttgttccattgctggtgaggagctgcattcctttggaggaggagaggtgctctgatttttagagtttccagtttttctgctctgttttttccccatctttgtggttttatttacctttggtctttgacgatggtgacgtacagatggggttttggtgcggatgtcctttctgtttgttagttttccttctaagagtcaggaccctcagctgcaggtctgttggagtttgctggaggtcccctccagaccctgtttgcctgggtatcagcagcggaggctgcagaacagcagatattggtgaacagcaaatgttgctgcctgatcgttcctctggaagttttgtctcagaggagtatccggccgtgtgaggtgttggtctgcccctactggggggtgcctcccagttaggctactcgggggtcagggacccacttgaggaggcagtctgtccattctcagatctccagctgcatgctgggagaaccactactctcttcaaagctgtcagggacatttaagtctgcagagttttctgctgccttttgtttggctatgtcctgcccccagaggtggagtctcctgaagcaggcaggcctccttgagctgcagtaggctccacccagttcgagcttcctgaccgctttgtttagctactcaagcctcggcaatggtgggtgcccctcccccagcctcgctgccaccttgcagtttgatctcagactgctgtactagcaatgagcgaggctccataggcataggaccctctaagccaggcacaggatataatctcctggtgtgccatttgctcagactgttggaaaagcacagtattagggtgggagtgacccgattttccaggtgccatctgtcacccctgtctttactaggaaagggaattccctgaccccttgtgcttcccgggtgaggtgatgcctctccctgctttggctcatgctcggtgcgctgcacctactgtcctgcacccactgtgcgacactccccagtgagatgtacccggtacctcagctggaaatgcagaaatcacccatcttctgcattgctcatgctgggagctgtagacttgagctgttcctattcagccatcttggcttcaccacaaaaattttctaaaatacgccctcccacttgattttcctacctctacattatttacccaatgaccatgtcataaacataagcatatgtattcttctgcattttctttattttccaaagttataagaaaaaatgcttatattaatatacctactgggtttttaaaataaattattatttttcagcaatgggtcatagtatacacttttttgtgaatttagattttcttttttgcactcaactatagcttatggaaatctttccaagtcaactggtaaagttctaatttagtctttttaatattttagattgaggtttgtattacaaattattcagccattcctatactggtgctaatttacatttttagtaaagttttttcatttttgcttctgtaatcaatactgctagactaatctttttataaaatctttatactagtgtcatgttacatatttatatgtgtgtatgtgcatgtgcatatcatatggtggataaattcttctcagaaaagcaatttccaaagtgtctaggtattttttattttaatatagtagacttaggttgtataaaaacatggttgtaacagttaacatttttaccagcaaggcataagagtgcttttatccttgcatctctactaaaccaaaatgcaagttttcaaaagatattgagaaaagtagtcatcgataaagttgattatttaattttatttatttattttttttgagatggagtttcactcttgttgaccaggctgcagtgcaatggcacaatctcggctcactgcaacctctgcctcccgggttcaagcgattctcctgcctcagcctcccaagtagctgagattataggcgtgtggcaccatgcctggctaatttggtatttttagtagagacggggtttcaccatgttggtcaggctggtcttgaactcctggcctcaggtgatatgcccgcctcagcctcctaaagtgctgagattataggcatgagtcactgtgccccaccttaaaatattttaaagagtggagattggtagatttgtgaaaaggatttttcctttttggtataaagctaagagatccatgcataccatcactcaaggagagtgctgaggacgtccctctctacctaaaaccattgcctagtttgaagaatagtggggcagtgatgactacagaagtattaggagtaggatttcctagtaaaccctactaaaaggtttaaagataaaatatgggatacccaagctgaattagaatggctgaataatgaacgaatagtcttttagtaagaatatatccaaaatgtttcaaagcacacacttatattaaaaatgacatctgacactataacttattccttatattaaatcatatttctgtacacattaaaaactcccctttatcccctcctccaccccacacccttcccagtttcttgacatccatgagatcagatttgtagctcccacatatgagtgagaatgtatgatatttgtcttcctgtgtctggcttatttcacttaacatgatcaccttaagttgcatccatattgaggggactataattaacattaatattttgtatatttcaaagtacctagaaaagaatatttaaaatagttcctattcaaagaaattataaatgttcaaggggatggatggcctaaatatcctgatttgatcattacacatttatacattgtatgcatgtgtcaaaatatcatatgtaccccattaatatgtacaaatgctatatatcaattaaaaaatacaatttaagagcaaaaaataacataatgcataggtataagcatatttaaaatagtttaaacttggagactctctaaatgcctatcaataagaaaatagataaattgtgatgcattcatactatagaatacaacactgcagttaagggtaatgagtgtaatcttcatatactgacatgaaaacatatccttgaatagaaaaagggtctagaagaatactattaatagtgactgctctttgagggagtgactttcttttttaacttatacacttcagtatattactttagtttcatcaaaataagcatgtatggccaggcgtggtggctcacgcctgtaatcccagcgctttaggaggccacagtgggtggatcacgaggtcaggagattgagaccatcctggttaacacggtgaaaccctgtctctactaaaaatacaaaaaaattagctgggtgtggtggtgggcacctgtagtcccagctactcgggaggttgaagcaggagaatggcatgaacccgggaggcagagcttgcagtgaaccaagatcgcgccactgctctccagcctgggcaacagagtgagactccgtctcaaaaaaaaagcatgtattacttgatttttatatatttattttgaatttttgcataattagtatttagaaaacataataaatacaaaccaaatttataatttaaaaaacatctgttatttatctaaagttcaaatttaactgaaagtcctatactttaaagtgctaaatctgacaaccctaaccaggagagtgtgatatctacactcttagttatggcaatacaattgactaatctttcacacatgccttggaaatctagatgggctagtcacctgcttagggtgggattagccttacattggtcatttgcctgaacagaggataggtgttttctcccattgaccagatgtagaacatgggcaaaggaaagcagtgcggggtgtgtgtcctgctctggtgcactcctagagggacactcccctgctgagtccagttcacacctctacgggcatgtctgaactcagcagaggaaccagaagcagaacactaattcctagaacctgaagaaggaataggcaaaccccaaagtagagtgcatttgtgtgagtcaaggaaacttcaggtaagagagtaatagtgagatttccaaagaacccacaaaaatagcgaggagtgagaaagtcagcattttttttttaaaccaaacagaccaaagagtgtgaggcttccctatgacagtaagtaaggtgcttcatgtcttacttcacttctattttgctttgatttggacaggggcacaaactttgtcttctaaatggtattaattccaaaaactttcaatataaattattgagggtagtttaattgatgttaagaagaaggaagacaaaatgataaaatcttcagggtgctggtgtaagagctacagctatttatgtgtcctattctgaatcccaagaatgctaaatgtaacttatcctttaaaattttcatgatgggtctttccaaattgtaggtccttaaaatgatcatatcttttggttctttgaattcccaacgtaaggccaagtactttctgcatggtaggttaaacatatttaataattgattggtgtctgctggtgacccttgaaggatgagaaataatagaaaatccaagtcaatggaacagacaataagatccctgggaaaccagaagcagagagattggttttaggacagctgaagaaagtctaatggaaagagtggggggccatgtgagttttgcaggaaaaatagtctttagggaagttttgcatgcagaatgcttttcaggcacatgtagaataggcaaatggaggaggtgtgaatacatgggttgtacttagtaattaaagagcagttgtcttcggatgaagcacaaaggactgtacggatgactactgagaaacttaagaaacacattaaaataggttgtagtcatacaaatttgaaatttctgctataacttttaaaggtatttgagaaaagaggtgatttacacaaaaatgatttatttatttttttaaaagtaagtcccagtaaattctgaactgggagaagagaaagagcaagaggttagaggcaacaggaggctggagctggagtaatggccacatagagtgttattatttcaagaaccctggaagaagtaggtaaggatttgaatagaacagtgaagtgaaacagaagaaattcacatgaaaggcactgcaaagaagagactaatacgatggcagaaagaagtagaaataaaaattggcaggatagattggagctggggaacatgatggtctcattttaagaaataaaatctggaaagagaagagatttaaaagtctacatggtgtactttattaaatgaaaaaaaataaattgtatagacttaaaagatcctcactcactagatacaaaaatattttgcaaataaattttgttttatatctacgaaaaatgtaaatgcctttccaaatttattttttaaataaaaaactgtttctttttaaaagtgaaatacagctgtctttttttttgttcttatgtaataattctgctgtttttagttctcagtcagcaggcaagcaagaccctcagtatatgtgttttctttatttggttaggttttgttggaataatttttgtattaagtcttatattagaatatgaatgtaaatgctttgagagatcaattagcagtgaattaaacatgacagaagatttatttctcctctgcttaaaaatctaagctggtatataatcaggtttgaaaacgttgcttattcatcatcagcataaatttcatccttggattcaaggtgattgttctgcttgttgctatttctcagcttaggaggaaaaaagaatacgtagaaggcaagtagccttcctcttttaagaatgtgatctgaaagttgctcatatccattggctaaaacttagtcatatggtttggaaaatgttatgtctaggtgggcattgcaaccaaaattggaagtaagaggaatttgtttctaaaacaaagaaggatagccttgtgttagaaaactcatatctgcttatatttcttaagaaaatttttggtttacttttgtatttctgtaagagctggggtctcactatattgcccaggctgttgtcaaactcttgccttcaagcaatcctcctgcctcagccttccaagtagctggtattacaggcatgagccaccgtaccaggccaagtctgcttatattttatgtattgcattctgtcctattaatgtatattcattatctgtctttttcttttcattctttatgctttttaaattatagatattcttatgaaattttaatttattatgtatagcagaaagatgccaagacactcaaggacaatatcctctttggtaattatttggattgaaagtagtatgaagccatatcacttgtccaaataagagtctttagatttactcaaaatgataattttctatttgatagcctagatatattaattacaagagataatttctgctagtctgtagtctcccttacctgaagtgttttttacatgattaaacatgcatgggagggtttatttgtttatttatttttgactaaaggggattcttttggggttgatgttcttgggaagagaaaaaaagctatgaggatgatagagatgaggagaatgcacacacttgctccataaactgatcttgagccatttgaaaagtgtttctaaatgaaaagatgaatgagctgtgtatatggacaaacgtgtttgaccctgggcacaaagcactgctgctgagagacccaggggtaatggtgacatgagttctagatattcatttttcatccattcctcaaccccgacacagacagtaagatgtatttgtggtcccaaggactaacagaggaaggaagaaggggtcactgtgcctgaagatcatggagtatggggaaagtaaagagtagtgtgttaaagttgaagaaagataagtgtatttattgtgttcctacacgggagtcccagaaacacctgggtgatcgtgatggtggtaaatctggtggaagtcctcattaatggataggtgtagacttggagcaggggaccataatggattatttccaatgtaacttaatatgcgcttagagataaagtttaggacagtacttctgaaactttaatgtacatatgaatcaccaggagaccttgttaaaaggcagattctgatttagtagctggggtggggctgagattgtgcctttctaataaattctccggtgatgctgtgctgctgttccacaaacaacacttccagtagcaagggattagtaatattgaattaatcaaggtctcatcctcaccatctgctaattcttattgctttctttcctacagtcagaaaagcctgaatttcaaaactgactatgctacttacaagtgtcattgagtaagttatttaacttccctgaggcttagtttcactactcaagtagatttttattagcattgtagtatttgctatttctatccagcagatatttcgattttcttcctgtgcacctggttggattgcatgattaagcccgtttggagttaggtgaggctacatatatgctttgtcattagtatgtaggcaaaaattttaatatatcacttgtgtggtttgttaccttctctttttgtctgctatgatcattggtaatgttctagtaaatgttttatcatgggaaccactagagtaaagcccttagcaaacccttggtggacatgtaacatgcaaataaacttttattgctttaagccattgagatcgtggagtatgtattatttcagtgcaacatggcatactctgactgatagaagcattaaatggaaaaagtcacatacattggttatgacacagatattcttttcccattgttttctgcttccaacctcttataatctagctttttgtcatctctctgtgtatatataataagagtaacaagataatttagaaattggctaaaagctacatttatgttttttaaaaaatcctttttcattcttataaagtaatagtaattcaaaaatgcagaacttgcagataaataaggcctctttttctccatgatcatgtcacgtcagctagactgttccaatgaattctaatctgttgggtgatatgtaacagtaagtgattgggaagcacaacaactgatgaagcaggcccatgaaatggacacttagtcagagggatggctgttttctatttataatattgcatttttatttctgcatttttttgtttgcaaaaagaatgtcatttttattatttctctggaaaccaatttgagtttggcatgaatgtagcaaatgctcttctattcttgagctgttagttcttttaatgtttcctctaccctaagaagaaaagtgctaagcagcatttctttgacctttttgctgggttataatttaaatgtctggtatttctttttctgctcacctttcatcctgctctataatccatgtgacagaacaagaatcactagcgaatcaaaatagagacaatttacaagtaatgtttaaaccaatctgcctttgaactttccttgtaattattctctgtcatttctcctttttttttctaatttatatactaactctctctctaagggaagttttttctttatctctcattgtacttatgttgttttaaaaatatatcccttaactcttgaaaatattaatatataagatttctcttttcatgattccacttaacatatgtaatatcttgaaattcaagcgcaatgcccaatagccatttattcattcattcatgcattcaacaaatattcattgtagcattctatttagttatgagtacatagcgttgaaaaaaattgtagctcatgagggatgagcttcatccttcatgaagcatatattctagtagatagagccaggtaatagacaacaaaagaagtatgcaagaaagtaatgttataggagaaaaatgaatcagaagaagaaggcacagagtgtcctcaagtatgctgctactttaaataagatatactgggaaggccttgtccataaagtagtatttaagcagaagcctgacagaggtagaggcagaattatgagatatcagtggaagaactttcagacaagaggaaatagcaagtataaatggcaacattgtcactagactcaggttgatgtaggatttgccaacttcccttttgactttgaaggttgctctgggaatcaataatgagtgacagatggaagaggagagagggtagctgcatggaaagttttatgaattagtcttgggtgtggagtgcctcactttttcttcattccattgaccaggaattacttagatgaccacatctaaatgcatgggaggttaggaaataaactatagcctggtattcaggagggaaagaatagggaattgagaaataaatgagtagtttctgacttagcatatacaatactgtactgaattttttatattatttataatttgctatctctgagtatcaaaatactgaacacatccaatgaatgaaattcttagaataattataggactatccattaagacatcatgttattacaataaacaaagagtactttgttctagtgagcagtatattgagagagtatgattcctttggattgcaaatgacccactgcggcagccaagtctcataatacttgggatgtctttcacataactctgctttgactgtacctttgtggttaaaggaggcctccttgagatattcctttgggtcccattagtggaaagcagggcatctgtattagtctgttttcacaccactgtaaagaatattacctgagactgtgtaattataaaggaaagaggtttaattgactcaaagtcccgcaggcataatagaagcatggctagggagacctcaggaaacttacaatcatggcagaaggggaagcagcctccttcttcacaaggcagcaggaaacagcatgaatgtgagcacagaaaaaaactgccacttttaaaactatcagatctcgtgagactcactcactatcatgaaaatagcatggaagaaacctctcccaaatcctatcactttcctctctctacccattgggattacaagtccctccctccacatgtgaagattacaatttgtgatgagatttggatggggacacagagccaaacaatatcagcatccaagtttactgttccaacaagaccactctttacttgaaatgggtaatttttcaaaataaataaagctgcttttagggaaaatggataatgaagaatgcaaatgatagatcttcactgttttatacatacatatgtgtttgtttacatatatataacataaaatgtactaaataatatattgtacatagcaagcagtatgtaatatataagatgtgatctgtgtgtatatatacatatacctatgtaaatatgtatacatatacagtttgagcatctcaaatctcaaatctgaaattgtacaaaatctgaaacttttactgagcaccaacgtgatgctcaaaataaatgctcatagaagcatttcagatttcagattttgggatttgggatgctcaaccagtaaataaggcaaatattacaaaatctgaaaaaatctgaaatccaaaacactctggccctaagcattttggataagggatactccacctgcatatatgtctgccatatttgattcgcataatggaaaagaagaacaataactcttatttaagttaggcagagttcatttagcatattaaaacgcttgttttctgtctaatcataattggctaaaaaccaaagaaaaagatcacatgtcatgattgtatttattttcatttgctatgtgatttggtagttatggtataaaaaccttggagattttattaaataggtcaggtccacattcaaataagcagatttctattatatgttaatctgctgagcatattgctgttcatatttgcttcactacttcttgaatgaatagaagagttaaggggtagatggggattaaggggtagatgaagcttctgagaacagagtgcctgggtttgagtcctggctccactatttactagctggttgatcttgtgtaaaatactaacctcggcctcagtttccttatctgtaaaatggggatgaaaacagtatccctctcataggactattgtgaggattaagtgagttaatatatgcagagtacttggaacagcatctagtacatagaaggcacgatgtaagtgttagctgtttctgttaattatttattttttcaaactctggaataaatcataagcccttgaagataaagatcacgtctaaaaattatatttagcccttaacacagtgtcctataaggtacctaacacatgtttttgaatgaataaagtaatgagcaaacagttacacattctagcattcatgttgtatgtttaatgtagcccattccttacttaactcaaactacctttgttactttgtgactaaactgttatttttcaataataaagataaaatgcgctggggtaggtggctcatgcctgtaatcccagcactttgggaggctgaggtgggcagatcacttgaggtcaggaggtcgagactagcctggccagcatggcaaaaccctgtctgtactgaaaatacaaaaattagccaggcatagtggtgggcacctgtaattccagctactcaggaggctgaggcaggagaattgcttgaacctgggaggcggaggttgtgatgagctgagatcatgtcattgcactgcagcctgggcgacagagtgagattccatttcaaaaaggaaaaaaataaaaagataaaatgatatattttttaataaaactacgtagctgttaatgatttgtttcaattttgtgtgccccgcattgtcagtgggagtacagttgaactaatcttgatgggaaaaaaatgacattattctatacaattgactactcacatattttcccagaaattctccacctagttaaggatctaagataacttcttgcacctataaacagaagacatacaaaagcattcataataaaactgttcataaaaacaaattccaggaaccatctaaatgttcagaagaacacggataaacaagctgtggtaatacagtcatctctatttgttgtttgagatcggttccagacctcccttggatactgaaatttgcagttgctcaagtccctgctaccaaatggtgtagtatttgcatataacctatgcacatcctcctgtaaactttaacttatctcgagattacttataatacctcacacaatgtaaatgctatgtaaatagttgatatgctgtattgtttagagaatagtaacaataaaaatgtctgtcaggttcagtacagacataattttttgaaaagtattttccacctgtgtttggttgaatccacagttgaggaacccactgatacagagggctgagtgtatatagaataaaatagaaaagtatagtagattgtagcagtaaaaatcccaacttttatttatcccttccttaatccatgtgtttagatagcacctttgcttactgactctgggccttaccacatgctttggccaatgggacaacagcaaacgtgtttcaagaagaaacttaaaaaatgcttgtttattggagcttgtggctcatggaaactctgtgactgccactgtttgtacaagcccatgccaactggctgaaaacatgtttttccagttaacgttataacctgagctgacagccatcacttaccgacagccagcacgtatcgccaaacatgtaaggaatgccatccttgagtgtccaagttccacataagtctgtgaggtgattctagctgtacatgtgtgcatagggaaaccagcataataagtattgtccatttaagcctaacctaagttgttgacccacagaattgtgagcttatccttgaacgctcttttaagccactgagttttgatatggtttattatgcagcaaaaaccaactcttgtgagagtaaagggaaatgaccaacagttacatacaacagaattaaattatataacatactgttaattttttttttttttttgagatggagtcttgctccatcacccgggctggactggaatgcagtggcttaatctgggctcagtgcaacctctgcctcctgggttcaagtgattctcctgcctcagcctcctgagtagctgggattacaggcatgcaccaccaagcccagctaattttttgtatttttagtagagatggggttttaccatgttagtcaggctggtttcgaactcctaaccttgtgatccacctgccttggcctcccaagtgctgggattacgggtgtaagccactgcgcccagccagtactgttaattttttaaaaagcaagtagcagaggtctacctgaagtttgcaaacctattaagaagtaaatataaataaacattgccaaaataaagataatgcttaagcatttatatattatgtatgttagtaattaagcaaaaattaaccacaatttcagaatataaagatgacagtgtttaatattttaatgttcttaactagcatatttctatacataaaggtaacataattgaatcgtaaaatgaattaaaatgtacatatttttataccttaacatgctattaaattctccaaaaatataattgaagactgctactaattcatcatatcaaataatgtatatatttaatcagtctctcattcttggcatttgggttatttataactttttattaacaaatgcagtaaacagcttggtatataattttatacattttgagacacaatccccatagaataactccttaaaagtagttttaataaaaatattataaatatactcaaaagttattaatacatttttattaattgcattttggaaagggcaaaaatttatattccagcagaaatgtgtgaggttactttcaatgtttaactcatgcaagcatttggtattattctattgataaactgacaaattgataggcaaaaataacatctcatttttaattaagttactagatgaatgtacaatcttattcattagtcatttgtattttcacatatctgaattatcttttcatgtactttactctgaataccttcttttgacagtttataatacagttgattgggttccacctttcttaattacaatcacattctagtacctgctatagagattataccctcatcaccttgattgtacttcagtgtttctgcagttttcagtcacacatttaaaaccatacttttctcatgattaacctcttattttatgagtatcttattattcctatatttgtacagtgagttttattcctttgaaatacaagaccaagctgagatggctcattttgagttggttcttaataactatataaggcataattatttccataattaaagagcacctcagtagttcttaaagaaattagaagaaaaagttataaaaaaatttatatcactttgtttctacatagactctaccatttggtttaagaatttgccaattgtggaatgaaattagtgtgatcacagaagataacactatttgaaaacttcaagtgaacgaaatgtggtttcaagatgatagattaataacaaaattaaaacaaatggtatcttggtaaacttccttttggtagccaaacttggatacaaatggtctttcattttgtaagttaaagaaaatgataaatgtgaaatgcccactagtctaattcaaagatctattgggtcactcattctgttttgtttttcaatgactaaataaagaggaatcaaaactatatttaggaaaacataaaagacggattaaagtgaaacgaataaaaatggaaataacaccaaaaggtgaaaattcaaggaaattatattattaggctcctgactgtaaagacatagagtataatgaagctaattctttccaagtggcaataatttcccaatgagtttattttgaagtctaacttaaaacaaaatcacatttgctttttcttctgagttaaaactttttggatgtattcatatttttctctgttaacactgtaaaggtacagtgagcacacaggatgagttatatgtagaagtgttcaggtttgaagcctaaagcttttggctaccgcaagtcattcattaggttgggatgccataataaacacccttgaaacagcacatttttcattatatatatatatatttcattttatatatatatatatatatttcattatatatatatatttcattatatatatatatttcattatatatatatttatttttatttttctccatatatatatatttccttacaaaactgagtttagacctgtaggcaattgagagtgcatgaaaacaaaagtatttttgtttttagaaaggccatcaaattagtgctagaagacacccctccctttaggcatacgtgttccaagactttatccctaaagggtttatttaggacaatattttgacttcctagactaccattatgccattattcccatagtactgataggtggaaatagtattaaaatggatgtagctaatcaggaaataggctctacatattacaatagttcttaaagatattaaagataataacttgacatgtgaaaaattgttataagagcactgcaacagtagcataattaaatacaatttagatttgtcctgaatctgcctatcaaaactatttgtttgaaaatcaagtcctttatatctctctgaatatgcagcaagttcttttcagtcagtaatacaatagatgaatattgtactactcacagaaatctttagcattcattaggatttcattatggagttaaggaggaaatagagaaaaggaattgccttctgtcaaaagaatttacatgtagtttgcttcaggagactgattgctacagagagaaggggaagataatgtgatttgttaatgataaccaaacagtattgcggacaacctcatcatttgtagcttttattagattgtcattattcaatgctaagaatactttgcatttccattgttactcacactttcagagagtctgacatgcttcattcctacagcccttctgcctttcagttgaaataaccacttggaaataagtagctgtaattaaggtaaagggtgacaaataaacatttgcttaaacacatacgcatatacagaagttgttcctctgaaaagctgtaatgctctgggacacctgctgggtaattgtcggtttgatccgggaggtgagtgcaggaatcgtcatcagtctttgttttccactctgaaagatttacaatttgcatgttattgtttttgttggcaaaggcatactcataaatctatgaagatcatttaagaggcaaattgagatggctcaagagaaatgttttgtaaaatataatttgtaatttttttttttgtagtttgtttagagttcaagcctagaacagtagattcccaaagctacagggtcttaagaactatctggagattggaaaagatcactacaaatcgtagtgacagagacaggagacagccaggggtctccagggaaaccctgccttcaagtctacaacagcctgaaggctgaaaaactggactgctggttctggatgaagcccaccctttcctgactgattctccctgagcaatgcccacctgcgcactgggaggacagggtggagcttcaggaagtttgcgctggttcgcagtggggaggagcctggcctcttcagttcctgggtggtgacctggaattcaatctgtgaggcaggaaacatgctagcgggactctctcttgctttgctgagagttatttttccattatccttttcacccagtaaattccattttcctcacccttctttatgtccgcgagccttatctttcctggtcgtatgacaagagactggttttagccaaactaaggagaaaattctgcaacggtagcaagagatagaatctattactgccacttcttccaaccctccaaaatgactgtgcattcctacccattaccttgtgatttgcaatgcttccagtgggaggatcatatattccttccacattaatggcatgtgagcaacactgaacagatttatgaaccaaaacatacctttatcacctctcttactctttttcctttaccctgagatcagtgttgtccaagtagagcttcggtttctgtcttggtcccagacttcatggagcagagaaaagctgtttccatagtgtcttacctgattttctagtcaacagttgccgttttataccacaaagttcggagtatttttatggaacaattaatggcagaatattaattcacttatatgtaacactgagcatgtattttaaatttgaaatatgttttgtttcttctgaaaactatatttgacaatagtcaactagccatgaacacagaaaaatttacaagtacattccccaggcagtcagctcagactgatactggctcaaggtactgaattttttttttttttcaatttattttattgtggtgaaatgcacataatgtagcatttaccctcttaatcatcttaagtgtaaagttcagtcatattaaataattcatactgttttacaaccatcacctccatacatctttataattattttcataataaaacggaaactccatatacattaaacagtaactccccatttcctccttctcttggcaatcatcattatactttctgtctctgtgatttggactactctaggatctcatataagggaaatcatatagtatttgtctttttggaaaccggcttatttcacttagtataatgtcctcaaaattaatccatgtagaatatgtcataattatacttttttctaaggttgaataatattttatggtatgcatatgccacatttggcttatctagtcatctgttgatgtacatctgatttgtttccacatattagctattgtgaatattgctgctatgaacatggttatacaactatctctttgagatcctgttttcaatttgttttggtatatactcagaaaagaaaatgctagatcatattgtaatttcatttttaattttttgagaaactgccatactgtttttaacagtatatatattttacaatcctaccaacagtgaacaagtgttccaatttctccacatcattaccaacacttgttattttctgcttttttttttttaaatactagctatcctaatgggtgtgacgtgttatctcattgtaattttgatttgcatttccataataattagtgatgttgaaaatctttttatgtgtttattggccatttatatatcttctttgaagaaatgttcattcaaatccttgcctatgtttgaatatgtttttttttgttgttttcaggaattccttatatattctatatatcctgtatatacatatacaggataaaaattctctctctctctctctgtgtatgtatctcaaatattatattttgcaaatattattttccattcttcaggttgcctttttactctgttgatcttgtctttagttacacaattaaaacaatatgaagtccaatttatctgtatttttctttgattgcctgtgcctgtggttttatatccaaaaaatcattgccaaatataatatcattaagttttgccctatgttttcttctaagagttttatagttttatgtcttatatttagatttttgatccattttgagttagttttgcatatggtgttaggtaagtgtctgactttattattttgcatgtgaatatacagttttcccagcatcatttattgaaaagactgtcctttctctattgaatggttttggcacccttgtcaaaaattattttttgacatacatctcaacatttatttctaggcttgtattttatttccttagtctacatttctgcctttatgccagtatcaggctgttttgattactatagctttgtagcaaattttgaaatcatgaaatgtgagtcctcccactttgttctctttcagtttttttttttttaagatatctgtggtaccttttaattacatatgaattttacaatagatatttctatttctccaaaagatgtcattgggattttaatagaaatggcattgaatctgtagatcactttgggcagtattgacatctgaaaaatattaagtctttcaatcaatgaatagaagatgtgtttccactaatttgtcttctttaatttctcagcaatattttgttgttttcattgtacaattctttcatcttattgcctaatttctaagcttttattctttgcgaattctatgcaagtgaaattattttattatttttataatttctttttcagattgctcactgttagtgtataagaatgcaattgatttttgtttgtttagctgaattctgctactgtgctcaattcatatataggactctttagagcctcctacatataagattgtaacatctataaaaaggaattttttttcttccttttcaattttgatggcttaatttctttttcttgcctaattgttctagctagaacttcaagtactatgttgaatggaagtggtgaaagcaaggatccttgctatgttcctgttatgacagtaaaaccttttagccctttaccattgtatagtatgtgggcttttcatatatagcttttatatgatgaggtagttttcttttattcccagcttattgatagggtgttaaattgtgtcaaatgctttctcagcatcaattgagatgatcatgtgtttttccctatcagtctgttaatgtaatgtattacacagatcaattttcatatgttaaaccatccttgcattccagaaataaatcccacttgatcatggtctataatcctttaaatatattgctgaatttcatttgctagtatttgttgatgattttgcatcagtgtttataaaggatattgattggtagttttcttttcttgtggtgtctttgtctgactttgttagcaagtaatgttggcctcatagtatgtgttacaaagtgttttcccttctacatttttcgagaaaagttggagaatttgtgttagttatttaaatgttaggtagaattcaccaatgaagccatcagatccaggactttttttattactgattaaatttcctcactagttgtaggtgtatacagattttctatgtctttgtgctttagtgttggtagcttttgtgtttttaggattttgtccatttcatctaaattatccagttggttggtatagaatttatcataacactctctataatggtttttatttttgtagaatcagtagtaacatcccaaatttcatttccgattctagtattttgaattttttttcctagtccatatagctaagattttgtcaatttagttgagcttttcaagaaaccaactttcgatttcattgattttctctattgctttcctatttttaaatttcatttatgtctatgtaatcattattattattttttcctttttctaccttggcttagtttgttctctttccattttcatgggttataaagttaagctgttaatttgagaacttatgtttaatgtaagtgtttctagctataaatttccccattagccctgcttttcattgccactcatacggtttagtatgttatgttttgattttccttagtctctaagtattttccaatgtcccttttgagtttgtctttgattcattggctgtttaagagaatgttgtttaatttccatgaatctatgaactaacttcatcctattgtggttaaagaaaatactttgcatgatgtctatctgtatctttctaaaatacatcaaaacaatttgtggcctatatatactctattctggaaaaattcccatatgcactagagaagaatgtatatgctgtttttggtagaatgttttgtatatgtctgctatacctagttagtttattgtgttgttttaatcctatattttctcacttagtttttgtctggttgttctatccattatcaagagtaaagtattaaaatctctaactattatcatgaaactgtttatttctcccttcaatctctatcctttgatattaatccagccactcctgctctctcttggttactatttgcatgaaatatcttttttcatcctttcacttttaatctatttgtgtcattggacctaaagggaacctcttgtagacaacatatagttgaataatttttaaaatctattctgtcaatctctgttttgtgattagataatttaaaccatttatgttgaaagtagaattggccctctgtatctgtgggttctgaatttgtgaattcaacaaactgtagatcaaaaatattaaaaaaatggatggttgcttctgtactgaacatgtatagacatttttttcttaccattttacataagaccatttctataccactttatataagagatgttggtgtcagtggaatttggtattaatgggacattctgaaaccaattccctgtggatattgaggcacaattgtaatcactgacaaaaagggacttctaacattttgctatttgttttttacagccttataggtatttatttcttgtgttaatgtctccttttatgttgtttattctttgtaataaaatactgaaattcttttttattccttttgtatatattctacaactatttgctttgtgactactcaatatcgtaaggatataccactctaatttgaatatatatcagattaatttcaacagcatataaaaacgcttgtcctttagcgctcttttccaacatctttcagttgttggtgatatcacataattataacgttacatactgtgtgtcccaaaacataaagtaataattcttttagatgaattagtctctctaattttatagaaaacaagtgtggaattataaaccaggttacaatcatactagcttttagactaataattgtttttttaaatatattagccttatatcttttttggatatttatatttaggtttattcaatacatagaatattattaaaaaacaaaaagtggaattataaaccattgtaacaataatatttatcttataattgctcatatattcaccttgactgatataattacatttcttttttattttttttaagatggagtcttgctctgttgcccaggctagtggggccatctaggctcatggcaacctctgcctccctggttcaagtgattctcctgcctcagcctcctgagtagctgggattacaggcatatgccaccatgccaggctaatttttgtatttttagcagagacaggatttcatcatcttgtccaggctggtctcgaactctggacctcaagtgatctgcctgccttggcctcccgaagtgctggaattacaggtgtgagccaccatgcccagcctcccttgagcatttcttgaaaggcaggtctagtgataacagactgtcttagcttttgtttgtctagaaatgccttaattttctgcttacttttgaaaaacagttttgccagatataggagtcttagttagggggaaggaggaaaaaaactaaaagtaaaatttttagattatttattctgtaacttaccaaatgccaacaaacataatatggtcatgtcttatttctatcatttataatttaatacttatattaatatttgtttgaacattaagctaggctttgtgttccaatcttattgaatgccatctctagaaggtggtgtatttttattgattgaccattttattaagtggcagagaaatacattatatttgtttttgttagatatttaactttttaaaaagcatcttgcatttatccatattcatattgctataaagaaataatggagactaggaaacttataaagaagggttttaattggctcatgattctgcagagtatacaggaagcatgattctggcatctacttgcttctggggcagcctcatggaacttacaattacggcagaagtcaaagggggagcgaggcctctcacatggtgggagcaggagcaagagagagagaggggaagtattacatacttttaaacaaccagatctcataactcactaactattgtgagaatagcaccaaggggttggtactaaaccattcatgagaaatccacctcatgatccaatcacctcccactaggccccaccttcaacattggggactacaatttgacataatatttggtggggacacagatccaaaccacattattctgcccctgacccccaactctcatgtccttctcacattgcaaaatacaatcgtgctttcccaacaatcccaaaagtcttaactcattccagaattaactcagaagtccaaagtccaaaatctcacttgagacaaggttagtcctttccacatatgaaataaaatggctgtgaaataaaaagcaaattagtcacttccaagatacaatgggggatacaaacattgggtaaactttcttattccaaaagggagaaatctgccaaaagaaagaggttacaggccccatgcaagttggaaaaccagcagggcagtcattaaattttaaagcttaaaaataatctcatttgactccatgtcccacatccagggcacactggtgtgaggagtgagctcccaaggtcttcagcagctctgcccctgtggcttcataaggttcagccactgtggctaccctgaaggcctggtattgaatgcctgtggctttttcaggtgcaggatgcaagctgttagtggatctaccattctgggatctggaaaatggtggcgctcttctcacagctccactaggcagtgtcccttggagaactctgtgtgggggatctccacatttcccatctgcactgccctactagaggttctccatgagggctcagctactgcagcaggcgtctgcctggacattcaggattttccatacaacctgtgaaatctagacagaggctcgcagcctcaactctttcatttttcacacccagaggcttaacacctctgggtttggaagctgccaaggcttatggcttgcattctctgaaacagcaacttgagatgtacctgggtccctttgagccatgactggtgctagagtggtcaggatcagggagcaatgtccccatactgtgcagggcaatggaagccctgggcttgtctcacaaagccattcagtcctccttggcctccaggctggtcatgggaggggctactgtgaagatctctgaaatgctttccagtccttttctccgttgtcttgattatcagcatttggctgataacttacgtaaatttttgcaacgtgcttgaattccttccctgaaaatggtcttttcttttctaccacatgtccaggctgcaaattttttaatcttttatgttctgctttccttttaaatataagttccaacttctggtcatttctttgctcatgtgtgtgagtgtagattattagaaatagccagataacatcttaaatgctttacttcttagaaatttcttctgtcagataccctatattatcattctccatgttcaaagttccacagacccctacaacaggggcacaatgcagccaagctcttttctaaggaataacaaaaatgacctttccttcagttcccaataagtttttcattttcttctgagacatcatcagcctggacttcatcgtgcattctaccagcattttggacataaccattcagttagtctctaggaagttccaaactttccctcatcttcctatcttcttttgaaccctccaccctcttacagcctctgcccgttactcagagactaacagaagcctctttcacccctaaagaagaagggtgaaaggaagattctctaagacctgatctaagacctagtaataaggacaccaggctggagctgtatctatgaaaaacatgtcagagatgccaagtgaagcagacaaggaatgtggataaagaaagtaattccatgcttctcctctctttatttatttattttttttccaattttcctttcagtgcttcctatggaccaaaccaacatgggaatcaaggagcacagaagtctgagaaacacaatttgtagtgaaggagtgaggaaaagatctgagggcaaaatgacaaataggctcataccctaaatctaacaaagaaacacatggaaactgcacgtttatgcatgactactgagcgagaacaagataattgaatctgtttgcttgggctcacttagcgcgtagttgcatttataacttacaaatgcctaaccaaattgcaagttggatggagagtgaggcagaaggtcaattctgccccagcgacttaattaattgaaagcaagaaaaaaatgaaggcatatagcacatatgtagagaaagtaaaggagaaaaggaagctacctttttctgtgtagggggtaagaacatgctttcttttgcagatccacgaaggtgaaaatggaggagggcttaagaacagggaagagctggggcatggaggaggcaaagagaaacaggtaaaattaattccttcaaggaaaatgggggtggaagtaacagtgaaaagatatttattggctgaggcaaattcgtgggctcaggtgtaagctgttctctcaacacaacatatccattgaatagattcatttacttactaatcaatgctcaatacactattcttgggcacttcggttattcttccctttatttttcatttctttgattatgtttgtttagaaattttcccaaatgtttgtttattctttttccaaatgtttgtatgctttttgaataacttaaagttgtcaatttttcatctattgagatattaatgattttcttatgtagttgtatatatcctttatattacatagtgaactttttaatatatattataaacatttattccaattttattttgacttattttaattaatttttatattgagaagcttaaacatttaatagttatatttttgaaatttttactgtcttccacattttcatgtaaattttgatgaaacataatatacatatagaagagcacatatgttacaaatgtgtaagccattgaatttttacaaactgaaaatataatcagcatttagctcaagaaacaaaacatcatgtagtactcccagaggtcttcttgctttcctccagtcataaatcctcatctttggatggggtaattgttattttgatttataacagaatgtattaattcatcctgttgtgtttagataaatagtatcaaacaatagatacacttttatgtctgatttcctttgctcaagatatttatttcattaatttatactattgattatagctgtatatcatttagtttcattactgtatgatattccaaagtatgactatccaatttaggtatctattcaactgctgttgagtattggagtattttccagttggggctattatcaatagagtttctaggaacatatttttcagtaaatgtatttctcttgagtacatcctagcaggaaaattactggatcctagaatatgcctatgctcagctttagtttttccactgtttttaacagtataaaagttggaaaaatatctcttttcatttccacttcctcttttacttactgtttgatattatatcaggatgtatttttccaaagatgtccataacagtatttctcatcccacatgctctttgcaatatgactttgccaaccttccatcaaattgagtggtctatagccctttctggtaaatttgggcagagaaactacttcaaaatagaaagtgaagaaataaacatatatgacttctgagactatgtcttagaagttaacagaagttctgccttatcttcctaatcacttgatgtttagtcctgaggctccatgtaaaaagtccaactaccctgaggcttccatgctgtgaggaaacccaggacctgtggagagaccacgcaaagtggccctgatgggaagcatcaactgaattcccagtcaagagtcagactaatcaatggagacctccagatgattctagcccccaaacaccaccacctgttcagccttctgatgaggtcctgaatattgaggagttttatatctctaaatttaggagtgatttgttatacaggaagtataactggaacaatagtttaattttaaattcactaatccacttgtaatttaactttatgtatgaggtagtaattttatgcatgaagtagttgccttttttatttcatataattatatcactgaccccaagtattaaaaatattttcttataataaattttaatgctttaacttcttctttttggtatattatattctataaaacctatttctgcatttttttactgttccattaatcatttatctgtctacaaatatgtaagtatcatactgtaaaattatttagtttttattatatatatttttttttcgagaaggagtcttgctgtgtttcccaggctggagtgcagtggcgcgatcttggctcactgcaagctccgcctcccgggttcacgctattctgctccgtcaacctcctgagtagctggggctacaggtgcccgccaccacgcccagctaattttttgtatttttagtatagacagggtttcactgtgttatccaggatggtctcgatttcctgacctcgtgatctgcccgccttggcctcccaaagtgctgggattacctgcgtgagccactgtgcccggcctactatgtgttttaggataaaaggacattacccttattacttaataatttttagatattttctttaggagtcatacttgttcattacttcaggtgaatatctcattcttgacgaaacaatcaattttggttttcttaatgtcaaaaaatgttttgtttattttaataaagcattaaagccattatgtttaaattgaaaataatttttagtaagtaatgaacctaagaataatgtaacatattctgctatttaagaaagtataagattctgcctatttttatatggttgtgtaaaacaggagatttaacacagtcagactagatgaccattgaggttttctactagctttaaaattctaaattgatatacagtgaatttcccttccataaatagcagcttcacattaacattgtaacattggaataagatccctccataattgcgcatgtttagtagatcctcaatcctgggctttgcttccagtagtggttgctctcttatgcttaatttcattcttataattttcaaaattttgtaaaaccaaggctgagggagatagtaagcagctaattcatagagtaaagggttcctgtcaatgacatttatttgcttttacttttaatctttatacaactctaaaaaatgtatatattttttattaacaggtgttctgattatcacagccaagtattaggttttatacttcctttaattggtagaatgtgttattcaccaccccgtaatcaaaagtactgattctaatggggtgtagaggagaagaactcctttaataatccaagagttcttcactcctatgtgtgcagttaattaatttatttccctcgtggaaatcatagatttttcagttcactgtccatttccactcaaggtaaaaacataaaggtcagcaagaaatggttaatgaccagaaaggctgcaaactaaggaaatttagaaagtgtgaaattgtacaatttcataagtctgttatttaaaaacatatcaaagtttgacaaaatgctcaaatttgccaatacatgacatgtgagtgatctaaagtagatttttgcctggtgtttttttaggtataaagaaatatgtaattcacaggaatcagtcgagacagtacaatgttggatgacagacagcttttgaatatataaagttcagcatttccccaattgggtttaaacagacttcccctaggagcagtttctgccatagagtatttattaccttgaataatgtgacagaaggaaatggaacaaaggaaatgatttttaccaaataaaagcagccatcaactctcaaaagataaactgtccatattttaggaagaatacagttcagtagaaaatactggtgttaaaagtgggagttgaacaatgagaacacatggacacagggaggggaacatcacacaccggggcctgtcggggggtggggggaaaggggagggatagcactaggagaaatacctaatgtagatgatgggttgatgggtgaagcaaaccaccatggcacatgtacacctacgtaacaaaattgcacgttctgcatatgtatcccagaacttaaactataataaaaaaaaagatatatatagagagaaaatactggtgttttaatgacaatttggaaaagcagtttttatttgcactgtgcaaagcaagcacacatatttagtgtttcaactcaaatatccacagctagatgtctaaaaattgtaaaaatccacaaaatggtcttctttttgttagctctgcctgaataaacaaggaggccaaactccctaaacacagtttctcagtacaggcaggaacagtaaataagagtggctcttagagaaactaaggcaaagatgaaagctcagggaattccagtgggctactagaagctgtcgtattctaccttgctcttcgaagatagggagcctaaatcaccgtcatcaagcttcaaggaaaatcagctgctggctttgttcttgggaggaaacattggttttatcctaacccccaaatctgaaagtggctcaagattactattccatagaggaaaaagcatgtaacaaagaaaagctatttttcagaagctagagcagaaaaggagaaaacttgttgaaaattatttttctgtctctcattttttttttctcttaatggaaagtgtgtgtctcttttctgatccaagataggcttattaggtttgtaaaagagaaatagaatgcttctagggtgggatggagagaaaatatagatgcgaagtcaagtttaaggacctgcacattgatagattcaagtgccctccccctgcgtatcacctacttgtctaaaatttcaaatacccctttttatgtctaaaatcattcttaaaaatattaaagtctcttctactttaaagcaactggggtttttattgttaaattatattattgcttggcaaaatcacatggcttacatttattgtcaagttgctcaaatgcacttggcatcagaactgcagttttgtctaaaatctctgtggttgattttgaagatatacagccttgattgtaagactagtctttaaatgggctgattctccactgtgcagctgccgctccttttatggcttctgagtgtattatattgcttacagaaatggaatgttcagaggcaacaagagataacgtattagaagccatgtagatcagcatatatgtatcaattttcaatgtgatttcagagtactgctgcaaaattccgtgcaatatctcatattaggtacctgtagaagtcaacactcatataataaataattcaggaatgctaaaaattattatgcacttagacaagtaaccagtaaaattctagacataagaggaagcaatagtaatcaatgtcatttatgatatcatcttcctcatggagatattcatggctccttggttcattgaataaactctctggggtttagctttattaacataagttgtcataagaacacttatctcaacctaaattggaaaaatggaaatgctcaaattaaactcatatttaacatatgaaacttccagacaacattccgctgacagtgaatataattcaaatatattatattttcttatgtttagtagagcttttagctatctgtctcaaacatgtgaaaatgaatcattttatttttggccctgcaatttaaatgatgcagtgaagaagaatcttaagttttttaagtttctcagcaaaataaactatttattggtcaagaggctcataagaatgcttttcccaaaaagcttcattttttgagaaataaaaataaatctcataatttaatatttatttttcacaagataaatcatcttttaaaatatggctctgtattttgaaaagcccatctttagtttaacagtgtctgattctgactccgtgagcttcaaccctcacttagatcaagtcttgggcataagtcatctgttgtctagggcaatgtcttctcctaggagcaagagctccttatactgcgaaaagctttttcatacttgctatccttccctcatacttttccttactttttgattcaactcacatcatcctcttcagcagtcactaggacaatcttttgattccaggtggaatcttttgattcacaaaagaaattattttcaaaaggaaactccttatccctatggggttataagacagccagagcgaaatttctattagattaataaacttgtttacagtctatcatcaggtttccatgcagttataatagttgtgatcctaagacactgaaaccatgaaaaaaaattgatgaatatatagtttagataatctctctactggtattcacatgttgtttctctatatatatttgccataacccatatccactagtctaggaaatacagtttgtagtagaacagtgctgtcagcttagtaaaaagtcttaacaattctatttttgtgaaaaagatgcggtgagaaggattcgtttctttttatttgctatactaaagatattctttctttatagttctgtctttatatttatcagtgtgttggaatgatatatttacccaaaatgttaatattaaagattagtgaacataaaaataacccattcatttagtttattaaaagataatataccagattagaataatagaacattatctacaaaggccaaatcatcaataagtgtctaaattaggaaaaaaataataaggatgttcataagtgatgatgcaatttatgcttttgttattgacttaaaccattttatttattaaaatgtctgtatttcattgaggtacagactctaaaattaaaaatgtggctgacctatacaggagttttagaatttcacagccttgcatttcacagaagatgtctagctgctacttccataccctgactctgtaatgaacacataagttagactttcataaagatttatctttaaaaataatcatgtagattgaaccctgactaataaaattcactaattgtcttgccttagtgcagctattggtcagaattaaatatttagcagctccatctttttaaggctcttttccagtgtttctgtagggacattggtgatgtaattggttgctttggtaaggaagtaactcattgagtcactcagggttctattatatgacaataggatgtggcaacggttagggagaaacatttatctgctctttcattcacagagcaaagactggggaggagactgactgttagctctcttagggagaatattgcataattttaaaagaagatagctagtgggttatgagtatgataagtacaaacatttctatatgctttcctgaaataaatgattttatgtaatgatatataaaacctcactgatatttatgaataaatagtataaatagtaatttataaatagtaatgaataaaacttcaatgtagattaaactatgtgtctcatttagttactgtgatagcaagattatagaacattgcagatgacatgctttttcataaaacacactatggaacaacaacatctccctccaaaaacaacaacagcaaagtacattggcttattaatgcatttaaataactgagtaaaattgtaaagttcatacaaatgtcataataatgtagaatcccccaaaatatcttacatctgattattgcaagttcttatagcagaagcaagatttacaagggtctttacctgttttgatctgagaaaaatgttacttaggttttcctcgctatttaaaaagagaagtaaattgttttatttttcttccaaatgaaaaaattggtaatacgccatttctattctctgagaagtgagcatattttcatgtggtatgtgcttcctttagatatgcatcaaaacattgacataacatgcaatttaaaagcatctcttgatgcactacagtgacaggtttaattcatattcgttgcttacatatagtactataatgatgtaaggttaaaaacaaacagtctatgtaggttatttcactgatgtgcattttcctggggaaaaatttaaaatttagcaaaatggctaattcacttgcattattttgtttgcatcattgtctttttgtataatttaaatggacaattgataaagagcaagctcagccaaaactgcaacagatgttgcccgtcatacttgtgggctggagaccaaaagccctttcacctcttttacagacccttgagaataaagtaattgaggaatttgggaggctattgattgaaagctctgtggtatctccccatgtgcactgagaccaaaaaggcacatagagaatgagcttggtctttatttgctttgcaaagtgactcaaataaagagattagagggaaggggccattgtgtcccaaatttaggttgatacagatctttagttcttagtatttttattttcagattgccaccaaatgagaattttaaagaatagcaacctctacaaaagaaaagtagtgttattttcttatgagaattaaacagaagcaccataaacaacctgctagttcaaatacatatgctatagtgaatattttttgatttaaaaaaaatcctgacccacaaacggagggtttgaccattaattcgatccattactttgatgctgcaaaatgctttttcaaggataatgtagagtgaaaaatcagtgaactgctgtggtcttaaatatgagccataatggtatatggaaactcgtctttcttgtaaaagttgttattataaaacccggttacgtttttaaaaaataaatgttaatagatgaactaaataatttcctttgactgattcagatgaagaatctcaattttttggcatatttattggtaagcaggtaatatggcaaagtagaaaaaatagcactagtgagaagtagtaaaaggggaaacagtacatacctattaaaaaatagaattttctaagcaccaaatcagacacataaactattttaaatttattcttgtttaagaatacttaaaaatctctgataagagcagagatgtaaatgaatatctttttgacatacaaaaccaatatgtgaataaaactttgctgattttctatgtaatacaaatcctttaaaaagctaataaaatgattactatctacaatttaggctccctgcacatgatgaaatgctgaagcatattctaatactcttagaaagtgcttaaaatcttcaaaagtggatttaagtgctcaatcactttcgcttctttatggaaagagtgacgaatttttacatatagggtacccatgtgttgtttacttccaatctgtgaatttcgaaagcaacagaagtagaaggaaaaaaaaaaattcaggaaggcatatcctgtggatccgccttcttgacacataatttgtaggtcttgatgtggctgcattgataaaatgctgggcgtgtaatgaagtgaaaataaaggctgcccactgcctagctttcgaacaaacttagattggctatgtgttcacaaatcaatgcttttctcattgaaagataatacattttggtaatgctggagaagttagaagctagagaggtcactgcagggggttaaaggaaagctacaacagtagtcagaacagcaattattcctaaaataacttggtttgacaaaaggagtaacagtgttactgggctagaattacttttttactttattatgcatattagtaattagaagaaaatgttggcagaaaccaaaatttggaaagagaattttcttgggctgtctttctatgataataaaacatccaaggcaaaataattagtcagttttgtctatacggtgccaaataacctatatcaagtttacacaaagccaaatattgattatttatgaatgcttaatgtgaatctgttcatattcagaagtcaatctgagaaaaaataacaacaaaaaattaggtaccttaaaaaaatttgtgatatacaattgataaattagtaatcacttctggggaataatttcacttactatttgtgcatgtagtccctaaacagcccagaaatagctcaaatcttctagtttataacttaagaaaaatcacgtaagaaaatcccaaataactgtaaacagaaagcagagtagaggtttgctaaatctctggacaaccgcaacgttttctcaggactgctatgaagacatttcttttagtcttctcatttttttttaatacaaagtaatacttcatacacaaaattatgctaattcctggtcatgcttctatacaccctctttcctttttttttaatagaacaagtatctcatctgcttgtaattggcatgctgctgcctttttgagacctttgtccactgaatatgatatcatattttttttttgttagaggagagcatcttgctctgttacccaggctggaatgcaatgatgccatcatagctcactgcagcctcaaactcctgggctcaagtgatcctcctgccttggtctcccaaagggttgggattactggcataagtcagtgcacctggttggatattatttctattaacaccgagacaccttcaaataatcagtaagcaaccccaccaccaataataaaagtactttttaaaatcttcaacaactctacattgcccaacagctattgacttccttctcctctttacaggaaaacctttgtaagagatgtgtacacttttttctccatttcttcaccttttgttcaacttttttacctgctgtgaaatggcttccactgcctaaatttcaccaaaactgctctttccaaggtcaccagtggaatactagttgctaagtgtaaattactgtttacatttttttctttagctctctgcaccatttaactctatacaatcctctctgttttgaataatgctatctttcctcctgagattcagtggtggcacattctaccaacttgatcttacttgtctgtttacttcttaatactatttttattttagactcttctctcttgaatattagttcctacatgattgattctgccttagaacctcttcttatcttactctataactcttgcaggataatttcatctactcctagtgcttccatcatcatctctttctaatgattctctatattagtcaagaatatattcagttacaaacaaactaaccaacaaacacttttgctactgtggcttaagtaagagaggatatgctgctgttgtcattatacttattattattatataatgtaaggtctaggagggagacagggcagggcttatgccaccatctcaatgtttccctttctatctttcttgtctgtcatccacagcatctagtatttttgtcctcaggtttacattttagagttcaggctttaggtctaagttctgaactttataaaaggaggaaaaggaagaggagtcacattagaattttccttatgtcttactggccataactgtggcacacgctcattcacacctttattggagggtaagaaatcaagttttcattttaatagcttctagagtagatcatgatgaaatagggctaaatacgctatttgattcaactattctacaatgtttgctatcttcccagatatttcttctgatctatcttgatcactcctttgacctccagactatctatctatctatccacacatacacctccagaatatccacgcattcacacacactagcatgttcacaatcacatgttgtcatttggctgtcccttctacaactcgggcttgacactacagttaacacttctctgtcctaaaacccacttgttaagtcctgacaatcccacccctatcaattctaatactttctatttccactattaatttctgtttgaacactatcttatccactacaaaaactgtttccagaatttttttctccttaaagtattatctacataacaactgtaatgatctttttatatagaactctggttacagatagagatactatgtgtctgtgtttctgtctttctttctctctgttgatcataccagcaataggagacattctccctgtcatttgatagctaaatatcttctgtgtagatctaattctctgtgacagggttttaaggtctacaggtggagcaggtaggaagaatggccagaaggggagaaatagaataaaaactctgttttctttttcccttttgcttctggatttaactgctttttctggggagcctattcctttgaagttactgtgtactgtactatactattcataaattaatcataagtcatacttaaatcttcttttggctcctttttatcctcagtttgctcaaacttagagaaatgagtgattagcaccctcaatttttcaaaattttctaacctgaatttagttcctaagtgatccttgcatgtttgaatggtggcggaaatgtttctaactcctttccataattctcagaaacattctttctctgtgttccctaactcagttggggttgccagacttagtaaacagaatattttaagtggcaatgcaaaccccattgcattgcctaacacctatccaggttcctaaggtacaaactgggtatgactttgaaacttttctttgctcttcgctttcttttcgttatttttcctattcttcctatcaaaatgctctcagatgcctctaattcttgttttcttactgcccaaaccctcaactaaactgtcataatctctctcctgtcttatttctggaacttcttagctgctttctctgcctactgggcttacttcattccatttctctatactgtagccagaaaactcttcccaaagtgctaatctaatattacaattttatttgctcttttggatgaagttcaaacaccttacactggcacgtaaattcatctgtggcatgggctttgttcatttttctagaactttctatcagcactgtaaagaataaaagaattggaattaagcagtaggagagggaagtgatgcaaactatttcagatcaaagaaataatataggtgagagagagcttggcatattggaagatgtaacaaaaggtaaatatagatggaaaaggaggaaggagtgggaatgaatgtgggtgatggaagaatacagtcactgattcccaggcttttgcaatctagagtctttttttcctctgggaaacttgccatcagcttagaagaatgggttaggtatcccttttatggtttccaatagagtcttacccttttccactgcatcccgcactgcattctataggaactgccagttaagctctctgccaccctgcactccctccccaccagtttatgttcttcatgaagatagggccgtatctgtcttatttatttatcctcaccactttgcacattcctttgattcaaggtactcaggaagtatttgttaaatagatgaatgaatgcatttatctatcaggaaaaaaatctcattatgttattcctctgctgaaaacttgtttaaacttggggtctcagaaagcaaaatgtgagacaaaaaaaataatctgctatagttttattaaggaatgtaactatagaaagctcaagtgaggaaaaaggcaaaaagtgaagtgagggaagaaaggagagccaatataaaggtgaaagctggctaccacttagtatcaagagcagctgtctgcttaagttcatggatttcagaagctgtattaattacagggtttcacagccattcttcttgggggacataagggaggagaatatcttccaccttctatatttcactagtcaaagtttgtcccagtactgtttttagatataaggggctgttgtttggctcctacattttgtagagttccacaccatttacttccttctctggctgggccttcgcccacaaattgaagagttcattcacctgggggattgtctatacaaaatacatgcccggtcagaatgcatgccctccttttctgaccacacacactctgggtacctggaattcactgcccaaatagctgcaacgacaattcttcttcagcttgcacgtctctttccttagtctaccctcccatgacagactaaaaaattggtttctgtacctccaagcctgagaattagccaagaagcagctattggtgtggtgcatggacccagcttgaatgtatggtttgagtgttcatacaggtacatataaggccactcacagtgcaaagctgctgagctaatcaatggtagagagggaatgcaagtgggctcataagccctggacagtgtaatatgtttttatgctgtggtggcttaaaattcagaaatctagaaattctttgacacatttccaaattttgaactaatttgttacaaagcaataggtaactgatacatgtacaaaacaacaaagagtctgaacatttttatttcaaattgtccttcacattgttattaaggtaggatgatggaacatatttaagagcttgttaggttaattttcagttcttagtatttagtacctttagatgtgtggaatgacgcatccatttgtactcttgtcctctaaggatgggcctaaccttccccacattcttggttgcacttcagaggcaacaatcatttcctgtgacatgtcgtgcttcaattacaaaagggaagccatggagtgtgaggcaaaaagcactcagtgaaggcttgaaacttcatggtttgtttcaaacatgaatacagttgttcgcgtgtccctgtgtaaaattgttctgaacccacacaaagttgatctctgcagcagtagcttggttggagagaaaaaatggcaggaggtcccagagataagtcagtccagacagatctgcagtggtatagaagaagtgactgatataaaaccctttagtagtcacccatgaccctcaatataaagtccagaccctttaagatctgggtccctctttactgtctgtcttcctctaatgacacttctacatcatgttataggctccagcaacatcgaactacttttgattgcttaaatgaccacgctcctttttttccctctgcacttttgagtatccctttaatctttcaaaaatatttttcactccccttctctcttagctaacccctatcaacaacaaaccctttcagaagccactgtgataccttcataactctttctgatgttctcattcattcttccgtaacacactgcacttatgttattttcacattataatgtaaccacgtggttgcttacagtcacaaaaactaaaatctctttaagggcagagttggtgttattcattcctgattccccagtgacaggcattgcacttgatacttgaaacccatatttagaatgtaaaattttagtgagcctatggaatgattctgtagaaggatttggattgctaaaactctaggggaaaagtgtttgcatttccttttaaaaaatactgtctgagaagtaaaatacaacaaagccagtaatggcccaatgtcttattagtgtacaatggtgttttaaaaagaacgtctttcagaggtactagagatactatcaaatgtgatgtagcaattactatcttaactacaatacatggtgtaaatcaatggtgacattaaatcttgtctaaatgaccagaacatgagctacagctgtctttgtagcacatatttttctttggttgatttcactcccttaaggcttgtagtttgtgaacagaggtttttaatgacaaaaaaaatcagggatcattttatttcagtctttcaaaagtgatctccctaggaaagcctacagtctagaagtaaatacctagtggcttacaaacatattttcaatgactcttggagtgataatctagtagaatagaattagctttttatccatggtatacatatttttaaatgtctcaaagcagtaaaatagtgaatcctcatctttgttttgtgatttcagagatgcctaaaaaaccgcaaatattcaaaacaaatatgtttaatttcctgagtatttttaataggctttacatatggctattctcagagaaagtgatgatctaataagtaatcatagagctcaatttaaaaacattttggaagcattgatattaaatgtaattgctcttcttctgtcccaaagagattaggttaaacattaaaatccaaaagaaatatgatattcacttgtgtctttcttcccttaaataaataattacatagctcacctttatgaaagtactctgcataaacatcatcaactctaaatttatgaatactgtaaattctgtgaatctgtgattctatcactttttttttctggtagcctttctagtgaacacatcatgttcttactgtagacgaggagaggaggtggcgacaaaatgctcatttcacttgagttccttctatgatagagactgtatcatacaccagaatctatcccttttgtagttctaaacctattgaaaataagatttaaatacagtctttttttccatccaacttgcatgttactttttttttctcgatgcaggtaagtgaggttcgattaggtccttatatcttaatcgcttatatcttctatggttacatatacactttagtaaacgtcatttctttttccttttaatgttgtctatttacatgtgacacttgctattcccttatttattttacaataaataaattattaagctattcaaacttattttctgtattttatattgttgcacctattcttattcctatttatcttaaacttattagtaacctatttcaaaggaaagtaaatggaaaatagcattcacttatttgaataacaaatggagcaatgaagaattccaggtataataacattatggatattcagtttttggaaaaacattaatgtataagaattcaagttgtggcaaaatttaaggttacattctcagtaaaccacagagatagatagagaagtggaatccagtgatgtgactaatttagtttctatggcttccatatgcccacttgttatacgaatatttaaaatctgtgttgatttttcaaagtcaaaaaaccttagatgatgctttaatgaatcttgtatcatgggaagagaagggaggaaattttcaaatgccagcacaaacaaacatgaatgctatcattgtttatagaggagggaatcacattcttttatgctctcagtattctattagtaaataatcaatgtaagtcactctctccctggaatataattaaaagcctgctaccaaaatacaagagtgttttatgtatggatatagaaatacgtattctcttaggaataagtgatcctctttcccgttttccctaccccaataaaagagtcttaatctgaggttatgtgcactggtatattcctgtgagaaatgacattttaatgcataggatcctaaagagtttttctatgttagcttgaaacaggtgcaattaatttgtgatcctttcaattatcttgccctaaatgcatgcatttaactggagtatcagtgtagtgtggagcaggaaaattgtagcttcttgaaatctctgttgtattcagatagctggtgtagattcattaggaaaattaagaaaaccagacaggcaattttccaaaacatattctgtcatttgaggtgagttgactgccctccttttccctgccacttcactgcactagtgagggtggtttcatatgatgcagcacagttcccttttaagatgacagggtagaaaatctctaggggacttggactgccaaagccctcaagacctcttcaacatgtccaataaacacacagatcagtgaaccaagagataatagatagaagtctccagcaaaaacagaccattgtagattccatggtgggatcttaaaaggacagaaatattgtagtgactaattcaataatttgcttcatcatgtacttcagaacaaatgcaattaaaaaaactgaaaaattttaagaaatagatatttttggagtgttcaggaaggctttttttgaatttccctttgtttgggaaatataagtttaattaacttttttttttccatgaaataactccaagggaaaaatagaaacataagtagtagctgtcaatgtgcctgggatccctttgcttcatacacatgttcagggcctgtctttctctgtttctcccacttcctcaacttcttttacataaattgtacacggtagatgggagaggtgtttcttttcatttgtaacatatatattcttttgttaattcctggtctagtttaatttatttatcaaatattctattaatttgctcatttcgctattatcttagttctagagtccttatattcaaaatattatagttcaactccctggggaaacaaagacccaaagaggaaggatatttcaatatcacatcactgataatggagattctaggactagatcccaaggtttgcttccatgatgagaggtttgaataactgggttcagggtccaggtctgtcttttcacctctcaatgtcttagttctgcatttataaaataaggtgtggtggctcacacctgtaattccagcactttgggaggccgaggtggacggatcacgaggtcaggagtttgagaccagcctggccaacatagtgaaaccctgtctctactaaaaatataaaaattagacaggcatggtggcgcgtgcctgaagtcccacctactcggaggctgagtcaggagaatcgcttgaacctgggaggtggaggttgtggtgagccaagatcataacactgcactccagcctgggcaacagagcaagactctgtctcaaaaataaaataaaataaaataaaataaacaaataaataaggatggtaccagctgttttgcatactcacaaaaaatgtagagaataagatatgatgatgtatgtgacagtattgagtaatggtaagtggtggtcaggtgtttgcaatatttaaaaataaaaagtgatacaatcatagtacctggacagccctgctttcctgaaggctgctgccccgagttgaataacttcaaggaattttctatggtagagtctggtaatctcaaattataaaacagatttttcaagcaaaatggacaaaagtagatctgtttctcattggcaaactcttattacttagtctcagtggcaaagttaaagtttttcagcttagaaagggaactcttaatgtcatctaatttggaacacctacattagtaatactggcatattcctcctgtaggtaaaaccatagaggaagtgaaattacaatcccaggctttcctagcagtcatggagtcagagttatgggagtcagttaaatgaatcaaatgtttggtgctatcagggatgcatagttttttggctccatttccatgaatgtcaaacaatataaatttattaatcagttactgtgtgtcagtcattgtactaagtactttggaagaattatcttatggaatacttacagccatccttggcagagaacaactttattatacctatttggcagaaaaggaagcaaggcttaggaagactgactgtctatcacaactccagtcatatttcccatgcctcccctgcatgtttgctggcctccaaccactctgcacttctaccagttcttcgaacacctcagcatcctctcacttctaagccctttcactcactattgtctctgctaggaatgcccttctcacggaggttctcatagctatcccctttgctttccagtgttgacttcataaccactcatggggattttcctagctcatatttaagatttccaatatagccccacctaacattttatataccccaaacctacgttattcttttcttacttactagtagaaaacatgctagataattcacttacatgtgattttattgggtatatctcctattagaaaaaaagcttcacgaggatttttatctgttttgtacactactgtatccccaatagaccctacctgactctgtgaatgctcaataaatatttattgagtgattgaatgaaaccacggcccaaagggatagcttgagtggggaaaccatccaggccattaaacattatttattccttctgtgagcagtagaaagggccagtattactgacattgctgctgtgatcttcctcaggctatgaaccttccattactgactaccccccaattaatggatttttttctttcactttcagtcttctcttgtaatttgagaaacagcctttaacagtactgttttacaggaagttctaacatgagaagataacttaattaaggcaaataacacagtaaaattgcttaaaagaggaggaaaattttcatatgaaatcatgaaaaaaattggatttttacattttgaaattgacaataaatttatttcatcttatatttaataaaatatctcataattgtcattaagttctgtcttttcaaagaataatgaattaaatgctattttctataaaaatgtatgataatggtatgacataatggaattctttactttatttggactttgtcaatgtgactgtaagagattcatttttataaaagtatttgaggttaatttatttttttcaaggtcttgtcttgatcttttaatgtcttaatactttccatttagaatgttttgtgttattatccccgttgacttcatctttttctctttatcacttttaatttatctaactgctgtatcttcatctccgataccatgttcaaacatttcatgaaatccttcgtttatttttattgtattactgtgtattaatagatgctgggcagaatcaaccagagactgagtgctgaaggtagaggttagacagataagataatagcagagttaaagagggagggaggtgttaaatatattagtaaaaaaagttaagattttttttctatgcaacttcaaagcatagaatcagttgctgaatgttctaaaaatacaattcctctagtgatgtcttgtaaaatttttaaagggcaattcacttttgctcttattttatccaagagtgattatcatgtattaagctgctattatgtgccaggtgctatgctagcagttatatgtgtacattactctccgtgataatttagtaatcagaaaactgaatctcaatactcagctaccaaatgatagacattctctcaaatgcccccacaagctcctagctcttccaacacagggttaatagatgaggctactgatagttgttttttttcttcttctgttgttattttattattaattttttttggaagagctctgtatagaaggctgctccaccaaatcatttttctcattagtttgctgaaaattcccttattaaaggttcatttccccagatttatgactttaaaatttcaactgtcccctgctttatgccaaagaccagtttttaacagccgagtataataaaatagcaacggatttgacccttgaaaccttgctttcaagtatgagttatttaacctctcagtctacttcttcataaactgaggagaagaaattcatcagaagactttcaatgaaactcagaggaaaaaaaaagtgtgtaaaactgacatggcaagaatatgtaagtcattatgtgacaatctagacaaaacatcttaacctgcaaatggaaatctacttgaaaatcatatagcctagtctacctacctggtaaagattgcctgctcattgactggcaagttgaagaaggttaaaataatataaatagtaacctgaattggggtgttgtacctgcaagcaacagataactgcaaactcaaactttttttttttttttttggaaaaaggggacatttgttattctatataataataattaagatgggcagagcattccaggaatcggcttctacttcacattggtcctggggactaaccttttctattttaggcatcatgctctggtctgggagcaagatggccacacaaattccagcaatcacacttggccaccaacatcaggcaggcatgttcttgcctcagggcttttgtaactgctattcctactgccagagatagcctttccttgtggctaatttccccatgatagtcacgtctctgtccaaaacttactccactgacaaatgtaagttttattttgtgcacataggtactttttggcacactaaagattattcagacatttagtcaatttaaaaaaaaatagtcaatttactaaagttattgcttttataaaatcacattcttaaaaagtttgacttatatactttatgattctatttataagactagtaattataatgattacctttaaggaaactttggttaatatttgttcccttcaataatcttagttatgttccattaaatatttaaggtgtatttacaaatttgatacatttaatttgctcctcaagtactatgtttgtttatctcaaatgaaaaacattcccaaagtaaagcgataatttttataaacatgttgaggtttacatgttaaacaagtcagagagtagagctgtctaatagattacattctctttaacattacttgtattaccaagtacttgtattaccaaatattcatagatttttaaatataaatcgttaacagtatgggttttatgttcttgttccaaatattcctaaagttaattataaatttattgagggtttagagatgactatccaataaggaaataattatataatattacacaatcttcaggaatacctttccaagtaagttttaagggtgctttctcagcttggaagcctgaagtaaccgaaatttaataaaacctgttcacagcccagagttcatgaggcagaggaaaatgtgttcatgtatgtcacaccttgtttttgagtaatatcaacattaattaattaattaatttttattttttgagacagagtgttgctctgttgcccaggctagagtgcagtggcacgatctcggctcactgcaacctctgcctcccgggttcaagcaattctgctgcctcagcctcctgagtagctgggattataggtgtctgccaatgcacccggctaatttttgtaattttagtagagacagggtttcaccatgttggccaggtttgtctcaaagtcctgacctcgtgatccacttgcctcggcctcccaaagagctgggattacaggcgtgagccaccgtgcctggccaatattaatttttaagtgaaattaaaatatcacttaaaacccacatagaaatggctgtattcgttgagtgagttttctttttgtctgctacatgatatatgaacatacctttgctatataaatatgaagatcacaggacattagacaatcctacattctttccatatattcttgtctcttagggttgcacagcaattataggtattaaaataatatccatttgtgttctagtcccaccaccctccaacttttttgtcacaacttctatgtccacttaatatgcagggctttgctgatcacatatattgatacagggtctttttcccacattcctttttatcacttttcctggctttagttttcttcatgacccttttaatggcctgagatattatttattgacttctttatgtttgttgtatttgtttcgttcctctaaaatatgagccctaggaagtagagtgacttggatttcctcctgtatctccaattccttgaagagtgcctggcacataggggtcaatcaaaaataattgttgaaaagatgaaagaatgaaagaggtcagatgtgcttcccatgcctattcataaactaatgtatcggtagagggaatcagactgccacgactatcttaggttgacatgtattctggagctggagatgatttcaattccccgttatgtgagtgcaatggcgggtccccaaacacaatcatgattctgtaggtgaataaccaagaatggtcttaagtgattctaataaccagatttggggaggaagaaaaaggaaacagagtttgttttagggtgacaaacagacatacacatgagttggaggaaaagatttctccccctaaaagtattggcatatcccagacagcctcacagaagaaaccacatgactgattttaccatgccctctgtactagagaatgtagttaaggtgtctcttagtccaatctcatagctcacatcacagagataaaaaaagactaaaaccttaattacttttacttgaaatgtagaaggaaaccattcttattttatgtactggttgtttcactagatttttttcttagataaactataataaagaatataattttctattgataactcttctttaatggaatctttaatagcttaaatactataaggtataaagcactccatctcactttcaaagacattggtaattctatattgaataaaaggttactaagtaatgtaactgatccaactggctaatagagaacattaactgcctcaaaatccctgcaagaatcagatagaaactatattagccaacacaatatccatgtcatactggccttgcaagcagttgcttgagttagctgttcagtatagaacactggcctgggtagttttactatattctcgctttaatcaacagcacctaaatgcataaaactcctctgttgtaagtcaactcatctatccgtctcacacagttattaattcttagattaataacaacattgatacaattattatcccttaattatgcaattagaaagatgccatatagttcagacaggagacaaacaacaaaggggaattgaattaaaaagactaattcgttgactttctcattacaatacttgaaaagagacaaaaatttatgttgatctacacattgtctctgaaaacagatgtatatgaaaatggactttcatggtaagagttaaagaaaacatacagttctgatttcaaaaggaaccttaaaaaataaagtaactttgtgttcttttgataattcaggaagctttatcccagatggtttaaagtatttacatacagtcacataaggaagggcctgaacgagaagtatgattttgacttctaatctagtgctcctgcctccctaatatgcttggtaaaaatccatggtaaaaataaaatctaactgaaaaatagatacatatgtggatacctctcccagtaaagagctttccttcacttcggctaagtgtaaattatggtaacatattaattcaacaaatatttattgaatgatgccatgagtactactcagcatcatgaatagaataactattcaaaaagacaaaaatttctcttgttccccacaaatgtgtgtgtgctttatttgaaacagcacatatactcctatcatgtgataactacatatttaccaagaagatatgtagaaaacaataactatcaatgcagctattactgagtaacaattagatattcattatttacatgaccatagaagagattgcaaaagagtttaattacttcctagtaagatatgaaccccttagattagacagttattttgtatacctaaatacaaggaattaaaggaaagatagattttattaccttttcagagtgaaaggactgtagtgactaagagatctcatttattcagcttcactgggaagtagtagcttccatatatttgaatttcctagatcaggagatccattcactcattaatttgacaaatatttgtggagcacttcctatttgccaagtcctattctaaggacagagataaaggagaacacaagacagttttgccctgtgaagttatgcacttaacagataaacagatacatagatgtgatcaggacaagtgctgtgaagaaaattaatggtggtaagaatttagggagagccaagtctttgctattgtgaataatgccacaataaacatacgtgtgcatgtgtctttatagcagcatgatttatagtcctttgggtatatacccagtaatgggatggctgggtcaaatggtatttctagttctagatatctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcattaatgtcttcttttgagaagtgtctgttcatatcctttgcccactttttgatggggttgtttgtttttttcttgtaaattttttgagttcattgtagattctggatattagccctttgtcagatgagtaggttgcgaaaattttctcccattttgtaggttgcctgttcactctgatggtagtttcttttgctgtgcagaagctgtttagtttaattagatcccatgtgtcaattttggcttttgttgccattgctttttgtgttttagacatgaagtccttgcccatgcctatgtcctgaatggtaatgcctaggttttcttctagggtttttatggttttaggtctaatgtttaagtctttaatccaccttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaagttggattcctaagtattttattctctttgaagcaattgtgtccaacaatgatagactggattacgaaaatgtggcacatatacaacatggaatactatgcagccataaaaaatgatgagttcatgtcctttgtagggacatggatgaaattggaaattatcattctcagcaaactatcacaaggacaaaaaaccaaacaccgcatgttctcactcatagatgggaattgaacagtgagaacacatggacacaggaaggggaatatcacactctggggactgttgtctggtggggggaggggggagggatagcattaggagatatacctaatgctaaatgacaagttaatgggtgcagcacactagcatggcacatgtatacatatgtaactaacctgcacattgtgcacatgtaccctaaaacttaaagcataataataattaaaaaaaaaaaaaagaatttagggagagcctgagataggcactatttcaaacagtttggtcatatttgattcttctcagaatcaaaacacactttttcatgagtactttacaaaaatattgcaaatacatagaaatactttgtaagaattggcccaatatgaatgcttcaaaaacataggtaattttagtgttaatctgcaatgagaatgcaatttaatgataaccatttaaataaatatatcaataaaataaaatgtatatgttgcaaacagaatattctatctgaaaaaaaaagaaatattcatatcttcttacctcaagaccatactcctaaaatcctaacaatgttttttattgctccagaagttgaacatggcctaaaacacttttcttggtctagtccttggctaacagtcaagtatcatactttcacatgctctcccctttgtgctttctatgtctattaaatattgtttgggagagatgttacagattattaaaaattggaggaagaaaacatgcagtgtacattctcgtgaaaaagtgatagaaaataagcatgttatcaaattcataaacacgattactacagatcgttgtgatgaaggtgttatagagaaaaattggtttggttggccaaggtgtgagcaggtacctggagaagtaatagaagaccaggagggaaggaagggcaatatgtaactatccttggatagcttaattaaagaaggaaaggacgtttattgcccagactcatggagaagataattcaggtataaataacacagagtgcaaagtctctgagtcaaaaatgtttattattttacacaaacagaactgaggccagtgttgcttgatcttaggaactcagttgattttatgagggcatttgaaagaagcaggtaggagccagatggtaaaggaccttgtgggccatgataaaaatcttcagaatatattcagagtgcaatgggagctatggaaatattttaagcaggggaatgaggtcttccaattcacattttaacacattttcactggctcctatgtagagaacggattttgagaaataaggatggaacacagaggaaccactggcagcttataagatgtgtaagattgtaagaatccagctgagagatggtgtagacttgacataacacacagctgcaaagacacagaatttatgtcagcacaaaagcttgtgacctgctcatggagaccctttcatccaagccctaaacagatattgatcgaaaagcagaactacaaaaggaaagtcagatctttcttttcatctgtgacagttgtattgacaaattttgtctatttgcaactgtgtgttgtgtcaaaaatctatgttttaaagattgctaatgagaaatcaatgatgctaaacagttccttctgtcaataaaaaacacaaacattcacaaatagtcaagatgtgttcgtgttagagtcaacaatattctgaatatattaaactctgtatacccataattgcatggcagatataagaaactaacaattgatgggttctcattatcaaaaattgaatgacttcagatttatatcgaaaaaaaaaaagccctgtaaatcctgtagtgtatcatgcagatcccccacttcagaatgaggcagtcatttgttcatttgctggaaatgttcctaaacaaggacttacaagtcagttcttctccagaacttcccctaggccgaagtgaggtaccttgtctaaggtcctgtttcttccctggggagaccatatgcaatgacttgtctatgtaagagtttagaccttggtaccttcttgcttcaacttaggatcctgaagggccctcctctcttgaactctgttgtattggccaaggtcttaacgcaattggatcacaatttctcttctgaccaatcctttccttaatccatccaggcatttttataaagaacactccctgatatggttttgctctgtgtccccactcaaatctcatcttgaattgtaatccctacgtgttgagggagaggtctgtaataaccatgtgtcaaggcagagtggtgattagatcacgggagtggtttcccccatgctgtcctcctgacagttagtgagttctcacaagatctgatggttttacaaggcagttttccctgctcttgctcgctcttctctatcactcctgctgccatgtaggacatgcttcttccccttcctccctgaggtctccccagcctttcggaactgtgagtcaattaaatctcttttctttataaattaccccgtctcaggtatttttttttacagcagtatgacaacagaataatacacttcccaagaaactacctctgtgtaaatattcagttcagagtctattttccatggaagcagacctaagattgaaaataagcataaacttatctcaaattagttgtgagaagcaaaaatcgcttctgggtcctcaagataatctaagtgatttttcagaaaattactttcttcttcacacataatttgaattaaattggacattttgagctactgagacattctacttaaactatggaattagtattttaagtacatgttaagacattaattatttgtttaaaagtttgatgaaatgtgatgtttggctgtcctttatcaaattagtaactcatttaaattttgacccatattagaaaatttgtaattacactttgtataaaacctgacaatggcttgcaaaaacttttctggttgcaagtatttctaggaagaaagaggttgagagattttctgccagtgcttagtgtattgtgtggtctctgtctgctgccagaaattgcagtgcctacagaccttgtactctggttgggtaattttttgcaaagcattttagttcactgtctgtagttggagtcagtggcaaattgggagaagagttgttggagatttagagacctcccgacattttttattagtcttgctcatacatgagaatacaatcaaagtaaatatcttttatttgctatttaagacggcttcaactggcacccattatcccctcttccactttcctgttttctgtacagaaattattgagttaccactgatcaccatcactcaggaaggcaataagccatgtcattttcttttttttttttttattatacgttatgttttagggtacatgtgcacaacgtgcaggtttgttacatatgtatacatgtgccatgttggtgtgctgcacccattaactcgtcatttaacattaggtgtatctcctaatgctatccctccctcctccccctaccccacaacaggccccggtgtgtgatgttccccttcctgtgtccatgaaaaccatgtcattttctattaaaagatcccactaaataagagaaaaatatcaaaaattttacttactggatttaagaaataagcactacagcaatgtgattagaagtattgttttcaaaaaatgtataagcatatttttcaatttgatctaaaggcccatgtgatttaaaaggaagaagactttcattacatcaacaattgttcctagtcacaagtatgtccatctacagggtcaaaccatgctatctttcagaattgctagcaatcaaaagataaacctgagtaaagaagagcaagaagtggttgagttttcccccttcctgaaaggacaaaagaaaaaaacattgacttattcaatcttcaggtttgatgtttggactttttgaagtgtttgatgcaagtcaatgtttccatctgcttgaaaggagagacttgttttagatgctaatctggctatgttcaaataaaacatgggtggagaatctgtatgtgttttgagtgtggttactagtttcccattcacttgaaaattactaccagtgtccaagtttgttgtactactcaatctttcattaaaatttcctgtagtgctggctcagaattgacatttagttaacaaaatttgtggagtcattgtattatgggcacaatgttccagccatcagagagctcttttgtgggcacagtgtaaatataccctctttaatctatgatgtgattaatgaccaggctttgcatttcattgttgctttgcatcactatcaagaaaaataaagcattcacattactttccaaaggtcacagaaaagaagttattttcttgttaagataaactttaataaacatattttaagcttgcttatctcagaatatttatggtatagaattttagaacagtcacaaacagaaatttcaatgaagattcatatttaagctggacattttttttcttactgtgtgttgtgcctctgttgtatatggcttagaagggagaaatgctatacaaagtctttgaatgtcatcattgcaaatcatatatacagcagtagaaaatagactcttgggaataatattgctgtggtgggggagaggcagcacaggccaaagtaatttaatttatctaacctaaatcaaaattttaagactcacccatgaaagaagtatatgtattgcccccatttctactttttatttttcaggctgacttgtgttcttgtctcccactcaaatcaatgttaaatagaaggatcatagtctggaaattatttgttaaataatttaatagacactgtaaagatttttttttagttttctaaatgccacatgttattttcagtaacacatactattattttcaatatgtaggcatagaatcttttagaaaatagatgccataatctagcagaccagataatgttgggtggcagttcatgttgtttgaaatctaccattacaatctcacatggtatttatttattcaagatgaataataagcttcatttctcaagggcaatgcactagaaaatgtacataacattttgtctgctgattaacctaacagataataaaagaatatgagcatcataaaatttttaaaagtgtaaatgaaaaggtaatacaagaggtgggatttacaaatcaaaaaatagagagctaattgtaatccaccttctatggcattgcattagggataaaaatacaaaatcatttaaattaaaacaatgatattatctgtattcaatattatttatttattttttaatctcaagaggtgaaagtataaaaatagctaaatgcttgtgggaatattaagatctctaaattattttgaatttaaatgtaatttttactaatactattgagcagtggtaataattagaatgatttcagcaaggttggatagttgaataattaaaggcacaagattaattttagaagaggcctcattatctaaaattaaatattagaacccttgtaaaagataggagtaagaatggagaatagacggaaccatattttaaagttatttagcctcattaataccataatttcccttgaataaatataaaatccatttgtattaaatataaatttcaaagtttcatgatatatatttgttttttatagaaattaagaattgaatgatcttgtctgtaattcttgtactgcagttcagaaatagcttcccaaattattatcttcttaattacttttgaatgggcattgcatgcaaattataaaaacttaaatatattgaaatgtaagattttatttcacttttcttcctgggccaacctcttcccccagagcaattcttttttgcttttgcttttttcagtttctgagatatcccacatatctttatatagttttgcttaaatatttgacacgttagtctttccacacacattgttttgcatctttcttttattactcaacactgcatcttactaatcattctgtattagtacataaaacttttagcagcaagataggactccataatttatttaaccagttctaatggatcgatatttaaacttgtttccttttttaaaccattataaacaatgctgaaaatataattgtacatacatctttaaatacatctatacaatgatttctaaaagacaaacttctggtcaaagacatatgaattcataatttaacaaatgactacaaattaccatccagagaggctttacctttatattttcacaagcaatatgtgagagagcctatttcaaaaaacaatgggtcaaaatacagtgttttacaatttttgatcttagccaatgtgacaagtaaaaatatgaaacatcactgaagcttcagtttgcatttatgtgtttagtgtgattgagattgttttatgttcactcatgcttaaatgccatagtattttctcttctggaagctgtgtgttcacatcctatactgattgtaaatattgaaagcttaaaaatggatttgtgcatctgcaaaattggtgaattatttacaagcatctatttcccactaggtccgcatttccattattcacatatctttcatagttggttaagtacccttttgttgcttactgaagcaaataataaaatcagttttgagtttggaaagataacttatggaaaatatatttcaccacagcagtatctgattccagtggctgagaaaaagataatttaatagcaaatacataattacatattaaaattcaaaaaataggaaaaaggtaccattctaatggcaattaaataatttctatagttccagaatacaacacatacatatgacgttacacttgttttaattactttcccctgaggtttgcttggtaaaggtacacgtaaaggtggggcttctaaattagaaatagattctcatgaataagtataccatttatttgctacaactgggaaaaaaaaagcagcatgtctgaaagctgcctacttcaagttctggacaagagtaatggtatggaagaaaaagtatatctaattttgaataatatgcctgtggaacttttcagcaggatctagtcaccatctctttgatatattctctgagcttttttggacaagttttacaaaaaaaaaaaaatgaatagagggcttaaaccccaacacataactattgcttttctctgctttctatcagtttagcctagaagttaatattgtgtattattaaacactgaaatataaaataaaatatttttatgatttatgcttttctgtattttgttacactagaacattaatattaaaaatcagaggcttatttctcacttagacttcgaaaatttatatcatttaaatttttatattgtggctatttaattataagacaaaaaattccacttgaaatatgtgttaaatccttctttctctaaaccttttctccaaaaccattttaaaaaagatattctgactcttgtgtatgcaaaaaaaaattccagattaaaacaaatggtttttagttagtttgttggtgctagatataaatcatctatgacaacaacaaaaacataagacaaactcgtttggaatattagtcacattcatctaagagtatgaagaaaatcctaagtctctcattatgttgcaatgattcaggaaaagaaagagaaaagcgaaatgaaacctgaaaaaataaactcttatgcatgagcataactatttatattaaagatatctcctcttatggaataaaagatactcttatggagcatcttttattattttcaaattttccccagggctgggttcagtgactcacgtctataatcccagccctttgggaaactgaagcaggcagataacttgaggtcaggagtacgagaccagcctggccggccaacatgccgaaaccccttctctactaaaaatacaaaaattagccgggtgtggtggtgcatgcttgtaatctcagctatttggaaggctgaggcatgagaattgcttgaacctgggaggtagaggttacagtgagctgagatcgtgccactgcacatctgcctgggcgacagagcaagaacctgtctcaaaaagaaaagaaaagaaactttccccagaaaatattatacgataacccacaaataaatactatattattcaattttttactagatcctcagtatttactagaccctaagtcaataaatacttgccaaataaataaatacaaaaaaaaatgctttctaaattaccaatcttaactagatatacaaacaaaaagacaaagaatgaagggatcctatggtgaggtcatctcttactagataagaatctccatcgtattaaacatctattatactaaaaaccaagttggtattaggaatagcaagcttagttggggaaataaagaaaaataaagaacatttagagaataaaggaatatagcaaaaagatgtcatggtctgtggagattaaaaggcttaggtttcaaatctgactatgccatactagctgtgtagccttaggcaagtttcttcatctccctcaccccttgtatctttatctttaaaatagttataaagtgtaatctatttcatgcatgtggcaaaggcatatactgaacacctgcctcaaccccttgcagctgggtgaggctatatgtatagctctggataaaggactaggagtgaaggtgatgtgtgtcacttccatacagaaaaatgtaagagccagtgggcaatcctccttcactctttctttcattaattttaatttagtgtttagcaaactttttctgtaaagggacagggagtaaacagtttgagctttgcatgctctatgttctttgttgctactactcaactctgcctttacgatgcataaaatgcaaattcattacctaaaagcaatcatagagtatatgtaaagaatgagtattgttgttttccagtaaaactttatttacaaaattaggtggtgggttagaattggcccaaaagccataatttgctgtcttctctattcaatcaataccatattgattgtgatgaagaagtgatgaaagaaaagagtttagttgaatcaagtttaattcacatgcattgacagagcatatttatgtgcttggaactctggtatttgctataggaaagaaatttatgtatattgagcattttttatgtggcaagcgatctgatacatttttcacataaatacttaattgcatttaatctttatagcctggaatttttcagataagatcttgagacccaaaggaattaagtgaggaacccaagttaatactgttagtaattctgaaataagggattagaataccatcctatcggaccccaaattctgagttctttcatgttcattaaactgttatattgaataaccatgactcagagtgtaatcataaagatgttttctcctcacagttgcatctacaaaacccaagagctgttatttttctctcatataataaatttggggaggtagcctgggtggattatctattcactctaagataataataatatttaaaaatcctcttatcactttagtctctcaaatagtctcagttcagtaattaacatatcctcataataatattgttataatgtaataataaaattacagtgtaataataaaatctctgactatcaaagtgaaatatttgcctcaaccttagttcaagtctgctgagtaggaaaagtgcatctggaaagaggatagtgggtaggtggggagacacttctttcctttttaccttcccagatccttttcactgtacccaatacctcttcagctaaaaagaggcagattttttctgctggagatgtgggaattgctctcatctgcagttctgttttctccactgaatatgcctccggctgatcccttaacctccctcaagcctccttctgccaaggtgtgcttcttcctcctgatgatcttcttgagcagaatctaaaataacttcaagttctctctctttttctcacagacatgatacttatggcccacctcagggtttctcaagctctagaggtctgtttaaagtaatttgcattggtattgaggggaggtagacgtgtccctctctccctatatctctcatcagcctcaaactcctggctgtttcaattttctaagatttgcaaaaacaatatacaactaccctctcagctgtccctgcctagcggtcaaacacctccctatgaaatgtgggcgaaattagtgtctattattctagagaagctatagaaactttttaacagtcttatagaaaagcctaaaatactctatttttcctaagacacttgcagtatggttgtgaatacaaagctaatactctagaaatatttgcaagatttttatggatcggaagagacttaagggtcaataatttcattccttagctgaactgatgaatatttactaagtgtctaatatttggaaagtgctgggctagggcttaaataaaactgaaaccaaatgcagatatcattacagtcactacttgaatctctctgatttgggagaatttactacaccttcaaaagtcccattttcattgtttttgtaaatcttggggtctccatgttattttaaataaatatgccttcctggcagagcaatatcagtctttaaagaatggaataaattacagaattccaatgttgaagacaggcttacagttccttccatcattctgactttctatcatttgctcttagttccttttatgacattgttaccagtagaacgaacccgagttaccctgagttactgtctgcgtatcagtgcgggtccgcagcaaagtcagtcctcccctcctcagaagaaataagtcgactgaggggcctgagacaggagagaccgaggtaagtttcagagcagtagtggaagtttatttaaaaaggctttagaactgcaagaaaaggaaagaaaagaaggaaagtacaacttggaaggggaccaagcaggtgacttgagaaactaaacgcacagcttgacctcttgacttggggttttctgcgttgacatacttccaggatcttgcattacttcttcccatgcctgagatctcattgggaagctgctgatcagtttcaggtgttttctatctactaggagacagcctttccctggcgctggcagtgatcaattattactttactgtttatttatttatttatttgagatggagtttccctcttgttgcccaggctggagtgcaatggcccgatcttggttcacggcaacttccgcctcccaggttcaagtgattctcctgcctcagcctcccaaatagctgggattacaggcgcccaccaccacgtcaggctaatttttctatttttggtagagacggggtttcaccatgttggtcaggctggtctggaactcctgacctcaggtgagccacccgcctccgcctcccaaagtgctgggattgcaggcgtgagccaaagtgcccggcccaattattactttagagaaacagttaacaaccgcctgaccctcacctgatggtcgcccaacactcctggtgtgtaggggaagccctctcctgccctgctcatacttgactagcttgactagctacctactgtaacaacatgtgtaacaggggtgcatgtcactactctctaattgtactgaagtacaaaggcttggagctctcttttagagatcacccttaattatactgtgggtgaaaagaaagcatcctgcattttctgaaacttccacatagcttgggctatttatttttatttttatttatttattttattttattatttatttttgagacggagtctcgcactgttgcagattgggctgtttcttaatgttgactttgcatctttgtgtgtaatcttctcaggttcagttccttatctctggctttcttgattttcatcaacatcatatgcattgttaccaaatacaccaaaatggttttcacatgataaatatttttaaatgaataactgagattacaaaagtaaggaaaactcacagggcactggaaagtagaaaatgataaagtgaaactaaaatggtggggaatgcaaattggcaaagccactttagagaatgatttggcaatatctagtgaaggaaaaaaatgactctgtggtccagcaatttctttcttaggtatataccataaagatatgctcaaatatgtgtacaaagagatatgtaaaatatcctagcagcattgttcatgactggaaaaaacaaacaaacaaacaacaacaacaaaattcaaggccagtctaatgtccatgatagaatggattttaaattgtgctatatttgtatactggtgtactattcagcaataacaatgaatgaattagattgaataatacaagtataaataaaatttacaactataatctataatgtataaagcaaattgtagaagaatataaaatgttaaaaaataagcagaaaggtactatattttgtttaggtagacatgcatatgtaaaaaatgtattaaaaatgtgatatatgaaattctgataatcacataaaaaactgaaaattaatcatccaagggagggagggagcaaataggagagacatggtaaatgaaggcaggagtaggagtaaactttatatattatttatatgtttaattgtaaaccatgtgagtatattactactcaaaaatgcatagaaattattagtgactaaactcaagatggtagagaaaaaagagaatgtgattggttggaaatacaaaggatacaacaattatatttataagcatttagtatattaatctgaatgatgaatacaaattctttattattctgtataccctttgcacatctgaaacataatattataaaataaaaccttagctttcaaagccattgtttctgttaagggcttgacaatccaaatttgggggtcaacaaataagcattgacttttcattcttctttgtaactatactataataatctcaatttatgtcaaggaagtgtggatgactctaacttttggaaaaacaaattagcaggtagtataaagtgtgaaaaagaaaaacagattaatgtttcaagatattatttgacctcttttacacatcccttactactgttgacacacttgactttgatatatttcttaaatatttcttttcagaagtaatcaaattaagaggaaaccttttgatgatagtgtttgttatctctgtattcatctatttatcataaagatgatctaatattctatttttataaatacagtgttgattgtataatacttctgagcaatgctaatatagtttaaccttaaaaaatgaaacctgacatcataaaactcaatattagtattgcttccactttttagagcttgattttggcaggccaattttttttcaaatgttggttttcttatctttagaatgaatggagttctatgagaaagagcattgtgagaattacatcaaattaaaatattaataataaattttcagtgtatataaaatgacttattgtctggaacaaaatagttatttaaaaatcaatcattccattagacattaaaaataagcataagtatgcctacatttgtgattattctggatgttcttataaggtctctggatcatgattatcactccgtagtacatggatatagttatatgaacaaagaaggtagaatatatttggatatatatatatatatcccagacatgtttaaatattttagtaataaatctgtaatatgagctaattttcaaaaaattttgtcaatgtcttccaaaactaatttagagaaataaagaaatgaaaaattctaaaacaaatcaaaagcccatttaattaacagtttcacaaagttgtattatagttcctttttaataagtatatatttaaactttttatggcatacatatataaactaatttatataaatgagcattatgtattcatatattaaaatataaatgtataaaataagcacaactatacaaacatgtttgtacagatatatatatacacaaacacatgtgaaagtatgaatataacaacaaaaatataaattagggagtaaacctttgctttataagagatctcaacatattattttttaaaactgtaattactcttacaattattttgcacaatttctaaggtcaagtcttacataaaatgagtaacactaataatgtttcttaggtgttataattaacaagatgagtttcacttatagtaaaaaagagtacaaagaaagaaactaaggcctatacattaaactttcatttaaaaaatatttgacagaaattccataagaaatgaaaaataacaattattttggcttgaattttttctatttgagtgaacaaatagtgatgtattatactcaacatccacatattaaaataatccaaacctagtatttcaggaggaaattttagcagtgtttccactgtaagacaccttagattgagaagaaaagaaaacttatcttggtacctgctgagtatgttttaatcccatagcccatgatgcatttctcttatcctgacaaataggtagcagtgctattttttgttcttagcatatagtcagcttcttttgaaattcagtcatatattggatatgctgaccccctgccatagtgaattccacaggcaggagctccataggatgaaaagtgctattcaactagaggggttcatgaagaaagtcaaagtctctcaaattaatttctcaaaatgccctaagccccagccatctccccttcgatgttctttgcagctgcttagcacttctggactagttgagcctgagtgagttggctgcctccccctatggcaatatttctttttcaaagggtagttgccatggttgtataattttgtgcagggagtaggagactttgtgattggccaaactgtgctgaaaaagataacaaacacaaaaactacaagtttaaactgaggaaaactttgtcaaactctcagtggagagtggaagaaagaatgctttccacattaaaaatatcttgcattttttaacattgttgaactgcaaggggcttaggatacttaatgggtcttactaaatttggttagacctccccagcctcctagtgagcacatggaaaacagaagcatatagagagagcacaaatttaagaaacacaagaatggactaaaattcttggctcatttactgtcacaccttggattgtgtaaatgattggtaccttttggagcctccctttgctctaggttaatgcatcatcattcatcttaatatactcattactatcctctatctcttgtgtcaggcaattcttgccacctagaatttcctctcaaaatcctatgtctgagcaaagctttggacccaaatctcctatgatatccttgttaataaaatagtaaaattatgattggctaagggtagtattggacagattcaaattgtattcaacaatgttgctcagcaagacctgtatatgctgaggcccctattgtcaagtactttggtaggtgcttttgcttacattatctcaattaatttttttggtatgcatgttatttgactaaccaatttatcttatttgttactaaaatgtttctggttttgttcaaggtttcactgttcctagctaaaattccaggctctgttgcatcttgttatgttaatatgacacagttctggctaataacatggagatgtaagtccctgagagaaggcttcctttcagaaatttgtcttcagaaataaaaaaggcagacccctgtgaaggtaaggttttgtcttttgtccttaattgttttcttatcccttcttcccaactgggacaatgtatgatagtgataaggagaaggagcagccatctttgactagaccacataataaggaggtcagagtagaaagatactctaaacttaaattttggatggtgttttggggtatttcaagcggccctgagctctctacctccagcatttttattaaatgaaaaatgtaatcctatttatataagtcatttttggtcaagctttctgctactcccagtgtaatcattacttaccacacaacgtaagaactctgagctatgtggtaatatcccacagctagggagtaggaaaaggaggtagaatttaaagctctccttgcaattttaattcccattttatattgattcacttgttaatggtcttatatggcctaatatttctgttagtgatttaaataaagagatcaaagagttagatatcagatgtgctgtttcccaaagcctgaatgatagctaatatactataatctgagactgcaactgtcttgacatatttgatttcctgtgtcaagattttcaacatttgttgaattatattaaaataattcatagtttgataactttattagaatccaagtggtgatattgagaaggtagttggatacagtagtatggaattcagaagggagatctggtataaacttatttatcaatggcatatagatagtattttatgccatgtgacttgatgagattgcaaaggacgaaagaaagtgtagatagtaaatggaatagaattagagattgaagcctgggctttcataataatattgttgagaagactaatgttaagagaaggaacaatcaatgactgtaatatccagaaaaaaaaaaacaagtgatggaactatgtaatctgtggtttcaaatacagtcatatgccacataaggacatttgcgtcaacaacagactgctatacgatcatggttccatagattataatggagctgaaaaattcctatcacctagttacatcatagctgtcagaatgtcatagcacaacacattgctcacatgcttgtggtgtaatgtgctggcataaataaacctagtgtgctgccagtcatataaaaatatagcacatataattttgtacaatacataatacttgatataataagaaatgactatgttactggtttatgcatttaccatactgtactttttatggctagagtgtactccctccacttttttaaaacaataaacttaactgtaaaaaaacttctggcaggtctatcaggaggtgtttcagaataagacattgttttcataggagaagatagctccatgcatgtttttcacccttaatactttccaatgggacaagatgtggaggtagaaggcagtaatatcttaatcctttggaaacctaggctaatatgtgtgattgtatcttagattttaacaaaatataaaaattaaaaaaatctttaaaaatggaaagaaagtttatagaataaggatgtgaagaaaaaatagttttgcacagctgtacaatgtgttttaaattaagtatttctacaaaaacttaaaaagtaaaaacatataaagtaaaaagttacagtaaactaaggttcatttattatttaaaaataaaatattttaataaatttatgtagactaacagtgcagtgtttataaagcctacagtagtatacagtaatgtcctaggccttcacactcacaccactccctcactgattcatccagagcaacttctatttctgcaagctacattcatggtaagtgctctacataggtgtatctttttaaatattttatactgcatttttgcgcttttttagatttagatatccttagccatgcaaatagtcattgtgttacagttgcttacagaattcagtacagtaacatgctgtacaggtttatagccacagagctataagaatatcatatatcccaggtatatagtaggctctactatccaggtttgtgtaagtgcactctatgatatgtgcacaatgagattgcctaatgatgtgcttcttagagtgtattcctgttgctaatcaatgcatgtctatactgttaatttgccaagtaaagtaaaacattgaattgactattggatttgaccacatgtagaattttggtagggatagcatccatcctagtgcacctttgacactttcagtttgttgccttgttttaattaataataatgccacttttcattcttaagtatcatagttcaaatgataaattatatggtcatcctaagccactgatgatctttagaaagatagtttcagtggaattctgtgagcaaaatactggttggaatgtatgtaagaacaaaggaagaaagagtgggagacggcaaagatgcaaaaagctttttgctgcaaagttttgcagagaaatgggatgaaagctggaatgagaattaaacaatgtaattatgtacccaagggattcagttgatagtgaaaaattattgatgtaagagagaggaaaaatgtcctggagtaactgagaagggattcaacctctgtttaagggagggaatggtttagaatagataaaaatcaagataccactctccaagcgtattttgcatttctgcatgttttgtgaatgaagcactaatggccttgtattctggagcatgtttatagaatgtttatataatcagcaggcattgaagagagagagagtttctttgtagcaaaggacaggttggcttacatccctggaagacagagatatcatcttcctctgaagcaaatggcaggtatatttactgccctttataagaaattagagatccctaagcttagatgtgtcctcctgtaatgtaacccactacatggtcagttgtcatatgcccctttcatattgcctgtaagaattgggacttggataaccggagtaaaaaaaatactctgactattgttgttgctgtgggtaataaactgctttacatttctgatccaggaattatgtgtcttctaccactgtccactaatgtttttttgtggataaatttaaggggtacaagtgaaattttgttacatgagtatagtgcatagtggtgaattctggcctttagtgcctccattgcccaaacaatgtacatgaagtaatttcccatcattcactccctactcctccgaatctccaaagcctatcattccatattctatgtccatgtatacacattatttagctgccacttataagtgagaacatgtgtttgattttctgtttctgggttgtttcatttaagataatggcctccagttccatccatgttgctgtaaaagacatgattttattattttgtatagttggatagtatcccattgtgtatacatactacattttctttatctaggctttcactgatgggtgcttaagttgattccatatccttgctattgtgaatgcataggcttgcaatgatcatatgaatgccagtatctttttatatactgatttctttttctttgagttagatacccagtagtggtattgagggatagaatggtagttctgtttttagttttttgagaactctccatactgtttttcgtagaagttgtactaatttacattctcaccaacaatgcacaagtattaaccttttctccacatgcttaccaacatctgttattttttaactttttaaaacccattctgactggtgtaagatatctcattgtggttttaattttcatttctctgatgattattgatgttgagcattttttcatatgcttgtcggccatttgtatttcttctcttgcaaaatgtctattcctgtattttacccactatttatgaatcctgtgggggaacttgttgcttggtagtagggtaagatctcagatccttcaccgttctcaataataagatcttagataatctaggataatggatactatgcatttttatcttattattttacataaaattaatacaaatttttataggttttattatatgtaggttttatataatcaaatgtatcaatctagtcttttagcaattgtggattttatggcttgcttagaaggatttcttaaaatcttcttatagatgaataagactggactttattctattattatctcttatagttaatttttaaaggtaaagttaattttgaattcacataaaatgttatttttatatgaattttttcctaaattatagctactttatctcaaaaccactaaaattgatccttatctgattatctgaaatgtctttctcataatatattaaatccctaatgtagagatttgtgttagattattcttattcatgtatataatttttaattgatacatgaatatatttaatcctttttttcaacacatgtttagttagcacctgctatgtgctacacactgtggcattcgctattacatagtggttaaaaaataggcatagttcctgctccattgaaaacctcagcctagctgtaaacataaatacctaaaaaatcatcaaataaatatattatttaaaagtatggtaagtgctaggaatacaattaaaaaattctttggtagaatattgaggtaagtgggaaacctataaatgtcagtgttctctgaggaggatataatttcagcctacacccagagtataacaattgagcatcataaaaatgagtggaagagtattctaagctggtggaacagcatgctcatagataaaagttgtttcagaaaagggtcatgcaatgccttttgcttaccaaccaacaaatctgccatatagagtttaatcttttgattaaccaaattcaagtcaaccaattacattatatatcttataatgttgatatattttcaaaacgtaaattttcttttagaattaaggccaaattattgtatgtatggtagaagtcatcaacaactactctattggaaataactaatataatccacgtttgttgctagaaattgatttttggagtggactcaaatgcctaactctcaagaagttctaaaaccagaaggattttttttgcttaggagtctgaatgaaacttttaaagtcttgcaggtgtttgctgtcagaatgaggataagtcaatatgtgacagagcagaacaatgaatactgtgaaaggcacaatagcgggccagagccctgatacatgtggcctgaagcctgccaaagtcttgggctgaattttaagttcagcaatgcatttttgtaagttaaattactttaaattgaagttttctggttttactgagctaaatgcattataatactaattagaatattttcaacttaaatttgaagcctgaaaggtgagaaacatcggccaatggcttcaaaactcccactcttcttggcacaaaacaaacatatctttataacatttcttgaaattatttgataacaactttggagttgcttcttaggtatgcatagcaaggtggtattgggcatcacacttctgaagtcacatccctttactctcctgtgtataagctctggaaatgaagtagacctaaagtagttctatagtaaaattaagttcactaagaaactgggacttatggtggagagtggcatcaagctgaggtacacaatttagagtccttcctttcctgtgctcttgccctgtatccatatcccaagatttgggctctccttgtgcttgttgctgagtgggagtctgtattgttttacaaccccactatcattaattgcctggccacaaatatattctaatactacctttattgtaacttttgttagacttttttctagtgttaatgcttaccaggagattagatgtcttccttcttgtgtgccccctcctgtagggttatatttctatcttgcatggctatagaggtatagaaagaatactaattattaaaattcatattatatcgcattttcatatttttatatttaaaagatacactgataatcatgtcaatctattacttttctttggaagaaataattttttgactatatgacagtttttttaaacacagataaaaaatgtttcattattcttaaactgtgcctgcaaaccattgctaaagcaaaatagaagctttctcctttgtatagtacaattttattgtatctaatttagatgtggaaaaatgttaattaatcttaattaatgcagctgttgaaatgagggatacctgttagccagagtggcctgagaggtgcctttatttcatgaaacagaagactttggtagctacaatccacttaccactttttaaattattattttcagtttttaaatttctaaatttttatttatgaggttatatgctaggtatatatatatttctggagtacatggtgtattttgatatgggcatacagtgagtaacaatcacatcagggtaaatgtgatacccattacttcaagcatttattctttgtgttatgaacaatccaataatattcttaataatattcttagttatttaaaaatatatactaaatattattaactatagcctccctgctgcactatcaaattctagattttattcattatatctattttttatatccagcaaccatctctacttcttacccccactactcttcccagcctctggtaaccatcattctactctgtcatcattagttgaattatttcaatattttgcccccacaaataagtgagaatgtgtgaagtttgtctttctctgtgtggctaatttcacttaagctagtgacttccagttccatccattttgttgcaaatgacagggtctcattctttatcgggggaaccagcccccaaaatttcaatgtaggttcttttctattttccctaagtgtcggccggtctgagaaataaagagaaagagtacaaagagagaaattttacagctgggcttccggggatgccatcgcatattggtgggacgatgatgatgaccccgagccgaaaaaccagcaagtttttattagggattttaaaaggggagggggtgtacaaacagagtaggtcacaagaattactgatgagggtctatgccccactgtgtatgcattgtcttgataaacatcttaacaggaaacaggttttgagagcagacaactggtctgactagaatttaccaggctggaatttcccagtcctagcaagcctgagggtactgcaggagaccagggcatatttcagtccttatctcaaccgcataagacagacactcccagagcggccttctatagatctacccccaggaatgcattccttccccagggttatcaattattaatattccttgctgggaaaataattcagcgatatttctcctactcacacgtccatctataggctctctgcaacaagaaaaatatggctctattctgcctgaccctgcaggcagtcagaccttatggttatcttcccttgttctctgaaaatttctgttattctgttctttatcagtgtgcattgattttatattgtccaaatacacatattttacaatcaatttgtacaatagtggtccagaggtgacatatattctcagcttacgaatataacaggattgagagattaaagtaaagacaggcataagaaattataagagtattgattggagaaatgataaatgtccatgaaatcttcacaatttatgttcttctgcctcagctccagccggtccttccgttcggggtccctgacttcccgcaacaattcttttttatggctgcattgtattttattgtgtatatgtactgcattttctttatccattcacctgttaagtgatgcttatcttgcatccaaatcttggctattgtgaatagtgctgcaataaacatgagtgtgctgatatctccttgatatactgatttcctcttttgggtatatagccaaaagtgggattactggctcatatggtagctttatttttacttcttaactccaaactgttctccatagtggttgtactaatttacattcccaccaacagtgtacaaagattgcctttccttcacatccttgccagcatttgtttttgactgtcttttggatataaaccattttacctggggtgagttgatatctcattgtagttttgacttacatttctctgatgagcaataattttgagcaccttttgatatatctgtttgctgtttgtatgtcttcttttgagaaatgtctattcagatttttgcctatttttaaatcagattattagattttttttcctatagaattatctgagctccttagatattttggttattaatcccttgtcaaatggatactttgcaaatattttcttctatagtgagggttgtaatttcactttgttgattatttactgttcaaacgcttttaaacttgatgtaatcctatgtgtccatattggctctggttgcccatgcttgtggagcatatgtcaagaaacctttgcccacttcaatgtcttggagaggttccccaattttttttcttagtagttccatagtttgaggtcttagatttaagtcttcaatccatttttgatttgatttttgtatatggtaggagataggtctttagttttttttttctgcatgtgaatatccagttttcccaccatcatctattgaagagattgtccattccccaacgtgcattcttggtgcccttgttagaaatgagttcactgtagatgtatgaatttgtttctgggttctccattctgtttcactccattctgtttcactggtctatgtgtctgtttttatgccactgccatgctgttttggttactataacactgttgtataatatgaagtcggataatataattccaccagttttgttctgtttgcttatgatagctttggctattctggatcttttgtagttctatataaattttgggattttctttcctgtttctgtgaagaatgtcattagtattttgataggaattgcattgaatctgtagattgctttgggaagtatgaacattttaacaacgcagattcttccaatccatgaacatggaatatctttccattttttgtgttctctaatttcttgcatcaatgttttatagtattcattgtagagatcttccatttattttgttaattcctaggtattttatttgatttttagttattgtaaatgggattactttcttcatttatatcagattgttcactttgggcatatagaaatgctaaggattttttgtatgtttttttatgctgtaaacttgaatttgtttatcagttccaatatatttttgatggagtctttacatttttttcaaacgtaacattgtattatctgcaaacaaggattatttgacatcttcctttccaatttggatgccctttccttttttctcttgtctgattgccttagctaggacttccaggactatgttgagtaacaacagtgttgaaagttggcagttggcatttatgtcacattccagatcttagagcaacagcattctgtttttctccattcagtaagatactctacatgaatctgttgaacatggatttcattgtattaatgtatgtttcttctataccgagtttttgagagcttttgtcataaagggatgttgaattttatcaaatgcttgttcagcatcaattgaaatgatcatatggcttttctccttcattctgttgatataatgttcacattacttgatttacatatgttgaatcattcttgcacccctgggataaatcccacttggtcatgataagtgatccttttaatgtattattgaattcagtttggtagtattttgtttaggacttctgcatcaatgttcatcatggatattgagctatagtttgtgtacgtgtgtgtctttgtttagttttggtttcagggtaacagtggcataacagaatgagtttggagtaattcctcctcttccacttttcagaatagtttgagtaggattgacagattttctttaaatgtttagtaaaattcagcagtgacaccatcagatcttggcttatttttgttgggacactttttattataatttcaatcttgttatttgttattgatctgctcatgttttgtatttcttcatagtctaatctaggtgggttgtatgcatctagaaatgtatcaatttcttctggattatccaatttattggcatatagttgctcatggtaatttccaattatcttttcaatttctgcagtattggttataaagtctcttttttatcactcacttgatttatttggtcttctctctctttttcttagtgtggctaaaagattgtgggtttattcagaaaacaaacttttagttttgtaaatcttttgtattgttgttttgtttcaattatatttctttctgctctgctctttaatttcttctcctctactgattttgggttgtgttttctcttgcttttctagctcttttgtatcattaggttcttcatttaaagtttttcctctttgtgatgtaagtgcttattactgtaaactttcctctaggtactgctttcgttttatcccgtaggttttgctatatcgtgtttctgttttcattttgttggtgaatttttaaaattttatcttaatttcttcctggtctgactggccattcaggagcttattgtttaatttccatgtgtttgtatagtttccaaaaatttctcttcttgaattttacttttattttattggggttagagaagatatgagataaaatttcaatttactgaattttttaagggttgtttagtggcctaacatatggtctctacttgagaataatctgtgttctgaggagaaatttgtattctgcagcctttggaggaagtattctataaatgtctatcaggtccatttggtctgtaatactgattaagtttgatgtttcttcattaattttttctagattaattgtccaatgctgaaagttaggtgttaaggaatccagatattattatgtttgaatctgtgtctctctttatctctaataatttctctctatatgtgtgttccagtgttgggtgcatatatattttcaatttatatatcctcttcctgagttgacccctttattattatataatgacctttcttctctctttttatacttttggtcttgaaatctattttgtctaatatcagtatatctcctccaactctttcttggtttccatttgcatgcattatcattttgcatctcttcattttccatctatctgtgtctttacagacaaagtgtgtttcttataggcaacaggtagctgggtcttgagggattttgtgtttgttagtttttgatcattcagccactctatgtcttttggttggagagtttaatcagtttacattcaatgctattattggtaaataaggacttactcttgccattttgttagttttctggttgttttgtggtcttctctttcacctttccttccatactgtcttccttttagggaaggtaattttctgtgcttgtatgatttaatttcctgcttttaatttttgggtatatcttgtattttttttttatttgaggttatcatgaggcttgaaaataatatcttataatccattattttaaactgatgataattttacactgatagtataaacaaacaaaaacaagcaaatagataattaacaaaaactccacactttaacttaatccctcactttttaacttttagtcatttctatttatatcttattgtactctctatatcttgaatgttgttggttttattatttttgtttggtttgtcttttagtctttctagtcaagatatgagtaggttacacaccacaattagacttttgtaacactttgtggttttctatgtacttactattaccagtgagttttgtaccttcagataatttcttattgctcattagcatcctttccctcaggttgaagaactcctgctcgcatatcatgtaggaaaagtctggagttgatgaaatccctcagcatttggttgtttgaaaaaaaatattacttctccttcatatttgaaggatatttttcattggatatactattctgggataaaagttttttcctgcagcactttgaaaatgtcaggccactctcttctggcctgtaagatttccactaaaggtctgctgccagatgtactggagctcctttgtatgttatttgtttattttctcttactgaatttaggatcctgtcttcacccttgatctttgggagtttgattattaagtgctttcaggtagtcttatttgggttaagtcagcttggtgttatataacattcttgtaacttatatattgacatctttctctaggtttaggaagttctttgtcattattccttcaaataaactttctccccacatctctctctctcttctttaggccaataattctctgattttctcttttgaggctgctttctgtattgtgtaggtatacttcatgttttttagtcttttttcctttgtctatgtattagtccattctcacactgctatgaagaaatacccgagactgggtaatttataaaggaaataattttaattgactcacagctttgcgttgctggggaggcctcaggaaacctacaattatggtggaaggcaaaggaaaagcaggcaccttcttcacagggtggtaggacagagtgagtgcaagcaggagaaatgccagatgtttataaaaccatcagatcttgtgagactcactcatcatcacaagaagagcatgggggaaatcacccctatgattcaattacctccatcttgtcccactcttgacaggtggggattatgattcaaggtgacatttgggtgaggacacagagtcaaaccatatcattttattcttattatatattttcaaatagcctgtcttcaagctcactaattcttccttctgcttgattaattctgctgttaagagattttgatgcattgttcagtatgtcagttgcacttttcaagttcggaatttctatttgacccttttcaattatttcaatctcctttaaaatttatctaataggattctgaattccttctctgtgttatcttaaatttcattgaatattctcaaaacagttattttgaattctctgtggacaggtcacatatctctgtgtctccaggattggtcactggattcttatttaatttgttttgtgaggtcatgttttcctggatgaccttgaagtctgctgatgtttttcagtatctgggcattaaagaattaggtatttattgtagtcttcaccattagggcttatttgtagctgtccttttttgtgatgactttccaggtattcaaagggacttgagtgttgtgatctaagttgtaggttactgcagccatgtctccactagggagtgaattaatctgtttttatgctgctaataaagacataccaaagactgggtaatttataacagcaacaaaaaaaaagtttaattgaatttcagttccatggctggggaggcttcacaatcatggctgcaggtaaatcaaaagaggagcaaagtcaccccttacatggaggcaagcaagagaacttgtgtaggggaaattccctttataaaaccatcagatcttgtgagatttactcacgatgctgagaacagcatgaaaaagactagaccccatgattcaactacctcccacctgggagctataattcaagatgagatttgggtggggacacagccaaattatatcattccacccctggcccctcgcaaatctcatgttctcacgtttcaaaacataattatgcccttccaatgacttccccaaagtcttaactcacttcaggttaactcaaaagttcacactccaaagtctcatctgagacaaggcaagtccctttcacctatgagcctataaaatcaaaagcaagttagttacttcctagatacattgaggatacaggcattggttaaatacaccctttccaaatgagaaaaattggccaaaacaaaagggctacaggacccatgcatgtctgaaatccagcagggcagtcattgactccatatctcaaatccaggtcacgctaatgcaagagttgggttcccatggtcttagacagctctgcccctttggcttttctgggtacagccccttcctggctgctttcatgggctggcattgagtgtctggggcatttccaggtgcgtggtgcaagctgtcaggggatctactattctgggttctggaggacagtgactttgtttttacagctccactaagcagtgccccagtggggactctgtttgggagcttacaccccacatttcccttctgcactgccctggtagaggctcttcatgaggactctgcccctgcagcacacctctgcctggacatccaggcatttccatacatcatctgaaatttaagtggaggttcccaaacctcaattcttgacttgtgtgcacctgcaggcccaacaccacgtgtaagacaccaaggcttgtggcttgcaccctctgacctaacagcctgagctgtatgttggccccttctagacatggctgggatgcagggaaccaagtctcgagactgcacaaagcggaaaggccctgggcccaggcctttaaaccatttttcctcctaggcatcctggcttgtgatgggaggggctgccatgaagccctctgacatgccttgggagacattttccccattgtcttggtgattaacatttggctcctttttacttttgcacgtttctgtagctggcttgaatttctcctcagaaaatgggtttttcttttctattgcatcatcaggctgcaaattttttgaacttctatgctctgcttcccttttaaacataatttctaattccaaaccatatctttgtgaatgaataaacctgaatgcttttaagagcacccaagtcacatcctgaatgctttgctgcttagaaatttcttctgccagatgcctgaaatcacctctctcaagttcaaagctccacaaatctccaggtcatgggcaaaatgcttccagtctctttgctaaagcatagcaagaatcacctttgctccagtacccaacaagttcctcatctccatctgagaccacctcagcctggactttattgtccatatcactatcagcattttggtcaaagccattcaacaagtctctaggaagttccaaactttttcacatcttcctgtcttcttctgagctctctaaactgttctaacctctgcctgttacccagttccaaagttgcttccacatttttgggtatctttacagcagcaccttgctctaccagtaccaatttactgtattaatctgttcttacactgttaataaagacaatattgagactgagtaatttataaaggaaagaggtttaatggacttaccgtgccatgtggctggggaggcctacaatcatggctaaaggcgagtaaagagcaaagtcatgtcttacctggcagcaagcaagatagcttgcataagggaactaccccttgtaaaaccatcggatctcatgaaactcactatcatgagaactgcatgggaaagatcctccctcattactcaattacctcactccaggtccctcccatgacatgtgggaattatgggagctacaattcaagatgagatttgggtggggacacagccaaaccctattgggggcatcccaagcccagtaacactgtgggttttactgactcatataggtatggccttggtggttttgggtaaaatcttgaaagtttctctgcattacccggcaaagaagctcgttgtgttcccttactttctgccaaacaaatggagtctttctctctctctctctctctgtgctaaactgcctggagctggggaaggggtgacacaagcacccctgtggtcaccactgctggactgtgctggttcagaccttaagccagcacagaactgggacctgatcaaggcttattgtacccactgcctggccactgcctatgtttcctcaaggccccatgcatctatcattagcagagaatgaacccagctaggcttctgtcctgcctttcatggtggcaagttttctcagccccaggcaggttcagatgtgtcatctgggaggcaaggcctggactccagaaccttaggcatctaattggtgctatattctactgcaactgagacaacacccaagccacaagaaaaatgtctttccattctttcccctttgctcaagcagaggagtctcttcctcatgaccaccaccaccccaggccctcagtgagtactgcctggctattgctcatgttcactcaaggcccgtgagctctttagtcaaattgtggtgaaagttcatcaggcctggcactctccctttaggacagtgtgctcccctgtggtccagagcaggtccagtgatgctgtgtaagacccatgtccttcattcaggagccccaggagctcagttggtgttctaccccactgtggcccagctggtacctaagctgcaggacaaagtttcctgtagtctctcttttttcaagaagatggagtccctccccataaccaccacagctgggaatgtgcttggtcacacctgaagtcagcccatctcagagtcttaaccaaagttcatggcatgtaatatctggccaccactgcttattattcttgacctaagggctctttaatcatctagtaatgaatcctgccagggacgggtcattcccttggcggcaccaggttcactctggctgaaggtatatctacagatgcctggagctagggcctgaaatggggacctcaggaccctgcctattgccctatcctattattgctgagatgatatccaagttgcaagacaaagtcctcatttttttcctctattctcctcaaatggaagggcagattctctcccagagctgtaagctgaaattgctgggatttgggaatgggtgacacaagcactcccttggccaccccagctggtactatgcatcccaacacatgatcaagacttgtccaggaattacagtccttgtggcctagactgcctttcaactttatttagaatgccagaactctttaacccacggtggcattacttgctagaagtcaagttgcgaccaccatgatgggcaattcccctctggctagtgctagtctaaatgctcgcagctctgccaggtgctgttttccactgtgacagggaaacactgggttccaatttaaagtcccgtattcattgtgctctgccttctcttagctcacaggttcactctttgtaccacatggcaactgcccaggaatggggaaggagtggcatctgcaattcaagactgtctttcctacccctcatcagtgtctttttcagttatatggagttaaaatcggcgttgtgatcactcacctgatttttggttcttataaaggtgctttttttgtgtagataattgttaaatttggtgatcctgcaggaaggatggttggtagaggcttctatttggtcatgttgctctgtctccaaacatatgaaaatttttatgtgtacttttgcatttatcatggactttagtttttcttaaatttgatgaaaatttaacctaccatcaggagaaattttagacacaagaacaaaaaagataatcctacaatgtgttttgttgttgtctgagacattttaacaaattagacattacaaatatctggtttgccaaatcaaactttttgatacatcactattctacaattctgagtggtttaattgaacatcttacttgtctgtacactgactcgtgctggtgtttttgttacccaaggaatttagctagtgtatctgaatgctaaggaaagtggaactaattggtggcttgcaaagtaaggtgttaataagtaacactttaaatgtgttacttattaatagctgttaggcatatatggtatggaaatggtaaacaattgaatattaattttcttctttaaaatcattaaatcttaggtgcttcaaattttataactaaaaattttaaagatctacccagacctctctgtttcacaaatgggaaaagaaaggaaggcccagaaagaaaaatattttctttatttaagtaatgggggataaaaagtaattttgattttcttttatttgcaaatgtgctaatgaaaaaacagtatataataaagtttttttaatgaagaaaagtaatttaaactaaaaaaagttaccaattttttattggaatttttctaaatcgcttttgaaacaatattgctataatacataaataatgagactaatggtaaactctaaaatgtggtaacgccagataaacacatttggtaaggttattgcttcaattttgtgctatgtgaattatatatctccacaaactttttcaggaaaatcaattaagaccttcctttggccattttctaatttttccattactagataaaagagctattaggtcaaatagattatttttctagaaacaaattattgattattacttaaacatcactagcgtatatggattgtgctttaatatcttacttctgaaaatgtagatacaaaataaggtttttataaaatggcctaaaggaaaaatttttatctattatgtaagcaaaattcttggagtcaaagagacatggaagaacagaaaaataagaaatgtaaagttttcaatatgtagccttaaataattaatttattagttgagtttggtgttcttaggataaagatgcaaaaaagcagcttaaacaacatctcaataagacattattgagcagggatgctgcattatgtttgtcttttatgtcttgtatgtgtttctcctatgagcctccaggtgaggctccctcacagaactcattgtagactatttaactgtctatgatcttccttttgtatgtttattagccctttgtaattttttcactgtgaatttgccactcaaacaatttactcattttaatggggtgctggtcttattcttttctttattaaaacatcattagcaattatttcatgtttatatattcatgtaaatagtagatattctgtgtagtactaagaaaaaagattgggactttcgtttctagaaaaatggtgggttagattgttcagagtaatcatattaatgtaaatatgaaaatagtttgatgtaactcattttaaaataattttaattaataagacatccaacaagacagtaaatgcatttaagagaattagaaatccagggaggttaagtggaaccattaagacatttgccctaaaggcatttgccaatctgtgaataggtaaaaacttctgttttgatgacttttgatggcaaggggagcagaagttgaagtctttggtttcctagagtggaaacttcaatagaacccataacacatgaattttggattcccagaaaacataccttcagagggaaggagacataactaccaccagaaagtatttttctaaaaagttgctcagaacttggaggaataagggaaaaaaaaaaaaaaactcttaagcagtggggaaaaaaaaagctgtcctgtgcacttgtaattccaaggagacatattctaaccattgtcagatgacagaggtggaacaaccagtctctaaggggatccagactttccctcatctttctgtgcttcccttatctcctgttgggcttagaagccctccaaactctcccaacctctgcctgttacagtttcaaagctgcttccacatttttagatttcttaatggaaagacctcactccctgggatcaattatctgttagtctcttcttgcattgccataaataaatatctgaaactggataacttaaaagaaaagtggtttaattggcttacagttcagtaggctgtagaggaagcatggtgccagcatctgctcagcttctgatgagacctcaggaagcttataatcatggtagaaggcaaagttggagcaggcatgtcacatggcgagagacagatcaagaaaggggaaagaagggcaacaatcttttatacaatcagatcttgtgtgaactaacagagtgagaattcactaatcaccaagaggttgatgctaaaccattcatgagggattagcccccatgatgcaaacaccttcagcattgtggattacagtttaacatgagatttggaggagacagacttccaaattatatcactaatcctactcaaactattctgaaaaatagaggaaggaatactttcaaactcattcaatgaggccaatattactttgatactaaaactaaacatacgtcaaaaaggaaaactacaggccaatatccctgatgaatattgatgcaaaaatccttaaaaaataaacccaacaaactgaagtcaacaacacattaaaaatacagttcatcacaaccaagtaagatttaccctagggatgcaaggatggttcaacatatttgaatcaatcaatgtgatacatcatatcaacaggatgaaggagtaaaaccatattagcattttaattgatgctgaaaaaaatctgataaagttcagtaccccttcatgataaaaattttcaaaaaactggatatagaaggaatatacctcaaagcaataaaagccatatatgacagacccatatcttgtattttactgaataggaaaaactgaaagccttttctctaagatctaaaacaagacaaggattccaactttcactattgttattcaacatagtactggaagtcctagctagagcaatcagagaaaaaaaaaagaaagggcatgcaaattggaaagaacgaagtcaaattatctttgtttgcagattatatgatcttagtgaaataaggtaggcgcagaaagacaaatttcacaaatatcccaaatttatacatctacagtgaactcatttttaacaaaagtgtcaagactgtacactgggcagaggacaatctcttcaatagatggtgctgggaaaactgtatattcatatgcctaagaataaagctagacctctatcttccaccatatgcaaaaatcaaatcaaatcaaaatggattaaagacttaaatccaagacctaaaactatggaactactaaaaaaaaaaaaaaactgggaacctctccaggacattgaactgggcaaatatttcttgcctcttagcccacaagcacaggcaaccaaagcaaaaaagaacagatgtgattatctcaagttcaactgcttcttcacagcaaaggtaataatcaacaaagtgaaatgacaactcacaacatgacagaaaatatttgcaaactaccaactcgacaagggatttataaccggaacatattataaactcaaacagctcaacagaaagaaatctaataatccaattaaaaaatggacaaagggtctgaatagatgtttcccaaaagaagacataaaatggcaaacagatatatggaaaggtgtttaacatcactgcaccacagggaaatgcaaatcaataaggcaataaaataccaaattaccccacttaaaatagtttttatccaaaagacaggctctgttgataggaatgttaattagtgcatccactatagagaacagtttggaaggtcctcaaaaaactaaaaatagaactaccatatgatttagcaatcccactgttaagtatatgccccaaagaaaagtaatcaatatatcaaacagatatctgcattcccttatttatttcaggactattcacaatagccagattttaagcaacctaagtgtcatcaacagatgaatggataaagtgtcagatgtatacacaatgtagtactattcagtcaccaaaaagaataacatcttgtgatttgcaacaacatagatggagctgtaggtcattatgtttagtgaaataaggcaggcacagaaagacaaatatcacatgctgccaatcatttgtgggagctgaaaaattaaaacgactgaactcatgaagatagcgtgtagaataatgtttagttaccagaggctgagaagaatagtaagggagaaggggaaagtgaggatagttactggatacaaaaaactagttagatagcatgaataaaatcgagtatttgagagcacaatgggaggactacagtcaacaataatttattgtacattttcaaataatggaaagagtataattggattatttgtaagacaaaggatgaattcttgaggtgatggatactccatttatcctgatttaatttttacctattgtatgcctgtatcacaacatctcatagacctcataaatatatatacttactatgtaccaacaaaaattaaaatacaaaaattaagatgaggtcatactggatagagtaggttttaattctatataactggtgtctttttttttttttttttaatttttgagacagggtctcattttgtccccccagtctggaatgtagtggtgtgatctccactcattgcaacctccatctcaaaggctcaagccatcctctgcctcagtcccacaagtagcagtgaacacaggtgcatgccaccaagcctggttaattttgtactttttgtagagactgggtttctccatgttgcccaggctgctcgaactcctgagctcaagtgatccaccctcctcagcctcccaaagtgctaagattacaggcatgaaccactgcactcagccttgtctttgttaagaaaagaggtgacaggcacacagtggagaaggccatgtgaagactgaggcagagaatagaatgatgtagctataaggtaaggaatagcagggaaattaaaagaagcaaaaaatatttctatcctaaaaccttcacagagctcctgcccattgctgacaagttagttttggaccactaggtctagaaatgtgcaataataaatttctgttgcttttagtcacttagtttgtggcactttgtcatggcagccctataaaatgaatacacggggtatgctatttctgccagattttatctttcagtttctccaattcccagtcaggggatgtgtttatctgagacaaaaaggtgctagcttcttctgcaggacatcctcttaattaaagtcctcaaagctggatgcttggaaatggtcagggacaaatgcagttttctgtatgactttctgtatggaagacaaactgtttccagttgtgttccagctcagcctcacaggtttcagattattctttctttcccctcttcatatcagttttcttttcctaactgaatatcttgcaaacttcaggtttccacataggacccaggaacaatagccaccacttctctaattgaaccctgactaacacacttggttaaatacatatatatatatatatatatatatatatatgtttctataaacttattttgtttaaatgtgtaaaaatcatgctatgttacctcccaatagttttgtttttttcttctacattactatcttttaatcttagcttttaaaatatttattaaatactgactaaaatatcactggtacttttacctcaatgtcttatatgcctgaagaaaccaacaatgcttgcacctgtaaaaaataaatgggtaaaaatctaccagtgtgacaattacaatgttagtaattgtatgaatcagaacttactctactgctgaaaatagagaaaatgcttactttaatttaaaacattagctatttgtatccagcatcaagcttttacacaaagaataattctatgcgataccaaaagactcacaaaatcagtcaattatttataaaatagattatttttataaaacaagcagttatttttgtgaactgaataatttggtaattaaaataacctgatagttccattttaaaaattaggttagtgtggagatatcctagtaacattttcaagtattttaatcctgtgagaactacacaaacctaaataacctagaagtctaatgcaatatttttacatacgcaaatactaattcccaccctccatactcacagaagtttatgatatacacagtatttgctgttcctttcttttcagaaatagagactgatctcacaagatgagataggaaatattctgattaaaaacaccagaaaaagaaagaagtgtaaatgggaagatatactctgagtacgaaaatccacttaccagaagcaacttctgttttgaaaaacacaattctgtgttttactttttactgtgcactaaaagataaattgattcatacattccatagattatatatctgtgtggaatataaaagggtctatgtgtatattactacttagaatatatttgaatctgacatgacttctgaaagctgaatgtaacttacagtgattttagttattctttattgtattttattagatgctagttgctgcataaggaattttgtgtgtattaacttgtataatctacacactaatattactaagaaaacactggctttctgtgcaaattatattttaaatctggatcttcataagtttaggtaactttcccaaatactcactgtctgtaatttagggaaccagcattcacattcagttgtcttgactcccaagtctatataacagctatgcatgctgttcttcccctttactggccagataagagtcttgtcactcggaattatgacagagtaagagaaaatattagagacttcacaattttctttcaaaatgtctgcaaatgaatatgtaagggaattctccagaatagcatatgaaactgatgacaatcaaaagtgatgaagtcaagcatgttccaaagagaatctaataaaggacattaaaaaccaccaatgattatgattttggaactatgcagaacaggacaaagagtgaaggaggctgtctgaggtgctgaaatacagcatacaaacatgttacagactaagtataaaatcttgtattaattcaggcttccatactgagttcctcaggtaacacataaaatgatcactggtcacaatttggaagaaactaattataaacaatcaaataaataatagaaactaaaaaaaaaaaagccttgccatattgactttaaaaaatcccatgcaggccattatgtaataaatcatatgaaaactatataattttaatatagtagtatttttcaatctggtccaatattgttggctaagtaagttctgctgtctcaaatccattaagaatttgtgggaatacatgtgatcttttattaatagatgcttaaaaagacatataatcaattttataaaaattaaagtttagtatgaaagttatttgtcatcatttgaatacattttatttttaaccaacttggatctctcagactctgagaaatttatcaatataaacatttctgtcatatgtttctcatatttcttacatttttatctttgtattttggtgatttttaatttggatgatatagttttgggacatgtaaagttaaatatgtataactttattggagtaaaaatttacccccaatattttgcttactattttaaattcaattttttgagattaatattagttacctttctttctttttcttgtatagcatacctaacaaatgtttggcttttttgcctatttaattttgatttgagtgtgttgatttaagtttaagtaataacatattgtaatttctgtttcaagatagtgagctgagcacatgcttcactcttaccttcctgtaacaaatatctagaaacaatataatatttaaacaacaggaaaacaaaaaacaaataggctctttcccaggaccagatgttgtgacaaggtcccaaaagttagaaaacagataaaatttacaaggtaagcctcagccaaggacacacatagaaaattacaactgtgaatggtgctgaaagctaattgaagccaaacaaaaagggagacttttgagtgatcgggccacgtgttttccaaaacctcctacattctgtgttcattaggcttactagatattaagcaatggagtgttttcctcagcaaaactccctggcaaaaaaaagaaagttgcatattctttttaaatatgtgtaatatattcataaaaatggttttaaaaggagtcttagaaacatgctcaaaatgttgataatgtgagagtgaaattcaattatcatgaagcagtagctgtaaaacttgacaaaagaattaacaaaatatctctcaatcataaaatttaagaaaaattaatgcttctaaataagtcttgcatttatagataaaatggatgtagtagttcgttttcatgctgttgataaaaacatacctgagactgggcaatttacaaatgaaagaggtttaattggacttacagttccacttggctggggaagcctcacaatcatggcggaaggcaaggagcagcaagtcatgtcttacatgaatggcagcaggcaaaaagagagcttatgcagggaaactcccatctttcaaaaccatgagctctggtgagacttattcactatcatgagaacagcatgggaaagacgtgcccccatgattcaattaccttccaccagatcccttccataacacgtgggaattcaagatgagattttggtggggactcagccaatccatataattccattctagcccctcccacatctcatgtccttacatttcaaaaccaatcatgccttcccaacattccctcaaaatcttaacgtatttcagcattaactcaaaagttcacagtacaaagtctcatccgagacaaagcaagttccttctgcctatgagcctgtaaaatcaaaagttagttacttcctagatacaatggaggtacagacattggataaatatggccatttcaaataggagacatcggccaatacaaaggggctgtaggccccatgcaagtccgaaatccagtggggctgtcatatcttaaagctccaaaatgatctcctttgactccatgtctcacatccaggtcatactgatgcaaaaggtgtgttcccagtcttgggcagcacctcccctgtggctttgcagggtgtaaccccctctcctccaccggctgctttcatgggctggcattgagtggctgttgcttttccaggtgcatggtgcaagctgtcatggatctaccattctgggatctggaagacaatgaacctcttctcacagccctgctaagtcgtgccctggtagggactctgtgtgggagctctgaccccttatttcccttctgcactgcactggcagagtttctagatgagtgctttgcccctgcagcaaacttttgccttggcatccaggcttttccatacatcttctgaaatctaggcagaggttctcaaacctcaattcttgacttctgtgcacctgtgggctcaacaccacgtggaagctgtcaaggcttggggtttccaccatctgaagcaacaggttgagctgtaccttggtcccttttagtcatggctggagtagttgggttgcagggcaccaagaccctagattgcacacagcacagggaccctgggccaagcccacaaaaccatttttccttaggcttccaggcctgtgatgggaggagccaccatgtagaattctgacatgccctggagacattttgcccatagtgttgggaattaacatttggttccctgttacttaggccaatttctgccacaggcttgaatttctcttaggaaaatgggttgttcttttctgttgcaccatcaggctgcaaatgttttgaacttttatgctctggctcccttctaaaactgaatgcctttaataactcccaagtcaccttttgaatgcttagctgcttagaagtttctttccccagatgccctaaatcatctctctcaagttcaaagttccacagtctctagctcaagggcaaaatgctgccattctctttggtaaaacataaaaagagtcacctttgctccagttcccaacaagtacctcatctccatctgagaccatctcagcctgactttattgtccatatcgctatcaggcttttggtcaaagccattcatcaagtctctaggaagttccaaactttttctcattttcctgtcttcttctgaggcctccaatctgctccaacctctgcctgttacccagttccaaagttgcttccacatgtttgggtattttttcagcagcaccccactcctgggaccaatttgctttattagactgttcacactgctgataaagacatacccaaacctgggctatttacaatcaaacgaggtttaattggacttacagttccacgtgggtggggaagcctcacaatcatggtggaaggcaaggagcagcaaatcatgtcttaaatgaatggaagcaggcaaaaagtgagcttgtgcagggagactcccattattcaaaatcatcagatccggtgagacttattcactatcataagaacagcatgggaaagatgtgcccccatgattcgattacctcctaccaggtcccttccacaacatgtgggaatttaaggtgagatttggttggggacacagccaaaccatattaatggagataactaactagacctacatgtcaatattaacattaaaaatacctactatttattctgcatttacaatgtgtagttactgttctaaatattccacttatgctcacatatttaatcctcataaaaaccttatgtggtcagcactgtcattaatcccatttaaagacacaaggagcttaaataatgtgctatatttcatctagctaatatgtgaccaagataggatttgaattcaaatagtctagttccaaagtccaaggtttaaaccatgatgcttcacttccttcaaactccaaggtaactactacatacaaaactaaattgacatatgatcgaagtgacaggtgaaaacatagctttatatataattattagaaaacaagaactggagaaatacaggaactaagcccgcaattcaataacatagtttaaaaaaaaaacagtgaaataaacctctaaacaacagaaggaaggaaagaatatattttaaaccagaaattactgaaataggaaattaataagttaaagcagcagaattgaccaataaaaagaaaagcaaagttctttgaaaatatcaattgtctttcaaaagacaagcctttggcaaatatagttaagagctaactaaatagagaagacacagagaaaaaaacacattcagaatgaaaaatgttatgagttcaggtctacaggagcttaaactaacatttcagagaacactatacgcagcttcataccaaaaaaaatgtaaacctaaacatttttgaagaaaactataaattgtcaaaatttaccctagcaaaaatataaatagaataaaataaaaatagaaaatatgcatgaattaagacagtcatagaatagttcgtgtagcagagcattctccattttccttcaaaaaagcaggaaatcttactaaaacaataacattagaaaaaaatgaaaacagttgataaagatttacccttagcaaagtcaaaagctccagggcatgttacagaaacttttaaataaaatttcaagtgaaggataatttcaattttagagaaagtatttatgaaacatggaaaattatgggaagttacatacttttattttataatgctcacatttatctgatgaaaaactgaatgaaaacagcatagagtagaaaactcatggtcaattttacacctgagcaatatattaaggtataagcaaactaaaatatttctgtttgagagtgtgtgtgtgtgtgtgtgtgtgtgtgtgtgtgtgtgtgtatgctttacaaatatggctgaatactcacactcagtaagacctataatattgatctgaaatcttcggtcatgtaagctcagggaagtatttctctaccataggtttaattactggttttgatcattaaaaacaccaattatctttagttcaactagcatttgctgtccttactttaatgccttttttctttatgtgctttaggaaattatctgtattttttttctgcatgttactgattacatttcctagagtattattatatttcctgcttgcattacatgtttattttgcaaattttgcatttactcatttcttttcttattacgtgtagctttttaaaaaatctctattttaggaatgcctttttatcttagtttattgccttctcatgtcagcttccatataccaatttcttatatttttaggtgtttttaaagtctattgagatcacaatcacatgtgttctaaaatttatactttttatctgtaaaagtatattttatttttaatagaaattggaaaatatttttttaaatcttatatgtatgacaaagttaactactaacttcaaaattcccaagttcataacacatgtaattaacaaagtattacaagatagtccataaaatatttaaagggtaatatttattgttgtctctgttataaaggtttatcaaaaacaaaaataatgtgtgtattttgtaaagcattcgactgaaaacatgtttcctatagattattatttaatacaaacagctcttttacaaagctaaactaaaacaaataaaccaacaaacagaaatgcatattccaagtcaacatgtttttctggaacataccagatctacatgaatgtggcaagtatgtaaaacgatcaggtgcatagttcactgtcttctttattcatataaatatatatgtatgtatgtcacatctatctatctatctatctatctatctatctatctatctatctatctacctacctatctatcatctatctatctatatgttttagaagagccatatttggtgattttcaccatcttgattccaagatgaaagtgtaatttgtgagcaaatggacaaatatatcttattaatatttagtcatggtttccatgcatatatgcacacatctaccttaatttaattgtggaaattgaaaatagaaataccttcaggttaacataaattttagaagagaatagcactcattaaactgaaaggtaagcagaaataaaactgcacaacaaataacgtgtccaggattcaagtaaataaatgtttagaaaatatgcatgaattaagacagtcatagaatagtttgtgtagcagagcattctccaataatccattgagtctctattttactaacttgatatgtggaagattttgagatacaaacaatagttgttccagtacaggcctcataatcatatttatcatatttatgattaacttggtgtgtcataatctatttgaagtattctgaaatgttagtatttgtaacaggattttatgtattagtcctctttagtgtttatgtccgaataacgtttccttccttccttccttctttcctctttcttcctttattttcactatgtgtataggtatgtgtcaagcatatttatcttagtaagctataatataatacatttggaatcaatcaagtaaaatgtaatttcacattattgttttacttatttgccttccttaaatacttgagaaataagcaaataaacattttacatctgaaagagacttcctatatgtctgttgtttaaaaagttcaactttattgaatgtcatattcatacacccttcttttgttaaattaggaactcatttctacttttttaagtcattgcacaatttctgacaactaattcaaaagcctttcctatgatcatatttatgctagatgcattgaaaatagtaaaattttatataaaataaaatatattgtacatattctcaactaaatataactaattctctagattttaaaagtaacacaactatattacacttttttaaacaattaagaattaatgtttaataaatttacataaattttaaaccttctcatctgaatttatgaacttcacctattcatatttggctacaaaatttgtttgaactgaagaaaacaatatctattatgaaattttatttgtagtttgaaacattatctttagatctgataccactttctagaagatcaatgctatcttgaataatgttttcctgaaacctaaggcttcatttttatgactttctttctcagttaaaaattcagtgaaagtatttttttttaattccagggttctctgatgagcgatgttttcttatttttggactattttccacagcagcccactattgctaaattttttaattaggaatttaaatgttccaggtctttccttaagaatcagaataattagatttcagatcactagatctgagcttttctgagttttgcatgcaaagtcctgctgacagccacttatttcaatcactggataaaaggactcactccagttgctttgccattacctgttctgtttttgaagaaatagctgcaaattcttcatctatagtcttgcaagccggatgttcatattactcttttggaaaccctggaaacctggcaagcttcttctattttaattttctcagtgataattcctctctttctctccatgtagactttaagattctttaaatatatttcttaaggtgatttatgaagaaatgtctctatccagatcagtctatgcctaattttgtacaaagcatgcttatttacacaaaatttaaaagtggacccatgacgtacaagatgctttaatgcttttttttttctttttttgaaaaccctttcattgtgaatcaaatctctgacgtattacagggtattttcaaatttctttctctgtatgtatcaccactcatctgaaggatatgactaatcaggttagccaatttcttcttggttttcagtagttctttcactttgttcaagtcaatattgtggcaatcacttttttcacacattcagataccaggtattattaacggcattcagcacatttcctctatgctttggtgaatccaggagagatgaggtgactacatttaatggtatgagcttgagtacatgcttttggttccctggagtactaaacatctaatctcattaattttttcttatgttgtatacaaaggtgttgactgtgcatttcacaatatttaattaaagttcttagacctttcttttttaacatttctaccaaaagatatttcaatacatatgggaaggcaagtagaaatcacacagttggcaagtaaagaagccagaggttggtgttaaaattgaagccttataacccagtgtcccaaaacttttcataaccttctgatttaaaccgtattagccatgcccacttgacctatgactttctaaaatttctctagtcttcctttacagaacaactagatattatcaccacattgttgaaggcgtacatttttaaaaaaatatatatagtgtcctgtgaaagcttgatgacatttctggaaaaagacataacatttttaaagaaatgcaggcttttcctctctctttccctgaaatggcctcaagcataaaagcctaagctctgaatccaagtttattgacaaaagatgttctgtctgcttttagtcatcatcaagaacatcttctgaaccatgatgtgaaagatacaaagtggtggtcgggcctctcccgtcaacaccaccagaagtgatatctctttgcatttttgcctcatgctctggtgtagagtctcagacacgacccacccacaccagacactgcccacagaattttgaaacactattaactcaggagcactagcagtgacaaagacccactgtattccctaaagccaacccttctgtacctgctttcaatctaagtgtaaactcccttcctcatctctcagtttccatctccttcatttgtctattaagagatcacatcagggatattttgctctgactatattttgttaaatttgaaaatactttgagggcaagatctattcacaagatctaagttcttttcttttccttatatttttgttattttctattgttgtcctttattcttcctgacacaagacatatttaccttgatctgttggtagccaataaacaggatcaataaattctcattgaccaccttaccccccacccccagagattgtggatattattgaaatccaattagatttttagaggagagattgttgatgtgcacagactgtaagtaaattttttcatgcctatgttgtttatcaaattttttttgtagggcaaagaagaaaacttttgctctcagagactagaagcatgacagaaagctacccttaggtgatttggactggtttgaagtgcatgaaacaacaaacagggtatggacacctgtaactgctattgctcccgtggcttctagtatttccatccttcctaatgtgaagctcacagcttgggttataatgcaccatcagttgctaatttctgcctttggtgatgttactctattggaaagtgtatccaaaagaatgtagaagaaaagctagtaattacttccgaatggagctacatagatactgtgcttgctatagagttagaagaaccttcagtgtgaagtatctgggcttttcacacagcagaatttagttggggttagtgcaataacttcttcagtctcactatctggctgtttcatctcagtccataacatgtttttgctactgaaaattcctcctgagtcttggtggatttgataaatattgagaatttcaaattctgtcacaatttactttctgaaattcttctctgttcaatgcctacagaatgtatttatctctgtgcttttatagcaattatgacagaacttgtataacatttgtcaaatagtatcacgtttgttcttaaccattttaaagagagaacatgactgtgcagtaatggctgcttgattcagaggcatttggccttactgtatctgattatgcatccataaaagctcgagattttccaccttatgaccagcccatcatgttttgttaacactattgattgctttggtttggcaccaattgacctagcatgtcatcaccgtcaatgtcagcatctttcacatttaatacacaattgtaaatgtaagacttgctcattactgcagaggatcttaattacacccaaaagatcataaagaaggaggttataagtagtacttggaggtgtttcttttcacataataatttgggaactccttgatgttatgaatcttattcaccttcttatcagcagattgtggcccaggggaagtaatttttaatcatttactgaatggaattgaaatgttaagtatatatatttggtgagaaatatattttaccactaagagatatagctaaataattttagaacattttaaaatttataaattaatttattcaataaaattgtttgcgtctgctatgtgccatgcaaagagattttttcaaagcacttatttcagatcttggtgattttttaaaaaataaatattggatagaaacttgaatgctgctaagaagaatgctttaaaaatattgaggtcatcaagagatcttaaagctaaattaatttgtgtgggcatcaatagaattggaattttctctggccaaccagtgtacaagttggccactcgtaactggttctgacatttggcttaacttagtcttctttgtaatcaattatatccaaaattattgaaaaaagtgaaaaaggtaataaacataattaaaagggaacattatttcaggtgcctcattgcttttccagtattttttctttaatccttttttaattctttctgacctcagagtcaggttgataggcaaaagattgcctaggcgtggggcatttaacgtcagctttagcctttccacattattttggcgtgttcttgggggaaaaccttccagtgcagtgtaagtagaggtccatggatttatttcctcacttccaggagtttaactgcgaattgagaaagattataacctcaaccttcttgtatttatagtctcaacagactcagaaaagaggatgttgaggtgcagagtaaattttaattgagaatatggctatagaactagtatgaaatatttacctgaaaggtgaaaataaagaaagcatggttattttattaataatgctggttgtagaacaaagataaagttataattcctgttaaactattttcaaggattgttatctatcattaaaatgatgtaatgataaatttatttaaataggcagtatcctctttgatccaaacagctttccatatagaaataactcatatggagaaatatgtattgacagattcctttcaatcctagtattcaatgctcctaaagctattatgtcaactaggaggcattttagtagatataaagttcataagactgtcaaattggttctccacatctgagaaatctgcatgcattttaatagagagttaatatattaagacattccaatttgttctttccaggaagttggattaaatgaaggaaggaatacattatttttaatatatcaagtaattcagaaattaagcctttgatgttacagaaaaatgttataatgtttaatgccaagaagagtatctgaaaatgaaaatatataatatttcagaatttatttcaccaatgaaatcactgggcagcatatttccatataactttatgtataatgtataaagcaagctttgacatttttttaggtagttaatatcaaaagagaaactataaaattttgtctgcagctgtctatggaatctcattgataagtgataatgaagtcccaagccctgtattttctctaatttttaaaaaatggatatactggaaaatacatttaaagagatcttttggagtagccaaaatggtattaaatacatgtttttcagaattgttttaattgatcacaacttctatggaaccctttaaagttgctttttgaggcaaattttgagtaactagattgtcagtgtcctctttcatttacctaagttggcattaaataatgtttgtctgttttaaaagaacaatttactctcataaaagaaactattggtctgaggtactcaaaataatatactacaaattccgaaagagttcaaaaaacattttgaacaaaggtgttgttgtaagaatttcccttctgatttaacaatttgtaatattaccaaataccgcatattctcactcataagtgggagttgaacaatgagaacacatggacacagggaggagaacatcacacactggggcctgtcaggaggtcagcaggcaagggaagtgagggcattaagacaaatatctaatgcatgaggggcttaaaacctagatgatgggttgatgggtgcagcaaaccaccatggcacgtgtctatgtaacaaacctgcacgttctgcacatgtatcccagaacttaaaccaattttttttttgaaaatgtgggccgggcatggtggctcacgcctgtaatcccagcactttgggggtcgaggtggacggatcacctgaggtcaggagtttgagaccagcctggccaacatggcgaaacctcgtctctactaaaaatacaaattagctgggcatggtgtcgtgtgagcctgtagttccagctactggggaggctgaggcaggagaatcgcttcaacccaggaggcagagtttacagtgagccgagatagcaccattgaactccagcatgggcaacaagagcaagactccatctaaaagaaaaaactaaaaaaaaaaaaattgatggatttttagacgcattttctaaaatatcactgatgttactataatagtcaaatcacatgggcttgttttttgctattgttttgaaatttttcttgaataaatgtcagaattgcactatttttttttcaatatttcagacatgcatagcacttggagtgtaatatactttagggctttaaatctcagttgtcctacacatgtggaatgaaagaactgatgttcagccaactcgtcagttcttttttttctaatgtatcacatttgatagatgatattagcatgcatgacatattcccaaaaactctaattgtaactccactttcccttccaaagaaatgaaagaaagagagagagagaaaggaaggaaggaaggaaaaagaaaagagaagagaaaagaaaagaaaaaagaaaagaagggagggaggaaagaaggaagggaggaaagaaagacaggaaccgtcaacatttcatcaatagaaacaaaatacatgaagaatatctcataactggttgactcacgtaaattcttggagaacagcagaattcggagctagcaatctaggatatcaatacatgactcagattaactgaatgtcagcggaatctattctatgccaacatacagatatggagaatatacttaacgcatttgttcattaagaggtccatctttatatccccacagtgttgttgctgatgcgcagcttggctttctttcatctgtgtcatgcaagtacccacttcttttttcatcttgctttaggggtgaatgactgagagagtaacctgtttgatagtactgtatagactttttcaacctcttcgttcttgtagacattcttattatcctttcccatatatcaggatggggtgtttttccatccttttgcatatctcctgatcttataaggacccctgatgtatatagcctcacttggaaataattagtgcctactatgtttattcctggaaaataattcttttctgtcttctgaacacatttcaaagcaagctctctcttttaggttctttaattcagggcactcttttttcttctttttttttaatgttacctctttgatgttatctttgaaatcgtagcacttgtcgaaatacctggctttcagtaagcttcataaatgcttgtggattgagggagtgattcagtcttgcactgctgatctagctcatgcaggtctggaagatttttctctgattttcctcattcttgctagctcctattagcacttgcttgtctgaggtttttatatgtccttgttcactgcgttcattatagttcacaagaaaatctttaacaacactgttcaaaccctagcaatccatagaccaactcaggcactgcttacacactgctttatactatcctcagtttgaaagtctttaattggattattcacgttcagttttatcacagtcgttacaatttctcattgttttatataggccccatccacatggctttgttatctgcctggttgtggtggacaatgagatcttgactccaatctaatttatgtctgctaagaactaattataatgtgcagggaacaggtcaataaaatttattcaaagaagaggaggaggaggagaaaaagaaagatagttaaaatttgaacgataaatatttaaacattctaaaaacagaaaatggacatctataaactcagctgccacatttgcctctgatttatttttgagaaataaaatcttatactctaaactctcctcctctacttgccttccttctcaaagcaaacaactatcaaacttactatatatcttttctctgaagatttttattactgttcttgcatacatttgcatccataataaagtttaacattctttcctaaatcctaacatattagactaccttaaaaagcttttcttctttttcagctaatgttatgttttaatacattattattttgatacttgaagacttagtttacttgttttcacagtagtgtagtgatagactgaatatagaaatgggcaatagccatagtatgaacaaaaatagaactttgactcacaacctctgcatcagtcagcccaaaacagtaaattacttggtcaaataactgttcgcttctctaattttgttcctgtttccaactcaggaccaaccagaaaaagttatatatgctgcccttaccaattacatagatgctttgcttctagttagcccactttcagctttccctttccaacaactttcaatcacagaacacttcaaacattccccttcttctaccataacattttcccactcccctccctgcctttgagtctctgccaaataagcgatggtagctgactcccttgctggagcaatctctcagtaaatagcctttgcttgtgttcattttggaagtctttatttgaacagtagtacagtcatgtgtcaatgacatggatacattctgatgaatgtgttattaggtgattttgccatagtgagaacatcctggagggtagttacacaaatctagatggtatagcctgctacataccaggctatgtgatatagcctattactctcaggctacaaacctgtatagcatgttaatgtgctgaaaactataggcaactgtaactcaaaggcaaatatttgtgtatataaatatggctaaacatagaaaaggcatagtaaaaatatggtattataatcttatgagaccactgtcatatatgcagtccatcgctcactgaaatgtcattatgtggcccatgactgtcttcagattctacatccattctcacaaaattctaagtaaacttattctcacaaatattctaagtaaactcttgcatatatatgtatatatatttatgttcatatatatgcaagagtttatttagatatggacataaatatatatatatatatggatattatatatatggatatatatgcaagagtgtacttagactatttgccataaaatgaaatgatagtttagattagttattacttcagctttgtttaactcttcccaaattgctatccaagctttgaacaaatttactttttaccagtaagagtttctgtttcccaaatctttatcaataattagtcttatcagactttttattttttggcaattaccagggatactgcaggctagggcagtaataacaaaaaaaaatcaacagcttcatttaataaaaaatgttttattattcatgtagattacattgctgttctgagtatagaccagtttggaagggagattaatattgtcaaaaataaaatcagatcaaaaaaaaattgtagtttattgtgtatacaaatgaaacattcacaaactgggagacctcaaaccaaagtggtacgtcctggtcagagcagttacagtgcagcatgtaaagcataaatgagggcatacattgatttttattgggattggctatcataaacttacattccttttaggcaagtagaactgttgaaacttattgatctgtcactgatttgtttaatttggctgatttatgctgtcaaagaacagaaagattatgttttgtgttttttaaaaaataattagagctagcattttggggaaaatcacaataacttgagttttggctatgtggctataggctgttggccttgagatatctaaactatatcctccattttaaattttgtaaaccatatcttaacaatatggagtattccaatatatgaacatttactaggtctttaaaagtttgtgatgcagatttctgtgaaagtcttacatattttttggcaaatttattctttaatattttatgttttaagagattttgtaagtgctatctaaacttttgaaaactaactgctagtatatagaaatattatgttttgtataaacacctcgtatccagttgccttgctagagtcacttattaattctaatttgatagatcattctgaaatttttggtcatctgaaaatttaaatagtacttctttttctctatctttagggtttctgtttgagacagggtctcactctgttgcctgagtgagagtgcagcagcatgatcagctcactgcattcttgaactcctggcctccactaatcctctcaaactcagcctcctaaagtgttagaattacagtccatttgttaatcataggtttaaaaatatcttttcctatgcctgtcttttcaatgtgttgattttatcctttgacatactgaaaactttaattttaatgacgtgaattagacttattttccttaaactaattctctaatgccaatagtcttttgtttattttatttatttatttatttatttatttatttatttatttagagacagagtctcactaccattgcccaggctggactacagtggtgcaatcttagctcactgcagcctcaacttcccgagctcaggtgatcctcccaccttagcctcatgaatagctgggagtacaggtgtgcgccatcacacccagctaattcttgtattttttgtagaaacgttttgccattttgctcaggctggtcttgaactcctgggctcaagtgatctgccaacctcagcatcccaaagggttaggattataggcatgaggcactgtacccagcatattttcataaagccatatttaacctgatattaataactatatacttagtttattttgggtagtatttaacctaaatgtatttttaaatccatttattttcaatattaggaaacctttgactttcagatgtgtctcctttaaaaaatatattgcttaaaaaaatgaaaatgcatttcttttaacatatatgcttagtttatttatatttattgaaatatttaatatcttcagacatttttatttactttgttctttttcattagtacattttgttgataatcttttatacattttcttgtctgcttttgttttttcatgtatttcattcttatgtatgtacatatttatttttattcagtttttcaaaatttatgttccttatttttttgtaatgctcattcttaaaaaagtatcacaaatatttagcacatgtagatttatataaatttccttataatttctctctggttttaggggtatccaggaacatatttttaatcttttatatcaatttgatcttttgtaccaaagtttatacacatgtagcttggaagttatttttctgttgttccaattttatcttatttttataagaaaactctagttctaggtgatatgaatgatttcatctttgttgcaacttcttttttatctcagcaaatgattaatatttataaattttctatataactttaaaaaagatctttaaatatttggtttgacgtatatataagttgatattggctaatattagctgacatataagagatgataataactcattaactgagttgattaattttctatatattactaatttgatttagttttcttatttctatctttctgattgtgttatattaaaaataattgttataaatgtgcatttttaaattcatcctcataattctgtttatttttaccttatatatttggaggctatattgttggatgcatgaagttcagcattgttatatttttctacatttttttctttttgctgtttaatgctttatctctaaaacactttatttctaataatgcttttttttttacagatgcctaaacatcctttattacaaacagctatgagaattttgaggccaaggatatgattgcaacagtaaggtttgatttacatggataagctttcttccccatgaaaacactatgtgtcacttcacactttgtctaacacacacacttaaatctccaccgtatctggcaccctatctggcaccctatctgaatttctgttccttgtctgtcaaacgaattccataactttcttgtctccttttatttttaaagtaataatccaatttaaagcttcaatttcaaattaaatctaaattgtactttcttatattgaacaacttcagtccgttgctcaaggaatttcaagtgcaaaagttgttctaatctattctttctcattcggtaagtcctgcaggttccaggatgcctgaaaacatgtatatgtgacaagttcccaggtaattatgcatttggattgcgaatcacactgagtagctatacacagaaaacacagttttgctagtgcaactggctgcattttatttctttgctgttctggttcagttagattttttctgctgatggtggcttcccactgatgttctggtgatatagatgtcatctgtggctatttggaatggtgttcagtattattctgagctcactctcttaccaagaactgctctgttcagatttacataaactcatttggctccatcagtaggtaatgctaccaatggcatggcactgaagctatgtgggcaatcccatgtcactatctcattactcattattcaatttctttatgagactccaatgagaactgaaatgaggtgaagattttcccatgtactctccagacacacaactcctctgttctgctttgtgttgctgtaaatccactaatccgacatgccttttgcctcagtagagtacccaacgagtgagtgagatgcaagtctttctttctttacacttccaacatccactgtacacttgatccacttgggccctctcttgcccaaaaaaatcatgtcttgtttttcatagggtagatttattgctggaaagtgactgaccagtcaggaactgcctttccttgctctctttgcctacagatgtgcctatctgactagttctcaccagtgtggatagaagtcatacgtgttactaatatttctagttatggtttctagtgctaatcctaagaccacagggaaaattcagctcaatattcaattacacataagttaaagtttacaaatgttcctaccattatcacaaaaatgaagactttaattcttacttgcctcctatgttaaacatatctttagtaatactttaaactctcctccaaataattttatttttaaatgtctgtgcttattcaggtttatccatgcttattaattgttttgtctaactttgctatttgcctctcatgctttgtcaggcattgtttatatgtgacccatccaatatccttcttatcctctgtacttagaatggtgcacagcagagtagtccacatgatgtaattttggccaatgagatacaaacagaggatatttgttaaggattctaggaaatgcattttcctgataaaaagggacaaccttattggtatttgatgattctccttcacaacttccctctttcttcctgactaaaaatgtggatgcaatatctggagatacaagagctaactggaaagcataaggaagacagtcagttgttagaaaaagaaaaaagagagaaagaggataatagaaaaatgctgtaatttggatgacattttgtagttgcaaatctctgaaaatctctgaacttcctacatctgaacttattctcatgtgctgaaaataaacttttatggtttaacattacacccttgtttggggatctctcttacatgcagctgaattcaattctgatggataccccccttcttctttctatatacttcttactgcagaatatcctacaagggcatttttggtgcaagactagaagtcataaagtcttgttgtttgtttgttttgttttaatttttgtcctaacatatctttatttagctatgttcatttcataatatagaattacaggttgacgattattttccctgagcttctagaagctattttgagctgtctttttaaatctagaaaactaaattttcattcatatcttttaagcttagctgaatatctaatggctgttttcttaataagtgtattgtcagtagaagggaaaccatacgaggctattctaccatgttgcagtaacaaaaatataaccactacagaattatatttgataagatcatgttctgaaattacttttgataactccccatcatgaggatgagatggtgggtggttgaggaggtgagaaatataataaatacaattaaaaagacagaatttttattaaatttgagttcttggggttcagttttttgagcctacaaaaatagattaatattgaggcaatctgtaggtgatccactacaacaataaaattaagacttttagtaaagccaatatttttagtcctaaatcaacaatagcataataactgatattcaacataaaaaatttattaaagatatctggttaatatgacgcaaaataggctataactgaagcattatgataaaattattccaagaaacaataatcttccagttttgttatcagaggacaatgataatttataattgtataccaaatagaatattagtatctagtggatttatgaaggattttagagaaaattgtgtaaatgatgaccttttattaatgcttcaacactattaccatagctctactgagagtcatattatttttatgttttccagtataggacttgtcctacttcaatgattatgaagtaaacattaaaattgtattagaaactgtttagctccaaaaattgtttttctattttaaaatgtaaatatggatattcttagggctatgctggtaactgtttttccagaaaaaaataataaaaggctaatttttatatttgttgatttctatcatgtaaatagttccaccatagccaatttcaagtttccagtgtgagatcgctgagcacaaagtttgtaaagagcaccactgtatcttttgagctggtacaggccacaggatatactcatgttcataccaactgtaaatctatttttaatacttttgttctagaaaggatttcaggtggctcatataatgtccaataaaacaagataaagtaacagtaaaatgatacacaatatttacataagaagatttagataaagctagaagttaggttagtaagggcttcaatactttaaaagcataaaatattctacatttactaacattggttctagattttcaaacaacagtgtagccatgtttagtttttggagtgagaatgcccttaaagtaaaaatgaacttgttgctcaggatcctatggttagagagaatcttatcctgagagccataatgaagaggactttgtgtaatgttttaaggtacattctgaaccataatgcagtacatctgacagtgtactttgtaggaaaagccataggcatttcacataacagaaagtgtagggggaaatggaggtggggaggatcctacatcatatggcctagttataacatttcataataatctggtttaattttatcttctaacatctgtgattcaatggataacatatttttcaggaataggagctctgctgagtttaagatttgtctccctgagtaatacctgttaaaaccattctgttttatatgtgacttataatgaaattagataattattaataatgacctcactggatgctcacaaaaatatttacaaaaaattctggcaaaacactgggctaaaggaggagaacagccactgtggagaaaggcacaaaacctcacccagggcaaaagcacaaaactgcacctcctctacaaaacaaaagccttaaactagggaaagaagcagagacagcaaccaatgcccttaaggcattgctgaaaactttgtgattgggggaagaaaaaacagaaatgaaaacctttttctgtgttggaagggtaagaatacctattgggtccagaactggcactgggataggatcagtacctctgaggccacaccatccagactcagaggcatagcgcttttctataacttaggctaaatcagtacaagagagaaccatcataccctcgaccccacctctcataacaccagtgttgaataacaagtagcaatgcaatactgctaaaagagataaaagagcacagagagatcctttattaggtgcaatgtaaaaggatgatttaggatgaaggtaaaatagatactggaggaaacctctctgtgaaccaacccctactctaaagacatgatgacactagaggactttgaagttacagtgcactgagaataaaaatagcaatgacaaatctcaacactgatcaattagtgactagattgacccaaattcatgcactaaatttctaaaataggacaaggcatacccatttctagccataaaagctacttacgtcagtatctattgtcctgtacaaattgtctggctttaaataaaaaattatgagtcatacagaaaagacagaaaaaaacactattaaaagacaaagaaatatgacactgatactcaaactatcagaagctattagagaggaaattcaaagtatgcatgattaatatatagaaggctacattgaaaaaaatatgaacaacatgcaatataagatagataatttcatcaggatgatagaaactatagaagaatcagatgtacatgctagaagtgaataccagagtaacagagataaggaatgtatttaacaggcttatcagaacacttgacacgtcaaagaaaaaaaaaatcagtaaacttgaagacgggtcagcagaaattacccaagttagaaggaaagaaatgaaactcattagtcctagctaaagtttgtctaccaataaaatgaatctccctccccaaatctacaaaaaacctataattaattagtcagtttagccatgtcattttatatgctacagtttggatgtttgtctccacccaaactcatgttaaaattgatttgtcattgtaacattattaagaggtagaactgttaagagataaatgggatatgagggctctgtcatcatgagcaaattaatgacattattgcaaaagggggggttattattacaagagtgagttccttataaaaaaagaagctgtgttgctttttgttctctctcactctctctttgcccttccatgataagatgacacagcaagaaggctttttctggacagtgacccctcaatcttgggcttctaggccatcagaactatgtgccaataaatttctattaattacaaattactgagtctgtggtattctttcataacagcacaaaacaaactaagatattacacaagatcgatattttatttctatatactatcaataactttggaattaaaaaaactaccatttataataccactaataagaaaatatttagatataaatttaacaaaacatgtgcaaaatctgtgttctaaaaactacaaagcattgattaaagagtacaaagaatgaatacctaaataaatagatttaatgtgttcatgaactggagactcaatattgttatgatgtcaatgaaattctaatcaaaatctcagcatgattttattgtaaatactgaaagactgattttaaaatttatacagggaggcaaaggaaatagaacagccaaaaacatttaacaaataagaataaagttaaattattgaaactacctgatttaaaaattaaaaatgcaatagcaatcaagacattgtgctattgatgaaatgatagattcataggttaatgaaatggaatagagctttcagaaatagactcaaattaatatagtaaacttttagaataatggtaaaaagggtaattatggagagagaagagtaattttttaaacaaattgtgcagaaaaattgcatgtccatgtgcaataaaaatgaaatttaacccatacttttcaacttatataaaaattaacatagctctaaatgttaaaattataaaacttctagaaaaagacataggagacagcctttgttatattgtgttaggcagaaagaattcttggataagacatcaaaagcacaatcaataaaaaaagaaaaaatctgataaacctatcaaaataaacaattttgctccataaaatatactgtgaaagaaaaaaaaacataagccatgtattaggagaaaatattttcaaatcatatacctgctaaaggatatatatcagaatatataggaaattttgaaagtcaacaatgagaaatcaaacaacctccatcccctgagaaatgggccataaatttgagtaggcattccatcaagaaagcatagagttggcaagaaagcatatgtaaaagtgcacaaaactattagttcttatgaaaataaaaattaaactcagaatgatataccattacacaaatattagaacatcaaaaacaaaaacaaaaaaattaacttacaatatggaatgctcattgcaatgtggagtattggaactctcatactttacctgtgggaatacaaaatgatacaagaatttggaagttttttgtaagttaaatgtacttgtcttatgacccagctatctcactcctatatatttgcccaagagaataaaaatttatgttcacattataacgtatacattaatatttatagcatacctattcataatgttagaaacaagagctcagagtcgcgaggaaaacgagcactcaaatgaaggatttctcagcaaggcaaatttacttctgtggaagggttttgctcacacttttggccactgcgagagcacatcgaacaaaggagggctttttattcccaatgctgttagtccctgcttctgtgtctgtccccattggctggagttggaccgcacaatctaaactgaccctattggctactgtttaaaattgaatatggctaattaggcaagaagggagaggctgtccattatggtacaaggcatgtttgggcatgtcagggcatggcaaaggtgggaagggtggtttcaggggaagagctctttcggcggtaggggcagtttacagaatgggtagccaggagtaaagaggaacctttccaaataaggaagagacatgagttacagattgggactggcaggagaagttgtttacagagcaggtagcttaggagaagggacaaggaagttgatctcgagaacaaagaacaaggaagtcagaaattaaaactttgaagcagaacttactgtatctgacaatagtcactgaaaactggaaatgttcttcagttggtgaatgaatagacaaatgaaatattctctatcttaactgtggtgataaatgaatgactgtatttttcaaaactcacataactttatattacaaagagtaaatttattgtatataaattgaaaataaagtttcaaaaattatttattaatatatatgtgtacattatattcacaataaaatatgtataaataattcatctctagttagaatgatataccaaaaaataagatgtttactattagcattcaatgtggcaaataaaatgttgcaatataatccttagggtattattccattcttgcattgcaaaactgcagatgggaggactactcggtaagtgtagtttaagttcatagatcatattatttcaataattctatctaattaattgtagggtagttctaaatttaaaatatcattagaagttaatgagctggccaggcacggtggctgactcctgtaatcccaacactttgggaggccgaggtgggtggatcacctgaggtcaggagtttgagaccagcctggccacacagtgaaaccctgtctttactaaaaatacaaaaattagctaggcatggtggtgtgtgcctgtagtctgcagctgttcgggaggctgaggttggagaatcgcttgaactggggaggtggaggttgcagtgagccgagattgtgtcactatactccagcatgggggacagagcacgacttcatctcaaaaagaaagaaaataagttaatgaacagataaaattttctcattattcacttgatcatttttatttaaagttatagtagcaccacatgattgctactgtatatggatttagtcagtttttgttggccacttgaatggttgaaactctaaaacatcatctaagaagtgaaaatgtagtttggaaaagactatgaggatatacggaaacaggcaattgaaaacattaaatttaagcagtgaaaagaaaaaggttcagtctatgaatatactctagataaaatctggtagatagcagtacagcataaaaacttgggcagtcatgtgggtggtagagataataaattcatgtggagaacattttcttacattggcgtctcttttgaagatctcatatccagaccgtataagcaggccccctggaatttgaaaatatcttaatctaactgtactctccttctcctcttcttttgccacaaattagttaattatgccatagtagtgatgtggtccttatacaacaaattgaattaaaactatgcatatccctgaaactggagatattttgaaaattttctcacaaattaactgagatgtcttttctgttatgccattaaaaaataactactttgtcaagaactttgaaagatttaagagttttttcctgcttgtaagttaaaaagcccatcacagttttgtggtttctggcaaaagacattagactcctgggtcagagattaaaacaaaacaaaacaacaacaaaaaacaaaacaaaacaaaacaaaacctgttactcatagctcagtaggcagcataaactgcatgttggcatcattttcccctgtcccctaaatcccatgggagcaatgtgaaatggccagatagaagtggtgcatgcagcggatttgcatgatagccagggaactctgagctaagtaagccccaatctttggaaggagctgcaagcaaacctgttcattattttccctgtagatatgaccttttttatattagagagctgtgggggccaagggctttgaaagatttgttgaaaatcactgacatgaggcagattcattaataggagaaaaggcataccaatttatttaatgtgtatacacgggagccttcagaatgaagacccaacatctcaatgaggcacagaagctcatatgccatcttgagggtacggaaagaatgaggacttgaatcctggtcaggcaggttatgggagggggagaagaattctattgagaggcaataaaggattactaggtagaatgattatattggggaacagaaattaacatgtaaatagttttgttttttttttaatttaaatgttccttaaatcatccttggagacagacattgtcttgaaaaagggtatcttcagatatggttacattcttggttttctttcctgtaatggataatgagataatggcgggtgtgggcagtgtgggggcagagtaagaactattgttctccttggtgtgtcagtcctatctttaggtaggtaggggacaggtcccttctagtgcttgttgatttctaagggtttttaatataaaatattcattataccacagagccaaattttggggttaaatatgttaattttcttcacagcaaaaaaaatctctctgaaccaggagacactattcctatcctcttttgaggctgtctgctatagaaaatccttataaaagaattctgaaacaaaagctgtcaaatcttctgctgaaaagatctgcggaaacatgagagacagatgaattatctctcaatataaacattgagtgaaagtagttaaaacattattctccaagcgttaaccaagaagaattttttaaagccaagtaggccattgcaactctaagtcattcccaatcatagctaaaatctaaaacaatgtaatgaatatgatagcaaacaataaaaatatttcgagtctttattatccatacctggacactattctaagaccttgtaaaatgcattgcctcatttaactctctgacagagatactattattattattcctttgacctcatataatcattattctagtctgtctagcatgtcctgcaaaacacgtataagtgatcctgaggagatatgtgtttaatagcttgcatgtcgtggacaaatttaaagctataccattttgattggatgtggtacaggagtggagacactcaaaatagttgaatttgtatagttatttcctaaattttccagatagcccatataattcatgtattgtcctttatatacatcctagaaagtaatttttctttatccagttctctactttctccatgtatgttcaagcatcttaacattttattaatctgttcctatatgacccattcttgctgcatttaaatttgtgcctccaattctaagatgagaatcatcctataatggaggtccagatatttagagtttgtgctatcaaaaattatttttctaagaaaattatttcacctgaagttatctagttaataaaacagaaatggtgatgatccagaatatttttgatgaagagatataaaacatacctagccctactatacaactatgggaccatcacagtttaaagtgcctgaggccaacataagtgagggccttgaattggtagttttgatttttccatcagctatattttggcagccagaactacaaagcctacaccttaaaaatttttcaagactataattctatggcttgagtactttgcgatcaactatttctagctttgatcatctaagacttgtgtggtcatcagactgccaagaatgattaatcatatttaaagtattttgatgggggtgataggaagtaaaacagaagaatagactttatcttccggccatgaaatttcatctgtttaccactggtttgttatgtggtcttcctggaaaccatttcatctgattcaaaatgccaacaaaatttaaagcagcgcttaactgcgctttactcaacataactaaactgctatgatttaaatgtgtcctcccaaaaatcatgtgctggaaacaatccctaatgcaacagtgttcggaggtagggcctaatgagagctgattagaacaagagggctccatctgcatgaatagattaataccattatctcaggagagggtttttgttgttgtcgttgtttgtttttttttaataaaagggaaagctctctcttcttctctgtcattctctcttgcccttccaccttctgccatgggatgatgtagcaagaaggtccccacaagatgctgaacactcagtctaggaccttctagcatccagaactgtaagaaataaattcccgttcattacaaattacttatccagtggtattctgttacagcagcacaacaacctgacacattcccagtgcactacaaactaggaatcttctgccagggttaggataggcctgttgaaaatgccactgaatgtctcatgatgttctttatttccagtcttacatttcccacagcaagagtgatatttcatttttttggagattaacagtaaactaataaatttaagcctttgtattatttccaaatgtttaattctacttctttgcaagtcattcatgtactctgttttctcatactccattggccttatttcacagatcttggacctcaggtagcgtaacagtgtagaaagctgctctttcaaccatcccatctctaaattacaaatcttctactaactctgaggacttatagccagatgaatgatctcaactaggttttcactgatgctgacacagctgcatatgtacagataacatgttctctacccatcaagtctccatgaaattttcacataatatcactatcttctagtgcatctgcttccatagcagatttccattctcggtattactcataagcctagaatgaccaccacccctgtatcccagttaacaactaagggaatatgaaaatgagaaagaccatgtctagatgctttacgaatggtataaaaatatactaaccaatgtttagaaacatatccacggaaatgttatttaattcacgaacctgataacaagtgtcaagactaaaaattgaagaagtgccatcttgagatctaccctgtaaatagtcttcatactctcattccaccttctttaccaagtctagatcacccacaagagcagaggttactgtggaaagttagacttcaacgcttctactttgaaacaatgtgatattctccagttttgcttctttttatctattcttgtcaatggatccagggaattatttctaagttgtaacttgtaaattcaaatcatattactcgttgtcttaaaactttatagtgagtatccttaaatagcactactctctctttgtgcctcctttgtctctaaactactttcaattctcaaaggtaaggctgttttgggtatccatattttgcacatgtgttctctttgtctaaactaacctgtatatatgcccctccaccatcctctcttctcactaacacatttttcaagtctagtatagaacaggacatcataaaaatgcaagccctgagagagtagtgagcaagtcttatttgctgttaatccctattgtctagcaaattagaggtgatcactatatattgttaaatgaattataagctggtttatcaattttcatttattcaaacgaagagttgtcacgtttcagaaatatacttcaaagcacttgttaaaattgatatagacatttctttgtgggataaacttcaatgtgaaatttcaataggaagtttttcttgttattatacaagtaatactccagtgtgtgtaagtagatgcctataattctttactcttggacaacttgaagagttaatttacattcaaggctagagagctttctgctgataggtgccatgagagtgtcagaacacttcaactgaactttatcaaactgagtggcagattggtttatctaaattgaggacttcttttcgccctaccttttaattgtggatcattcttaaggtgttttattataattgtgcacagcttgtgctgttttattgattaaactgctgtgaagctcttggtgcaagtacagcacaaactatgtgatataagccttttaaggttattgttatgcttgtagtcagatggctgcagttgtgatggctgtgattgaaaaacaaatgaaatgtttttgggaaactgtaatcacattagtcttgacatttcactacttcctcctgggtaactaataggttcttttcatttctaaaaagaaacttctaattaaatattatttttcttcttttttttgttagaaaaggtctaattctatgaagacctattaggctgtatgaagtttcacctctttcttcatatttgagttattactgtgcatgccatgtgtatatacatacacatatttcaagaggcttaggatttaatgtaaggatttaataacttaattcaagaggtctaggcgtatttaattactattagacaaagaatatgtacttataagtaattagatttcattagaaaacataaagaaccgaaaattgtgattcagaataaatctgatattgatgattatgaaattaccaagttctttgagcatggataggaagcaaacgaaagagatggagtgtgaggtccttcgacctcataatactgtgagatattatacaattaacacaccagaacagcaaaaccttaggcagctttggtagtcagattgtcagtttgaatccaggctttatcatatactatttctgtgatcttgagaacattttttaacctcttaagtctctgtttccttatctatataaataggataatagtaatagctaactgatatgattattgtaaggattttataacttaatccaagtaaagtattagaacattttaatcactaagtgttggctcaactaaactcatcataaatagatagaatgcctactggtacgaggtaccataaggcatagaaaaaaagcaaggtaatttctgtctttcagggtatttccgtgcccattcgatgcatgacacagttctgaatgccaacctggtagaattaaaagtaccagcatcatttccctcgagcagaaaaaaatgctgctggaagccttactaagtcaataaatggtaagtgtgttgcatatgaatactgtgtgagtttaaaaaaaaacattcatactgagtcactaatgctgacgaataagttaaggctgtggctggtcagtattttcttgagaaccgatgttaccagttgctttgtattcagggattatgtataaatgtcattgcactactctttttagctcatgacatgtgcaagtgcatacacatagtcaactgaaaaagaaagaattaattttctctggtgggcaaagtctcaggatatacctattatgaatgaatctgaccagaattaattatttgggtcttgtaacatcaatattcaatttgccaaagttaggacccctctcaggagtaaaatagccatgatttatctctctaaattaaaaaggttgaatggcattacctcatatacataattcattttaattaaatgcatattcttaaataccttcttaatggatatccaatgcctcattaatcttaaatgtaacaacttgagatcctttgggaagtcatgtgatgactcaaaattcacaaacataatgtgtaatgcccaggtagaatgtctattaggcaatctatgcaggttgagtatatgccaggtatgatactcatttacaatgctgttagctcaggaaaatgttaaacagataaaagacatagattcaaaaaagctgttttttctaccatctatttttaaaattctctttcaaataacactgagatactaatattttaatttttcttctaagaggagagtttatgagggtttgagatagactgagttaacccaagtcaaataaggtttcttttgtgtaatggaagtttcctgtgcatgttagactatgaacttaccaaaagcagaaatttctctctgctttgtttacttctatgtcaccagaatctagaaaattccctcacatatggaagtcaataaaaattccatgattgaatgaataatcttcaaatacactacagtgcattatgactgcctgagaaggtgacatgtcagcattgacctacttgatgtcctcaatcttttttacattttttgagactgtaatatttcaatggaagtaattagagtacacttttctggcccatagttgtgtcttccatcacaatccctgatagaattcacactgattgtgagacattaagctaaagaatgtgataaatgtcttcatgcaaacccaccaccattacgagagagaaagatgtgatgcatgaaaacaaaacaaaatacaattcttagttttatgagctctcaaaaatagatgaattactaattagacatccaagaaatatgctttgcatgtttcatttctttagtttcttatattgccagaagatgtgaaatcgcaatatactatctctcattattttggcatagcatacttttataatgtagtttctttacaaaacagatacttctaaaagaagaaaaataagtctctgaagtttctctagtacattaattcatttgagggaaagaataaaagagagtgagatgggacacacccacagacacatttccagaaaaggctacaaagcctgcagagatggaatcaaacatatagcttttactgactacaaaatacccttgtgaaatttgagaactgcatgaggcattctgctttttgaagcacttttacttcattaatttagggaatgtgcacaataaccttgtgagttgaatcagaaacacggtcccattttgcagataatgaaattgtgacaccaggcagtaggaggaatttgtataaggttatgtgagtaatgaatagtatattgcagagatgggataaacaaattgcagtcattaaatatgtacactagtatggctatgaataaaagaaagaagagggttttggtagagaaggaatatagaattggacaggcagtagagcaacctgatgatatgtcactgaaattttttgagtcttaagcaaaggttcacagaggaactaaggttgaatatagaatcttgtagctcatcacacacaaagaacacaacaatgagattcagagagaagtttttataaatgaagctattcaaatgataattctttcaatcaaattttccttcagtctattcagatttttaaaaagtaactaatatttatatagacttacagtgtgtcaggaacagttcttattgctttgcatgtattaattcatttagttatcctgaccatctgttttgtagattagaagattgaggcagaaggagattaggtaacttgctcaaggtcatatagcagaaatttgtgcccaggcaatctggctccagagaccacactcttaagactacactactctgcctctagataactgagctactctctttttttttattctactgaattaagaatttaaattgaattggggcaatattacagcacaggagttaaacacaaggaattgaaggttgaccctctttagttctagtgcttgctctgaaactgattagctatgtaatttttaacaacttatttaatttctctaagacagttttctgttgaatggaaggaaaaatagtatgtatagatttactagaagaattacatgaaaggacaaatacaaaaatgtttagcgaagtacctgacttttagtaaaaagccatttaatgttaaaattattattattgactgaatcaatcatttgctttaatatcaaaaggtttcaaccatgttgagaagaacagattcagtgggaaaattttctatgagcatcttttgttataactgctgttaccggattggttatcattagcttctttttcatactgctctgagatttttgaaatgacattttaaagtgtttgtgtaggaagtggttcatgtaaaaattgtcagatcactaagacccaagaacagagaaaatcctgatgcatccctaaaattcaataaagatatttaaaaagcacatttattgaagttagaaatattgaattgatttttttaaaagatgcttcaaaaggccttctgaataactttcgatgagtttaaaagagtgaattgaagagtagtgagactgtgagactaaatggaacttttgttaaatgctttggaactctttaggaaaaaagtagaaatattcattaatttttttattttaatggaagtatcagttacaaaaaataaaataaatatacgataaatatttagtttgacaagtttttataaatgtacgtatctgtgtaatcaccatcctgatcaagatacagaacattttcatctctgcaagaagctccctagtgcctctttcaattcaatccccacctcaaactctaccctcctccgacattgacaaatgctttctgattcctttttggcgttcatatagactatatgtcatgcttcttttactccacataatagtttttgaattcattcattttgttacattatcagcgggtcatgttttttcttactgagtattatgacattgtgtattaggtcctccttatccatggtttcaatttcttttttcttttcttttcttttctttttctttttttttttttgaaacggagtttcacttttgttgcttaggctggagtgcaatggcgcgatctcgactcactgcaacctccgcctcccaggttcaagagattctcctgcctcagcatcccgagtagctgggattacagacatgcaccaccacgcccggataattttgtattttttagtagagatgtggtttctccatgttggtcaggctggcctctaactcccgacctcaggtgatccgcccacctcggccttccaaagtcctggaattaacaggcatgaaccaccacgcccagcctcatggtttcaatttctatggtttagttacatacaatcaaccaagcctaaaaatattaaataaaactttccagcaataaacaattcataacttctaagttgcacagcattctgagtagcatgatgaattttgtgccatcttactccatcctgcttgggatgtgaattatcctttggtccggaatgtccatgctgcatagtctacttgccaattaatcattcagtggccatcattggttatcagatggactgtgatggtatcatagtgcttttgttcaagtaacccttattttacttaataacggccccaaggcacaagagtagtgatgctggcatattgctgtaagtgttctattttattattagttattgttgttaatctcttactgtgcctaagtttataatttcaaccttatcacaggtatacatgcataagaaaaaaacatagcagtatatataggatttggtgctatttggggtttcaagcatcttctgcgtgtcttggtatatacctcttgcagataaagcatgatttttcttactatgcaaataagtaatgctacttataagtatagttataagtaatcatgccttatcttcaggagatacattccaggacccccaggagatgtttgaaagcccaaatagcaccaaaccatatatatgctatgggtatatactatattttatagtagaaaatgtcagcaattttatcttcattcacttgttgcagaaaaatgtttctccagtatttggctataatgactactatgaatattcttgaataagtcttttggatatatgttttcatttctcttgtataaatacaagtgaaattgatgagtcatggggtgaatgatggtttaacttcataagagattgacagtctaaaaagctatacaaatttatgttcctaacaactgtgtataaagtttccagatgtagatatattagcattttctattttttgtgcacttttcataattgtgattttctaggagattgcctattttatctaaatcgtctaattcttagcattactttatccacaataccacctttgatatctgtagaatctttggtaatttcctctcttttgttcctgatattgggaattagtcttattagtctctctctctctctctctctctctctctctctctctctctctctgtctgtctctctctctgtctctctctctcacacacacacacacacacacacacattgttattaaccagtctttctaattttttatcaattttcttcatttttacaagaaactaatttttggcattgcttgattgtatctccattttatttactcttgctgttattttttttcatttcattttgttctaataattttggaattgccactcttttaacttcttgagttaaaagctttgaatattaccttggaccattttcttttcaagtgtagccatatagctgtattttttagctgtatatgttactcgacaccgttgattgtggctgattgccaaaagtgagattaactctccactcaaaactgtgtgataagttgagactggtgacatgacaatcaccagtaggctgtgaaaagagttattacctatataggaggattttctgggtaaagtaggacaggctcaagacagtttaggtaacttgagggaagcagagagagtgagttaatttttagtatggctaagaggtgggaatgggaagatttcatgcctgtgcaaatgggtctgagcttcagtgatatgaatgttctgctagtaccatggaagcaggtatgtaaactttttaattggcttggctagatgtaggacaaaagaggaagggggaggataggcttgtaagctgtcagtagtgaaacatcaaaaatggagtctttctctttattatagccatatctatctccattccactaattctatgttgcatttcattattatttggtaacgtattttctaatttcctatgtatttcttttttgacctatgagttattcagaaatgagtatcttaatttcaaatattgaaattatttgaggcattttctttgtattttatccttattgatttctaatataatttaattagaaatctaatttaacaccattgtagtcagaaagcaagacttcgtatttttcagtcctttgaaatttattgagatgtgttttatagcccaccatataatatttgtacagttaaaaaatgtatattatgattctgataggtgttgttttctataaatataaattaggtacaggatgttgatagtggttttcaaatattctttatcataaacagcatttctttcattgttctgtcaattactgacaggagcatgttaaaacttccaatgcgattatggacttgtctgtttctttctttagttatattttcacttcatgaatttgaatctttgttattaggttcacatactctgttttaggtacattagtatgtctctaataatttgactttttatcattatgaaatgtctctacttctgattatactccttaatttgcctgataataatatagccatgttgactttcatatggttaccgtatttatggtgtatatagacatagaaatagatatatatgtgcccttttacattcaatctatgccttatatttaaaatgtttcttgttttccgaactttgacgatttgaatataatatgcctgtgtgtgcgtatgttttttggttttttttgttttttttttggtgtggggtgggtggtatttctcttgcttggtactaacttcctgaatttgcagtctggtgtctgtcactaattttagaaaatttttggtcattgttactttaaatgtttctttttctcttttctctttatgacattccaatttcatatatgttatatcttttggtattgtctcacaattttgagatgtcctgttctattttgttttctattcttgtttctctttgcattacagttgcgagtgttctattgttctgttttcaagtgcactgattctttccttggccatgtccagttttttggtgagttcgttgaaagcatactttaattctgtgtctgtgtttttctatttctagcatttcctcttgactcttttttttatagtttccatctccctgcttacattacccatctgttcttgcttcttatacacttgtggcattagagcccttaacatattaatcatagttattttaaattccctgtctgatgattcccatatctgtttcttatctcagtgtggttctgatgaaattgttttctttctccagagtgtgtttttacttcccttttgggacttgtaaatgttgttgaaagccagatatattgcattaggctacaatttcccttccctccctgggtcacctggaagatgtctcttcgattgtcactgtgagaagctggtggaaattctggaaatctcactgtgagaagctggtggaaacaaagtaaatatgtccttagtgtgaggatttatgttaatctgactaacagttagcctgtgtttagtgtcgattacagcagtagatacccaagcgttattgtatttttccctgttatctttgggcttccctatgtactctttttcagaaagcctgttttgcatctcattcggctgtaatgcactatctttacactggatccctgttggcataatactcaaatataaagggaaggggataattttgtaatcttctcattaatctgctatttagtgggcctgtatctccaaggtatgaccttcacaagtgtttctgaaatagcatagcttttattccccttcctcctactcctgttctagtacagaattttcagtctatttcctcgaaaccctgaactccgttgaccatgtttcccccaactccctttggtgagacaggaagtctagtgactggaataaggaggagaaattctcttctgaagtttgaagtttgcactgtggctaagtcctttgcctaaaagattaggggaaatattgtgatgattgtacccaagggctactcttgcccttccctgacagtcaccaggggggatttctcgtggattgtcaaagtgagaaactggtggaaatcatggagaggaaatttaggaaagtttgtcccccattccaccccaagactgtgtctcctaggagtttcttactctccaactagtccataataagcctcctacaatttatcccaattcccagtaagtgtttctgccagtttctggcttcagtagtttctgcttcaggtaggcagattgcagctgtatcttttcagatgtgcctgattttctggattgaaggatggtagtttgccctgtgatctccaattttattatgggtccgaaaaagtccctgattttcagtttttctagctttttctagttttaaatataggagtggctctttgcatgtcaaaactgaaaccagaagtctgcagtatttcttgtactacataaaatataggtggttttgtttttttcatctaatctgacaatctctccctttatttagtgtatttggtccatttacatttaatttcataatggatatgtttatatttaagtctactatcttggtatttgttttacatttgttctgtctattctttgtttctctgttcttcctttcctgactccttttcagagtcaggcattttttagcatttcattttatcatagggaatccccaagataacagggaaaaatacaataatactggggtacctactgctatatctctctattggattattagctatagttttctattttatgttttagtaatttttataaagtattaactgtctatgtcatcataatctacctttaaataatattatgtggcttcatggcaaatgtataagcctttcaatagtattgtttcatttaccctttcctccctttttgctcctgtcacatattacaccattctatatgcagaaacctcacaattcattttattattttgttttaaatggttattagtcttttaaaatgtatatatttatgtatgtgggctcccagctttctgtagctgttgatttacccttttatagaaatttctctcagatattttgtcccaactccattcttcagtcaggtgttgctttgtcctaggggaaggccccatctgcctcaaggaggtcctctcagtttctttacctttttaactcagtctttggccaactactcctgaatttgtttagtgtgcctgtgtctccaagctataaccttcggaagtgtttctgaggtagcatagcttttgttcccctttccttctactcctgttgtggtgcagaatttttagtctatttcctcaaaaccctgaactctgttgatcacgtttcccccaaatccttttggtgagacaggaagtctagtgactggagtctatgaagagaattggtaggtgaatacatattgccctgtggctggggatctttgggattctaattcatcatattagctcacatgtagccacaaaaagtttgatatacatttatctggtttattctgtcctcaatcaattatttcttcttgttcttcaccaggaataaatgcagtagtgatatgttttcttatagaaagggcttgtcactgtctggatattagctcatttagatttctttgcattcttaactgtctgcatttttttattgttgggtagtttgttcagcttatttccagctttatagttctcccaacattattacttttaaaattctaactggaagtagaagtcctcttactgttgtataaaacatctgcctacttgacaggtgccatcagccaatttgtagataacctattgcaaatgcaagtaaaagcattttacaactagtcttctctttatagacatttatgcagaataactatatttaaggcatggatgaagaattcagggctatagaaagatcttatcaatatatctcagagctactgttgtggtagcagcaggggttcatcacaggtcatgcaagttgttcggcttgactaatgaagaatatggcttcttttactgagttaatcataggtcctaagtcttctggtgtcatcaggctcaagaagaactgtatgaacaccaaattgtgagtagcaagggagaagtgaacacattagtatctgcagggatgtgaacagaaataaaggtcagaataatatctgtttagaatttctaaatgtctatgtccttctgtggtgcccaccactgggagagggggtagaaaataacaaaccctaataataaacactctctagtcttaaacatgcacagcatgatgatggccattcaacccagtcatggaactactaattggatgattatcttttgtatagatgctatttctatatactttccgaacctcaagaacctctgttgcttagtgctgaggagctctccccatcttcacactccttcacatggaaaaagtgtgtgtgtgagattgtgtttattgagggggatgggagcttatatattttttcaaagtgaactttatttttaaagcagtttagggcctgggtgcagtggctcatgcctctaatcctagcaatttgggaggctgaggtgggaggattgcttgaggccaggaattggagaccagcctgggctacttagtgagaccctgtctttatagaaaaatgatgataaaaattagctgagcatggtggcacgtgcctgtagtcctacctactcaacagggtgagacaggaggatggcttaaacccaggagtttgaggctgcattcagttatgatcctgccactgcactctagtctgggcaagagagcgaggcccagtctctaaatataatgaaaataataatataaataaggtaaataaatcagttttggatttacataaaaattgtgaagatagtatggagtgtttgcatatatctcaaacttagttacccctgttattaatatcttacattagtatgctatagttattacagtgaaaagagtttaattaagcccatactttactcagattttcttcatttttatctaatggaaggatcccgttctaggatccccaaccaggacaccacattatgcttagctgtcaatatctccttaaggcttctcgtggttgtgacagtttcttaaactttccttgtttttcataatcttgataattttgagaagtgttggtcatgtatgtttcagaatgttcctctattgggatatatctgatgttttttaacaggttataggtttttggaaggaagattatagaggcaaagtgcccttctcatctcatcaaaccaaggacatacaatatcaatttgacttagctctattgatgttgaccttgatcacctggaggagaaaacatttgtcaggtttctccactataaagttactcttctaatttctcactttaaattctgtactcttttgaagagagtccctatgtgaagcccacacttaaggagtcgatagtttcacttttcctcctgagatttgtcctcctttcccatcttatttattcaatcaattatttttatcagtatgatttcatagatatatattgaaactttgagttacatctaatatcattttatatattttcttgttcaaattgttctaactttggtcattgcaagttgtttcacttgctttttgtgttcccttttttcctttcttttttgcactttcttattttctgaagcagaatactccagactcctcttctgtatttctgtatttcacttgctttttgtgttccctgtttttccttctttctgtatttcctaccgcattcccagtattagccattttttttggtccaagaagccctggttatttttcatggagaatgatattagaaaccaatatctgggtgtgaagtgagttgtttgtccctactggggtgtaacatttcttctaggccctctcagctgacagagcaaggaaatatttagtatatgctaactcttgtatatacaaatatctttatatatgtatgtgtttggaactgtgtctttataagttaaatatgaatgtctgttgatgtcttcaactgtaacccattaccgcatcaattattctgatctcatcacattgcttatctgtaaattcccactccgaaagtgagaagactggatcccctctattcaccatcctttaacttaattgttcaattctatattgaattgtgttttatggcctaccatagaatataagtacacatatatgagttagcaactctgatactatagcagtgttggaattgtattagtattagtatacctatactaaaactattatactattagtattcctatactaatactattatactatactaaaagtatacctacgctaatcctattatactattagtattatatacatacaatacctattatcatagcagtattagaattttattagtattagtatacctatactaatcctattatactattagtattatatgtatactattagtatattatatattagtatacctatatacctaatatacctatataatagtatacctatatattagtatacctatactagtacattatactattagtatagcatactaatagtatatgtgtaatactaatagtataataggattagtataggtatactaatactagtacaattatatacaattacatagtattagtatactagcaatattagtatactagtactattagtatgctaatactaatagtactgatatactagtactattagtatgctaatactaatagtgctgatatactagtactattagtatgctaatactaatagtactgatatactagtactattagtatgctaatactaatagtactgatatactagtactattagtatgctaatactaatagtactgatatactagtactattagtatgctaatactaatagtactgatatactaatactaatagtagagtattagtatgctaattctaatagtacaagtatattattagtatactatagcagtattagagttggtaaactctacctgtacatatattacatggttggacacaaaacacaaacttatcttgataaatttcaaggattaaagcatacaaagttttgtttcttgtcttcaatggtattaaattagggatcagtgagagtaaggtattaagtaaattccaaaatatttataaattaacctgaataactcatattaatgggaaaaaaaatcacatgagagattataaaatatttctcactgaataataaaggaacacgacataactaaaatgaagaagaagaaaggaaatgaaagaaagaagaaagaaagaaaagagaagagaagagaggaagggagagagggagagaggaaaggagggagggaggaaggaaggaaggaaggaaggaaagaaggaaggaaggagcgaagtgagggaaggaaactcccatttttgtcgcttagttctatgctgcagcactctttcaacacttcgccaggccgccagtttacaactccatcttagctttcacttcctgcttctgctgactgtagatcaaccagagatcaaaatgtagggttttctcaagtctttctgagtatgagttctgtcctgggcatgcacgtatgcatggctttccaaatagccttgcccttttggatgtcacaatttcccccaaaaatattctcctcagcttttccttccaggcttttgacacactttatttatttatttattttttgcctcaaatgtaatattttgccccagttggcagcaagttgtttatgtgcttttgagaaatgatgggtgactctattttgagtaattctgagtaagggaaaacaaagacatgttacttgtgctgggccttcaggcagcttttaaataggtcaaaacggacaaacgcaattctttaaggacaaattctgatctgctctctctataaccagggaacagtgtttcatatttggactatgggcttccatcttcaagatcagctctgaattgaataggggagtgtagtaaggacaggtaaaaatgctgtgaagttttcttgttactttacagttgcctttttcttctttcagcattcacttgattactgtaaagctttgactactctttagtgttttgacaatattaattctgacagttttacttaattttttgatgtttctgtggatgaatgggactgtggagttacttttgccatcatttttgctcttagtactctatatctttttcggccaggtggctgtgtaatttttttgcccactttcaaattaggatgtttgtattctgattgttgatgtgtcagttttctgtttatttggaatataagtcttttatcagatatgtcttttgcaaccattttctctcaggttttagcctgttttttgattctctccactgtctcacggagaagaaattttttatttacttgaagttcaacttatcaatattttctttgtgaatcatgctttaaccatatttatataaaaatgtattggcaaacccaggtcacccagattctctcgaagctttatcgctttccatttcacatttagatgtatggtacattttgagttaatttttgtaaaaggtgtcaagtctgtgtctagattcttttctttgcatattataggtccacttacactagaaacttttgttgaattgccttttttgggggtactgtctaacattagtttatatttatgtgagtcttattgcgactttctatttcattccataatatatgctcttgattattatagctttatagcaaaccatgaagtcaggtaacgtgaggttttcaaatttgttcttaatattgtgctggatcttctagattttttttctccttttaattttagaatcaatttttcaaaaactacaaataacttactgggaatttgactaggattgtgttgaatctatagctcaagatgtaaaaaattggtattttaagaatattgagtcttccaatccataaatataaaatatatctgcatttatttattgttaaatttattttatcaggattttatggttttctctatatagattctgtgtatattttaatgaatgtgcatgtattttatttttttggaatgcttattgtaaattttgctttttaaaaaaattgatctcaagttccacatattcactgctgttttatatgaaagcaattacatttgtatgttgaacttgtatcttgtgaccatgctatataaacttatttcctggagttttttggtttgtttatttgggggggattttcttcatagacaatcacgttatctgctaggtgaaacagtttttgtttttcttcctctcaatctgtataacttttattttttcctgttatctaactcccactataaattgaataagactggtgagagaggatatatttacattgtccatgatcttcagagaaaaccatacagattctcaccattaaatataatattagttgtaaggtttttgtagatattctttatcaagttgaaaaagttctcctctatttttatttgctaagatattttatgataaataaatcagatttttttcaaatgctttttctccaccaatttttttttcttgagcctattgatatggtggactgtagtgattttgtaattgaactagccatgtatatctggaataaatctgatataatggtggtgtataattcttttatagattgttggataagatttgctaatattttattgagggttttgcacctgttattaaaacagatattggtatgcaattttcctcctgttaaatgtttatttagttccattatttcggtgatggtagccccatagaatgagttagaagtgtttcctctgagtctttggaagagatgttggtaaatggctataatttatttattaaagagaattcactggtagattttaccagtgaaattatctgagtctgctgctttgttttttttccttaggttattaattatttaacttctttaataatataggccaatcatgtaatttcctcaattttatttaatgatataggtcaattatttaatatttttaatgatagtggccatttaggttacttatttctccttgtctttatcttagtagtttgcatcttttaaaaaggtggtctattttgcctaagttacaaaattttgtgggcatagtggtgtttatagtatttctttattattcttttaacatccaggtggtacgtagtggtgatctctttttctcttctgtagtcagcaatttgtgtcttctctctcttacttttggttggactacctggctggaaatttgtcaatgttattgatctttcaaagaactagcttttgttttttgtgtgatttattctattgattttttagtttacaattttattgaattctgatgaagtttatattatttctttgtgttctatttgctttaggctaatattgcccttattgccctttctttgctagtcttctcaagcataagcttatgttattaatttaagaggtaccatatattctaatatacacattttaatttctgtcaaagtaatgctattgctgcatcccacacattttattaagttgtacttttattttcatttagttcaacatattttaaaatatcacttgaggcttatttgaccaaaatgttacctacagaaatattgtttaatttccaaatatgtgaggatttttaagctattatttgttattgatttctagtttgattccagtgtggtttgagaatatactttgtataaatttctattcattgatgagtgctttacatgagcttgagaagaatatattctgttgttggatggagtattctgtaaatgttaactggattgagttaactgagagtgttgtttaggtaaactgtatacttactaattttcttgtctgcttgttctatctacctgttacagaggggtaaagaggtatccaactaaaatactggattaatctatttctttttgcagttagtcagtttttgcttcaagtgttgatactctgtgtttaggtacatatacattaaagattgttcagtgtcctcttgaggaaacaacctttttatttttatgtaacgcccttctttattcttgattcttattgtaaagtcggctttgtctgaaatcaatataggcccttttaaaattagtgttagcatggtgtattttttgccatctcttttcttctaacgtatttgagtttttatatttaagtgaatttctcataaatctcgtggtggtgtttttctttttcccctctaattatttctatcttttaattagtatatttagacaattcacactcaaagtgattgtttttatgttggatcaatatctgccatatttgtaactatttctttatgcggtgctatttctttgttgcttttttctaatctttttttccccttctttggctataattgagcatttcattttctctcatatcccatatcaattacatttctttataaattttagtagtggttacgctagaatttgtcatatacatgtttaactaatctaaggtcactttcaagtaacactataccacttcatgaatggtgcaggtaacttataatagagcattcccaattcctccctcccatcgtttatgtcattgctgtcattcattttactaatctatatgctataattcagtgcatggctactattataatttttaaaaattatatcagttaagattgaaaaaaataaaagattgcattttacttttctttattctttttccaaggcttttccttaaaaaaaatggattgaatttctactctatatcattttccttctctccaaataacttcttgttcttacatttcttgtgggtcaggtgtgttggcaatgaattcccttagtttttgtttgtttaatagagtccttaatttttgtttgtctaagagaatcgttagagaatttgttgagcatttgtatttttccttcagtttaaataattttactgcatatagaaatctaaataggtggcttatttctttcagcaatttaaatatttcacttcactcttcttgcttgctttctgagaggaagtctactagaattctttttatttcttttttttaaaaaaattatttcaatagtttttggggaacaggtagttttagttatatggataagttctttaatggcaatttctgagattttggtgcacctgtcacccagggagtgtacactatacccaatgtgtagtctcccatccctcactccactcccatccttcttcctcagtccccaaagtccattatatcattcctatgcctttgcagtctcacaacttagtttccagtgtaagtgagaatgtgctatatttggttttccattcctgagttagttcacttggaataatggtttccagttgcatccaagttgctgaaaatgtcattatttcatgtttttaatggctgagtagtattccgtggtgtatatatactacattttctttatccactcattggccaatggacatttatgttggttccatatttttgcaattttgaattgtgctgctatcaacatgcatgtacaggtatacttttcatataataactgtcaggcctctgagcccaagccaagccatcgcatcccctgtgatctgcacgtatatgcccagatggcctgaagtaactaaagaatcacaaaagaagtgaatatgccctgccccaccttaactgatgacattccaccacaaaagaagtgtaaatggccggtccttgccttaattgatgacgttaccttgtgaaagtccttttcctggctcatcctggctcaaaaaacacccccactgagcaccttgtgaccccccactcctgcccactgagcaccttgcgacccccactcctacccgccagagaacaaaccccctttgactgtaattttcctttacctacccaaatcctataaaacggcgccacccttatctcccttcactgactctcttttcggactcagcccgcctgcacccaggtgaaataaacagccatgctgctcacataaagcctgtttggtggtctcttcacaaggacgcgcatgaaaataacttcttttcctttgggtagatacctcagtactggaatttctgggttcaaattgtagttctactttaaattctttaaggagcctccatactgttttttatagtggttttactagtttgcattctcactagcagtgtagaagtgttcccttttcaccacatccatgccaacatctattattttttgatttttaaattatggccattcttgcaggagtaaggtggtatctcactatggttttaatttcatttccttgataattagtgatgttgataatgttttcatatatttgctggccatttgtatatcttcttttgagaattgtctagtcatgacctttgcccactttttgatggggttattagtttttatcttgcttatttgtttgagttccttgtagattctgcattttagtcctttgtctgaggcatagtttgaaaatattttctccctctctgtgggttgtctttttactctgctgattttcactcgtgtctgtgtgaagagaccaccaaacaggctttgtgtgagcaacaaggctgtttatttcacctggttgcaggcgggctgagtccgaaaagagagtcagtgaagggagataggggtggggcagttttataggatttgggtaggtaaatgaaaattacagtcaaaggggggttgttccctggcaggcaggagtgagggtcacaaggtgctcagtaggggagcttttgagccaggatgagccaggagaaggaatttcacaagttaatgtcatcagttaaggcaggaacaggccactttcatttcttttgtggtggaatgtcatcagttaaggcaggaactggccatctgggtgtgtacgtgcaggtcacaggggatatgatggcttagcttgggctcagaggcctgacattcctgtcttcttatattaataagaaaaataaaacaaaataatggtaaagtgttgggaaaattttgggggatggtatggagagataatgggtgatgtttctcagggctgcttcgagcgggattaggggcggtgtgggaacctagagtgggagagattaagctgaaggaagattttgtggtaaggagtgatattgtgggactgtgagaagaaacgtttgtcatttagaattattggtgatggcctggatatggttttgtatgaattgaaaaactaaatggaataagagaaggagaaaaacaggtattaaaggtctaagaattgggaggacccaggacatctgattagagagtgactaaggagattcagcatagtcctgccagcaaagattatttatttgcttcaagagttaagagtggcagtttggggatagcactaggagatatcagctgtggtggcttggagaaacagtgtaaaacggcagtgtaaacaagagcagggcatgtatgaggtagttgagaatggtgaataggagtatgactagacagaagatagtagggatgacaagttttttggggcacagtccaagttggtctggtgtctgaaatgagactggggcctaataaaaaggagcatctatacaagagcttaaatgggctgtaccttgtagcattctgaggacaggcccgaattctgagaaaggcaagtggtaaaagtattgtccagtcctttttaagttggtggctgtgtttttaaaagactgtttgtccgttctacttttcctgatgattgaggatggtaagtgatataaagatttcattgaataccaagagcctaaaaaactggttgggtgatttgactaataaaggctggtctgctatcggactgtatagaggtgggaaggccaaaccgaggaattatgtctgacagaagggaagaaatgactgtggtggccttctcagccctgtgggaaaggcctctacctatccattgaaagtgtctactcagactaagaggtattttaatttcctgacttgaggaatgtgagtaaagccaatttgccagtcctgggcaggggcaaatccccgagcttgatgtgtaggaaaggaagggggcgtgaggaatccctgagaagtagtagaataacagatggaacactggaaagttatttccttgaggatagattttcacgatggaaaggaaatgagaggttctaagaggcaggctcgtggcttgtgctatagcatagcctgcctttctggtgtgtggcgattaggcctggtggaactgccatcaataaactgagcgtgatcagggtgaggaacaggaaagaaggaaatatgaggaaatggggtgaatgtcaggtggatcagagagatacagtcatggggatcaggtgtggtatcaggaataatgtgggaggccagattgaagtccaggccaggaacgatggtaattgtgggagactcaacaaagagtgagtacagctgaaggagctggggagcaggaagtatatgcatcaggtgtgaggaagaaaatagattttggaagttatgagaactgtagagagtgagttgagtatagtttgtgattttaagggcctctaaaagtatcagggcgtcagcggccaccacacacagacttgagggctaggcaaaaacagtaaggtcgagttgtttggataaaaaggctacagggtgcggttccagttcttgtgtaagaattctgactgcacacccctgcactttggctgtgggtaacgaaaagggttgggatgaatcagggagagctagggtgagggcagtctctaaggctgtcttcaaggaatgggaagaggagtggggaaaggatttaggatctatggggtcagctagatttccttttgtgagtttatataatggttttgtcaggatggcaaaaccagatatctaaagtcgaaagtatctaaccatgcctaggaaggaaaggagttgttgttttgtagaagggattggggtttgggagattagccagacacaatcagtagggagagcacatgtgtttttttgagaattatgatgagataggtaacagatgaggaagaaatttgggcttgactgaagtaatgggggctgcctgtgaagacttgcagcagtacagcccaggtaatttgctgagcctgatgggtgtcagggtcagtccaagtgaaagtgaagagaggctgggatgaagggtgcaaaggaatagtaaagaaagcatgtttgagatctagaacagaataatggattgtggagggaggtattgaggataggagagtatatgggtttggcaccatggggcggataggcaaaacaattcggttgataaggcgcagatcttgaactaacgtgtgagccttgtctggttttaggacaggtgaaatggggaaattgtaaggggagtttacaggctttaaaaggccatgctgtagtaggtgagtgataacaggctttaatctttttaaagcatgatgtgggatgggatattggtattgagggggggtaagggtgattaggttttaatgagattgtaaggggtgcatgatcagttgccgaggagggagtagaggtaccttatacttgtgggttaaggtggggggatactagaggaggatgcgaaggaggttttgacctggggaaaagggcagcaatgaggtgtggctgtagctaataagggaactgggcaggtggggataattaaaaaagagtgcataaaagaatgttttctaagttggcaacagagttggggagttttaagaggtttagaagcctggccgtcaatacccatgacagttatggtggcaagggaaacaggcccttgaaaagaaggtaatgtggagtgggtagcctctgtattgactaagaaggggatggacttaccctccactgtgagagttacccagagcatctgtgatggtcctgtaggcttccgaggtgattgggcagtgttcagtcttcagctgctaagccaagaagatctgggaaggagtcagagagccttgggccagagttccagggactctgggggtggctgccaggtgagttgaacagtctgattttcagtggggtcctgcacagatgggacgtggcttacgaggaatcctgggctgtgggcattccttggcccagtggccagatttctggcacttgtagcaggctcctgggggaggaggttctggaggaacccctgacagctgtggttcaggcatttggagttcttatgtgctggagatgtggctggggtttgtctcacagtggaggcaaggaattgcaactcagaaatacattgctacttggctgcctctcctctattattgtacaccttgaaggtgaggttaagtcttgttgtggggtttgagggctggaatttaatttttggagttttatttaatgtcaggagtggattggttgataaaatgtatattcagaataagactgtcttttgaccttttagggtctagggccgtaaagcgtctcagggttgctgctgaacgagccatgaactgggctaggtttttcatatttgatgaaagagcctaaatgctaactgatttgggagaggtcagataaagaaaaaggagcactaaccttgactatgcctttagcttcagccacctttttaagaggaaattgctgggcaggtaggggagggctagtcacggaacgaaactgtaagctggaccgggtgtgaggaggggaggtgataaaaggattatagggttggggagtagaggctgaggaagaattgggacctagctcggcctggtgaggagcagcctggggaggaggggagaggtcagatgggtctgtagaaaaggaagattagaaagactcagtaacacttggggttgggactgagagaacatgtggaaggggaaaaaggataatttgggacgagtcacattgagaacagagagtagggagggaccgatgtgtaaaagaatgactggatgtcaggcatctcagaccgtttgcccattttaagacaagaattatctagatcttgtaggatggaagaatcaaaagtgccattttctggccatttagagccattgtcaagtttgtattggggtcaagcagcattgtagaagaaaataaggcgtttaggttttaggtcaggtgtgagttgaagaggttttaagttcttgagaacacaggctaagggagaagagggaggaatggagggtggaaggttacccatagtgaaggaggcaagcccagaaaaaagagagtagagacacggagagaaggggttgggtggggggttcttgccctccagagaagcggagaaggggtagagacatggagagaaggggtcggggggttcttgtcccctagaaaagcagtatttgctgctaaggttgaaggagaaggggttagggggttcttgccccacagaaaagtggaaaaggggtagagacatggagagaagggttcggggggttcttgccccctagaaaagcggtacttgccactaaggatgaagaaggggttggggggttcttgacccccagaaaagcagagaaggggtacagacatggagataaggggttggggggttcttgccccccagaaaagtggtatctgccactaagggtgaaggaccaaggcaggcatccccgtgtggtcaggcacctctgaaatgtgggtgaataatcaggcaggcatccctgcgtgattaaacaccaagggaagactgtcttcccaagtccgtgactggcaccgaagttttgggtccacggataaaacacatctccttcgtctctaccagaaaaggaaaggaactgaaattaagagaagggaaagattgaagtgtggcaccaagattgaaaggaggaagaggttgagagatagtgagagaggtcggagaagagagtaaaaagaggccacttactggatttaaaattggtgagatgttccttgggctggttggtctgaggaccagaggtcgtaggtggatctttctcatggaacaaacagcaggaggacaggggattgatctcacaagggaggtcccccaatccaagtcaccgcaccaaatttcactcgtgtccatgtgaagagaccaccaaacagtctttgtgtgagcaacaaggctatttatttcacctgggtgcaggcgggctgagtccgaaaagagagtcagcaaagggagatggggtggggccattttataggatttgggtaggtaaacaaaaattacagtcaaaggggggttgttctctggcgggcaggagtgggggtcacaaggtgctcagtaggggagcttttgagccaggatgagccaggagaaggaatttcacaagataatgtcatcagttaaggcagaaacaggccgttttcttttcttttgtggtggaatgtcatcagttaaggcaggaactggccatctggatgtgtatgtgcaggtcacaggggatatgatggcttagtttgggctcagaggcctgacactgattatttcttttgctgtgcagaaactttttagtcatgttccttttatttatttttcttattgttgcatttgcttttggattcttggtcatgaaatctttgcctgagccaatgtctagaagagttttttcaatgttcttatagtatttttatggcttcaggtattagatttaagtccttcatttatcttgagtcaatttttgtgtaaggtaagagatgagtatccagtttcattcttctacatgtggcttgccaattatcccagcaccatttgttgagtagggtgtcctttacccattttatgtttttgtatgctttgtcaaatgtcagttggctgtaagtatttggctttatttctgggttctctattttgttccattggtctacaagcatatttttatactagtacaatttgttagtatcatctgtaatttctttcagcagtgttttgtagtttttcttgtagagatctttcacctccttggttaagtatattccttaatatttttttttcagctgttgcaaaaaagactgagttcttttcttttattattttatttgagatggaattttgctctgtcacccaggctggagtgcagtggcacgatctcagctcactgctctgggattcaagcgattctcctgcttgagctgccaagtagctgggattacaggctcacaccaacacaccctgctaatttttgtattttagtagagacagggtttcagcatgttggccaggctggtctcaaactcctgacctcaagtgatccacctgcctcagccttccaaagtgctgggattacaggcataagccactgtgcctggccagaactgagttcttgatttgattcccagcttggtcattgttagtatacagcagttgctcctgatttgtgtgcattgatttttgtatccagaaactttactgaattcatttatcagatttaggaggtttttgcatgggtctttagtgctttctggtatataattctgaaggggtggcctgcccctccacacttgtgggcgtttctcatcggatgggatgagagacttaagaaaagaaagagacacagagacaaagtatagagaaagaaaagtgggcccagggaactggcgctcagcatatggaggacccgcgccggcaccagtctctgagttcctttagtatttattgatcattatcgggcatttcttggagaggcggatgtggcaggacaatagggtaatagtggggagaaggtcatcaggaaaacatgtgaacaaatgtctctgcatcataaacaaggtaaagaaaaaagtgctgtgcttttgatgtgcatatacataaacatctcaatgccttaaagagcagtattgctgccagcatgtcccacctccagccctaaggcagttttccccatctcagtagatggaatatacaatggggttttacactaaggcattccattgctcagggatgagcaggagacagatgccttcctcttatctcaactgcaaagaggccttccttcctcttttactaatcctcctcagcacagaccctttacggttgtcaggctgggggatggtcaggtctttcccttcccaggaggccatattcagactgtcacatggggagaaaccttggacaatacctggctttcctagacagaggtccctgcggacttcctcagtgtactgtgtttctgggtacttgagattagggagtggtgatgactcttaacaagcatgctgctttcaagcatttgtttaacaaagcatatcctgcacagcccttaatccatttaaccctgagttgacacagcacatgtttcagggagcacagggttgggggtagggttacagattaacagcatctcaaggcagaagaatttttcttagtacagaataaaatggagtctcttatgtctacttctttctacatagacacagtaacagtcggatttctctttcttttccccacacaattctatcatcagtgaagagttacagtttgatttcctcttttccaatttggatgcccttatttctttttcttgtctgattgctctggccaggacttccagtactatgttgaatagaaggggtgagagtgggcatctttgtcttctttcagctctcaagaggaattctgtcaactcttccccatttagtatgatattggcagtgggtttgtcatatatggcttgtattactttgaggtatgttccttctatgtcagttttgctgagggttttattataaagagatgctggattttgtcaaatgcatttttctgtttctattgagatgatcatgtgatttttgtttttaattctctttatgtgatgtatcacatttattgacctctgtatgttaaccccttattgagtttatttgtatcttctctctccttttcttggtcagtctcagtaatgatctatccattttgtttagcatctcaaagaactagctttctgtttcatttatttattttgttgttgttttaattacatttagctctgttctgatatttgttatttattttcttctgctgggttaagtttggtttgtttttgtttctctagttccttgaggtgtgacgttaggttgtctatttgtgctttttcaggttgtttaatgtagacatttaatggtatgaactttcctcctagcactgcttttgctatgtcacagaggtttgataagttttgtcattattttcattcagttcaaagaatttttaaatttccatcttgatttcattgttaacccaaagatcaatcaagggtaggttgtttaatttccatgtatttgtataattttgagggtttgtttggaattaatttccagttttatttcactgtggtctgaaatgatacttaatatgattttgattttcttaaatttattgagacttgttttgtagtctttcatatggcctatcttggagaatgttccagatggtggtgaagagtgtatatttctgcagttgttgagcagaatgttctataaatatctgttaagtccatctgttttagggtatagtttccttttttcttttcttttctcttttttttttttttttttttggaaacagagtctcactttgtcacccaggctagagtgtactggcatggtcttggctcactgcaacctctgcctcccaggttcaagccattgtcatgcctcagcctctcaagtagctgggactataggtgtgtgccatcatgcttggttaatttttgtatttttattatagtagatatgaggtttcaccatgttggtcaggctggtcttgaactcctgaactcaagtgatccatctgcctcaggctcccaaagtgctaggattacaggcatgagccacagtgctctgccattaagtccattgtttctttgttgactttctttcttgatgtcctgactagtgctgtcagtggagttctgaagtctcccactattgctgtgttgctgtctacctcatttcttaggtctagcagtaattgttttatgaatttgggagctccagtgttacgtgcataaatatttaagattgtgttattttcctgttcaactaataatttttatcattatataatgcccttttttgtctttttttttttttaactgttgtctctttaaagtctattttgtctgatataagaatatctactcctgctggcttttagtttccatttgtgtgggatatctttttctacccctttaccttaagtttatgtaagtccttatatgttaggtaagacagcagatggttggtcgactttctacccattctgccaatctgtgttttttaagtggagcatttagactatttacattcaactttagtattgagatgtgatgtcctattctattaatcatgttaattgttgcctaagtgccttgtatttctcattgtgttattgttttataggccctgtgaacagaacctttaaggagattctattttgatgtatttcgaggttttgtttcaagatttagaaccccttttgcatttcttgtagtacttgtttggtagtagtaaattctctcagcattcatgtgtctgaaaaagactttatctcgccttcatttgtgaatctttgttttgctggatacaaaatccttggctgacaattatttcgtttatggaggctaaagataggatcccagtctcttctgacttgtaaggtttctgctgataaatcagctgttcatctgacagatgttcctttataggttatctaatgctttttctcagagctcttaagattctatcctttgtcttgacttcagataatctgaagactatgtgatgaggcaatgatatttttgtaatgaatttccaaggaattcattgagcttcttgtatttggatgtctgggtctctagaaaggccaggggagtttccctcaatttttctctcaaatagattttccaaacttttaaatttatcttcttctccaggaacaccaattattcttaggtttgtccatttaacataatcccaaatttcttagaggcttttttcatttaaatgtttttttctttgtctgatttagttcaaaagccttgtctttgagctctgaagttctttcttctacttgttctagtctattgttcaaactttcaactgcatttcgtatttccctaagtttgtctttgaattccagaaattgtgactgtatttttttaattacatctatttctctggtaaatttttcatccatatttttaattgttttttagaatttctttaaattagttttcatctttctctaggatgtccttgagtaccttaatagttaagcttaacaatccattcaaccttctgaattctttatctagcaattcagagatttcttcttggtttgaattcactgctggaagctagtgtgatcatttggggtgttataaaaccctattttgtcatacaaccagaattacttttctgattccttctcatttcagtagattatttcttcaaattgttcttgaatttatttttggtgggattggtttttttttttaatttaatttttttccctcataggaaccagactttaatgtttatattagcctaatttgattcttcatgcttgtaggggtgaagactctgttacttagttatagagagtctttgtgtgttggctttctgtgatgctggttgtagctgttatattcttgatgtgtaggtgagttcactgactgttatggagttggaatggcagggatctcttgaagctcctctcattctctcatggtatttatttatttatttccccagtcttttatttagtgagttggtgattcgggcctcaggtcaataaaggaagtatccctgggtaggcatcagttgtggctaaggcaggtaggtagatgtaatacccaaaggtgggccaaggtcttagccttggtgaatgtggctggtggagctctcaattacatatggtgatgttttatcaggatgaagaatgagaactacctcaactcccctaccaggtcagtaggaaagctattcatcttacagcctcatgtctgtcctaatgtttcagctattcagattaaacaggcacctcttttcctataggaatgttgatgttccaagtagggagaaattgtgattctgcctcttgtgcaggcctgaatctggggagtggtcctcttgtggggctgcacttaccctgggttgttccagaaaggctatctataggtgcctctatgtcactttcctgtggagaaagccccagctgtgtctgcagtgcagtaccagggagaaaaatgaccccttctccaaagcccgccacaatcacagaagctgtctgcctgttagaatatagacgcagaatttccctactgcatccagcattgcaacgatgtctctgctcctgcaaagagatccggaactcaagacctgctcttcagattcttttgttccacaggtgatcccttaatgtgatactctcccccttcctttagggatggggctttctgaaagtctgattgcagtggttgttattgtcttttggttctagccatccagaggggctagcaggcatgggctggtgctggggaatgtgtgcacagtccagtgatatgaccattctttaggtctcccagccatcgataccagcacctgctctggtggagatgtcaagggagggatgtagactctgtgggtatccttagttgtagataggtttagtgtgctggctttcttgaacgctggttttgttagcagtgaagtttttacttggacagactcaggacctctgattagccaggatgttgcaggcagcaatactaactgttgttttctccttcctgggagcagggttattctgacatgagttgctggaatggcctgagttggttagcctccagccaggaggtggtgcttttaagaaagtactagctgtagtattagcagtgggatttgagcttgccctaagttggtcaggggaagtattctggtttcccaggtgatgggtggagccataaaactcccaatagtttttgtcttttgtgttgggagattttcgcctgtctcactgagttttcagggcatgctgttttccttcaaaggatccgtgaattccttcagttttcctggtacagtcctgcagtagttcttggaacaaaagtttgcagtgtgaatttctacaaactgctctatccatccaaatgggagacacatgttaaccctgcttcttatctgccatcttctccaggaagtctactgtaatttatattcttggtcttttagagggaagttttatattttttcctttctcttgtttctgtcaagacttttgctttgtctttgataattttcagtttagatgtgatatgtctaagtgtagatattttggaatttatcatgtttgctcttctctgcttcttgaatctgtggtttgatatcatttattaattttggaaaatcatagccattactatctcaaatatttcttctactccactcatattctctttctctcattgtcttactgatgttccaattagtgcatgtatattttcaattaaacacacattaaaatttttgtaattgtcccaccgtttttacatattctgttcccttgtttttattattttttctatttgtatttaaatttggaatgtttttatcaaactatcttaatgctcattggttctctattgagtcatatccagtcttcagataaacctactaaaagcattcttaatttctgttaccatttttttttaatttatagcctttagttttgattatttccttagactcttcaattaactgtttacaataccaatatgttattttttaagttttttaatttcattttttattatattttaagttctgggttacatatgcagaacatgcaggtttgttacataggtatacacatgccatgcatacacgtgtgtttgctgcacctatcaacctgtcatctacattgggtgtttatcctaatgctatccctcccccaggaccccaatccccaataggccccgatgtgtgatgttcccctccctgtgtccatgagttctcatggttcaactcccacgtgtgaatgagaacatgcagtgtttgattttctgttcctgtgttagtttgctgagaatgatggtatccagcttcatccatgtccctgcaaaggacatgaactcatcctttttcatggctgcatagcattctatggtgtatgtgtgccacattttctttatacagtctatcatcatttgggttggttccaaatctttgttattgtggatagtgctgcaacaaacatatgtgtgcatgtgtttttatagtagaatgatttataatcctttgagtatatacccaataatgagattgctgagtcaaatattatttctgtttctagatccttaaggaatcaccccactgtcttacacaatggttgaatgaatttacactcccaccaacagtgtaaaagcattcttatttctccaaatcctctccaacatctgttgtttcctgacattttaatgattgccatttaaactgacataagatggtatctgattgtggttttaatttgcatttctctaatgacagtgatgatgagctttttttcatatgttttttggccacatgcgtgtcttcttttgagaagtgtctgatcatatccttcacccactttttgatgtttttctttttttatttttgtaaatttgtttaagttccttgtagattctggatattagccctttgtaagatggacagattgtgaaaattttctgccattctgtaggttgcccgttcactctgatgatagtttctttttctgtgcagaagctctttagtttaattagatcccatttgtcaattttggcttttgttgccattgcatttggagttttagtcatgaagtctttgcccatgcctatgtcctgaatagtatggtctggggtttttatggttttaggtcttacatttaagtctaatccatattgagttaatttttgtataaggtgtaagtaaggaaggagtccagtttcagttttctgcatatggctagccagttttcccaacgccatttattaaatagagaatcctttccccattgcttggttttgtcaggtttgtcaaagaccagatggttgtagatgtgtggttttatttctgttgtgttaccaatatattcttacactgtctgctttttttattagaacccttaatatattcatcacgttattttgattactctgataattccaaaatctgtgtcattttttgaacctggtttgtatgtttccttagctcttcaggtgtgcttttacttgcctttgatgtaacttgtaacctttgcctaatatattagataataggaactgaggtaaatatgtctttagtgtgaggttatgtgttaatctggcaagaattagaactgtgtttaatattttgtaaagctgtaggtgtcagaggcttcaaatcttaatactgctttctttttccttctctttttttttttttctgatgtctttgaactttcctaagtccttatgtagagtctttttctttcagctccttcatctattatccattgttattatactagagtcctgctggtgcagggctaacatgtggagaagagtgattgttttataatctgactaaaactcagatttgtagtgagcctatgtccctgaaacttggccttcacaaatgtgaagcttttttccctttctttaggtgagaccggaaggctagagaaggatgaagtctgagaatacccttctctcaggtgggataagactgtggtaaattattttcctctggggagtaggcttgtgttatggggaatgctctggtcatatttcacaatgattattctttcctttcccctcttagatccctgagggatttctcttggttcttcctcttgagaacctagtgggattccttaagataaaaaccataaaagtgtgcggcttctccccactgcaaggttgtattccccaaagttctcactctcatcatagcccacaatcagcctgcagcactttgtcaattttgccatttgtgtgtttctacagtttatgtttttatttgcttctgattccagcaagtaaatattagctgtgactctctgtgtttgcctgtatttccagattttggggtgacagttcaccctgtgacttcaattctatcacgaattcaaaaaaaaaatattgctttttagtctcttcagctttttttcttgtaaggatgggaataattacttttagctctttatgcattggagctgaaactggaaatcagtatatgtgtttttgaggtataagaatagcacataacttttgcagttttctctgcaatgaagtggagttttaagcagatagtctaaatttgggaaagagtgaaaggattggaaagagttgtatgcgtggcaaaacaacaacaacaacaaaaaaaaattacgtggtctgaagcaaggatccttgtattattttactagaaattcctggctactgactctctctcaatagttctgtgtctacattgaatttctatgtaatctaactgtgttactaaaaaaattctcagtaaatataaattccagaattaaatcaacagtaattaagaattgtattgttttgttacttttcttggattaaacacatagctgatatttctaaagcatctaccttacaaagataaacagtctgcaatatgttttccttagtcattttaatttcatgactttgagttgctaaatcaaggaataaaggcttattactgaaagtggtacatcagtgaacataaagggaataataaactgctggttctaaacttggcctagtttttctttgtcctaagcagtctctactccaataacatcagatactagaaaggaactcataagaataaaaggcttgcactatcttcatagtccattttttgttgatgacactcttcattttcacagatgcaaaagcagattggggatttccatggcagtgttataaagatattcaaaatctgcatgtatagttaaaatgctttgtgggtctctccaggacaacagtagagtgatgttatgcctaaattcaaatcttctttagcaaagggtgtgtggatgttaaactgtttactaaagacatgtgtatgttaaaaactgagtgaagaaatatataaaccaaaagataatcaagaaggcacttaatgaatttatgctaaattttagagtttatgttggagataccaatttagttatatgtggaatgtgaagactagtgtagatcaaatctggaaaatttgtccatatagaatttcagtttagatattagaaaataaaagtgtaaccccatttaaaggaatattctaaagataaattaaaatatattaaacactcagatatatagtgtaagaataaattgactatattattgattatattgtctactttggtacatatgatttgtttagcagcgattgggtaatcaaaatttttattctcatcctgctggctcctattagacagaaaaacctaagcatgcttgatatatagcattctgctatttaaagagtgagaagaaataataagcataagtaagtgggtttttatattttcaacaatagtgaaaatatctgcaatataggagagttatcaatttatgccctactttgttatctcttgaatttagttcagttgatctaggagcatcagtcaaaataaaataaaatagtatttttttttttttttgagacggagtctcactttgtcgccaggctagagtgcagtggtgcgatctcagctcattgcaatctcagcctcccgggttcaaacgattctcctccctcagccccctgagtagctgggactacaggtgcgcaccaccacgcccagctaatttttgtatttttagtagatatggagtttcaccacattggtcaggatggtctcgatctcttgacctcaagatccacctaccttggcctctcaaagtgctggggttacagaggtgagccacagcacctggccttaaaacagtagtttaaatggtaaaataaaaagaaatgggtcaagattttagaggatacataattaaaagtctagaagcatcaaaaaggggctaaggtctgtatgaaggctgaggtggtagttttttaaagtactgatagttttttattccatgaaaggatacatggaataaaaataggaagcaaagatatttttaacatttaaatatgtgaaagaactctacaatgaaagaaaaaaattttatgatccagtgatgctcttgagaatcttaaaaagattgtataagtaggaagaaaagccttgtgatatagtttggatgtttttgtcccctccaaatctcatgttgaaatgtgatctccaaggttagaggtgagcctagtaggaggtgtttgggtaacaagggtgccttggtgctgtcctcatggtaatgagtgagttttcactctctgagttcatgtgagatctggttgtttaaaagagcctgtcacctccccactctcttgctccttcttgccatgtgatatgccagcttcccttttgccttctgccataattgcaggctccctgaggcctcaccaggagaagatgcaggtaccatgcttgtacagcttgcagaaccataagccaaataaatgtattttctttaaaaattacccaggtcatgtatttctttatagcaacacagactaatacacttttccttcctgtgttgagtattaatcctaggtcactataaatatttttgttggagaagtatattttaaacaaatgttcacctatatgtcatattttctagtacagttttctaaaattgcatatttaaacatagcttcaattgctgtcttcccacccccatttttacagttttgttaaagcctgatcttagcagggggttaatatacagtctacatagctgctaaaagatagagttgctcaataaaagtaacaacagcagcttactaaaataaaaacaaaatatcaaaggaaactatttcgtaagatgtaaagctatattttcattttgcacaagagtgtattttctaattttccgttggtgctgaggaacatgacttattttttatctaatattcatttactgattgtaatgataggtgggggtcatgttgagagatggtggtactgaggggagatgagacactttacaaagaacgatgaggaattttgtgaaacttggcaaaataaaaattcatggttctacacaaattgtcactgcatattttatacctttattttcctaccatgaatgaatggaacactctgattaatttcacattactttacatgttgtaacattaagagaagaatcacagaaaatttgcctattgaaagcacaagaataaaatttttatcttgattattttttagagtcttaaaagtggaagaagacagagatgataggtattgaagccaatgctgctgattggttctaaccttttcccaaccttctcacacaatgaagggttctttgagagacagactagagaggattctttataaagtgtacaaaatggacttgtataaatagttctttcaaagcaacaaaaaggaaaagttacaaattgatgatacctaatctttcaagccctttaaaatcctcaggagtttatttactgacaacaaaaaggcttgacgttacatatttttgtggattcttgtgtcctctaaaaatgaaatagtacatttttatgcagctaaaatgatgaatttaactttaaaagtatttgaattttgatgatttgtattgatatattttctatgatattatttgtaagtaaaagatttcttcatacttgtttgttgaacaatgttcaacagcagcctggttatgaatggtataaagttgttcatcagttattttatttctaaggctgtgatgatgatttgatatctgggctggatcctttactcatctatctggtttaagatatagtttccaaacttgcaaaaaacttgtgtagaccatatgtattccatcagagagtttaagcgtttttgtttagcagcttcatcaaggcttttagcatttttatgggttttatgttaacaaacatttattgagtttctgttttctgcaattatttttttctagaacttagtgcattaataaagagagatataacctatttcttgcccacacagattttggagtcttgttagcaaaactaaaccacagtttattacacagtgaatactatctacatttgtgtccagattagatttctgaatatggatattagcataagaatggtttatttatatatgtgctattcatatttttatttagagtctcagaaaattgtataaatctcaaaaaattaaaaaattataatataaaaacttatcttacctagatgtaccaaatgtaagattttgctccttttgtttattttattcttctctctctgtcaacccattagtcccttctgaagcaggtatgaataaattacagaaaaacaaaatacgtcatataaatagttctgaatctggctcctaaaaacacaagaattcttttgataaccacaataataattataacatcagggaaatgtaacattgatacattatttttatctattacatagttcaaattatgtaatattcaaatatccctaattgtctgaatgctttcctttttaaccattttttaaacccaagatctaatagcaagtatgcattgtttcattggcacctctattttatctctttcagtccagaacaaatcagccttctatttgtctgtataacattgacatttttatagagaccaaagcagttgttctgctttatgaatctcaattcggatttttatgattatttcctcaagaaaataaaacattttttaaaagaatatttcttagatgatgttgttatcttctcagtgtgtcactttagaaatgctatgcactattgaaatgccatatcaggtgcgaagtatacaatggagctgtaagttcctgagcactggaaaactggaaagtagatatattgaagggacatgtttaattcaaacctcagtatgatccacattactgaattatttgggtatatgcatatttggacatataagtgatcacttaatggagatcaacagtgaaaacaacattgaaatcgctaaatagttgaaataaacacaaaggaaagtgacaggcacaatgtcacttttataatcttttgatttggcctttattttctctaattaaacacattgaaatgaggtgggctccaggcaccactgacatcttaattctaatatttttataattacaaatacaagagtaagtcaagatagtgaaatagtgaacacacatgcttgcttcctcttcccggcctcaacttctggaaattatagaaaacatttaagtatttaaaaggctcaaactcattaacaacctggaaaatagaaagaagtgtgtggataggtgaaaggtgttgttatgtgtctttgctgaccaaaaattacaaataattttagaaaataaaggctgatgctctaataatattttccatatttaaaacaataacaatcagcacaaccaaaatcaaaccaaaccaaaacaaaacaaagtaccaaaatctctttgatcctacagtcttctccacttagtccatttttcagagtataacttctcagaatagttgtctataattgctgtttcacttcatagtctaccattctgtctccttgccctacccagtcttttatctacagaatttctctaaaactattttgctcaaggttttcagtgaccatcatcaagtaatgaactgtcacttggctgtcttcattttatccaatttctcagcaacgtttgacagagtataattttttctacttcttgaaatacattcttcttatgtatatggggacaccgtgttttacagtgttcttctttcttcactcacaactccttcttctccattttggcaccttttctttctgctctggaatctacctaatttcctccatcacacagctgtgattctgctccaagccattatcatgacgactaagtactacgacatcctcttatgcccagcacatcatttcacttttcaattaaattcctctgaagacaacccatgaaacccagaatgaatccaagctccatcaagagctcacaaggtgtagcacgctcccactcaaacacttgatcaccatgcttcagatacaaatggccttccttttttttcctaaaaactcaaacttcgtttctaaataagagcctttttatgagctatctcttctgccctaaatgttctgctcaaaccttttaaaaaccatctactctttcttattcaagtcttaccctattactttgttggaaaagtctgcactgactacttaatctaaagtatgtttcaagctctgttctaaatatgttgtatataacattgcatgtaatagtctcaatagccctttgaaatagttaacattcttgtttctaatttatatgtagggaaactgagaatcagaggactgaaatcagttcctcaatatggtcaggttaccacatggaaattggggctctctttgaggcagatttctaaacactagctactaactactcttaaactgccagtcgtaattgctgtcatgccaccttgtcttattttcattgatatctgcttgtttctttatttgtttctactgcttgttatgtattgagcataattttcgtgacaaatttctagtttttttcaatgtcctatcttatcacctaaaataatgtctagaaaaaaaaaaaaatcctaagaaagggatttataatggattagcaaattccattagtaggaggaaatcccaatataaaacatataaaagatgacatataaatttggagagtttcaagtgtgctgactgaaaaacaaggagtagttcttggaaaatctctgggcctatggttaaggaaaggtgtataattggagtgctcaccccggctcgctcctccttacctctcacctacttttttggcacaaacatagtctagctaatacattacaatgcctctcattacaatgactgtgagtatttggtctggccacctatgcaatctggttaaaccagtttaatctgaaatagaaaaatgacttttaaaaattataactttgaatatagtattccgtataggttgaatgtctcctccaaaactcattttcagacataattcccaatatggtactatggataggtgggatctttaacaggtgactggatcacgagggctctgcactcatgaatgaactaatccattaatggattaatggtttaaagggttaatggatagatgggttatcataggagaggaactggtgactttataagaagagagagacctgagcatagcatattagcacactcaaccccattgccatgtgatacccagtgccccagatacttcagaatacccaaaagaatgaaggctgtcaccagatatgccccttcaggtttggtcttcttagcctctgtagctgtaagaaatattttttttctttataaattacccagttttaggtatttttataagcatcagaaaagggattaagacacattcttcagttgacccttaaacaatatgggtttgaattgcatgggtccacttatgcgtgtatgttttgtaatgaaaattacatcaaatgtgccttcctgtcctgcttctccttccatatcctctgcatgggaattcagcatccctaacctctgcattccttaacggtcaactatatatcttaaatgtgttttcatatgcaattttatttaatactgataataactataggaaataaacgatattatccttgttttaaagatatgaaaatggagaattccagaaattaaattacttgataagcttgttggtaaatggtacatctgggacttagacttgccgtcaaatcctgtgctttcaattcttaattacaatgcagcggcccctctcgtgactaatttcttatttactgttttcatcttggatgtctctttatgattccttgttgatagttcatagtcagctttttatttgattttctatttcattaataaattttggctaactcttcagccacaatgtcttgtgaaatgaaattgatcgtataatgaaataaatgtaattgacttacattaatgtagcattattttagagagtaaatttgtaagaatattgaataatattgaataatataagaatattgaatatacaaaaacattggatgatatgagaaaataagaaaatacagatcaggtctttgtttttaaaaagttacatgatgtaatactaggcaatacattgtctcaaattatgcatatttggggaataaaataatgaatattaattttcaacattccatttcaacattcattttatttccccaatatgcatattgcggaatatttgcagagtaggtataagattatatcatttcataaaacagctataattaacagaattttattcaacgctaaggaattagacagacttttaaagtagagctatacatattacaattttgtagtacaaaaaaattggtgatttttatttcccagtttaaattacagattcccttttcttgaaccacagatattgtagcagtaagtggaatctacatatttttctatgtgttatacctaatgtgaatgtgtctgtactacacagcactcagtaccatgttacaagcaacatggtgataataggtgtagagggaaagtatggacttttagttcagacacacatgagttaatttgagaactacttctgtctttcaagctctctgactctgagctagcatcttaaccttgctgagcctgtttccgtttgtaaaatggggatcgtaataccattgcaaatgattcctgtgagaaataaatggtaaaagtaacatgcactgtgcttagaacagtaattgttctacaaaagaaaatcaagttagtcctctttttccaccatgagcagcatattgccataaactagtatgaatttgcgtgtcaggaaagcacttaatttatgggttaaaacgggtattttcatttatctacctacttctttatctctttctcactgtatcatctatatatttttgtaggaattaatgtttcctttgtattaaattttaattgaaatgctactatgtaaaccaatacaaatgctcctattgtcaagtgggtttcctagaaacagatttggatctcagtgtggggtgcagtctgaaaatcactgggctaaataagctttttgggtcatgtgtccaccccagtgcaacaaagttttacaagctagtttcttagatttcatctgcttgtaggcacagctgacatcacatttgcaataatgactcaaattgtattggctcaggtatccaactttttaatgaacaattatggcaacctttccaaatgaatcttcaggtataaattacatttgataatcatgtgaataatctatttttaaaagaagaaaccaattcagttttatttcaaataatatactaacatttcctagctactttatacatttcatctgtttaagcagaagcatttaggacttcaaggggagaggaagataatgtctagaaaaagatgtcactgctttggcaaaacctgagtttttaaggctcatgaagtgaatataaaaatgtggaaacactcaggttatgtttagtgcctcatttctgtagttgtgtcctcgggagactacaaaccttccagagaaatgttgtatttgtcatggctctgtgtctcctatggcatggaagcaatatgggatcaacttctgtgggtgcgtctacgtaggtgcctctgggcaaactcacacagtgtcttaaactccttatcatggtgtagtgaagacagtccaaacccctgtgttgtcttgatgtttaggaagtataagaagtctagttaggctgtacacggtggctcacgcctgtaatcctagcactttgggaggccaaggcaggcggatcacctgaggttaggagttcaagaccagcctggccaacatggcaaaattccgtctctactaaaaatacaaaaaaattacctgggggtggtggtgggcacctgtaatcccagctactcaggaggctgaggtaggagaatcactagaaccctgggggaggttgcagtgagccatgatcatgccattgcatccagcctgggtgacagagtgagactctatctcaaaaaaaaccaaaaaacaaaaaaaagaagtccaatcaataagaaattttgactttatgctagcaggtcatagagtgagggtagctccaactacgcagaatggaaagatccatggttatgaaaacaagtggcagcatatatacagaacatcaggtgaaccaagttatataccagacaataaagtacagagagtcagtgcagttcatgggccaagggaaagaaagttccttgccaggaggccatcgatgaattccatatctctcccctgattttgaaattcacaaaatcctaaagggaaagatgttagcaaggggtgaatgtacatggttgaaaagtcttgcaatactgttttccttcacagttcctgaactttggaggggagagggacttgaattgttctggaaaaccctttgactgtactgagtatctttgaataggatagagtaacttatatggtgaaagcaaccaaagagccaagttgtgttttattttaggaagtagaaatagttacatttattacaaatatctcagacaaagtataagttttggtcacattgtactcatgaagacactttctcagcctattgctttgctcatactgtggtcttccactagacattgccaccacacagcaggaaatcagtctcctaccagtcaccaatatagagccaaaagtcactgcagtcactcactgatatggtttgggtctgtgtcccacccaaatctcatgttgaattgtatccctaattttgggggagggatgtggtgggaggtgattggatcatggggccggatatcctccttgctgttctcatgataataggtgagttctcacaagatatgcttgtttaaaagtgtgtagcacttccctcttcaccctcttcctcctgctcctgtcatgtaagatatgttggcttccccttcaccttctgccatgattgtaagttttctgaggcctcctctgccatgcctcctgtagagtctgcagagctatgagtcaattaaacctctttcctttataagttacccaacctcaggtagttctttatagtagtgtgagaatgaactaatacattcattaagtgagaatcaacactagtataaagctgttgatctttggtactgtggggagaggaagaatacctatccctcctttagtttactttcagaaaaagggatcttatagcaacgttgtgttgttactgtgcaaaatttacagaatgtattgaaatattgtggctcacacctgtaatcccagcactttgggaggccgaagcaggtggatcacctgatatcaggagttcaagaccaggctggccaacatggcaaaaccctgtctctactaaaaacacaaaaattagctgggcttgagggcaggcacctgtgatcccagctactcgggaggctgaggcaggagaatcacttgaacttgggaggcagaggttgcagtgagccaagatagtggcattgcactccagcctgggcaacaagagtgaaactctgtctcaaaaaaaaaaattgttcttttaaattttcttaaccacagccctctcattctctccccaggacgaggaatgaatccatgcatacacaaggctaaccttaagatggctttaagtgatggccaccacattcaaaattattattggtatttaataagtaaaattttcttgttgaatatactttagcattcctgcctctgtctcccagcatgagtttcccctaggaggtcctttagacttctaaaccatcttacaatttgctacacttggaatctagtttcatttaaataaggaccacaggtacatctccattgctgttggtgtttggagttatgtgatgaaaaagttataatgtatggagaaaagtcctagatgtgtaataagaaaacccacatatttcccatggtcttccatatatgaacagtatgacatttgataagtcatctatctctctgagcttcagtgttttcatataaaatgaagcaattgtaatgctctgtattccttacaggtttgatgagaataacatgataaaaattatatgaacacactttgcaaagtgatatacacgtgaatttttttctttttaattactgaccttagttcacagcattcctcatatgtggtcgcagttatctaccaatgcaagtagttgttcttccaaaggattgaaggaatctaccacatttgattgggtccaaaaaaatgtgtatacctttagtgtatagttgtctataattgctgtttcacttcctagtctaccattcactttcataacacaggtgatgttttaattctactttctaaattttgatatttccacttgtacatatttccatagttaactaggaaaaaagaaaatatctttgttgtagcttaaaacaggtaattattctaaatatgttttcacagcaatttgaacattcatgagcaataagactgctgaaatccagctatgcattatgatagctttttagaagtaatattactaggcagtattgtagtgactcttagttctgcttggaatactacatttgcatggggcttttctattgaaatggaaggtgtgcacattacaatttttcctacattaaagaacagaacattctgcctcgttttcatctccttcaaataccgtctatgtactgagaccccactgacttaaaaaatataataatccatagggtactacatcacatgaactccatcaaaataggcctaaatttgaaagacattgctcaaatttttctctgttactgtgtctctcctgtcatgtttattagtacagaaaggattttcacataaatcatgaaattttcaaccctttccacaaaaagggcaatctcccatattatatctgtaatcttgtcagtcttatcaacttcacagtgggttatctaattgctaaacaggatcaatctacacctaccacatgttgacaacatagttgtaaatacacaggctcattttgcttacattcaaaatgtcaaagttgtcactaacagaggtgtggttgattgcagaaagggccacagtcatttcttcctatatatgcctttttgctgactttgttgcttctctcaccaagagatggagtctctttcccctcttcctatatctggactggtcttgggacttggtttggccaataaaatgcagcagatgttacatgccatttccaagcctagccctcaagagccttgaacatttctgttcactatcttggaacactacccaatgcaatgtgaataagctgcgttggcatgctagagagtaagaggctatgtgaagtagagctgtattgccttagcctagaccttgctagaccagccaattccaagttgacccatgagctgactgcagatgcatgagtgagccaaactaagattagtagagctgtcaaattaacctgccgattcatgagccatataaatagttattacaagccactgaaatttgaggtgttgtattatatagcaatagacaactaatatagaaggactcatactttatctatgaaaatatattttgattgttcagacaccatgactgaaatttaattttctacaataaatgtattaagaaaactgttattaaccttaataaaggtattaaaaccaaatatcaaggtatttgacaaattcaagtatgaagaaataataaaaatggtaatttacatattcatttgaaactagtcaaaatcaaaacagcaattgaactaatttatttctgtttatgaaataatcataagaacataagaggaagaagaacactatgaaaaagttaactaaaaaaatacctaaaaagttgactttttaaagaaagcttactgttctctgcacagtaaactgttaggaaacaaggatactttgtacaggacttttctacctatactgtaaaatgtccacttggaactttgagcttctttattctgattagaatataaagtgtcacatcttacttctaacacatgaaactgctttccacagtctaatgtttatgacatcttggtaggtgactcagatgtccaatggaaaattacccatgatctatttaataagcatttcctcccacagtttgctgaacacaaagctttggttcacaaacctaggagtttataaaagggcctgtgaatgagaataattattagagaaaattgtctcattctccatggaatctgcacttacccctgtcactcatcctcatgtgaccatatgtgcacagatgatgatgtggttgattataatagtgttagttgattgtgataataatgtgatacattcttacaagagaaagaatgaaaatggctgcaagtgtacactaatgtagccacagccatcatggttctcaaatcatggtgatttgagggaaacaaaagttactaacaatatcttacattgttttggaactttcttaacatagttcatatcctgtataaagctagctatctgataagctgatgaagagcaattacatttacttacattctcatgtgtaagaccagaaattcacttaaaaaaaccattattacctgagagctactccttaagaacttgcacataatggctcatttgcaatagcttcaggagaagggggggtttcttgaaacatctttttccatggattattatggctcattgtggtcttttattttttgtcagttgatggatatcatgaaagattgaattaagggactgacagaaaagaacttctaaaaatagctttcacccctaaaaagacatcctgatgtgaaaacaagatagggagtttccagaataaaaggttctcaatttgagctatatcttgatgaagcaaaatcaactaacaatacctaatatgaagctgcatcaaagactaatgacaatctcaatacattctcatttaaattgggaaaaaatatgacaggttcttaacagagagtgatttttttcctcccaggacatacttggaaatatctggagacatttttgactgtcataggttgggggtgttactggaatctactgggtaaaagccttaaaatgcactaagcaccttaaaatgcacagaacagctcccctacaataaggtttagtctaaaatatcaatagtactaataatgagaaatctcaactcagagtgtacattcttgttcagtgcaaattctatgccttgattttagcatttgataagctttcacgttttaaagagagaatattgtgaagattttctcccacagtgtgggttgtctgttaactctgttaattatttcttttgttgtgtagaagctttttagtttaattaagtttcatgtatttatctttgtttttgctgcatttgcttttgggttcttggtcatgaagtctttgcctaagccaatgtctgtaaaggtttttccaaagatatcatttagaatttttatcacttcatgtcttagagataggtctttgatatatcttgagttgatttttgtataaggttagggatggggatccagtttcattcttctacaggtggcttgccattagcctagcactatttgttgaatagggtgtcttttttccctactttatgtttttgttcactttgttaaagatcagttggctttaagtatttggctttattttggagttctgttccattggtctatgtgcctatttttataccagtaccatgctgttttgataactatggccttatagtatagtttgatgttgggtaatgtgaagtctccagtttttttttttcttagttctgctttggctatgtgagttctttttttggttccatatgaattttaggattgttttttctagttctgtgaagaatgatgctggtattttgatgggaattgcattgatttatagatcacttttggcaatttggtcattttcataatacttattctacccatctatgagcatgggatctgtttccatttgtctgtgttgtctatgatttcattcagcagtgttttgtagttttctttgtagatgtctcacttccttggttaagtgtgttcctaagtttaatttttttattttttttttcagctttgtaaaagggattgaattcttgatttgtttctcagtttggtcattgttggtgtgtggcagaactattgatttctgtacattaattttgtatcctgaaactttgctgaattcaaatatcagttctaggagctttttgattgagtaattagggttttctaggcatatgatcatatcatcagtaaccagtgacagtttgacatcctctttaccaatttgcatccccttgatttctttcttttgtttaattgctctggctaggacttccagtaccatgttgaatcaaagtggtgaaagtgggcatccttgccttgtttcagttctcagggaaatgctttcaacttttccccattcagtataatgttggctatggttttaaacaactcaaacaaatcagcaagaaaaaagcaaacaattccatcaaaaagtgggctaagaacatgaatagaaaattctcaaaagcagatacacaaatgcccaacaaatatatgagaaaatgctcaacatcactaattatcaaggaaatgcaaataaaactacaatgtgataccacctcactcttgcaagaatgaccataataaaaaaaaaatcagaaaataatagatgttggtgaggatgtggtgaaagggaacccttttatactgttggtgggaatgttagctagtacaatcactatggaaaactgtggagattccttaaagaactaaaaatagatctaccatttgatgaagaaatcccactactaggaaatcccactacccaaaggaaaaaattcattattcaaaaaagtatatatatatatatatatatatattcaaaaaagtatatatacacatgcatatatacctatataaatacatatgtatatatctacatatacatatatacttatatacgtgtgtgtgtgtgtgtgtgtgtgtgtgtatacataccccatggaatactactcagccataaaaagaaattaaataaaaacattcacagcaacttggatgagattggagattgttattctaagtgaagtaactcaggaatggaaaccaaatatcatatgttctcattcataattgggagctaaggtatgaggatgtaaaggcataagaatgatacaatggactttggggactcaggggaaagagtgggagagggtgagggataaaagaccataatttgggtatagtgtacactgcttggttgatgggtgcaccagaatctcagaaataactactaaataacttattcttgtaacaaaatactactggttccccaaaaacctattgaaataaaacacaaatttaaataaataaaattataaaaatataaattaaaaaatataaaatagaggtagtattatcgtattagtccatttacatgccgctgataaagatataagcaagactgggaagaaaaagaggtttaatggacttacacatggctaggtacacctcacaatcatgacagaaggcaaggaggaacaagtcacacgttacatggatggcagcaggcaaaaagagaaagcttgtgcagggaaactcctatttttaaaaccattcgatctcctgagacttattcactatcatgagaactgcacgggaaagccccacccccatgattcaattacctcccaccaggttcctcccatgacacatgggaattgtgggagttacaactcaagatgagatttcggtggggacacagccaaagcgtatcaattatatagtgtttaagaataagtaggctcaggaatcaactttctgttatcaaattgtttctactaattgtaaaatatatgactgtggacaacttttttttttgtcttatctcttagttttctaatcgtcaacatctgcataatattaatgaccacctcatagaagttattaagataacaaaataattttaagttaaatgtataaatgtaccagcacatataggcacttgttaaataatagttgttattattgtatcagaataataaaagttggtgaaaagtatagataattctctagtgaatgtattatatttgaacttgcttctgtatgaaggttcatcatgaaaataataacttaccattataacaaacaactgtccatttattttaaatatccaatggtaaataccacttgagttcatttttttctaaatagactttcctttttagagcagttttaggttcatagcaaaaaccgagcagaagatacagagattaagcatatattctgctcccacaatacatgacctcccccagtatcaacatcctccactagagtggtacatttgttacaattcatgaacctacattgttacatcattatcacccaaagtccatagtttacacgaggatatactcttggtttcatacattctctgggtttggataaatgtataacgacatgtatccatcattatattatcatacagaatagtttcacttccctaaaaatactctgtgcttcatctgttaattttttcctcccctccactaattcctggcaaccactaacatttttactgtctccatagttttgcctcttgcagaatgccatattgttagaatcatatagtatattgcctttctttcacttagtaacgtgtttatattgcctccatttttatggcttgataggtcatttctgtttagtgttgaataatatgctattatctggatatactagtttatccattcagctatcaatggacatcttagttgcttcaaatttttggcaagtaagaataaagctgctataagcatccatgtgaaggattttttgtgtggacctaagttttcaacatctttgggtaaacaccaaggggccccattgctgggttatatggtaagagtaagcactgctgtaattgcatttcataaatgttgatgaattgtgtttttattttcatttagtttaaaatatatttttaaaattgtttttaagagttctttgactcatattttttaaaaacgtgtttgatatctccaattatgtttaatattttccagatattctgttattaatttctaatttaactctattgctgtctgagagcagatattgtatgatttctattctttgaagtttgttaaggtacgtatgttttattgcccataatgtagtctatcttgtgaatgttccgtgcgagcttgaaaagaatgtgtattctgcttttgttggatgaagtagtttatatactttgttggatggagtagtttatatacatccattatatccagttattgatgtgttgttgagttcgattttgtccttaccaattttctgtctactagatttgttcatttctgacagagggataatgaagtctctaactgtaatagtggctttatcactttcttcttgcaattcttccagtttttgcctcacatattttgacattctattagtaggtacatgcaggttgagaattgttatgtctttttggaggtttaacccttttatcatcatgtaatatccctctgcattcttaataatttttgttgatctgatgtctaactctgaaaataaatacctattcccactttcttttgattagtgtttacatggtatagctttcttcatttatttactttttttctacatatgtctttatatttaaatagctttcttgtagactacatagagttgggtcttgcttttagatagaatctgacaatgtttgtcttttaatttgtatatagaccattgatatttacagtgattattgatatagttggattagtatctaccatatttgttttggttttctatttattgcccttgtcttcattcccatttttttctttcacacttttttgctttttgtggatttaattggggattttatgagattctactctctctcctttcttagtatgttcattgtatttatatattttatgtattacatgtatatgtgtgtgtgtgtatgtaatatttattatgcagaacatgagaggtcactccaatttgggggtagtggtttgccctgtaacctcagttatcttgcagatataaaaacagttgttaatttttcagtttgttcagctttttacttattcttaggatgaactgtcaacttcatgctgaaccagaactggaaattcaagttcggtttttaaaatagtgaaagtaaaatagcaaatgaagagtggtataatcacacccccacataaacccacacacacatacacatgtgcacacatatgcacacacacacaaagctgttaaacgtatcctgtttggagctaagagtataataatgaaatatgcaataacgagtatgttggcttgcttcaacaaaaatatattgagtatcttctacttataatgctggatgctttatggaataaagggagaattactcagaaactatcctcttgccattgcttggaagagctcttgcaaaggcaggctaactctcagcaactgcgtttgtggaacagagagaaatctgagcaatcccagggttgggaaccttgataagctgaatggatggcctctgtagaaaaataggcaccagaactgacagttgctttaataaaacatgtgccatatgtggtattggctttgaattctggcagtgggtgacaaacaattacaagggtctggaagatatggtgatccacacatgacaaagaatttgataaaactatttcctataaaaatgtagaagacctgtgatgtagctagtaaacttgtaactttaagtgaaatagttgtgaaacaagttttactatctagattgtcttggtagcaattcactgcatttcaaagaatctcaataaatacctgttgaatgaatgaatagatgtctaccattactctctagttcaaatttctaatcttcttaattcgaatttttatagcaacctcctatctagtcttcttaatattaactttagttgcactgcacaattcctttttgaatctctggaaaaataatctaccataaaaggcaattattgccttgcatctaacacttttggatatattatatatcatcattttttcagttgaataattaggcctctgattaccttttccactttctactgttttcccatctataattcacccttcagatagttcaaactatttgcatttttacaactcctcatctataaatgagagcttttcatcttttaaaatttgatttgcaaataacacaaggtgaaaggtgtggattgttgttatgttaggtcaactccccaagttccctttattcaccaacctacatggcttaggaaaattctactgagaatgtttcctgatggaaatacacatattgagtcccagacaccactggaatttccttgctgatctacagccaccagataagctctcaaaagttaaccagtctcagtttaaacactagctctcctcagttttgcctgaaacatagtagcagcttaataaatacttatagacttaaaaatgatgacttaatttctgaatatgaagatcaaaagaggaaactattacatcagtcagatgtcacagaaaaagtattatttgaaatggctcaaaccttaatgtacatatgccatacctaagatcttattaacatgaatattttgattcaatcgatctggagtgggcatgagataagtttccaatcagccttcaggtgatgccaaagcccttagtccatggaccacatttggcttaacaaagccttaacaactgaatttcccaatataagaacagtattaaccaagccacaggaatagaaggttattggttacttttagccaattacagtaaattatttcaattggttacaattggttacaactggttacggtaaattatttcaatttagtggcaacaggatttctagaggagaaatttatgttgcaatgttgtaaaggtagattaagaccatttctgtggtttagatatggtttgccctcaacaaaactcgtgttaaaatttgatccccattgtggcagtattggggggtgaggcctagtatgacatgtttaggtcacaggtctggatctcttatgaatagattaaagcccttcctcaggcgtgagtgggttcccactcttgtggaaacggatttgttgctgtaagagcaagagagttgttaaaaagagtctggcttctttggtttctctttcttactacctctttcaccacgtgatctttttgcacacaccaccccagacttctacatttgccaagaatggaagcagcatgaagccctcatcagttgcagctgcccaatctttgactttccagccaccagaatcatgaatcaaataaacctcttttatttataaattacccagtcttagatattctgttatagcaacacaaaatagaccaagagagctatattatagaagatcttgaaagtgacagtgagaaatgcatacctagtagaactcacagtaacttttaagttttgttttttcttaaacaatgcgtttggagctatcatgtgtgcacgtgtgtgtgcatgtgtgtgtgtgtgagagagagagagagagatagagaggaacagagagaagagagagggagagagagagagaagagagaattcattttggttttctgaactgtgaaaaaaattcaagtgaaaagcattttagcaaaatatcaagagatagtcagacataaccgtgcctgaggtatgagttgctgaaattcattattgatgtttagtatcacaagagtatcttcaagtcactgcaatgccatatgtgaagccaatgcaatacttctcctcacacctatctctcacaaacttgaattcaattaattaccagtttggcttaagtttggtttagaaaaatattttatgctgtttttgtacctgtttggttgagacatatttcgatttttattctttcttaacctagttggctgaattatgaaagaaaccccaaacatattaaaaaaagcccagcacaaaacctaattcagttagtgcctcaataaacagttttatatttgctttggttagggttaaagagctcaacaaatataacttttggatttgctttttggttagacacttgaatgaaaatgctggttggaacatccagaatgtttttaaaagtatccaagtacacaatgctaaagtctaaaatctctagactgagactagttaactttgggagtttatctagtggctatagttcagcggggggaaatctcagtggtgtctgtgactcaatattatgcccatcaagagacattcttagtagaatttgcctaagccatgtaggttggtgaatgaagggttggcatcatgtaacaaaaatctactccctccacactgtgtggtttagttgcaaaataaatcaaatcattttttaatttttattttattttattttttattatactttaagttttagggtacgtgtgcacaatgtgcaggttagttacatatgtatgcatgtgccatgttggtgtgctgcacccattaactcgtcatttaacattaggtatatctcctaatgttatccctccccccttcccccaccccacaacaggccctggtgtgtgatgttccccttcctgtgtccacgtgttctcattgttcaattcccacctatgagtgagaacatgcggtgtttggttttttgtccttgcgatagtttcagctgaagctaaactcatctatttaatgattctctgaaaatttcttcaatgggaaaacagaatgtggaaatcaccttagcaaggttgtttgctatgttacaggaagaaaaagattaacaatcttcattttattggttttatctgattctgaaagcagaatcaggatgtatataattgacaaatgcatcaaaactaggatggaattggcacagatagattacgctcctttacttagtttctatactataagcatatcgaacatacaatgtcatcttaaagatttttgaatactgcatgcaatcagcgtaacatgatgttcataaaatacccacttattagatgttgtgaaattgcatgaaaacaaattacctatcaaatatgcttttcttggtattaagccccaaataatttttcctaacactttctaggttcctagaaaaagtcagtgtgggaggggaaagagtgcagattttagaagacagcctaactcagttcaaagtccagtttttcattcattttgtgtatgatcttgaaaaaattatttaaattctctgcaccctgatttatttatctttaaaagagaaataataaaaacattttgcaaaggttggcatgggggtgggaaataaagtgcatatggtacctatcacagtttctgatgcctaacagttttcagtagatattaaccgttattgggatatagtcttcacccctttagctttcactatgatgaagtcatcaattcatcccggtaggacattacttaaaaaaataaaaagtcattccaacctcccctttcttcttggtttattcaaagacacatggaactgactttgggtgggaaggttaaatgctaaaaagggcaataagcatttaagcatttgaatcagggagtgttgtgaaaactcagtagataaaataaatcttgaagatgatgaataaaactgtttccttcttgctggagatgggtaaaatatagcacctcatgttttaaatgcttttctatgggtaaaacaaaaccagaagcagtaaatatactacttaaattctacttccaaggtcagaataatgatttttttttaaagtttctgccactgagaaatttatttcgggggaaaaaataagagtatggttcagagacccttataaacctttctaaagataccaggatcatcatctcccacatatcctaaattttaagaacataaagaaaaatctctcctaagtaaatgcttgatgcctcttctagctaagctactagttttagataaaatttaaagtagaatagtcatatctaacattgctataggatttccccccataatcaataagcacatgacatttatgtttattttacattatcagagcattttttattatttaaataattacagatttgtattttttatgtttttgcctttatgccattttatttcaggctaagatttattcaaggctgaatttttggtcaggaacgcaacaagcaattataacactactattttataacttgttttctaggaacacattgtgacaagaaacatgaaatgggatttcctgaaacacaacaacataaaggcaagcaaacaaatgaaaagtttataagaaacaaatgctatgcagcttctatagaaaatgacaatttcatatgcaaggttattaagagatacacatgcaaatttgggctagtttttgatgctgtgcctttatttatacttagaatttgatataatttttggttcaatttgttacaatactgtcattaaacctgaatactaatttctccacataagcaaactctaaacattcaatattaacatcatgcaactgaagtacctttattttaaattgttgaccatactctttctgatatataagttagaagtaaaaaataaacaaatcaaaacaaaaccaaaaaggaaacctggaaatctttaacttgacaattgttgaaacacatgagaatttggaaatatataacaaaaataaagttcgatttattttttgtctgctagagtaatttcacattgaacagaatcaagatacatttagaaaacatcactctacttaacaatcatttaactgaaaaaatgcctgatttacagactgtaatgatgaaattaacttggaaaacatttcggtcatgtgaacctgaagagaagtagtagtcattttttttagtttttttattaagttaacatgacttaaaaatcattgatttataaattttgcatactagagtgaaagataatttataatctagtcaaataccaaatattatgttgttctatattaaattacaaagtaattatttagcttttctaaaacattttcggtggaaggtttactgcctccatttttaaaccgattttttgaatgtttgtcctagtattgaattgacattaaactctattacttatatctgttcatctcatagaaaacagaatactataagcattgtgtacatgaacctcaagcttttttttttaatttgtgaattctaattctgtttttgaagatcacaaaataaatattttgtttaccatatgacaggtcttcactggctctaatgtgtccacaatttttttttcaggatatacatcctcggaaaagcaaaatatgaataattttataagttttcatttttggtagtatagaattatttatgtcactctatctctatccctgaaaacaactaaaaaaaacaaggttaatacgatatttatagcaactttattcataattaccaaaacttggtagcaaccaaaatgtctttcagtgggtgagtggaaaaataaattgtggtatgtctagacaatggaacgttatgcagtgctgaaagaaatgagctatcaagcacgaaaacacacagaggaaacttacatgcatatgattaagtgaaagaagtcaatctctaaaggcaacatactttaccattttaactatatgatattctggaagaggcaaaattttgaagacagtaaaaagatcagtggtttccaggagttcatggggaaggagggatagattggcagagaacagaggattttgagggcaatactctatataatactattaatataatgatggatatatgtcattatatatttaatcaaacccatagaatatataacacccaaagtaaaccttaatgtaaagtatggactttgggtgattatcatatgtcaatataggctcatcaattataataaatgtactagttcggggatgttgatagggatctgtccatgtttggagacagagggtatatggaaaatgtctgtactttctgaacaattttgctgggaaccttaaactcctataagaaaataagtcttaaaaaaagtcaccagactgagaggaaagtaagaaaactacggagatctaaaacaatgtaaaaatggggattttaatgctattgttcataagcttcaattttgcagttgtggaatcatgatgagataggctagagataaagtatataggagcctcttatggagagaagaccccagaaagtgatttcatttacttatttgtgtatgggtaaatgaaaaataaatttgcccatccttctttcccatgtccatgctaggtggataaaaatgaaattcttgcaaaggagtaactacaaatctgcccccacaaatctgtggctcatattataaaacatgtataaacagaaactccttaagtagagaatttaacttgaaactgttcaaaatgcctctaggttctgaagaatttaataaagactctctaaaagaatgcagtttcaaactagccctcaaagaattcgtgcagttgaaattccaaaacaagagtgccgggtcaaaatttacaaaacacagaagaaaacaatgcactatgagtaagagtcagaaaaaaaatatatagccctagtagactcaaaccagtgaaaaactttgattttgggggatagtcaaacccagaatataaaataataatgtttaatgtgtttaaaaaatagaaaattcacttgaaaatataaacagataacagaagcttataaagataaaaatcaatatgcaaagacatttacttttaaatataaaatataacaattaaaaataaaatataacaaaaataaaataccaataaatttgaaactcctacaggaagaattagagaggagagagacttataaccttagcaatccactgtaaaagaaaagatatcataggggaaaaatattcttcgttattgaagataatatttttcaccaaaggacatggtgagaaggttttagaagaagaggtttaatgcaggttgggtgagtggaggatatatagagcattgaaaattgatagcattattgatatagtcatcaatgacagatgcttggaaaagctttgggtagggcatgatacagtttaaaaaaaataatgtgaaccatggtaaatttagtctttgggaaattcattaaatggacctaataagattcacctggttcctggaacgatggcccaacaatgagaaggcaatctctgatcatttaccttagtgactctcaatcctggcaatgcagtaggaaaacctggggagctttcaaaaacagaaatgcctgggtccccttccacatgaactgaatgaatagctttagggaaggtttcagggcttccacgttttaaaggcttttccacgttttaaaccttagagaaggtttcagggcttccacgttttaaacattaaagtttaatgtgcagcctgtttgagaaccattgctttatgttatagtcagctggtgttggtagctacagttaacacagcaagtgttgacagaatttatgatgcatgagccatgtgctattttacttgagttggaggtaagaatgtggaggtgttctttagtaattctaactcaccttcccatggaagagtttgggatctctttggaaatgatatcttctctgggcttagaattagtcccagagatacagtcagggaccttttctcaatcctttgtacaataaattaggtgcttaaaaaatctactttgtgataaatagtccaatgtgggggagttaaaaatgaaaaagatttttgaaattttacttactgccttaggtttataggatagacatttcagcaaaagatttaagatgacaaggacagaattttcagtaaatatggcatctccagtcttttatagctcctctccaggagagaatctcaagggtggcaagtggtcagcttgtctaatgtagatcatatcagattgtgggaaagcctgagttaggattttctcagactcttggagccacagccatatcaccaggaaaatcctgcatagttacctcatagcttttatggtgagaggtagttttcagactaatatttgggaattggtaaaatgtcactcatgccaacattacaatattactgtactaatctcaggacataaggtaatgaccaggtattacacgtatggaattacactttatctctgtaaaaataacttctcagtgggtgaaactgtaatttatttactgaacgatggcctgggtaggggggtactaagcatgtcattaagggcatggtctaacaaatgttaaggactccaatgaaattggattttatatcacacaatttttatgctattcgctaaacttttctcaaagggatatgttgtgaacattgtgttgtacagattttacggattattaaaaaaattactaaggcaacattgggaaccagcgtggttgcagtctagaaaccgaataaagaagtttcacatacctattttatttttaaatcttagttttaattcatctgtcacctgcatgcatacttatttggccaatagcgtttaatatagctcatcatctatgtatttatttgactttctagtagtagcatagtaaaaggctgatcagattgcatgaattcaaatattgaccctaccagttactgtctgtttacctttggcaagtaacatattctgtacacttcagtttcctcatctgtaaaatgtagaaactaaatttgtatatttcattgtgtaattctgaaaaccggatgagatgaaaatgtgtctttaaaactttcagtaaataataactcattttattgtaactgaaatatttaata

SEQ ID NO: 92 - DNA, 5579 bp, Homo sapiens
tttaaagtgcataagaataatgacgtcaataatattttaattattttgaaattgtttccagcttcactcttgatcacaagctagtgactagaacaggttaatcatagtgaaaactaatagatatgctgtttaaatttcttttttttattattatactttaagttttagggtacatgtgcacattgtgcaggttagttacatatgtatacatgtgccatgctggtgcgctgcacccactaactagtcatctagcattaggtatatctcccgatgctatccctcctccctccccccaccccacaacagtccccagagtgtgatattccccttcctgtgtccatgtgatctcactgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttccagttctaaatccctgaggaattgccacactgacttccacaatggttgaactagtttacagtcccaccaacagtgtaaaagtgttcctatttctccacatcatctccagcacctgctgtttcctgactttttaatgattgccattctaactggtgtgagatggtatctcactgtggttttgatttgcatttctctgatggccagtgatgatgagtatcttttcttgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaatctcgtcttttgttgccattgcttttggtgtttcagacatgacgtctttaatccatcttgaattgatttttgtataaggtgtaaggaagggatccagtttcagctttctacatatggctagccagttttcccagcgccatttattaaataaggaatcctttccccattgcttgtttttctcaggtttgtcaaagatcagatagttgtagatatgcggccctcagcaaatgtaaaagaacagaaattataacaaactatctctcagaccacagttcaatcaaactagaactcaggattaagaatctcactcaaaaccgctcaactacatggaaactgaacaacctgctcctgaatgactactgggtacataatgaaatgaaggcagaaataaagatgttctttgaaaccaaggagaacaaagacacaacataccagaatctctgggacgcattcaaagcagtgtgtagtgggaaatttatagcactaaatgcccacaagagaaagcagaaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcacaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacaccacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcactagatgcagaaaaagcctttgacaaaattcaacaacacttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctgtctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaataaaatacctaggaatccaacttaacaagggacgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagatttaatgccatccccatcaagctaccaatggctttcttcacagaattggaaaaaaaactactttaaagttcatatggaaccaaaaaagagcccgcatcgccaagtcaatcctaagccaaaaaaacaaagctggaggcatcacactacctgacttcaaactatactacaaggctacagtaaccaaaacagcatggtactggtaccaaaacagagatatagatcaatggaacagaacagagccctcagaaataaatttcaatttaatactaaatttgtggaatatgttggtacagttgatgattttatagcagagatatgttcatactcaaatattatactagctttgctgcttctgaaactgtacaaatatattattgaaaaaatgtcttaaatgtagaaatatgtaaagtccagaatgcaaaaggaaataaaagcaataaagctatgaaagtggcaacactgaagaagaattgtaactgatttagcaggcccacaaaagcactgagaacactgtgggaaaagtcaagaaggaggcagtttatactacaggaatcccaaaaaggcttgggaattttaggatcaaatagtagaacacagtgcctattcttggatattttatagacttctggaaaagacacacagagtcttcaaaaataatatcgcagattataagattgacatacaactaggacatagaggagggtcactgaacctgtgaagttttgaggagagtttacagaaaagacgacacctgaagtgagtcttggaggataaataaaagacatgatgtagccaggcgcagtgtctcatgcctgtaatcccagcactttgggaggccaaggcaggtggatcacttgagggtcaggagttcgagaccagcctggccaagatggtgaaacccccatctctactaaaaatacaaaaattagccaggcgtggtggctcgtgcctgtattcttagctactcgggaggctggggcaggagaatcacttaagcctgggaggtggaggttgcagtgagcagagatcgtgtcactatactccagcctgggtgacaagagcaaaactctgtctcaaaacaaacaaacaaatgaagatatgaagatatgacgcaagacagaattagtattccaatgccaattggcatttggtattctactaattctgatttgagatgtagggatgaatatgaagtaaaaacaggaggaactggatcagaagctttttaagaagtggtcagacctccagttgtccaacccaactcttgaaatagtagataactgtctcttttctatcttagcaaaagactagagagtttcctctgggaaaagaaaaaaagaaatgtaatctggatgggacacactgcacagttgagggctgaacacaggttaattaaatattgagaagaacttttttccctccttggatcctgtaatcctggcaacctggtgtgagtctacctgatcaggactatcactgatcctttactttccctgtatatctgacacgtgcttactgactgcaagtctgtacatcattgtaagcagtacagatatgaagaaaacatagtgttgtgagaaataatttaacataattaatcataaaaaggggatttagagtttagattcctggtttatgatcccatctaagccatcggttggttgtgtgggtctggaaagttagctgtcctggcctcatttttatatttataaaatgaatgaaactaacagttacaagaatagttctctttagattgtgacagaaaatcatactaaaaccgacttgagaaaaaaaaagtatgtattgtttgtataactgagaagtccatagttactatgaatttggatgtggctgaatagaacagtatttggttacctttatctcctggcctggctgtggtatttttcctagataggatttgggggttatggagtcttacatccaatgcaaagatggactagcacaggaattctaaagggtttttaaaattttagttttaagtgaaaagagagtatgagatttttagatataaagacttagatttatagcttaattacctgaaacggtttggggaaaactaatccacagtcatcagttttgaaagaaatgtgctttaagacaaagcataattattgcctacctccaaagttttattaacctgccattgatctattaattattttcatgactactaacatgaaatgtgaggccctcctctgattaaaacaatgcactctcagtcctatataattcagggttcaaatccagtgggagagaaacaagcttctgcaaggttcccaagagtcaagtggattgaacaggttaggacatcctgaaacaatcacggaagccaaagaagcatctt

SEQ ID NO: 93 - DNA, 79854 bp, Homo sapiens
gcctccaaattatgcaaatggaaacgaaaaaggtaagtgtttgttacatcattatgacacaagtccaacatgagtcttgtgaattgcatgctaaatctaatatttgagcagcgtaacaactttgggcctagagatgttatcagtggagtttctttatgtttcctaactgtcccctcctgactgccagctttcttatctgaagaacattttaaacaaataaactcattcattttaaagtagttagttatatatgcaagtacaaatactgtttctcaaaaacaggtccttccaaatgcatgtaaatcacattttcttatgtctttttatgtttttgaaaatgtatcctgaaatcataaagccatattgaatttatctgaatccttaacttcagttaaggtaagagccataagtgtttttgacaattaaggttggagcatcaaaatttgaaacataattacagtaggtttttatctttgcaagcagcagatcccagagatattatgacctcagttttccccaaaagacaaattattcatatttgttttgttttcttgaattagtgcataatataaatatcaaatcacaaaatcaaggacattaaatgaaagtgtctgttaaaggcatattataaatgaatcataagccacacagttctctgtgatgtacgaagtgggcatttaaagaggtgctgatttgatgcttgtcactgagtagcagagaggacggggatgagtatgtgtagtttacacctcaatcatgaggaagtgaagaacttgtgctgttataagtagtatggctgtgtgaggaactagggtgttctgctggattttgaggaagtattttcaaatcaatagaacttcaaacttttcttcagagtgttgggctctacatggaaaaacacatgaaattaaaaagtggcacaaatgtttagttagtagaacatctggctaattgggatcaaataattcaaccatgtgggaacgtttttgctcaaaatagataattgtgaattgtttcatataggcaaatgattagacaacttcctcttcctcaaatgtgaacggacagatgtgatctagaagcaagacactcttttgtgtaaatattccctttggcctaaagcaaaagtggacagactttaaacacctgagagcagagcagtgtgtgttaagattgcaatatcttaagctcttgagttaaatggaaaatgaaaaacaaaagtgtatatttggaagttaggaatgttttctttaaaatataaaataaaattttagatttaagatcacaagaaatattactgaagacttatactcttcctggggctaagggaggtgacagtcgctcatcagaaaaaaaaaaatgccctcatttcctaacttttctaaaaaatattatacaagttcaggctaatacttcctgtatatgtgggaaatttctaggggaagctaacaggcttagaaataaagatgtgttaaatagactaccaaagtgtccaattaagcaacacgataccaccgttattgatattctagcaagaaattactagcaatgtttgtaaatagacttagaaatgcatttgatgaattaacacttttatatcttaatttatctgaatttttctgtaatgtgaaaatgttttatttaacttatttctggcatctattagtaaaattctgatgatatacaagcattaatatttttccatggccactcaattcatacataccttccctatctatgcttagaaggcagtgcaaaattagatagtagcaatattgattataaccacaaggtggagacagatgtcgtgtaatatgcagtctgctcatataaagcacattttcttagacaagagttttcatacgatataataaagacatctggaatttgtcttgtatgcaatatgaaatttgctattaaacgtggagttaaaactttatgtcaatagatccaataacaatgttcataaattaatcattatgtcatgctgtatttccaaaatactatcttaaattataagagcaaacgaggtaataatatattacacttaaaacattttttttttttttttttttttgagacggagtctcactctgtcgcccaggctggagtgcagtggcgcgatctcggctcactgcaagctccgcctcccgggttcacgccattcacctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaaacattttataaaaatacaaaaaattagcctggcatggtggcgggcgcctgtagtcccagctactcaggaggctgaggcaggagaatggcgtgaacctgggaggcggagcttgcagtgagccaagatcgcgccactgcactccagcctgggcgacagagcgagactgggtctaaaaaaaaaaaaaaaattataagttattctatatccaaatggtacattttttaataaagatgtttgttttaactttttgaatatgaagatttctagttctagaataatgtttataaaaatatacaaatccatctggtgatgagttgacctctatcacaactagtttgcatatataacttgggtgtgaccaagcaaggtgagagttaagaacttttaaaacttactgtattatattgatagaactcagaaagtactaacttgaatattattattctaattgcttttcccttttagttattaaaaataagaatacttaaattaataacaagatcttttactggcaggattaaccaaattatctgtaatgtgttcctcgaatgcttttaagtggaaatatactttatacattctttaacaactctgagaggatgagttacataaatcagttcaggaatctatagaatctgtaatacatagtaaaggtttattcacaattaaaacaatttcacttctatattaaaaaaacaaattgttgaaagtacagtggcttttcatatgtatgatttgtaaaacaaattagcttttttaaagtgatgtgacgcttaatgagaagaaatcagtagagaattacaaactgcacttcaaaagatacatctaatatcattttaataatgaaatttgaaaaaatagtgtgctcgttttacagtctcattaaatgaattaaaatatcagcacacattgtagtaggttatcattggcagagaaggctgaaatagaaacgttacaatgggatgcactgccatctgaacattatgtcgaagtggaacgcggaaacatatttctcagaacaagtggtaaaatgaaaacagcatcatttgtaaagcatttcttttgagagtgcttcagtttcttctcctgatgacctgccattcagaaactgacaatgaataatacactctgacaccagcatttgtcaatttgcccagaaccatatgagagtactctagacagatatatgttccgaagtaaaccaaatacctgttaactgtaaatcaaatcttgtagaaaccatgccatggttcctttggacatatactttgcatgcctgaagcaagttaccttaagaaatcattcttttgttttacaaaacttgtattaaaaaattaaaaatgcaaaaaagcttaatattattaggaatttatccatagctttatttggaatccagtttctttattatgatctataaacatgcatcatttgatggagttccttagtggagaggtgtttttccatgttgctaagaaacatgccccagcaccagaagggatactacctaccatctttttgccatttctcaccgtgattcttacattgtacctgtttactcactgaacagggcttccttctctttgtctagattctaatcaggtgtcttctggtgtggaagctttggcttttatttacacacaacacagaattaataagatagatgccaaggatttagcaacattttaattcaacattatacaggtatcagagttaatgagaattatgcattagtctttaaatttgggcagcttattcagctaaaacatagatgtctagctcttaaacactttgtttttttaattactctgaaattacaataaagtcaaagaactgaactgttttcttttcaagccagtgcaaatgtgctttagttattattttactggtgatctaattatgcattttaatgctttattacttaatacttatataagcctaaaatacgttgttaatgtcataatttcagggattttagtattctttccatgagttaccataactaggtgcatatgtgtaaatatatgtatatatctatatctatatatttatatctatgtatatatcaatttataagactaaatagacttggccatatgtgttgttggtttatgcatacatgcacaaatattgaggtgtccacaaagtatatatgcctgtacataaattacatactggctggtgagtgaatgtaagcttctctaaattgtacaactctccacagagtggcactctaatattgcaaaggtacaatataagcatgtgcagaatgaacagctcttctaggatccctataaaactccaccccatgtttcttttgagtcactataaaattgatgactgaggcaatacacgagcaattatttatgcaaagcagtgtgaggaggtgcatgaggatccacttaataccaagacatatttagatttgactgccacttttcttcaacttaatttttttaaagcatttggtatgttgttgtggaattaaagtcctaattatttatcaaaataagtggcatagccacattgtttaatcattttcctctttccaccacgatctgtgatgcttaaagtatcctatattcagcagggaccatctatatcaatgagcacaatgcctgccatgcaggaaatacttcagaaatgaatggtgcttttgtcatcatttttgttgtcacttattatatttcagagttggaacctagtttacttttgtcaaagcaacgcactattcagtgaggaaaaagagataagcgattaagaatcatctctatgtcctttctcagactgataccactcttggtaacatggtgctaactctacagctaactgaggttccagagagaaatgtcccactataaactttccatatgcctgttgtgactgccacatttacatccatgtattaattttagaacttggttggcattgttcccaagtcatcaatattgtttatttacaagatgagataactagacattagttctgtgaatttagatgttttgcaagtgtgaacgaatatctattctcacatcaactcagaggaacaggtgcaagtaagatgctaaagaagaaggtatataatacctgaataaagtgtcttgtgtgatgttctccccatttatatcctgctcaccaaggaagaaggaaaacaaggagttacccaattaacttgactgtgcgataaatgtggcttgctggagagccatttcagcagaatttctggcatgcagtaaacatgtggaaagaagagacagtgaaaatcttccaaatgtttgagtcagataaaaatgagttccaatttagattttgttttttctaagttttgccatatgtatgattgaaaacaaattatctttctaagttttcattttctcatttttaacaagagagatcataagcatattgtagattattatgggtttaaatgagataccatgtatgaagtacttattatgtacttggaataaagtaagcagtagatgaataatattatttggttatggtggagttggcaatggtgagtgtaggtgaggtataagaagaggaagcagaagacagggagtggaagcaaattgctatttggggaccatagacaagaggtaaggctgtaagcagagatagcccataaaaatgcaagatacaaatccatttttggaatgcctttaaatatgtgcattagaaatctgttattttccccatgctgagattcattcatagtcagaagttgagtaatcaacattcagaaatatgtcattgagaccaggctacttattcctgaatatataaatggcaacgattataatttgtgactacattcattctgtagaaactacaggtgctgccatttcagctgctgttgtgcaatctttactgtgaggagtccagagagactcttattattccagtgccttcctgatgcacaacaacctatgatttgccctcttaatgaaatctgaagcatctcattgcctctgtatagggacaggctgtggacagatttagagcggagcttcaggaagtatcttatatgtgtgtactcgcctgagaatgatgttacagctgctgttatgactattactgtgggttggatgtggatgtcataattcagagtccctcttgtttcagttttgggtgcagtgatgttgaaattcctcttctgtacttgaacttctatagcagtcttctagctaatgtcttcaacttgtttctcttttctaaggaaagagcaccttctcttatgtcccttgttcatcagccagttaaaaaagcatcctgactggttcttttctaccctctccgatcaaccccaccgaagctcccaggcacactcttacttcttaacctagttgtagatgcacagaagatacataacaagtatgtggacaaagagatgagaaaaaatgacattaggggaacctgaagagtttattttggttttagagattatttgaagcaaactgctaaacatccaggtgaactcagagctagccaaggttctgaaagttcagtaaaaaatgttaatattgcatagctatgaaacatttaatgaatttagcaatttgggggactgtgttaagaaacagccctttaaaactgaaaaggccaacagttttcagaatttgtgagtctactcaacccttgctactcaaagtatgacttgtgtgtgagcagcaacggcatcattcagaagattgttggcaatgcagaacctcagggcccactgcagacctgctgtatcacatgtgcatttaacaggatccccaagtatcatgtgtgcacattaaagttttgagaatgactgtggtaaacacttagaatgtttgacattccaagaaaattatagagcttgggctgtagagtgacaagatgtggggtcaaagcctagctccaccatacactcctcattagatacctaaatcattgaatgaagcttactaagctctggtttctacaaatgggaattaggaatatgagcccttcccacttcaatgggctgttgtgaaataatgcagttagagaaccttcaataaaatgtcagttagcataattatatttgtaataattattcatattatattcattatagaataaagcgaaatatcataaataacttttttttttgagagagagtcttgctctgtcatccaggctggagggcagcagtgagatctcagctcactgcaacctctgcttcccgagttcaagcattatacaacatatttttatagggcaaggtggaatatccatttactagcatgggctacagtggtggttggaaaataacaaagagaattgcttagaggagggatagtgttttgttcatctttggatatctgtgactagcaaatttatttgggtaagagtaatttcagaggggaaaataaacacgtccccccacagcccccaccccagaatcaatgcctctcaaacactctgcatttttgaaatatggtaaaaaaaaatcacatcagagaagtgattgatgctgcagtctcttttcagttcagaggagagagacttctatccatcaatagtttggaagttctcaattatgtaatataaatgatcaagattaatcgccttttctttatttttcttctaaacaatgtccagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacaggtaaggtggcctctgtttatccacagttgtaaatatatttacaggcctacatactcagagtgtaatagggaaggctgataaagtggtgctttatgtcgtcattttggagtaaagtttcatgctaaagatagaggcctagaattcagtgcggaatcttagtctggaaaaagacttccagtaggatctagttttattccctctctcattccctgtcagcaattgagaccttcaaaaattgaattacttgttatcaaaagccagctagaaaccagatgccacaactttctcttgtgtttattcatattattgctactactatactgcttctattactagcggcagacttttaaaataattctcacttttacatcgtttacggttatttttgttgtcatctttgggagaaagtataccataatggttaaagaggcagcctctgaaatgataaagttgcggatttcattcctagttctgccacttttcagctataagacattgggaaagttacttaacattctttagtctcattttcttcagctgtcaaataggaaccatgcactactttgtagagttgagactattaacagaggtcatgcatataacatgtttactgtatatcctgatgtgttgcaaatgttcttcaaatgttatttataagatattactttctcagtgtaaattttatattaatttcccacagcaaggcataggtttctaggtaaaaggggttacatatataatttgtattacttatttgggttgtattactgatttgttttttttttaccttttatttatttattgtttattttactttgcattcttattttgtaggcattgaaatacacaatataaaatttttaaatgcattattatgcattttaaaatatgcatcctaccatccaaatggtaaagacaacactttgcttgttgttctgtgatttgttttaatcgattagagatatgtcagtaactgctgtgtccccagtttattcactgcttggttggtaaggagatggcctggggagcaataatgtctgctttgtccctctttcgggcaggttggcaatttaactacagaaagaaaattttatgaataggaagcaggacccactataattaagaaagggtcaaaactatatagtttaaaattttattaaattttttgaatgtaaaagtttttaaaataaagcagtttatactgatttatttttttgctcaatgaggaatgtaagtgctttttttctgaggttttttatacactcagcaaaacaaaattattataattattacatttaagctcttgggacattacaattgaatgttgctattctgacttcaatagtactaactcatttaaaatacttgtatttggatcagatgggagtctgcagctccttctgactccagggtccctgtttgacaaagcagaatttaagatgtcaaaatcatgatccacatttcaaaaacgtgagaaaaaaaatcatgaagttttaaatatgtcatactcagcacacttttggattacaaatatattctgtaaaaacatcaatcctttcaaaaaatcacaagtgaatttcataggaaagtgtaaatctagaactgctaatttagtaggcttctttctataagtagcaacaagcttttaaaaaaattgtttgcaataaaatatccagtggaaacaaatttagtggtttccatttgaaaatgtaacttttaaatatcaaaaacaggaagcagcacagcagcacagcttagaagttacagtgtggatccgctgtgtgaacctgatgagttctttgagaaactctttgagtttctgtttgacctctttaacaacaagactataaaagtgaggcagtgtagccaagtagctaagaaaagaggcattagagaggctgaagcaggaggagaatcgcttgaacccaggaggtggcagaggttgcagtgagctgagatcgtgcatttgcactgcagcctgggtaacaagagggaaactcaaaaaaaaaaaaaaaaaaaaaaaaaagagaaaaaaagggcgatagaatatgtcttactctaccattgttcagaaacagcatcttgtggtggtggttgcctaggtgggaatctcaatgccaccactgatcagttgtgttactttgggtcatatatgtaaagattctgacccacaatttcctaatctgtgaaataggtatgataattgtagaagctacctcattagcctattttgaagattgagttgatatttatctgtagaacagtatctgccacatagtaaacagccttccctaaacttcactttctaatcctataaagtatgattgataaaggatgcctacctcgattgattgtatgaaagattaaagaaaataatcccatgtaaaatttttagcacacagccagattttgagcaaattacatgaatatcagtaattatttttattattatcaacaatataagatagctaaaaataaatgaaactatggttggcatggtggctcatgcctgtaatcccagcattttgggaggccaaggtgggaggatgacttgaggccaggactttgagaccagcctgtacaccagagcaagaccctgtttctacaataaataaataaattaaaactgtctcataaaatttcacattgaagtctatatataaagtaatattcattcaaagtttttaaatcaatgcagaacaattttacaaataatatgtaaatcctcaaaaggcagagtggttaatattcattcttttcagctttcagtaaaagcttgtttatagagtcatgacatttggattatgtaaccttttatgttctttctgactttcactgttctatccccatgtaagaatccctcctataaaatccctgacaattatttttggagttgctaatcatttgatgagataagactaataatttactttttgatgttggtattatcatttgttgagtgcttacttagtgaaaatctttgtgtcacaaaatatatgtgaattttctcatttaaacttcatcatgaactcatgagaaaaaatgtcatcccccattttccagaaatgaagaagcagagatattaagtcagaatagtaataatctcttcagatcataaagctagtagaaatttgctttgcttatcagttctatctatgtgacagaaataagaggtattgttactgagaaaattctggttaggaaaatgccaatagtacacttgcaaaattctcaatcagaactcatttataattgaaaatggtaattgctgttaattagtataaattatataaatgtatacagatacatatatatatgatatgtaaatataattaaataacttttatataatgggaagattgatggctgatggtgactttttttctcaattctaggtcagtacttattccttctgagacttcaataaatgcttcatagtactctttgtcacacactgggtgttcagagttctataaatataatgtggattctggaagttaatagatttcctattagcctaacttcctatctaatataaattattctgtacatagtttcagtaattcaattatctctacagagtgataaagtagtttcaaatttgctgttattcttattcatttatcaaatagatataactaagacaaaatgtcaagaattaaagaaaatattttattttggtttaagaagttcctgataactagagctacctgaaattggaataggctgctttttatagtgttaagatggccatctgaagtatttaaaaagtggcaaagtgaccagttattacagtttaagcaaagggaaattgctgcatactttttcatttatgtactcatccctcattctacaaatactgtgtaacagaagatacaaagattttttaaaaaaatctctgccttctgggagctcagtctactaagggtagtaagaacaatatcatcaaaaatattaaaccattactgttatggaagtgtatgcaacatacacaattaatgtagaaaaaaagagggttttttacaaatctggcaaaatggagtaaactaatgcatcaccaagaagttaagataagggtaaggcataaaagatgagttacagtttgtcacaaggaggtaagaatgttgtgctatcatccgaatttgatattctacaattttataatccaggcatgatgggaaaaataataggtaaattgtgagctgctatgcaaatactagtaactggaactgctatagacactaatggttaggatttgtaattatatgaatgagagactatattagtcagttttcacactgctataaagaaattcctgagactggataatttataaagaaaagaggtttaattggctcacagttttgcatggctggggaggcctcaggaaactaacaattaaggtggaagacgaagaggaagcaaggcacgtcttacatggcagcaggtgagaaagagaggacatgggaaactgccatacacttttaaagcatcagatctcatgagaactcactcactatcaggagaacagcatgggggaaactgctcccttggtcccatcacttcccaccaggtccctccctctacacatggggattacaattcagatcacaatttgagatgagatttgtgtagggacacagagccaaaccatataagatactaaagaagaaaagaaatggaaataatttagattttgtttttctctttcaatgaccccttctccatacatcaaattttcagctagtcttcctaacccttcttctgaaacataccctcaatcagactttctttccatttccagcccttgtctcctagtccaagccacaacaccaccaattctcatctagtttccaatgagtctcccagcttccactctgggctctttgcagtaacatccttcacacagatggcattttgaccttctaaaagcgtaaatcatatatcttattctaattaatgaagccatctattaggtttccattacattaaaaaaataaaactcaaacattgcaccatgaccctccaggttctaagtaatctaataccctgttcacaattgatccccacagccacatgcagtcccaccttcccccagcacgttgtatctcagccttcatcctccttctcaacaaaccaacctatattgctttagaacatatctttggcatatatgttcatttatgactgtaacaactgtcttctagatcactgcaggcctgtcttgttattagagctctgctaatctccagccatctccaaccacctactccaggggaatatatattatgcgccttctcagaattctatttaatcatcctcttgtattttctttacacagtttattactatctgttcttttcttgtttacttattaactagtgtgatttcagccacctcctaatgtaatgtaagttcattgaaattaagagtcttgtctttctcatttagtagcataattgcccagtacagaggccacctacagtagataccaaataaaaattgttgaatgaaacactatcatcctgtgttagaatcacttgctatagaagaattttcaaacctgccaaaaatgtacactggaacaaaaaaaaattctgaagtctctcacttcctataaatgggagggtttaactgaaatacaaagagctttaaaatatttaaagaattaaaccataccttctcttcagcacattcattcacttattttttatcttctttcaacaactacctactaaatatctcttatgcatgagacatcaagaattgagtgaaaaaatcatacgtcctatgtcgttttcttttcatcatccacaatgtggtagacaaggggcaagctcaaagagaacaacaaaatgcagctggaagtgtaaagctccccaggagtgaaatagatttgttatactgaggcttcaaaaaagtgaaaagttacttttagctattggaatcagggaaagtggcacttgaactgagtccagaaagataagtaggatttggtaatgcagagatgagggggacagggagggaaacataaggctgaaggaaccacataaacaaagtcaataaaagatacgtaggctggtcggcaagtaggtcagtttctcttgaacattgaagattgattggagcctggttgtagtagaaattcttgaatgtcagaaacttggactttatgtatgtatatgtgtgtgtgcatacatgtgttcatgcatgcacatgagcatgtgtgtggaaagcatgatcagaaaagttattctttcttcagtatgtaaaatggattgtttgtgggagaggtcagagtaggatgaaccaggttaaatgtatagatgaaggagcaatttactgaatttcttaggtttgttaaatctcgaaggaggttccagttattggaagaaaagagaaaggagaaccacatagttttttcattctgtttttttaaaactcctttttttattgttcctcttctttcttggtgtccatcctgagctatataatttgaacctgtttttcctgcctggagttcaaatattgttaccttacatccttcagactttcaaaaaatacctccctttttcccatatgtcatttttcttccattgcttttgtgttaattacatcacaactatattctacatgctttcaaggacatgtgaaataaaataatataataattggttaattacagagaaaagggagacctgtgtgttttccctaaacctgtctctttagaagcctccaacaaagttttgaaataatgcttacccagagttatgctgttttgaagtctacattctttcttttctgaccatttgtagtaaataccaaggaaacaatgcattggacataaagcaaacatgaagaggcaaagagagcagaatcagggttttgagcagttctcaaaaaagaaaaatacctaacccttagataaggcaaggcactattcataaggagaaaagtatcatgcttcttaagcccattaattaaatataagcagagaccctctattaacacttgacttgtaaaattaggtcaagaaaatctgaatttagagtttttccttcttttgatataatatgctgtactttatacaaccacaccatggattctcagaagagatttttattataaaatatttctgtgggactatagatttgcctaggatgtgacagggaaattgacattttaatatgctattttccaaaaggtggagaatgcaaaacattagttttgaaaatgcttactcacaaggttttaagtttggcttatttgtcgagctagtataatgaagaggaggaggaactgtgagtttacaaagattgaaatgtgaagcctttaaccatcattcaggtaatgcttttgtaagccctgaagctacttctacataatataccacagtaatggttttatgtgaactgggcataattgactatcagtaaaaactaaagcttattgaatgcttggcttgcaagctcgtcttttgctaggtttgatatgtatctgcacatcaggtagtgatttgcatttcctcgcacagcggtatttttaggatggaatatgaacacactgctagaagaggcacttttgtgtagaatactaccacgagtcggcattttcccagcagagccagcagagaggttcacaaactaccttttctgtgcttgattacgaggttcatggcaagattgcctaaccaaaccattgttatttcttctcttcatattttatgttatgtttttggaaaccattttaatcttacagaaaatttgcaagaattgtgcaaatgactctcatgtacacttctcccagagcactcagagaacttattcatatttcaccaagtttcaccaaagatggtcacttttagtaattcaggataaatattgcacctagtagctgtcacatcttctgaatatccctcaatctggaacaactgtttagcctttccctgactttcatgatattgatatattgatggctaggcattttacataatgtttctaatttgggtttgtcatatagttcctcattattagatacatattaaatgtattttttttgtcaggaatgtcatcgaaatgatactgtgtttttcctgttgcatttcattgggtgtttcatgatatgaatatcaatatcttccattttggttgtgttgaatttgattgcctgattaagataatatctgccacaattttatattctaagtgaatttgtctccagttgtatgtaataggtatttttgtgggaagatattttgagactgtgtgtaaaaacgcaattttgtatctactttgacccacaagttttagcatccgttgagctttgttgcctgaattaataatgtgcaaaaaatgtcaataattaatgacaactggttttctaattccatcctgtcttctgcattttctctctggcattctactttaagaaagagatgtattttctccccatgatctttctatctatttaaattgtatggacaaatagatttctactgtatttgttataattcattactatcacaacttactttgatgcttaattttccaagatttggccactgggagccccttcaaactggctgtgtctcctttccaactgccctatcactctttgagaattttctttctttatggctcaaggtgttctaggctcatcttgcacattccctaacttggctttagatcctattcttttctttaaggaacttgtatgtctttttgtatagggtgattttagaaaccaagatctcattgctcctaggttttcttggtggacaaaaccaagaaatttatgtatgcatacacacacatacatacatacacatacattgaagcattatttattttgatattatatatatgccttattataattcaatgtgattattcacatatacatacattcataatacctccaattccaactcaacaccacagtttatttttctttccatacttgtgcctctttttgtcaaccatgagaaacttggctctcattattctcaatatgttttcttatttactcaactcccctgaatcgagtaaatcttccatccacactagacttctgttcaacccaacagtttcctggccttggccctgtctgtcacctgtctgcctttccagaatgaagaaaataggaaagcaagcacattagtggtttttgaaagatatgtgcttttctttcctttttgttggggttataaacaggaattacaataccattagttaatgtttctgactcaaatcagttctacttgtgtctacatttgtgaccatatctatatcaagatggatccacagggggaaatatttcttgaatacaaatcagtatgcaaacattcatgtttatgacattaaagattagaggtttgatagtgtctaggatttattactgagttccttttaatgatcagtacataaagaataacatttaggttagaccagtggaagtgtcacatttaacgaccgagtgactgagctgtctgttagctaagggaacctcaaatgcagtaaaatacttagttcagaggcattttcatggagttaaactgcagggtagtagttaatagagcaacatttacaggtagccagattcaagtactggttaagcatctactagattgttacctagggcaacttatttgacctctagatgtcttaatttctttatctgcagcacctacattgcaagattattgtgaattttgagtgataggctctaggaaaatactaagcaccacacttggcacatattaagtgcacaaaaacaggtaatagctctcatggtaatcactggtatcatgacttttaattactacaactctcagtaacagatgaaggacctggcttattagaattctaaataaattatactctggaggctgaggtgagagcatctcttgaaccaggaaggtcaaagcggaagtgagctatggttgctttagtgcgctccagccggggtgacagagtgagaccctatctcagaaagtaaataaataaaagaaatccagataaactgtttttgcaatgctgtatcttatagtttcaatagttactcataacatgatgaccatgttgtaaatgcacagtaagattgtctacataggaccatgttgctgaatattttgaaggaatattatgatacatattttttctttttccagttaataggaagagaatgcattatcagtttatggggaaacagtgaatgtgccactgcattattcactatatctgtcaaaatgtactttctgattagaaaacactcttgattctaaagtctttataaattatttcatgaatcaacccaaatatttttatttaactggtacaaatcatgcataaaaatagagggtatgttgtgcgtcttcagagatttaactcaacttctttgatcatttgcataaaaggtacatctttaccagttggcattgattgatcctctatagactggagttaaaatctaattttgccataacaaattatgaggtggaaatactagagaaacggatggcttgtaacatcagtagacatttctggtcccatttccatgtgaatataaagcaaggatgacttctaagtcctttttacagtgatttgaagtttaccttcaccatgttcctttctttcatcgatcaatctatttccttattaatgctaagttagatcactcatgtagggaatttgatgagaaatacaccagagaacttaaggtaaataagagtctcttgtgacttaaactaaaagacataaaagagtgagtctgccaaaaatatgcactgctacattaacaaaaattttaaaaaggcttccaagacaagactgagctgtcacaagtaggaatacatttttttaaaaagcatgtctcagacagggggaatgggaacttaaccaatggaattaagtcttacatattgaggaagatagctgtaagtcagcttctgaagaattctttttaagagctgtttgcttttagtagagcaaaaactatacggctaaaatacattccaagttttcttttactccagactttcttagatggagatagaatcttttttaactaacatggccagaaacattcttgctcctgtgacagctgttggtcttgttctcataggaaccaattagcggtgggctttagacaaatatttcagtgaaatgcttaatgtgactcagcttctaaaagataaatctgtgaatacaaagtctgcaggactagaggtcaaccctggctcccagccagttcaacaaggtgctgtgtctctgtgacacttctttgcaggcagccagtcagctttccctggggtccacagtttcactacatactctccatttaaacttcttcagcaagtaataaaaatccttagaacacttcagaggattgtttttcccttcgttcagagacaataggttaggcaagaggtcagcgaggggtagagtggcccacaatagatgaagccaggtggaagaacagactttagtagactttagaaacgaatggggagggactgtcagtagatgggggatatgtgagaaattggggtccagaagagaaagaaacagcctacacaaagagcagatatatttgctcttttaatattgaccagaatttcacaagagagaatgtatttccggtccttttgtaataacagttgatttcacaattattttgcaaggcaggcattttttcttatttttacagatgaacaaacaagttcagagaggtgaagtaactagccaacatcacatgagttagtaactgattagtgatggggtcaagttttacacccaaacccagtatatttacacatatgctactctttcttgcatatgttttacccaccaataattttgttttaccgttgtggctaatattatttattcatatatttataaaagatttgttgactgaaacttatattctgatacaagactggacactggggatacaatggtgagttcaaacatggagaatagcgtctagtctgggagttaaacattaatcaattaattacattaatctcatatcacaagagtatgaagttctgaaaacataggtccagggaatactaagtatgaagtgcttataattggagactttgcctgatgagcgaaattagggaggaattttttaaaaatagtcacttgagctaagacttggagggaaggaatcaactggatgaagttgggaggaaaataatcaagtgtaaagaccctgttttggcaggaagctgtggaaagtgggtagaagactctggtggccacagtagagagaggagagaggagtcttgtgtgagatgatgctggagaccatcatcccataggttgcgtgggacccaaccatgcaagaccttgtaagttccgtaaagttttcaccagagggctccatgaatcaggaccaggtttgttaataaaatattatgactttagttctataaatgatgggtttgaagtatttttgtgacagccaagaagaaatgtcaattagacagtctttatatacattgggaattcagagtaaagtgctgggttagagttagaattttagaattcaggcataaataaataataaccaatacaatgaatatgattgagatcatttagagagactatagacaaaaactggaagaagaatagaatattcctttgctgaactcccgcttctgctctctgtatccccacttctttttctactacccagaaccacaacatttaatgattatgtagaggaaaacaatagaataaagtagaatccagagaaaatgggaaacacactggagaatttttgccataaaagccaaggtagtacagtttgataaaggaaggaatgggctgctgttctaaatgctgccgagataccaaatgattggaagactaaaatatcttttaaatttagctactttgaggtctttttttctggccttaatggtatatatcctatcatttaaatagtacattttctttctaaatttgtttatgctctttatattcagttttaagctagaataaaataggaacagtctgtcagaaattattggagtccaaggcacaactttgtataggaaagtttctttcttgtatagttctttctttcatatattaattcacatatataacacatatatcaatacagacaacatgtagttttccatactttattaaaacctaagtgaacttttaagtttctaggactgtcagttaaatattgactatttctaatatcaatgattactttttttctcttgaaactcaaatttagattaaaagcaaaatgttaattaagcattgattcaaaaatataatacatttttattcatatatgaacattatttgtaaatattcttaaagtagtaaatattgaaagatcacttgtcatggcccagacctactaccagaaaaaaaaagggtagaagtaaggcaaatgagatgtctctaaagaacacagtccagtgtgcaatcctatattacctcgcctccttctgtgtcttagtagttcatgccgtgaacatttaaaatgtgtgttagtttgtgtcaaatatacgtcgattttgaagctgcatcaaatagaaagcatatcttaaaatatttacccatgcataaagggaagaaacatgcatgaagtatgattagaatatcaaaagtattcaggacctttgttgagtgcttttcttttaattagacacactctttacaagttaaccacacacacaaatacatacccatgtacatacatagacaaatgtgaaacagatgatatgaaaggtaattgtaagaatgagaatttgtttctggttgactttaattgctctgaaatctttggtaattaagtcatcataatgatgtataaagtctagaacaaaattattttttatttttacacatattttaaaatatattttatagaatttttgttttaaaaaagaattttaggtgtgattttaatactttcactattctcacaaaaaatgtaatttggccatatttcctctaaaatagcaaaagaagttggatcttttaaaatattttgctcccaaattataatcaactattggtagttataagcttccaaatttagacaagcctaagaaatctaattccacatctcactcccacttaggttgtgtatgaaaaataacacagttctcctatacatagacagctctggaacattccagtcataaagaaatacttaccttgatggaaaatttgtaattaatatttcttgtagaacttccactttgatgagtgactagtgactataactgctatttctttctattttcatggttaatttcagggcacattcagaaaatgaaggtaccgctttaccatcggctgactcctgtaccagtcctacaaagatggacttatcatatagtaagactgctaagcagtgcctggaggagatatctggtaagtgacctcatcgatgcataggtcaaacctaggaatttccgtattctctccataagactttttattaaatcatatatgtggtatactgtttttagtgcaaaaatggactatatacatctcatgcttcaaagatcattaactatttggctattctgcttaggatgatctctttgttactataaaaggaatggtagtcctttcagaagtgaagactttaagtcattttgccctcagtcaagtagttgaataaaatcagagaaaacctggataatacatttggagattgaaaataaactaatgattggccatgtatattctccatggctaatgcagcctgctctgtcatcaattctgtatgatttaaaacatctctacagggtggcttcaaatgaccattctaaaaaactctgaaaaggaaaatattttattatatatagatgatgtaagaaaaaaaatacatatcccagacacagttatcatgtttttggtgtgtatcaaatgggatgctcagcttgagcacaatgttttctctagggtccaggtaagcctaagcatatatggaaggcatttagtttaatttcattacatatagatctatattcgtgaggaatcaagtaacctcctagcaaaatatattgcccctaaagggtgagagagtacagagtactttatctgctcctaagtataataatgcatgaaagtaggggtgtgtctgttgttccaggaaatctctggtccaagcctgtgtattcacagctaagttcaaatgaagaaaactaaataaattatttaattttaaaaaattactgtgtactccaaagactcaaagtataagtattgctatgaagctcaagcgactctatcacaaatttgggggttaagaaacttccccacttcggcagacctgaaaaatatttggcaagcattagacatgactacagcatcctgcagtggatactgacaacaattacagaacaacatcccaagggtacattttggaatcagcattagttgataacattaggcgtcagaggtttcatatggagattacaacaaaggccagttctaggtaggggtagaaatggtaatgccaagacacagatatagggctaataattgtagatttttcaaatacatgggggatgtgttgactttccattaactctgggtagtaccacggtcaaaataatgctatgtgtctattatgaccagatgttttataaaattagcatggcatgaagatgtgtatgcctcatatatttatacataaatgtcctcaaattgcatgttttagcactagagctcaaatctttaggataaatgaatttagtagagtttgaattgcaatttttttgtgaatttcacaaaggaacactgttttcagaaactaatatatcacggtatatctgattgaatagtctgtatttgatgtttttctccacttccttattgtctaccctttgatcactttttcatttttccagttgatatttccttttaacattctgatttttaatagaatacctgaaagtgaatataaactggcaattaatgtaataatttaatgggtttatcagagagcataatatcattttgcagcaataatcaattatttacataaaatcatagttttcagtctaggattttgataagaattcagtaaaagaaagaaaacagaaaataaatggtacagtgagacttgtctaattatgtcaatctcactatcatctgtttaaatgcagcctatagtgggatagtgaaaatgtctctcgttgcttgagatttcctggaagaattgtgatattatttgcagttagtaagttataaattgagtactataattgaagaaatttagatgaggaaatatgagcaggccagtgataagatgactatcacagagaaattagattacatatcttcatcattttaagattttggtttatgggtcactattactctcttaccatttctgccttaatttttagtgattttagtatctacacgggtgttctttctaacaccttggcctctcctcccataattttgtgttgcagtccctcctgagcttcttattctcatcatcataccctagatctaggcaccatcagaaactactacttctctatgacctcactttcatgcactgcactctcactgattatatactcctatcatttcagtattcttccttttgttccctaactccagcaatgattccactaggatttccaattcattgatcctaccactttttaccgttcttcaccaacctccgcatatttttcttctctccttagctgaattcctgtaatgagtgaatgtatttttatttttatatatcctaactccattgcctctctctcacttaattgtactcatttgatgaaatcatgacctggttacatttaaatctccacctattctataccaacaatgaatgaaccaggagaaaacacaccgcatgtcaatgcaactcactttacatatatgacctccaacctcaagtgactatgtaatgctcctggcagtcagtctattttttatacctttttttctcaaatgtccgacatcaccagtcccatcctttctcttaactgacaacctggatatgtacttcacttaaaaaagtgaagcacaaagaaaagttcatgaaccactgtcatcacatctacccaagtaaaacatatatacccacttaatacctatttactctgcttttacttagattactctctcttctctttaatagctccctcccaaccaaatcacttattttaggccatagcatactatcatttctccaaccttaatttaaaaaacacaacttcctggccgggtgcggtgtctcacacctgtaatcccagcactttgggaggccaaggtgggcagatcacgaggtcaggagatcgagaccatcctggctaacggtgagatgccgtctctactaaaaatacaaaaaaatagccaggcatggtggcgggcgcctgtagtcccagctactcgggaggctgagacaggagaatggcatgaacctgggaggcagagcttgcagtgagccgagatagcgccactgcactccagactgggagacagagcaagactctgtctcaagaaaaagggggaaaaaaaaagccacaacttcccttgaccccaaatttgtcctcaagtactgttgtgatttatctccttctcttatggcatgctgtaaaaagagtacggttcaatcacagtctcttaggcttttagccccacttctccactggaactgctcttattgaagtcaccactaatgtcaacatggccaaatccaaggatcaagtctcagggcttatcttatttcacctcacagcagctatttgtcctcttctaagaaggtttcttccttggtgctatagtttggatacagtttatttggtctcaccaattctcatgttgaaatttgatttccttggccaggcatggtggctcacgcttgtaattctagcactttgggaggccgagggggtcaggtaatgagatcaggagttcgaaaccagcctggccaacacagtgaaacctcatctttactaaaagtacaaacattagccggctgcggtggcagacacctgtagtcccagatacttgggaggctgaggcaggagaatcacttgaacctgggaggcagagattgcagtgagtcaagatcgcaccactgcactccagcctgggtgacagagctagactccatctcaaaaaaaaaaaaaaaaaaaaaaaaaaaagaaatttgatccccaatgttgtaggtggggcctcatgggaggtgtttggatcccaggggcagattcctcatgaatggcttggtgccattctcctgggagtgagtgaattttcactgttaggtcccacacaaactggttgttaaaagtaacctggcaccttcactttttcttgtttatgctctcaccatatgatctctgcacaacagctcccctttgcctttcactgtgagtggaagcagtctgaagccctcaccagaagcagatgctggaagcagcttcttgtacagcctaaagaacagtgagccaaataaacctcttttcttcataaatcacccagataatcctttatagcgtcacaaatggactaagatacttgattttcagagtcatgtatcccctctgttttcctcaaaccttactgttcctttttggtttccttttctagttatactttttttcttgatgatttcttatgatttaaatgatccaggtctctgcttctaggtttctctacctataaatgtgatttaatatcgatattatctcatggctttaaatttcatctatattctgatggcttacaaatgtctctctctgcactagttctctccccggaactctggactcaaatatccaactgccaacacaatctttccgcttgaatatctcacagacacttcaaacataatatatcccaaactgaacctctgatattaacctagcaaattgtacccctcgaaaactctttacccaagtcttctccattttgattaataagaatttcatccttccagttgcccaagcctgaaaccttagagttattcatggctcctttttaatgcctcacacctgatgtcctgatattctattcattatagtatatttttggctccagaagtattgttttctatttgtactcagaaacaaatggtgtatatgaatcaactttttaggatatttctcagtacttgaactcttgttattttctcagaaattcagaaactgaaaaaatttagatgacacaatattgaactaactataagaaataaggtactaagataccctagaataattgcattttaaaatatatccagaatttgccagttcttcttttttctacttttatctattaagtggcatcaccaatggatggttagtatatagatagcattcaataaacgcatgtaaaatgaaattaatataatggatgtagcattaaaatgagaactacgctaaaaaaggaacctaataattttcagaggaaaacagtaaacagaaaagataggacttatatctttggctttggaaggcactcaggaaataatcacagtgaacttatgaccaattatactcaactgaaggggttgatataaatggaaaataaaaatttacttttgattatgccatcactgaataatcaaagaatatgaggaagaaaatgtttagttattctacagaagtaatgttagagttcagaagctctccccgttgagctgggattttaagacagcacattagaaaatggaagaaagccaagaatggtggctcatacctggaatagcagcactttaggagaccaaggcaggacgactgcctgaagccaggagttcaagaccagcctggacaacatagtgagaccctgtctctaaaaaaaaaaaaaattcaaattgttcaggcatggtgctgtgtagcacatgtgtagtccaatctactcaggaggctgaagagagaagactgcttaagctcagaagttcaaagctgcaggagtcatgatcatgccactgcactcaagcctgggtgacagagcaagaccttgtctccaaaaaaaaagggtggggggccgggggagaagaataaatttgtaacacaggttgaacatccataatttaaaaatccaaaattcagaaggtcccaaagtcataagtttttgtgtggtgacataatgccactagtggaaaattccaaacctgacctcctgtgacaaattgcagtcaaaatgcaggtgcacaacacagtttattcagcattctcaggggaaaaaatagtctgtcagcccctttagctgctatgtatcttttccatgcacacccacaaagggtaatacaatggcatgtgtgcagaatggacatgccaatggcaggttccccacagtgccccacattgggtcaagacctatacgcattactctgtggtttttgttttgtttttgtttttgtttgtttgcttatttttcattgtgtggcataaagatattgttgaaaatgtcaaaaaggcctgaagatacccctatgggtaacagtgataagaaaaaaaggaagcgtttttttttgttttgttttgttttgttttgttttttttatagcacagaaagtcaagctgttggagagactagactgtggtgtaagtgggaaacatcttccagaagagaatggtgttggaatgaccaccatatatgacctgaagcaaccaaaggataaattgttgaaggtctccattgaaagtgatgaacagaattaatgaaaaacagaaaaacactgcataaagctgaaaatgaagatctcaattgtgtattgaaagagtggatccatcagtgtcacggtgtacacatgccacttaatggtatgctgatggttaaataagcaaagatctttcacaatgaactggcaattgaaggaaactaaatattcaataggctggttgtggaaatttaagaaaatatatgacattaaatttttaaagatttgtggtgataaatagtgaaaacatacattgactagttttccaagatcattgccgatgaaaaactgactctggaaaaaatctttgatgctgaaacaacacaagttttgatgcctcagaaagatactgacacagaagataagacagcccctacaggaagtaaggatgccaaggacggagtaactgagattggatgtacttatacagcaggaacccataaatgaaaacttgctgtgataaccaaaagcttgcatccctgctgttttcagggagtgaatttcttaccagtttattattatgctaacaaaaaggcttggatcaccagggacatattttctgttggttttgcaaacattttgcatcagcaattcttgctcactgccaggaagctggactgaatgactgcaagaatttatttgattatatttattctactcattgtctagctgaaattattatcaaaaacaatgtttatgccatgtactttccccgaaatgtgacttgttaatttagcccagtgacgaggtgatccttcaatcgaaaaagaataaatataaaaacacttccttaaatagcatgccagcagcagtgaacagaggtatatgtgtggaaaattttcaaaaggagtttagcatgaaggatgtcatatatgctgttgtcaagccttggaatgcagtgactaaagacatggttgtacctgcctggcacagcctctggtctgcatctatgttcaatgatgatgatgaaccaggtggtgactttgaaggattccatatgtcaaatgagaaaaacaatggtgtctgaccctacctattccaaaaaaaaaaaaaaaaatactttcagagtccataagtaggctagaaaaagtggatatcaaagaaatttttaacattgataatgaggctccagttgttcattcattgaacattgataacatagccaaaatggtgctgaattcaggtgactgtgataatagcaatgatgaagataacaatgttaacactgcagaaaaagtgcctagagacaacatgatagaaatgcatgatgatcttagtgaagaactagagcagtgtacattcattacagaacaataaattatgccagttgataaaaatcagagagatttctaagacaaaaactgttgttaatgaagcagatgactctggggtaaacattttaaaaagctacacagcagaatgccacctcatccctaaggggcccacttcccagtccctcaactgcttctgatgtttcttctcacctaaaaaaaaaatacagtgtacagtaaccttttaatccaaatacagcattgaatgtagagatggaaagcttgtggttgtttgtggttgctgttgtttcatagctgatacaggtattctggcaatgctactgtgctgcttagtgaccttgaacacattattttttcactgcattaatgctatgtcatattttttattggtaagtacttatgtataaataattgcaataaaataattgcctattagtagcatataaattcagtcaggaatgatggtgatgccacaaaaccacagattgtacaatcctgttaggtgactgagatagagacacctttgatttctgatggttcaatgcacataaactttgtttcatgcaaaaaatttttaaaaatgtatagaattaccttcaggctatgtgtataagatgcatatgaaacataggtgaattttgacttgggtcccatccccaagatatctcattatgtataggcaaatattccaaaatctgaaaaaattcaacatgcaaaacacttctggtcccaagcatttctgataagggatattaagcctgtaatagaataaccctataaaagaatgaacctctcagaattctaaagctcatgagatgttttctatattaatgatgcctctctttctcagaatctccatcctttattggctttcatctttctgagttctggatgctagtgaaaccacaaagcactaagcacctgaatttattgccaggtcctagctcagactggcccacagaataccccttccaagactgtttgaaatgtggaaagagaaatgttctaggaattggaaaaaataaattttggcttcagcactgcaattatttagcgattatttggcctctgcactgtgaattgctccctggttcccttttctgtgtggtgaatatgatgatacttaataaactcagaagattgttgtgaggtatggtattattcctccatcagtcttttcagtaattatcacctggcatcttacacatgccagacatctcaaaatttgggaaaacaaatgtgactaagaagtgagctctcctttgaaaaagtaagaaacaaatagataaaatttaacaccacaaataaatgaataaataggcacatggaaacaactaacttagctgtaaagagtcatgcagaacttaaaagaagatcagacatgcatattgtagaattctaatgaacaatgaaattgtggaataacatgaaaataatgggaaacaaattcttcttaacttactcttttcattagtttctttttgtaaaattgggcatttctcctaaacttactgaggtttcgatagttctctgattttctgcaaccccaagcttcaacactattgttattgttgaacttttattgctcatggttgctgtaggggcctcagtgaggaataattctgcttcccaagtgaagtggccttcatgatacagaattctgaggaagttagtcttgccagggtaagatgcaggctttataaatttgtgaagtctatataacattcagagtcctgaaaatagtacagaaaataaaatgtatagtgtctagaaaggggtttaggtgagttaggagttctatagcttaagctctattgctgtgtattaagcctacctggaagtactggtgtcgttttgtgtgtctggtatccattgccccatcttctgataacagcaccttgattttctttggggagaattctctgctcatgtgatctaactgaaattgatataagtggagccaatgagaacaatctattcattgactgcagtgactgtttgaggactggatgtgtgacccaatcaagtttgatcagaacaaataagactcaatctcaggacttttcctgaggttgttataagagaaaatgtggcacatatacaccatggaatactatgcagccataaaaaatgatgagttcatgtcctttgtagggacatggatgaaattggaaatcatcattctcagtaaactattgcaagaacaaaaaaccaagcaccgcatattctcactcataggtgggaattgaacaatgagatcacatggacacaggaaggggaatatcacactctggcgactgtggtggggtggggggaggggggagggatagcaatgggagatatacctaatgctagatgacgagttagtgggtgcagcgcaccagcatggcacatgtatacatatgtaactaacctgcacaatgtgcacatgtaccctaaaacttaaagtataataaaaaaataataataataaaaaaaaagagaagtggtctctttttccactacacctaaaactaacaaaagagaagcttagacctgctaacagtgacctccaccctcaaatgaaacaaacatagaggaaacagaacctaaatcaggagagaccaaattcaaggccattgtcggaaataactgagcccctgaaaaatccatgtctgaaactatttctcctctacttttgagttatgtaacccagaaaaaagtctttttgtgcttacacaaatgtgaaaatcatccctattgcatgacccacaggatgtatgacatgtaaagatttgccatactattaaagagcaaacttgagtggttcacattgcaatgcagatgtgttagagggatttgctaagttagttggagagcttagctgtttaaattttcaccaatgcagtaactcacttgacattataaaaacattgtctttgccattaaatggtaatgaaagtttaaaaaggtaataaattatggtttgaagataaatatcagaaatgcatgacactcaataaagtagaatactggataaatgactttttcaatttgaatattcttcataagtcttcagtgcacctctccaaaatttttaagtacgtcacttaaatttgcttttgcttattatgttctttgtgaagaaacctagttgtatttacccaatctgatgatggtagctccaataattattatagtcaggtgaaatgtattatataatttctgccattgaagaagtagcttattgcttcctgcctttcctctaagattcatatcatgacctcaatattacagtgctggctgaattaatggtacagattttactgctttggcttgagttttattctcacattcattgacagaaagaatttgtcctcagaggccatccctttcatcatcttccaagtgattctgccaaatgtaaagcgagcccaaattttcatcccactggtactcaaggaagtttttcaatttttcttctataggttcacacttgccctttttttttgcataagactatccaccaacatgtaacacatttgtttaattcacttcttaacctttatctggaatttatattcaactgaaaaatgttcataggtgctggactggctcaatatcaataaagctggcatgtcatttgtaaaaaagtaatattaaaattattggttgaattcaggaaaccattttagaaatagaagaatttaggttaaccagaaggataagcgaatggttacatgtgcttttactgactaccagactttgtattaaaagtgggaaatatctgacatttacaatctctgtaaatgatcactgaaattgcccttttttttttgaatgtttataaagatcaagaagatcaagctcagataattcaaatcagtttaggtcttttacttaaatagccacattataattatgtttactaaagagctgaaaagcattcctttccagcacattataatagctataacttattttaggtcttggcgtaattagaatgattcacatttttcctactgactgggtgtatttgtctcctttgcactgcaccttcctcctcttccttgtataacatacatctatatgtgtgaatacaaacaaatataaaaacattcatatatgaatgtacccccaaagcaagcaggatggcgctctccagagaaggaataagtgggttccccactgtcgctcagagtaaatgtggactgatgtagttctgggacaaacctactgtaaccacaagttaataacaatatctttgaacaaagagacagaaacccccttttgataagccttctctacaatcccctccttgctggctccattggactgagcccatcctttccagggttcacccctccagaaggattaaatttcctgtctcattgaatcaggaagaaccatgtgatttaatctgacaaatgaaatacaagtggaaaaatgacatgggatgttcctgagcagaaacttaagagccattgcttggatctctcacctctcttttcctttggtcataaaatcaacatgtcccagactaggattgctcttgtagcatggttgttagaataaagaatacctgagagagagctgtaacaaacagagtggacattaatgtcagcaaaatacatctttgtattgaatgccactgaagtttctaaaccatttgtaaatgcaatataacaatctaattcaggatttcccaacttcggcactgtggacgttgtgaaatgcagaattcttttttgcatgggggtggtttatcattgtaggatgtttagcaacatcactggccacttccccttagatgtcaccaccacacccacagttgtgataacgaaaaatgtttccagatattgccaaatgtcccttgggggaaaaaccatccccagttgaaaaccactaatctcagcatagtagttctcaaagggggttttcagagccagcagtatctggaaatatgttagaaatacaaagtcccaggaccctccgagtccaactgaatgagcagttatgtggctggggcacagcgaactgtgttttgataagccctccgagtggttctgaacatatgaagcttgagaaccacaggtttaaactgattggtatatgtataagcagtcttgaataaggaaagggcataaatattgcttttatttacagatgaataaggtcaactcatttgatatataaagcattagaattgcattttttgtgaatctgtaaggctttagggtatattagcatatatactagtgtaacaaatgttaaatacattgaaatttcataatttgaacaaatttcactatggtctcaggacttggaaattcactgtgtcacaataactcaaaatgaaagaaaaaagattttctacttaggaattctaaggggagtgtcattttggtcttccaaaaaatactttacaaaattgtgtttttaggagcataactgtcagtttcaattatctgatatttgtactgtaattttatttagcacattttatataaacgagtagtatttaaaaagtatagaattgagaatgagtatcaataattcacagatttctttattgcagaattttgtcacaaataattgctgttctttccagctaatttccttttcatatctataaaatgggtctaagtctgatctaccttgaaaggtggggcataaggaataattaactttacaaagtaagtggttattatgtgtaaagttataggcaatgcatattataatgctaatatatatagttatgagattgggtatttcctctattgagattggcaataggaggtagaaaatcacaattaattttgccacattagctctgaaaatgatgaagataatatctctgcatatttctccattttccctcatttgataaaggagaaatccctatttttctgtttgtgagcagaaaatcttcagaagttaaatactgaaaggtcgatagtcttcttaactgtcaatggtacccatgatttctgctatactatatatttgttttttaaagttgtcctaaaatcagaattttgtggtggtatagtgtacgtaccagtacaaggtaaatacaagaaaattatctttaggttttctgtttttatgaaaacattaagaaataagagctgattatgctgtgataggcttatgaaatagacctggaaaaatgcaatatcaaaagacacaatgtgcattttgtgttatctgtaacattattatgttccacacacttgaccataaactttcaattttaagctttgagtcaaaatatcaagggaaaacccttttgagttatttttttctttctatttcctttttgtttttacaaaaaggctgtaagaaatctttatcatcacattaggattttaggattcaaaataagaaggctttgactttgttctttaaaagattagggaagtctttccctttaaagcattatctcctagcgggtggagagtgtcatgcttcattttttaggtcctttacactcttgaatttgatttgtgcttttacagcacaaatcccaacattcagaagggagatctgcctgcttcagctgcctgcagctacagagaattagtctgtcattctcggcatcggggagtgtgtgttgtgtatgtgagggtgtgagtgtgtgtccgtgtttgagattgggtggctgagagtcatttaaatgtgcataaggttaatagtggaagatctcgtacaggcttggctcagaaacctgtggcattctacgctggacagccgttcccgtgcctctgttttaatttggcaggatgtttgctgccatggcagccagcagcatccactgcagcagcaaggaagagccatagatctgagaatgcaggtggaatactaaaatgtaagaggcttgtgcagggctgggcgtcagtgcttaattcctgctcttcctgggctcctatgagcaggctgtacttgctgcactgtgtcagctcgttagagtaaagggttacagacctaggtcagttaagggctggtgaaaggcaggggaaagaaaaaaaaaagcaaaaagcaagagacctcagctcgtgcttcacctcctggcgtttcgggacacagaagcaacagagggaaatgtggacccatcctcctgctgagacatgtgattggatgaagacgggcaaacgtagttggcttcctggactacttttcagctggaggagagtctttggtgaactcttttctgcttcagatatattcgagcaaaatatttgtaagtactgctgattagtaaagtgatgtgtcaagctaaattgggggcaaataattatatatactatatctctagaatcttctgtgaatgtgtgagcttgagcttttattgaagtgcatgtgataatcaaaatcaaatggatcagttacaatcacagtgtaacaagacaatatgaagtccaattgaaaggaaggagccactggaagaatcatgcagcggcctgctgaactctctgtgttccggagcaaagaagtaaggagaaagggagcttgccttcagaaacaaaagtctctgaccaatctttccctcaccagtgatggggagaggagacccacggtgcgcatttccaactggtttggaaatgctgccaaggccagccagagagaagccaactatgcagagcggcgctcactgtccaagtttctctcgcggtctgtgcagtccctgtatcacaccagcagctcagcctggaacctcctgcctgctgggggcagccagtcagacagtgaagacttagaggaattgtctgcaagaagaggcttggaaggtgagagtgatgaagatagtaggtctgaagatgaaaacgtgtcctccaagccaagcagcatcagcagaagctgggctgaagaggagggagaaagctgtttgcgggaagggacagctcatctggatgaggaggtgatccttaccatgctgggtgatctagaacaggcactttacactgacttattaggtaagtccaatttgctcctaaaaacgtgtatgggatcttaagaaatttcatagtctcttatgaaattatttgcatttgccaaatagctttcatgtttttagactgatttttaaaaatacatagttacattttaaattcctgtttcttgaagtgatttttttttttaattttttggtaaaactgagctatgagcaccactggtaaggttcatttggagaaaataaattccggaaatctgccatgggcattattagcctcacctagtgtccagtaccttctagacatccataaataagttaacattttaaaactccaaacatgtttttcacctactcattaaaggggcctatttgttcaacttccctcaaggtgacctcatcacagataagggatgaataatgaagggcctcctgggtaaattttctgtagagttaagtttcttctgctgcctccgtgctacctgaatagaaggcttcttctatacctcagtgacaagccctttttattgtagtaacactttcagaaatacaggggccgctgctggcttctaccttttttcttttctcttttgtttcagtgtttgacaaaaactagttctgcatgtgcacattataagtatttaagctactatgtagatgactatgaactgttttcatactttagaaactaggcctttttgataacatgagtttcagtagtaacttctggcataatctttaactaaataagaagaggtcaagtgattctatagtttgtgactaaactttaaatgtcaactgtgccacctacctaaacagctaacatgtgaacattttaattgttatttctgaattcagtcttgtatcaaaatatatttacatcacacagtcccttcttccataagtattaaattcctggccatatcatattttatgtcaatgtgtatttccacaaagggcttcatattggcctccttaagttgaaaggaattaaacctgggaagtgatctctttgtttctgattcaagaaactaatgctaaatgcaggcttgcttttactcttaatgtagaccctcctgttacaagatgttttatgaggttttctggattcttttagtgaaccagttttagaagaagaaagcttatagagatagcagaggcaaatattgttcaatttttcatgtcagtttggttttagaagagtaatctttccacagttgtcagaatagtgatttctgaatctgaatacaccaggtgctccaacactgaagatttacttttgcaccattgtgtgatttctgtgatgaactgcttctcataaagggctatgtgcagcacaaaggcgagagaaagtcttaatctttatgaagctttttcttttttggatcctctgaaactgtagaatcagataatattcctcttttgcttttgaagtggtattatttatcttgttctcagtatctcttaagtatttacaaagatatgaacagagtgcagtcccctgacagcatttgatgcttactcagttaaattatagcatgctgtgggtgggtgtatatatgacatgtgcctttttgtgcataaataacttgaagcattttggtcagagggtaacctctcaaaagaagccggtatgccttggtttttcaagagcatctgcttattgtatttatatgattattctgtttaagtattttttttcctacttatgccagtattcaaaaatgcaagtgaaaaagtaaggggaagtttattcaaatagctgtgatatgaataatcatatctccagataatgaagcattctgatgcaattccctaaataatgatccatgttaagttgttgaatatatctacgcccacagcacacaggaattccagaatttctaccacgtgcttcaataggttctgtttacgactcaaaatggcctcttccaagttagtttttaggtggggttccttgaggttaattctttactcttagatatcctcctaaatcagacagattaaggtttgtcctataaccgtataggagcacattttaaaagtaactataaagcttttggccatattttgctatttttctccaaagtgtcaagattaaccagaggagtttaaaaattttcatccaaatcactactagggccatccacaaaactagagttacttcacacaataaatcaggaagctgtactctacataacatttgtaatatggatggggtagagggcataattctctgagaataagatttattcatacagatttgatttcctattgaaagatggcaatgctggcagtgttaattacaatgtgtataattaaagcctaaaaattaagagcaagatcacagattaaatggtctgtctgccaccaaatagtaacgtaggagtaccaaattgatgctgttattttttttttctctactaagaacaccttatgagcagtgagaaagcactttgcaccaatgttaaaaactctagtagatttcagaatataccattctggaagatgtgtggaagccattccattgtgtttgacacataggaagcctctttcaggaataatggttgactttgagattatgcaagcaggaggagacacaacattgctgtgattaaatgcatttctcacgtgcatttttctggtaacttgtattgttgctaaacatttaattttatttttgcttttatatttagactttgcaattgtgtttttcccccaaagcctctggacctcactcagatacaaatttataggatatttaagaccatgcaatcagtccttagggggtttgtaagtacatttagttttatcttgccttttgtgggtcattgaaaacatttactgcaataaattttctttggttattatctttcatgacatgaataaggcagcagttatgttttgctcaataagcgttggaaagaaaaggtccatttgtctgtcatgaggagggcagtgtcataagtgaatgtcatgatgaaaaaaacctaaggaatgagggaggctttggttctaaaacatgagagaaaccagataaacaatgaattcagttagaagaatccaaggatctaagatacctgttggattggaaaaaagaaattgaaaaggaaatgaagtagatgtgaaaatatatttagtgaaacagcatgtctgaaaatacaacgttcttaaaattaatatgaaaagatggaacataattgagatattaattttaatattccagttggcaaatgattgagatgcagctggattacaacttaaaagttttcctgggggaagggggaaagggataggaacatgtaatgatgcgttctaggaatctgtgtgaggtcaattacttgtacctcccccaccaagtaaaaaaaaggacatctcaatatactccttctttcatgactttttatctttcacctacaatctaagatgccaataactgtatgaaatctttcatattgaatcttaggtttagtgcttctccaattttgtccccttcactacttattttgacccagtttgaataaatttcttctttgtatgtctcttccttgtctgtaataattttatttccagtctgtaagattttctctacaaaacttctttttcttcatagttctctcagattatttggaagtgaaagatagaattctttatagccatctctgaaatactctatattatatgtatgaggagaagtatgggaagaatttccaggaagaatgtgatcagtctcaagggttattaacagttctgagttctaaaagaataatgttaatctataggattagtgattgtgtgaacttagtgtagagaaagtttgtcatgtgcatgagatcccaacaagtgttttattattctttaaaaatatttacttcaggaaagtttcttagtacgttatgtttgaaataatgatcttattattaagtatactttaattgttcaaatgatttgtaaattcaagggaagaaatttacaggctggcagcacaatggtggctgtttcgtcaaccacccaaagtgaggaataatgaacaaagtagtaatgtttgcctgaaaaatatagtaaaggaattagccgttgtgttgcaatatttgagtgactgccttggtaaagacagtgtaaatttgttcatttggtttcagatccactggaaccacagggtgaaagtttaagggagacaaatttttgcttatcccccataaatattttacattttgacctgctactggaaggagccatctcttactggtgaggtggaggcctttccaatgttggagttttcaggcagaggcagatggccttgtcccatgtgagacagatgaatgctatggccaagagataaggcaagacaatctctgaaatccaccaactgtatgattgtgatgataggtgttaaaggggcacatttgttatagatttttaaaaatctggcctgagtattaaggaagtaaattaacagattaaatagttagctatattcctaaaacagattatagatacgcatcttgacttccctatgtgacaattttcatagtgtaatttaatacatgctattttttgcttttctttttgttccctttctttttcttccatcctgtttccattccattcccttcccagccgtcccatctacttcctttttctctgtctcctctccttccctgtccctctcttaatctatccattccaattccctcctcctttctgttttcacttttattgaaagtgcccatcattagacatcctcttcagtccagattgaacagaataaaaactgtgcttccactactctcttttcatgttctttctattatctagactcactggctttagaaggtcactagcttggggaagtattgtatgactatcaacaaaatggcttaaggacacttctgcccccagttgataggtggtgattgtatcaggccagcgttagtcatacttgcagagctatttgtttcatgctcattagatacaaacattttgggtttagatgcctaggaatttacttgaactctagtatcattggtagaactgtagaaactggagaagtaattaaaaataaaaccattcaatgtttgtcagtctttgtccatgagtctaataaaagacttcaaaagctattgcttccataagaaaagacctcagccgggcatggtggctcacgcctgaaatcccagcactttgggaggccaaggcaggtggatcatttgaggtcaggagttcaagagcattatgaccaacatggtgaaaccccatctctactaaatacaaaaattagccgggcatggtggcgagggcctgatatcagctacttgagaggccgaagcaggggaatcgcttgaattccagaggtggagtttgcagtgatccaagatggtgccattgaactccagcctgagcaaaagagtgagactctgtctaaaaatgaaaatgaaataaaaaaataaaaggcctctagtttattccccagattccaaatgtgtcctttctacataaggcaaatttacctcaagtattctgagtacacccagaacaccttgaaataattaggatcctaatgatcatagtttttttttttattttactttaagttctgggatacatgtgcagaatgtgcaggtttgttacatagatgtatacatgctgtggtcgtttgctgcacccatcaacccgtcatctacattaggtatttcccctaatgctatccctccccttgatccccccacccaccaacaggccccggtgtgtgatgttccccttcctgtgtccatgtgttctcattgttcaactcccacttgtgagtgagaacatgtggtgttcagttttctgttcctgtgttagtttgcagagaatggtttctagtttcatccatgtccctgcaaaggacatgaactcatccatttttatggttgcatagtattccatggtgtatatgtgccacattttctttatgcagtctatcattgatgggcatttgggttggttccaagtctttgctattgtgaacagtgctgcaataaacatacgtgtgcatgtgtctttataatagaatgatttataatcctttggttgtatactcattaatgggattgctggatcaaatggtatttctggttctagatccttgaggaattgccacactgtcttccacagtggttgaactaatatatactcccaccgacagtgtaaaggcgttcctatttctccacaacctctctagcatctgttgtttcttgactttttaatgatcgccattctaaccggcgtgagatggtatctcattgtggttttgatttgcatttctctaatgaccagtggatgatgagctttctttcatatgtttgttggctgcataaaatgtcttcttttgagaggtgtctgttcatatacttcacccactttttgatggggttgtttttttcttgtaaatttgtttaagttccttgtagattctgaatattagccctttgtcagatggatagattgcaaaaattgtctcccattctgtaggttgcctgttcactctgatgatagtttcttttgctgtgcagaatttccttagtttaattagatcccatttgtcaactttggcttttgttgccattgcttttggtgttttactcatgaagtctttgcccatgcctatgtcctgaatggtattgcctaggttttcttctagggtttttatggttttaggtctttggtttaagtctttaatccatcttgagttaatttttgtgtaaagtgtaaggaagggatccagtttcagttatatgcatgtggctagccagttttcccagcaccatttgttaaatagggaatcctttccccattgcttgtgtgtgtcaggtttgtcaaagatcagatgattgtagatgtgtggtgttatttctgagggctctgttctgtttcattggtctatatatctgttttggtaccagtaccatgctgttttgattactatggccctggagtatactttgaagtcaggtagcatgatgcttccagctttgttctttttctttaggattatcttggctatacgggctcttttttggttccatatgaaatttaaagtagttttttctaactctatgaataaagtcaatggtagctttatggggatagcattgaatctctaaattactttgggcagtatgaccattttcatgatattgattcttcctatccatgagcatggaatgttttttcgtttgtttgtgtcctctcttatttcctggagcagtggtttgtagttctttttgaagaggtccttcacatacctttaagttgtattcctaagtattttattctctttgtagcaattgtgaatgggagtttattcatgatttggctctctgtttgtctgttattggtgtataggaatgcttgtgattttcgcatgttgattttgtatcctgagacgttgctaaattcgcttatcagcttaaggagtttttggctgagaagatggggttttctaaatataaaatcatgtcatctgcaaacagagacaatttgacttcctctcttcctatctaaatgcactttatttctttctcttgcctgattacccttgccaaaacttccaatactatgttgaataggagtggtgatggagggcacccttgtgttgtgcaggttttcaaagggaatgcttccagcttttgcccattcagtatgatattggctgtgtgtctgtcataaatagcccttatgattttgagatacattccataaatatctagtaattgagagttcttagcatgaaggggtgttgaattttatcgaaggccttttctgcatctattgagataatcatgtggtttttgcaattggttctctttatgtgatggattacatttattgatttgcatatgttgaaccagccttgtatcccagcaatgaacccaacttgatcgtggtggataagctttttttttgttgaggcagagtcttgctccatcacaccggctggagtgcaatggcacaatctcagctcactgcaacctccgcctcctaagtacaagcgattctcctgcctcagcctcccgagtagctggggctgcaggtgtgtgccaccatacccggctaattttgtatttttagtagagatggggtttcaccatgttggccaggattgtctcaaactcctgacctcgtgatctgcccacctcagcctcccaaagtgctgggattacaggcatgagccactgcacctggccagtggataagctttttgatgtgctgctggattcagtttgccagtatgtgattgtggatttttacatcgatgttcatcaggggtattggcctggaattttctttttctgttgtgtctttgccacgttttggtatcaggatgatgctggcctcataaaatgagttagggaggtgtccctctttttctattgattggaatagtctcagaaggaatggtaccagctcctcttcgtagttctgttagaattcgactgtgaatctgtctggtcctgggcatttttttggttggtaggctattaattactgcctcaatttcagaacttgttattggtctattcagggattcgacttcttcctggtttagtcttgggagggtgtatgtgtccaggaatttatccatttcttctagattttctagtttatttgcatagtagtgtttatagtattttttgacgatagtttgtatttctgtgggatcagtggtgatatcccctttatcattttttattacatctatttgattcttctctattttcttctttattagtctggctagcagtctatctattttgttaatcttttcaaaaaccagctatggatttattgattttttgaagggtttttgtgtctctatctccttcagttctgctctgatcttagttatttcttgccttctgctagcttttgaatttgtttgctcttgcttctctagttcttttaattgtgatgttaaggtgttgatctttagatatttcctgctttcttctgtgggcatttagtgctatgaatttccctctaaacacagctttagctgtgtcccagacattctggtatgtagtttctttattctcattggtttcaaataacttattgatttctgccttaatttccttatttaccccgtggtcattcaggagcaggttgttcagtttctatgtagttgtgaagttttaagtcagtttcttaaccctaagttctaatttgattgcactctggtctgagagactatttgttaggatttccattcttttgcatttgctgaggagtgttttacttccaattatgtgatcagttttagaataagtgtgatgtggttctgagaagaatgtatattctgtttatttggggtggagagttctgtagatgtctattaggtccacttggtccagagttgagttcaagtcctgaatatctttgttaattttctgtctcattgatctgtctcatactgacagtggggtgttaaagtctcccactattattgtgtgggagtccaagtctctttgtaggtctctaagaacttgctttatgaatctgggtgcttctgttttgggtgcatatatatttaggatagttagcttttcttgttgcattgatccccttaccattatgcaatgtccttctttgtctttttttatatttgctggtttaaagtctgttttatcagagtctagaattgtaacccctgcttttatttgctttccatttgcttggtaaatattcctccatccctttattttgagcctatgtgagtctttgcacgtgaagcttatgaagcttagtttggctggatatgaaattctgggttgaaaatcctctgctttaagaatgttgaggccaggtgcggtggctcacgcttgtaatcccagcactttgagaggccgaggcaggcggatcatgaggtcaggagatcgagaccatcctggctaacacggtgaaaccccatctctactaaaaatacaaaaaattagccaggcctggcaacgggtgcctgtagtcccagctactcaggaggctgaggcaggagaatggtgtgaacccgggaggcggagcttgcagtgagccaagattgtgccactgcactccagcctgggtgacagagcaagactctgtctcaagcaaaacaaaacaaaacaaaacaaaaaaatgaacgttgaatattggccctcactccctctggcttttagggtttctgcagagagatccactgttagtctgatgggcttccctttgtgggtaatcagcctttctctctggctgcccttaacattttttcctgcatttcaactttggtgaatctgacaattacgtgtcttggggttgctcttctcaaagagtatctttgtggtggtccctgtatttcctgaatttgaatgttggcctgtcttgctaggctgggcaagttctcctggataatatcctgaagagtgttttccaacttggttccattctttctgtcactttcaggtataccagtcaaacctaggtttggtcttttcacatagtcccatatttcttggaggctttgtttgttccttttcattcttttttctctaatcttgtctttatgctttatttcagtaagttcatcttcaatctcggatatccttccttcccctctatctatttggctatttctacttatgtatgcttcacgaagaatttcgtgctatgtttttcagctccatcaggtcatttgtgttcttctccactaaactggttattctagttaataattcctctaaccttttttcaaggttcttagcttcctttcattgggttagaacgttctcctttagcttggaggagtttgttattacccaccttctaaagtctacttctgtaaattcgtcaaactcatactctgtccagttctgttcccttgctggtgaagagttgtgatcctttggaggagaagaggcattctggtttttggaattttcagcctttttgcactgttttttttctcatctttgtggacttacctacctttggtctctgatgtttgtgaccttcaaacggggtttttgtgtggatgtcttttttgtggacattgatgctattcctttttgtttgttagttttccttttaacagtcaggcccctctgctgcaggtcttctggagtttgctggaggttcactccagatcctatttgcctgggtgtcaccagcaaaggctgcagaacagcaaagattgctgcctcttccttcctctggaagcttcatcccagaggggcacttgccagatgcctgctagagctctcctgtatgaggagtctatcaacacctgctgggaggtgtctcctcgtcaggaggcacgggggtcagggacccacttgaggaggctgtctgtcccttagcggagctagaacactgtgctcggagatccgctgctctcttcagagctggcaggcaagagtgttttagtctgctgagcctgcgcccacagccgccccttcccccaggtgctctgtcccagggagatgagagttttatctgtaagcccctgactggggctgctacctttctttcagatatgccccgcccagagaggaggaatctagagaggcagtctggctacagcagctttgccaagctgcagtgggctctgcccagtccaaaattcccagcgggtttgtttacattgtgaggggaaaagcacctactcaagcctcagttatggcagttgcccctccccccaccaagctccagggtcccaggtgtccttcagactgctgtgctggcaatgagaatttcaagccagtggatcttagcttgctgggctccacaggggtgggatccactgagctagaccacttagctccctggcttcagccccctttccaggtgagtggatggttctgtctcactggcattccaggtgctactggggtatgaaaaaaaaaactcctgcagctagcttggtgtctgcccagttttgtgcttgaaactcaggcccttggtggtgtggacacccaatggaatctcctggtgtgcatgttgtgaagactgtgggaaaagcatagtatctgggctggatagctccgtccttcaaggcacagtccctcatgacttcccttggctaggggagggagttccccaaccctttgcacttcccaggtgaggcaacaccccaccctgcttctgctcaccctctgtgggctgcacccactgtctaatcagtcactgtgagatgagcctggtacctcagttggaaatgcagaaatcacctgccttctgtgttgatctcactgggagcagcagactggagctgttcctattcagccatctttctcaggtcataatcatagatttttaattgatcccagcaacatggattagtaaacagcatatttccaagtgatttttttttattttaaggtcaaatctacaaaatattatagtgttatcaccacttaaaattattactggtgatactatgtttgtctctattcacattttattgctagaaagaattataatttgtagataataatagttatttgaaatgtattacatatccttttacttttaagaagaggtgacttaattatctaggtatacaattattttgaggatactaaatgtcatgaatagcaaatttatcatattgctttcctaggtgaagaccctgaaacaagaagaatgagaacagttaaaaacatagcagacttgaggcagaatttagaagagactatgtccagtcttcgtgggactcagataagccacaggtttttttcaattttgcatatatttgagccaataaagaaaaaataattacaaacaaacatttaacttttcttataatgacagagatgggatttcagtttccccttactattttctcccttgttttatatcaaattgattggtaattatccttaaactgagaattcacagtatatacctatttatcttttatctctatctctatctgctatttatgtctttttcagtataatttccagtactgcaactaccaccatcactgttaagtggatttgtaatacctgtcctagaaaacagtggcacaagttgcacttgaaatgcatctgggcagggtagtagggagacattcaaacataattgtagttaactttcagaataggtctgggaaggttacagtgagttaaggatttgttgaaaatgtaaaacaatatgttgttttacccaaggtgtactgatggcctttcttttgaaaacaaacgaaaagctataaaatgtatgcccctttccacaatttgacctcaaaatgaatatagagtttagctttcgggaagatgacgtgtttataagagatgaccctcaactccagccttttctgtcttcatgcattctagattatggccctaagtgaaccagagtatagttatttctccattttatttgacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtaagtaaccctgttctccgtcagcattgtgtgaagaggggaggtggtctactataatgcattcactataaacaaatgtgtaagtttgcccagaaagtcatgagaacatatgagatatctgaggttattcagagtgttgaagggcccttcctctgctcattcatggagagtaaagaatccaagatttctataaattcattataagccgctaagtttttctgttgttgagagaaacacatgtggcttctgtttttcagagtgattttcacatgcttcttaagtaacagattttgtagttaaggacgtgggaaggagacaggaggagttttgctgatttgcttgattttttttttcttttttagcttgttagaagctgcctgtaactgctttgagaaacaaatattttcttactgtcttcaattatgcatccccaatttaacttgagggaaaaatcactttggagttgaaagtttcactctattcattttcttttgatggtatcagatttcaatacatctcagaccctgtttttcttctgtgtcctattacattccaaaacatgttgtgattgtaaaactcttagagtatattaacaatttgggatatttggcataatcagagaataggtccaaaaggaggcaataggatattctattaataattgtaattgccatttttagcatttcctgttatgtactatgctcttgtcaagtgctttgaagatattgttttacttttccttcccaccaccagcaatgtttatgaggtagatgtttttatacatgttctatggataaggaaactgagtctaattggccccggctgggaactaacgctagggaaacggcagacctgcattagaactcagctatgtctgacttcaaacacaggctcagtaatatgtggaaaagcttcccaattaactttgtctataaactttgtgtgagtctggattttgacttactctttgtctttacgcatctgagaggacccatgtaggaaataattcttctatataagtgacccttcctgacttcattcatgaaaagcttatgtttgaagggtgacacgacctaaaaaagagtacaaaatagcttttgattacatttatagctttgctctgatatcccaatacctactagtccattcctggtatccaccctacctgactttctaaaaatttagaattatagagactaattatgattaattaagataggttgttgttcagttgccactggattcagagtgcctagtttgaatctctcccattcactatctgtggaccccttcggaacctaacgtatccaaattagtttttgtcatctagaataaggataaaattgtaccatcttcatgaagttgttaggatcatccacaaattttagtttgcgcaatgcttggcatgatacaagcactcaataaatttatcatcttcctctttatcatcactattacatttattatcattaataaccataccaatttttggttgttgttagttataattatcatttttgtatgtatttaacatagcctaggaggcaatgcccagttcagaaaacataatggcaaagcaagagtgtctaaggcacactctttctcccatctctctcttctttcttctccattctttccactctatcccctcttctcttttttttctcaatctccttagatgtggacatatgtgtgaattcaattttataatcactattcaaatatatttatatggctaattatatacataagtatacccatataatatatataaagatatatataccaaggctgggcacggtggctcatgcctgtaatcccagcactttgggaagccaaggcagatggatcgcctgaggtcaggagttcaagaccagcctgcccaacatggcaaaaacccatctctactaaaaaagttagccaggcatggtggcttgtgcctgtattcccagctacttgggaggctgaggcaggagaaccacctgaaaccgggaggcagaagttgcagtgagctgagattgcaccactgcaccactccagcctgggtgacagagtgagactccgtctaaaaatatatatatatataatatatatatgtatgtatgtatgtatatgtatgtgtatgtatgtatatatacctatgtgcactcaatatcattattcatggtacttctcttctatgaagtcaccacaaacactgcattagtgaatcctgaactattgcccctagtagagatataggttttggttcctgtgagcatttggccacaatatttttgtcaactgatcaatacataaacttgctttacgtaagtctctctttaaagacaccttatttaatacatactattgattcattcacgtggaactcccagccaacagcactataactaaggccggaatgaagcttatctagtgcatattttctctgtgagatgcattgaagactgcttgcaattaggaacataatatgacacttcagcaccaagtttgggggccactttaaacagcacaattctcagcataaaaacacaaaaaatgtggaaaacatggcactaaataggccatagaagaacatttgttgtgatattagagctgatacaagaacacagagtatcactttatttagccttagctggaaacgtctgagactcattttttttcacggttctgttcatatccatgaatggctgtgaaagtgctacgagtttagattttgtggctacatataaattttagcaagtaggcaacttcacgaatatagaatttgtgaataatgatgattgacaatatatactcacactcatgtagaatgtttatctgtagagtgacagcatatcttgggagcagtttgaataagaaatcaagggacatctacagtgcaatatgttgggaatttcaaaaggcttatagggataaaaattgagctaagagttcagaatgaggagaaagtactaaaccctcacatgaaatagaaagcagtgaataagaaaaagaaacattttagttattttttctgatttaagagctatagacaaaggaaatatatttaaaatacatatataagaaaagtacaaacatagaaggtataaattattcagtaaacttgcataaaatgtaattttcagaatcaaagggacagtggattagatgatattgatgatttttctcttaactgagagtcatggaacatgaatatttaaagataatgtcttagagataggcactattttgacagaccttaacatcattatgctaagaagtttaaactacattataagctatgtaaaatactatatcttagagattactaaacagtcatagaacatggcatgaggatggtgatggcttttgaaggccactttatgggaaggaaatatgcaaagtgaattcaggggagaaactcgggggttcaatttcaggaactagtgcaagagctctggctcaagctcataagattagaaatatggtagtggcatttgtagggataaaattaggaaagtaattgatatgggaagcactgcaaaggaaaagtttatagaaccagagatggactacccatgaaggcataaggcagacaagaattaagatacctacatcataagcacaggagatggaaaatagtaccgttagagaaaatcggcagagagagaaagagagagagcgagagagagaggattttttgatgagaaagcagagagagagatgatgaatttagagttagagatgtagagctggagacggtgagatatgaagattgtttgtccaggatagagatctattgtatttcatctcaataaaagagagcaggaattgtgggaggcattaaggctcctgggaaaagaatatggaaagaacagggatcataaactgaattatgtatatatgtatgtatacatgtatatgtctattaaaaatatttatcgagttcatcctatgtgtcaagcaacattccaggcactgtgcattcagtagtgaataatatagacatagtacgtgcccacatgtgactcacatgatggtgttttcatatttttgtagcagtccagttattcagtaaattaattgtaatatgcacacatatgtgtatatatacatatatatgcacacatatgtgtatatatacatatatatacacacagagaagtattcttaaacagatagttgttttaaacgttttttaacaactgaattctgcatataataatatatgttacaggcatattgtactcaggagcactttatattttgcaagaatacatgcaatatatgcaagaatacatgcataatatgttaactatattagttaacattgatttcgaaaacagagaaatctcaaaatctcagtaacttaacacaaagaagctaatttgttcttcacataaaaccctcgctgatgtttctgatcttcacctggggaatgcactccatgtagtcattcagagaataagatggatggtaattctgttgttacccagccagatttccagtgttaccctaggcattgatattcaacaggcaaatggcaaaagaggggaagacccagggtgtgagaagattttgtatgtatcaggcctggaagtcatgcatatgagttctgcctgcattcatttgtctagaacagctgcatgaccacatctgactgtaaaagagactaggttatatggttcagctgtgtgcccaggaggagagggaaattggtttgatgacatctggctagtctctgctgaactcactaattttttaaaaaatgctgttatagactttgtccttcttatttgtttctgcttcatttaaaacatgattcagacttcttgtttcctctatttttgttccctaacatctttcaaaaaagtcttggatagtctcacaaatgagtccatttaaatatgcattgatggtctacatgtcttatgttgacaagtaaaaatacctcaaatcctacatgaaacttcccctgtttactcacatacatttgttctttcctatgttagagtacaagacactgaaatttaagtcatgactcagttctcttacctgtgcggaagatgctaagatctgatcagcagatgatgaggctggtcttagctcaaggatgattgtgcgaggatacccaggatgtgctggacttattgctcatcagcttatgcagtgtgcccttgttggcttacgtaggaggcagccccaaaatctcagcctagaattaaaacgtgagaagacaagagggctggagatacccaggaaaagtttaatttgatggtgtttctttaagaaaagggggcttagaagtatttatgctggccgggtatggtggctcatgcctgtaatcccagcactttgggaggctgaggcagatagatcaccttaagtcaggagttcgagaccatcttggccaacatggtgaaacctcatctctactaaaaatacaaaaattagctgggcatggtggtgcacaccagtaatctcagctacttggtaagctgaggcaggagaattgcttgaacccaggaagcagaggttgcagtgagccgagatctcaccactgcaccccagcctgggtaacggagtgagactctatctcaaaaaaaacgtatttatgctacgagtcatgaaaaagttgaatcataaatttaactctcttttcaaaatgtttaaaaatatgttttaaagattaaaggaacaaaaggctcaataaggtagtaatgaatgaagatgtttaatttaggattttctcatgtaaccacgaagaacgtcatgaagtcatttaaatgggaataaagtttcatttttttccatgtactctaggtgtaactcagaaagttagttaatcagcattctgagaattcaaaatttcttgaagcatgcgaaggcttatctctttctcctctttttgaatttactttaaacactgggggatatgaatctgtcagtaattaggaattagtcagagaaaggcctcttactcataatgaacctctttgaaaagtctctatttatgaagttaaaaacaccctggaaaattgggataaaagttacatattttaattgagtggaaattgaagttatcttcaggtgtcacagtaataaatagttgggccaagaatataacctaaaattctactttaagtcacgtgaccaaacacaaactaatctaagaattctgtggagtaaaaattaaaaataaggcacagaagtgaggggtagatatactttaatcctgcttctgccttgatcctccctcaattctcatttagtaaactttgtgatgactgaagtatgcataacagtgtgcaaaaggtcagagttacttgagctgtgttaaaaagatccatcttttgcaccacagattcctaatcttaatgcttcctctaatttcactttcaggatatgagctattttagtgactctagaaactctaatgcataaaatagctagtatttttaaagatagtatttatatgtcacttacaatgtgctagacaatgctgtatgcatgttatatatatattaactcactggtagctcaccatcactgcaagaagtgagcatatcattgctgtttccattttacagatgaagcaatttaaacatagcttgtttaagtgacttacctcagcccacacagctagtaagtagcagcactgtagttgaacctaagcagtctggctctggtctacactcaaccatccttacacactgaccttaggaaactgtctgcatgtctacatgtaagggtttctctcctaggtgcctgatttttttccaaacaatcatttaaaaaaggttcacagcaatcatttgttatcagcatggattttgtagctagcacatttaatgtaaggggcatttttaaatgttatctatgccactctaaaggaagatgctgaactggagtttctttaagggagtggtgaggatcactttagattctctgtgtgtgcatgcaattacaaattaactaattgtgacagatagcagctgatatgagatattaaatataaaaacatagaattctaggaagatggctctattagtgtgttctcactctgctaataaagacatatttgagactgggtgatttataagggaaagaggtttaattgactcacagtttcacatggctggggaggcttcacaatcatagtggaaagtcaagggacatattacatggcacaccgcaggcaagagagcttgtgcaagggaactcccatttataaaaccatcagatctcgtcagacttactaccaggagaacaatatggggaaaactatccccgttattcagttatctctatctgccccctcccttgacacatggggattattacaattcagggtgagagttgggtggggacacagctagttgtgacagtgcagtgacagcagctgatatgaggtattaaatataaaaacatagaattctaggaagatggcagatatggtggaagtttaggttttgatccattactcctatgacctcttcaaaaacagtatttcaaaaatgaaattttctttcttttaatttcttaagagttatattatctgcaagcctattcataatattaataacaaaagggaaaaataggttctatggtaggctagttacttgtcgcagtaactactactaggaaatattgatacaaatactaggaaatattgatttcctagtaaacttgaaaaaatattttaattatccctggtgagtagaatgtttatacagaataaaaaacaagataatagaatatatttgagtaattattgaaaattgtggacaccgtttgtttattaagttaaattgtacagttgagttgatttagttttctgtgaattaattagacatttcttttcaggtacatgacagatggaggacttaacctatatactagaagtctgaaccgaataccagacacagcaacttcccgggacatcatccagagaggggttcacgatgtgacagtggatgcagacaggtaatgctatcagcatatatgatggtgagacatgcatgaagtaattttataaataagaaaataacagaaaactcctattaaacagtgtaaatcaaaggactttttattttgataaataattattttattttgataaataattatttagggtttttttgtttgtttgtttgttttcgttttttttgtgtgtgtgagacagagtcttgctctgtcaccaggctggagtgcaatggtgcaatctcagctcactgcaacctctgcctcctgggttcaagtgattctcctgcctcagcctcctgagtagctgggactccaggcacgcaccaccatgcccagctaatttttgtatttttagtagagatggagttttaccatgttggtcaggatggtctccatctcttgaccttgtgatccacccgcctcggcctcccaaagtactgggattacaggcatgagcctctacgccccgcctatttggggatatttttaaaactaggatgattttctttacaaggccattttagctctgtaataccaaaaataaatgtatggctggggagatttttttttaatttcaggtaacatagttgcaaatgttaatatctataaaagcagaattataaacatagacttattttccttgttagaaagaaactctggttaataagtttcattcagttcagatatcctcagatttacctggaagctaatgatataaagattaaaatatatttcaaatcatctagtataataagcttgatgctttccttgaaggtgttgtaaacatagaaaaactcttactttaggcttatttttgcttctttattgcctcaaatttcttaaagatgtgtgtgtgtgtgtgtgtgtctgtgtgtgtgtgatgaactaattattttgctggaaattgctctgctgatttatcagaatcatcactgtttaagaacattgctttggtaagataatgttgtaatatacatttctggcctgattttgctccctcttcactcagaattttgactttgttgagcaggaagggattgcatattttcagaattattatatctaaatacctagagtagttgtttaattcagcatttatgaaaaagacaaaaggttaaggtgcaatgtactcacattctgaaataggaactgtatacaattcattgtgcatttttgtacagtcaactccaaaggctagatacccagggaattctaatattagtcttcagtttctccttacccacaggctgttgatatcctgactcatagtggttagaacagtctcagctcccaccctgtctgtatcctactctcctagcctatatactcttgtgtgtgggtgtgggtgtgaagcatgtgtatgtgtgtgtgtgaagcatctccccacctgtaatgtaagtccatgagtgcagaatttttgtcatattctttacgtgttgagttttaacaaatgtttgtggagtgaatgaacaaattaatgaatataggctatttattaattaggcaatatagtcacataggctggcaatcgcatctaattaaatagagtggtaaatgagttccagaaagaactaaggtactacaaggatgttatgaaagagaaaaatgagttatgtgaaaaataggagacagtgataagagggaaagaatcccaaagtgtgggccacattttgaaactaatgacctattattctattattgttagctgaaagtagaaaacgtcatgggagggaatatctgctagtttttggtaaaggatgttgtgatggcagaaccaagaaatgaacacaaggtgactttggtttggggacagtgggataatcaactctccttgctccatcagggccccagactgggctctggcagaggaactcagaacaacgtaaagacctagataggtatctaataaattgggacctgtgaaaacagtgcctcttaaagtgtggtacctggaccagcagcagcagcagcagcagccattgaaacttcatagaaagacagattctcagcttcatccaagacttactgaattagaatatctcaaggtaaggcctggtaatctgagctttaactagccctcaaggtgattcttaagttcaagcatcactatattaagttgaacaaatagatgccaggcctataaatacatgtaacgcctagcataaatatttcaacattaaaaatgacatttcatagttcttatttaccctattagctgtgttctgtcaagataatgagaatattgatatgttagaatacactgatggcactaatttttaaattagatcaaataatgacttgttatacctgaaataaattggttcagcttggtagatgcagtttttgagaattatataagtcatttttaaaagaataattttaacttgagctgcttgcataaattaaattgcaaaaaggtcatagtataaatcctcctattagcagagatagaaggtttttaaaaaaattacagataagtctgaaggtcttttaaaatcttatattcaggaagtgactcgggatgtatatcattttaaaatacatggtcttaaatgttgtagttgtatgactctttcagttaatttaaaatacttccttctatgaaaaattgtttcaaaaatttttctaaattctgttatccatttcaagtaggataggcaagaacagatataagatactacttttttgttcatgtttactaaaaaaaaaattactgtaattgagatcatgtaaaaacatgtttcctgtctatttgtcttaaccttttaatcctggcaccttaaatttgacatagtaggaattagaagacaattgcagaaaatgtcaactggggaaattttattctactaaaaactatgtccatacaacatagcaaatcacattttaaaggccaaaaagtctttcatagcaatttttcagattattttcaaagcatatcttctctctgctcctgcagcatgccgttgatttttctgttatgcagtcacataagtaattacatgtttacatgtctatttcactcatagaacacgaaacagttaaatgtagaataatatccaatccatctttttatcaccagtagctagcatactgtaggaactcaataaatatatcagataaattgtggaaataaccatatcagcttataacatatagaaatgtgagtttaaaaagaaaacaattatacatatgaaaaaatttttataccatttttttaaagacctttcagatgtcatacagtttggacttttccagtgtttcttgtatcatgagacaatagtagacattgtaaatcaaaaatagttttctggggttgtgtacatttgaaaaaactgaatatcatatctgttcttagagagtaatgatggatattaacatatcaaaggtacagagaagtcttaaagttcaaagtaacatctgcttaattgtatttaattcagtgctccatgagcttttttatcactgattccctcccttttttctcttatgataataattaacttgttcctgtagcattttaagaaatgttgatttagttgaatgccttcacttctccaatataatagcagaaactcagaaatatttatttacccagaatcatgcagctaatagtacaaggattcaggtcttttacttcctattttgtggttcccaactacttttgccaaaggtcttttaaataatatgaaacatattagtgattgattcattatagtaaatgggtaaatgataaggcttgcaataattcactgacaagaaagcttaaaagtcaaaagaaaaaaaaatccacagcatttttttttcttagttattctttctaaaagctgtgtaagtgcaaaagcagagtcatagcacaatggcagccagccagctacctagcatagcaatggacttgaattgtttgtattgttatagtgaaggctatagtttccctttgatcaacttctggttaaaatgtgatggacattagagaacaactgaattcctcttaccagcacattaaaaaggccccaaaggaaaaatgaggactttcagcagccatctgtagtatattttaaatattttattgcttaaagatattgcagttcatttactttccatatcaatccaacaccaaccccatttctgtatttacttgactaaaaaaaagattgcagaatgggtataatccttgcagatatgttggagactctccagcaacttcacagatacatttatagctggcagttaaatatgtgggttttatacattgtgttgggctatgtttaaagggtacatttttggggactgcaggatgattgtggttttgacctttattaactcctattattgttcttactctagattctatgctaacaatcacaaatattttataaacaaatatatgattacttcctaagtgcctgtcatcatagtagcaccttgggtaaaaataaaacaaaacagtatgggtgaaagttcctcagtttaatggtaagagagagtaatgtaaacaaaggcccctcttaatagatgtctatacaatgtgccttagaagcaccaaagagaaacagttactcctacctgggagtataaaggaaagacttcaaaacacagtagcatttaagcagggtcttaaagaaagcatacaactttttgacatccagcctgggagaaatcagaaggaatgtggggagtgagagcataaaggcatagaagagtttggtgtgaggaaccagtaatgggattctgaagtgcactgggaatgtggacaaggagacgagagacaaaggacctgggggccatactagggtgtttggacctataggtgataaggagctattttactaagtttaattagttttatttcatttcaaggcaaaagcacatgctataatcattgtattttaaaaggaactctcatagcaatgtaagaacattgaagagggatgagataaagacaggtagagtgcttagaaagtgactaaaataaattagatgagcacctaactaaagaatggcagtggggaagggggctggggacaccatctatttctagaggaacttgggttttgtctatgtgtatgataatccttggctgtcataactaaataccacagactgagtggcttaaacaatagacatttagtttttcacagttctggaggctagaagtttatgatcaaggtgtcagcaaatttgttttttgatgagaactcttcctgacttccagagagtgggtttcatgctgtattctcacatggcctttcctctgtgctcctggagacatctatctatctgtgtctgtctgtctgtctgtctgtctgtctgtctgcctgcctgcctgcctgcctgcctgcctgcctgcctgtctgtctatatagagagaggtctttggtgtccctctctcttcttataagggcaccagtgctattagattaggattccacccttatgtattaatttaacctgaattacctctgtaaaagtcctgtttccaaatacagtcacattgcaggttaaaaattcatataaattagggggtggagacataattcaattcataaccctgtgtaactcccaggtggatatgtccttggggatataaggtcagtcactatatatgtgctggattaaagtattagtatgtataataatcatatatataatctagatcatatatacgagtgtatacaaaattagctcgtatacaagctctagattgtatatatgcatatttatattgtaaattgctgcctttggaaatgcgtaaatgtggaaaagagagccagggattgccaaaccatttgattttgtttttcaagtgaagccaagagtctggactcttatgagaagtttcccaatttttaagtattagaactctcctaacagatacgtaagatcaatagatacagttaaagacaaaaaactttcttcagtgggagaaaaatctagaaattcacagacatggttatataaagcaggagagagtgaagattgcactcatggtcctgtaactgtcctagttccttgaagtttctcaccgagatagagctggtgatgataccacctgtgcagagtgaaaattccaccagtcatgagaagcctgcccagcaggtgaggtaactgtggcaaaactatctgagctctttttggagattttaatgcaagacagcacaaatctaaagtcagcttcccagccatagcatcactcagtagagctggcctcctgcctgcctgaggccgattatgacagtaatgaattaaattttgtttaaaccactctgtgactctgcactgtgcaagctaggaacatttgtatctcaaatgtacagtaagaaaacaagccctgagaatgaattcttagcattgaaagagtgaataaaggaagaacaaccattggagagacagagaaatcagctttaacacaaagatcaaaggacaaccagggttagctgatattttttgaaatggagagaagaggaaatatgcaatactatacaattccatggataagtgatgtttgacaactggcaactagtttcttatcagtggctttatcaaagttagtttcaatgaaatactgaaggagcatgctaggttatgaaaaggtgaagaagttaggaggttgaaacaataaagggagatcttcaggaaagttgcagggaaggtaaggagaaagatcagatagaagtcaacaaaagggacaggatgaagattattgctgatttgctctgttttgttttggggagaaaggaatttgatctggtacagagagtgaattcctagacaaaataaggtgataagtcttaaggaagatagaagaatctgggaaaagattactagaactgctgtagatttaacatttatctcctttccacaattcatgtgttaaaacctagtcccccttgtgatgatatttggaggtaaggtctttgggaagtgattggatcacaagagtggagctctcatgaatgctattagtgtccttagaaaagaaatcactagcaagtgccccttagcctctcctgccatatgaggttacatcaaaaagtcagctgcctatgaaccagcaatcaggccctcttcagacacaaatctgctggcaccttgataaaggcttctgaaaacattaccttgaagtccctgagcatgtttaatgaaaggaaggggatcaaagaggttgattagaaggtttttaccacaaaataaaataaaataataataaatttcacatttgagaggtagagatttactgactggttgaacaaattgcaagctataacctgggttactgaagtagaatgataatagaagtcaaaattaggttacgtagatgattcatccaggtagctattcagtcaatatgatggcaaaatgaatctcaaaggagagaaaggcaaagctccagataccatatattatattgaatatgaacaaaattctacaacttgtggtaacaaagatacctttcaagctatattttgggttgtctgtcacattgttatctaaactatattcctaaatatagtgattgctaattttaattataaactaatcaatataacttcacatttatactattttcatatataatcatgcttttattgaaagtataaaagcataatacatcatagaaattatttttgtattgtactacttgatggattgttttgatttgtgaaactataatccagatgctgaaatcacagtttccaaaaggcattaaagattgtcatgtttttatgtgactctgaggttgccattgtaactcatcatatattgaagcaggcctaagttcaaatctaaatacatagttaacactaaatatctaagtctgcaattgttagcaatgtgcagaaaattacattgccatgacaaagggcaccatgccagttctcatgaaatcatgggggcatcagttataagggtgggagacctttatgatttccaagccttttccaactaggaaaagtaaaggcaacagagatttttcctaagccgccaagcaaatatctctgggatcaggttcatgatgcttgtcactagtgtgtgtaaactaatcattcattttatccatgttgatttgttccagtacaatcacagaattagtatactcccatgtcttaactatttccttcattagcttactggctctccatagtaattaaaagcaaacacaataaagattaacaggctgagatggaaagagacaaagtaaatataattacttcattttataatcagatggcctgccttttctgcccacatttctttactctaagagaccaatgcaaaataatagggacgtggaaaaactgttattgatgccctctcaaattccctttgccattctgctcatgattgcaagaatatgaacaggttctggacttctcttcaaatcttaaaattaactgtgcccattgtgaataacctcagaggcttccagtacttttttataatgccccttaggaaattaattcataccacatccacatgttgagaacctactctctgccaatcactgtgctcaatcctgggctttttattcaagagtcttatattagaagagcattagaatagggattgttaaacctcaattgccattgaaattcaaaagatccttcaacactacaactggcccaagttgtagattgtagctctaaatgctattttttcataagactcaccttgacattaaacttgatcaatttttaactttaccattatagaatgattctcccaatacaagagatggttcccaggactcttattgatgtataatttttatcttatctgcttataatagaatttactaatgaatcttatgaggatggtaaacatattgagaagaagaaaagaggaagaagaaaaggaggaaaggaggagaaaagaggaggaggaagaggaggaatgaggaggaaaaggaggagaacgaagaggaggaagagtagtcaaatttgttataataacaatagctataatagacataagtattgaggacctagtgtgtgtagctaacataccatattacttaaatatattattttactttatctttacaatagccctataaagtaggttttattactaccattgaggcaaataattcttacatcaagtagcttacccatagatactttcttaataaataataattgcagaatttgaatttagatcttatgttttaagtattattcataaaattattaatttagataaaggtttttatcatgcctggatgaaatattttgacttcataaattatttaatttttccattttgacctaaacatatctatactataaatagtttttttaaaattcagcttcaaaaaagttggtaaattaattcaatgtataatggtatctatttccattgcagattgtcaatagatcttaaaacacaggtgacagaacagtcatttcacatgtgtgagagcgtctaaaaagctagttagcttgctgatatcaataaagcaatttaacagtgttttgttcttttatatatattatatataatatataattatatataattacatatatataatttataatacatatattttatatataatggatgtaatatatataaatctgtcattatcttgaaatctaattattactgaaatatctatttctaacaggctcaggaaatagaaaaatggaagagggagaaatatgtttggctcataaaatgaaaaatactaaaagagcacttatatgagggaaaaaggaattttggtccttttatattacatgatattacttttcatgatgagagatatcctagctaattaaatggttaattttatttaagaagttatatctatacatgaaacacttcgttattttgccttcaagaactaggcatgaattcttttttttttttaataggctaactaatgggttcagattttcaatttgggatcattaaattgaaggcattttggccggcagctgataaattctgcatcttcctcactccggctgcatagagtgggtggcatggacttatttattagaggcatatgggttccatttatatttttttcttgcttgacttaatttgcattttaaatagttaaagttatttgcaataagcttggttttttttaaagccttaccagagctcccatatgtttttttaggataagttgtaaatgacagtgttttcattataaaattattttctaaactaaatcgttttttattacaaaacttttctaggtttattaatgaaaattcacagagtatacaaaagtgtgaagaagaatctaaaaagaatctgtaatcctctcatcccaaagacaaccaagaatattgcattaagatatttccttctaggcttctttaccctttctatttacatagtttggttacatcatatatatagtatagtaccctgctttcttcactgtatttatataataaataatactgtgtaatattagatattatttttgaatatgatttttaatgattgcatgtccttctgttatgtggaataaattacatatctaaagagctagtgcaataaaccattaaatttaaggtattcatcacatttctgatttatatgcagaacaattagcagaatcctatctgatctggttgtatgactatattcatgaatttgttttctaaaaagatcaaattttgaacttactaggagatgcctcacatatcgtgtgtgtatgttagtgtgggtatatgtgtatgtatatatatacatacacatttggtatttttctatacttgtttgatgagataaagatttacaatttttagatttttaatttcaagtatgtatttgtaaactatcaggaattatagtttgttgcaattatgaaatattttgtcagttaggttttcctgctgacaagatagatgataaaacctttttactgaaactatgcttctttatgaaacttaattaaatatccaggagttccttactttttacagaacaaaactctatcatttgtttctctaagagtatattttactctaacgtcagacacgttggactagccacatctacctgactgttcaaatatttgctaggtaaaaataaaattatttataataatagttcccttcttgaatatttggttggtgccacatatattgctgagtacttcacatgtgcgaattaatttaattcccataacaaccttctaggtttgatactataatcaatgcctttttgcaaatgaggcatgcaatgcacaagagactgaaaaactttctcaaggttacaccactagtaaatgccagatgctgggatttatactcaggtgaagttttttttttttttttaaagtgcataagaataatgacgtcaataatattttaattattttgaaattgtttccagcttcactcttgatcacaagctagtgactagaacaggttaatcatagtgaaaactaatagatatgctgtttaaatttcttttttttattattatactttaagttttagggtacatgtgcacattgtgcaggttagttacatatgtatacatgtgccatgctggtgcgctgcacccactaactagtcatctagcattaggtatatctcccgatgctatccctcctccctccccccaccccacaacagtccccagagtgtgatattccccttcctgtgtccatgtgatctcactgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttccagttctaaatccctgaggaattgccacactgacttccacaatggttgaactagtttacagtcccaccaacagtgtaaaagtgttcctatttctccacatcatctccagcacctgctgtttcctgactttttaatgattgccattctaactggtgtgagatggtatctcactgtggttttgatttgcatttctctgatggccagtgatgatgagtatcttttcttgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaatctcgtcttttgttgccattgcttttggtgtttcagacatgacgtctttaatccatcttgaattgatttttgtataaggtgtaaggaagggatccagtttcagctttctacatatggctagccagttttcccagcgccatttattaaataaggaatcctttccccattgcttgtttttctcaggtttgtcaaagatcagatagttgtagatatgcggccctcagcaaatgtaaaagaacagaaattataacaaactatctctcagaccacagttcaatcaaactagaactcaggattaagaatctcactcaaaaccgctcaactacatggaaactgaacaacctgctcctgaatgactactgggtacataatgaaatgaaggcagaaataaagatgttctttgaaaccaaggagaacaaagacacaacataccagaatctctgggacgcattcaaagcagtgtgtagtgggaaatttatagcactaaatgcccacaagagaaagcagaaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcacaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacaccacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcactagatgcagaaaaagcctttgacaaaattcaacaacacttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctgtctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaataaaatacctaggaatccaacttaacaagggacgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagatttaatgccatccccatcaagctaccaatggctttcttcacagaattggaaaaaaaactactttaaagttcatatggaaccaaaaaagagcccgcatcgccaagtcaatcctaagccaaaaaaacaaagctggaggcatcacactacctgacttcaaactatactacaaggctacagtaaccaaaacagcatggtactggtaccaaaacagagatatagatcaatggaacagaacagagccctcagaaataaatttcaatttaatactaaatttgtggaatatgttggtacagttgatgattttatagcagagatatgttcatactcaaatattatactagctttgctgcttctgaaactgtacaaatatattattgaaaaaatgtcttaaatgtagaaatatgtaaagtccagaatgcaaaaggaaataaaagcaataaagctatgaaagtggcaacactgaagaagaattgtaactgatttagcaggcccacaaaagcactgagaacactgtgggaaaagtcaagaaggaggcagtttatactacaggaatcccaaaaaggcttgggaattttaggatcaaatagtagaacacagtgcctattcttggatattttatagacttctggaaaagacacacagagtcttcaaaaataatatcgcagattataagattgacatacaactaggacatagaggagggtcactgaacctgtgaagttttgaggagagtttacagaaaagacgacacctgaagtgagtcttggaggataaataaaagacatgatgtagccaggcgcagtgtctcatgcctgtaatcccagcactttgggaggccaaggcaggtggatcacttgagggtcaggagttcgagaccagcctggccaagatggtgaaacccccatctctactaaaaatacaaaaattagccaggcgtggtggctcgtgcctgtattcttagctactcgggaggctggggcaggagaatcacttaagcctgggaggtggaggttgcagtgagcagagatcgtgtcactatactccagcctgggtgacaagagcaaaactctgtctcaaaacaaacaaacaaatgaagatatgaagatatgacgcaagacagaattagtattccaatgccaattggcatttggtattctactaattctgatttgagatgtagggatgaatatgaagtaaaaacaggaggaactggatcagaagctttttaagaagtggtcagacctccagttgtccaacccaactcttgaaatagtagataactgtctcttttctatcttagcaaaagactagagagtttcctctgggaaaagaaaaaaagaaatgtaatctggatgggacacactgcacagttgagggctgaacacaggttaattaaatattgagaagaacttttttccctccttggatcctgtaatcctggcaacctggtgtgagtctacctgatcaggactatcactgatcctttactttccctgtatatctgacacgtgcttactgactgcaagtctgtacatcattgtaagcagtacagatatgaagaaaacatagtgttgtgagaaataatttaacataattaatcataaaaaggggatttagagtttagattcctggtttatgatcccatctaagccatcggttggttgtgtgggtctggaaagttagctgtcctggcctcatttttatatttataaaatgaatgaaactaacagttacaagaatagttctctttagattgtgacagaaaatcatactaaaaccgacttgagaaaaaaaaagtatgtattgtttgtataactgagaagtccatagttactatgaatttggatgtggctgaatagaacagtatttggttacctttatctcctggcctggctgtggtatttttcctagataggatttgggggttatggagtcttacatccaatgcaaagatggactagcacaggaattctaaagggtttttaaaattttagttttaagtgaaaagagagtatgagatttttagatataaagacttagatttatagcttaattacctgaaacggtttggggaaaactaatccacagtcatcagttttgaaagaaatgtgctttaagacaaagcataattattgcctacctccaaagttttattaacctgccattgatctattaattattttcatgactactaacatgaaatgtgaggccctcctctgattaaaacaatgcactctcagtcctatataattcagggttcaaatccagtgggagagaaacaagcttctgcaaggttcccaagagtcaagtggattgaacaggttaggacatcctgaaacaatcacggaagccaaagaagcatcttcatagcctaagtctttacttacctcttaacatgcttactctatggaattcccaatgcactttttctctactctctcccttcttgttttcccaatctgagcatcctggcgtctggcacacaggcttaccttatctcttggtttgcctggtgccacagtttacaatatgaaaatgtgtaactatttgttgatgtccaccaccatcctaaaaccagctattctgtggcgttgcttatgcctgaaatcccatactcaacctggaataccaattctggtttccttcgtatctcttatttatcctccaagactcacttcaggtgttgccttctctgtgaactctcctcaaaacctcatagactcagtgctctttctctgtgcgctagttgtgtgtcaatcttataattcgccatgttatattgaggactctgtgtctgtcttttccagaaacctatgacatacccaaagacagggactcccagaatcgaatgcagttcttatcacaaaatatacatgtgatgtatattttgccatcatatgcatcttaatgtttcccatattatttcgaaagtatttatttcatgtcttttctgactttatattcttcacatctagcactggacctgattcactattagtactcaataaacgtttatgtaaatgaatgaatgaatgacatgctttcttttgagagctttttaaaaaaaacacaggtatgaaaagcatgtagctagggtattatctcaaaagaaaaaatacatttgaaatcattgtggaggaaaatttattgagtatgaaattctatagaagccatataatccaaaatattgctacctgcttttacttgcttaagaaattcaaggctttctagcttgtggtaattttaaaatattttgaccaagatattaatatgtttaaatagcaaagtataatactaggatatctgatggtaatttactttagaaattctgcttaaagtatctttggattgtgtctaaaacatcaaagaattcatctctgagtttagaaaatgtgttgagtgaaatgatagacttctaatatttgttgtatatgtaatttatataaatattttctgaaaaaatacaattatatgtatggacctttccatatttcttaagtttcttcttaagtttttttcatattcttcatttgtttttactccttgatactaattctgtaaaataatgaaaatttttagaaagctctgttgtacaaataaaaatataaaagctcaataaagttaacccaaatttcaataactaaattaagttggatttcaactcagcttgattcttatctgggccagagtttacaatttttgttcataaaggaccagacaataaatattttaggctttacgggccaagaggcaaaatcaagatattgtgtatctgtttacacaatgagagaaaacaaattgtccccaatttttctaactatttagaaatgtaaaagacattcttaaataacagtgtacaatttgggttttttccatggccatagtttgctgactcccatggtggtgaaacaaatccaaatcttaactgttagactcttaagtttaacattgattctctgtattagtttgctaagactttataacaaagtactacagattgggtggcttaagcaacagaaacatattgtccaggcacagtggctcatgcctataatcccagcactttgggagactgaggcgggtagatcacctgaggtcaggagttcgagaccagcctgaccaacatggtgaaaccccgtctctactaaaaatacaaaaattatctgggcatggcagtgggtgcctgtaatcccagctacctggagggctgaggcaggagaatcgcttgaacctgggaggcggaggttgcagtgagccaagatcacgcctttgcactcccagcctgggcaacaagagcaaaactctgcctcaaaaacaaaaaacagaaacatattgtctcacccttctggaggctagacattagaaatccatgctttggtaggcttgttttctcttgagggccacgagtgagggatcctgtctccttgtcttgtagttagcttctgtgtcttcacattgtcttccctgtgtgtgtctgtgtccaaatttctcctttcagtaagaacatccatcatgttagattaggtcccactccaatgagctctctttaacttgattacctctgtaaagaccctatctccaagtaaggtcatattctgaggttctagggttagggtttcaacaaccaaatttttggaaggtacacaattcaaccgataacattctcatt

SEQ ID NO: 94 - DNA, 4060 bp, Homo sapiens
ctcctctactgagtttttctatctcctagacaaagcatgatatgtcaagagtgagcaggtgcagacccacagtgtaagacttgaataagagccatttttaaattttttttaagctatcattgtgcaatataaattctgagtatgtgtatcatttcattcacgatgtattcattttagcactgtatttgaattgattttattttctgaaatttgggagaattaattttggatttattctatttatttttaatagatggtgttaggagattcctgaaaataatagcagtttttagataattgtttaagcaatatgagaaaataagggtattatttaaccttgttgtgtttttaaagagatagtccagaggcaaccgtaaattttataatataggctacatgtatagaagtatgaaatattgttgtctaggttcctgaatttgtacccagaggaagtagaataatgtaaatgtcagaacctcctgggttgtgtttatctgcaataagaaaggctcaatggcaaaccttatttattagattgtcaggatacttgcagatgtcttgaatgattactcagggtttcattttatttttaatgtcccttggttgagctcatcatataattcagatattggaataataaatggctgctagacatagtggaagatgggctgatactttccatttgaaatgtaatgatgcttattgtcttcaaaagaaaaaactaaaatggtatttcacatttttttgtttttgtttttgtttttttttctctgagaatctcattcttactcatgattattggtttcttgtgtaccatttcaacatttttctattatatgctaatgtgtatatatacttaatacacacgtgcaaaagcttcctcacacacacacacacacacacacacacacacacacacacatacacacacatacggaaccaaattctaacataggggaataatcttcggagtgaactctgtgctgctgtttgaaaatggagatataattttagaaaggttcctgcagttggctacccacctcgtctgctctaattatgcttgtcacactattttcactgatgtgttttcatgactttagggcatgaattctcagctgggtgttaatatgaccaacaaagggtgaaaacaggttcttgcatttttttaagtactctttttatgtgaaaagcacagatatgcagataatacataactgaacatccagcatatctgtggctttaaaatatcacgaagaagagcacaattagggaaaagaaaacatctatagtgtttccctaggggaacaatcatttaaaaaaaaataaaaataaggaacacagactagaagcagcagtgccaaatagataattcatgctagtctttgtgttaatttaaaaagtgctagtcttggagacaaacgcccaaattgctctaggttccactcagctgtatgtgttatcattagtattaacttttgcacgctgatgggagactgatatatatcctgttttatgttcctttaaacaatttataatgtaatttagaaaccttctcaaatcacattagatccacacaaaaacctgtacatagcagctttattttttaatagccaaagaaaggaaacaaccaaaaatatcccttaataggccagttaataaacaaattctgatacatctatatcatggactactactcagcaatataaagaaatgactattgatacgtgcatcaacttgggtggatcccaggggtattatgctgagtgaaaaaagacagttatagaaggtcaaattttgtataattccatttatataacattccagaaatggcaaaattaaagaaacagagaacagattagtgattgctaagggctaaggatgaaggagagagagaggtagtgtgactataggaagagggagatctttagttttgtattttgaatgagatggccatcacatgaatccacatatgtcaatctattaatgtaaatcaatattgtattcctggctttgatatataatataattttataagatatataatcattgggggaaactggatgaaggatacaagggacctccctgtactatctttgcaacttcttgtgtatataattataaaatatataatgtattaaaatgtataaaataatattttaagtatcagatactgatctttactcagtatatgaagtgttctatcataacgtaacatgcttttcctttatttgtggtattttagtttcaaactaaaatataaatcacctaaagatctacgacagttcttttgaaaaaaaatcttgcttttaatttcccaggagtttcaaccttaatcctctctttagtgtttctttatttggtagtgatagggactatcaaagcttcttaccatcaaatacatttactgactaaaaatagaaaaataatttacattgtaaaaatgtacaaattgaatgacagtcaaaaggtacaggtaatgaagatatgcattaacatctacttttaaaaaaaagtttattaaaattctcttttagactaatgcagtatctgggaatttatataaatagatatgtatataaatgactattaaacaattttaatgtcagttatattttaaacattttaataatattgttataactatgggggtaaaattttgtatatatctgaacatttttgttcttaaggaaataatcatttttacatatccaggaatttgaattactctcaagtcacctattaattacaagtcattttgaactcattcattttctttgtgtttgctttataatgtcattttagatttcatgcatcataatcagccatcaaataatttagttaatacttgatttttcctcagttgtaagaagtgctgtgtttaaatttcattcagaatgtttcatttcatctgaattaatatctgttaatgtatgtaatatacacatatttttaacatgcatgtacttaaattgattatagggacttggtaaaattacttatttataggatattttaaatataatcaaggattttttaaatctacagttcccatttgaaagtaaaagtaagtctttgtttactagtttgttcacagtacaagtaaactttctaccttttggttaaatgtgagtgcagcccccacagtgagaaattgttatattagaactctaatagctataatttatagggatgaatttcaatgagtttggttctaagaaataatctgttggttttaacaacatttttaagtatcagatattcatctttactcagtatgtgacatgtactctcatagcttacgtgcttttcctttatttggggtgttttttatatattaattggtatatcgcatatttaaacttggcataattacatttatatggactctaaacaataacttgtattttaatttttaaatttgaaatgcatctatgtctctgttaaaatgcatttctttccctttgcccaaatggggtatggtaagtcaagagagtctctagttagctcacctctcatttgactggcagagtaaagcccttgttcagtagaatgtgtgttaagccttccctcccttttgtaaagttgttctgaacagagctgcataaaaccacaggtaaagtgttaagctgattctactagcatgtccttagaaaggagagcggttatattggcaggtcctattgcctggcgtttctgatcaataactcaccaacaaacagaaaacagaagccgcacaaggaaaggcagaactaaataaatggtaatagcaaacaataagccagatagcctctggcctctcgcccacaccttaaggcagctgggtcaggtgggatgcttttgtttgtcttttaacgtattttctttacaaatctcagccattacataatttggaaatggacacaaggctagttattactaacatttttaaagacattactgaatgaatgtgtaagaaaacaaaaggtcctttttgcctttcagcagataagtcttttaaccaaaaatctcttgggtattttgagattgtgttctacttctttgcttatttaatattttcata

SEQ ID NO: 95 - DNA, 1352 bp, Homo sapiens
ccaggaatttgaattactctcaagtcacctattaattacaagtcattttgaactcattcattttctttgtgtttgctttataatgtcattttagatttcatgcatcataatcagccatcaaataatttagttaatacttgatttttcctcagttgtaagaagtgctgtgtttaaatttcattcagaatgtttcatttcatctgaattaatatctgttaatgtatgtaatatacacatatttttaacatgcatgtacttaaattgattatagggacttggtaaaattacttatttataggatattttaaatataatcaaggattttttaaatctacagttcccatttgaaagtaaaagtaagtctttgtttactagtttgttcacagtacaagtaaactttctaccttttggttaaatgtgagtgcagcccccacagtgagaaattgttatattagaactctaatagctataatttatagggatgaatttcaatgagtttggttctaagaaataatctgttggttttaacaacatttttaagtatcagatattcatctttactcagtatgtgacatgtactctcatagcttacgtgcttttcctttatttggggtgttttttatatattaattggtatatcgcatatttaaacttggcataattacatttatatggactctaaacaataacttgtattttaatttttaaatttgaaatgcatctatgtctctgttaaaatgcatttctttccctttgcccaaatggggtatggtaagtcaagagagtctctagttagctcacctctcatttgactggcagagtaaagcccttgttcagtagaatgtgtgttaagccttccctcccttttgtaaagttgttctgaacagagctgcataaaaccacaggtaaagtgttaagctgattctactagcatgtccttagaaaggagagcggttatattggcaggtcctattgcctggcgtttctgatcaataactcaccaacaaacagaaaacagaagccgcacaaggaaaggcagaactaaataaatggtaatagcaaacaataagccagatagcctctggcctctcgcccacaccttaaggcagctgggtcaggtgggatgcttttgtttgtcttttaacgtattttctttacaaatctcagccattacataatttggaaatggacacaaggctagttattactaacatttttaaagacattactgaatgaatgtgtaagaaaacaaaaggtcctttttgcctttcagcagataagtcttttaaccaaaaatctcttgggtattttgagattgtgttctacttctttgcttatttaatattttcata

SEQ ID NO: 96 - DNA, 106949 bp, Homo sapiens
ggtcaccactatggattcaatatactggcattaaatcagtagagaatagttgtcattgccttttgcaatattaaccaaaccactcagttcactgtgacagacagtgaattatatccaatgactccactgattttttccatgtagatagacaaaatataactactctcaaatgtaaggaccctgctttctgaaatggttctgttgctctcttcacagataggcttcttataatacttttaaaataatttgctaagcatacagatggctttctagagtgtggcattgacaaataaagtgatttttatatactgggaaattctggccttcaatgtatcaggattaaataatctgaatttctgaaagctagcctaagtgggcaagatggcttttttgtgctcacgcattgaatactgaactattctagttcttaaatggcgatctagattcaagacttattgaactagattgaagggactttattgatatcctacctaatgctcacactgacagatgaagagactgagccacatgttctaaggtcataaacagaaagaatgagaatgagatggtctaattaattgtccacctttcctatggtacatcagggtaacactttagtttacgagggtattattagagatagaaagaatttttttttaaataattgactcaaataccaacattttgcacattacatagagtaatagctttgcccaagttagaaaactgggggttcttctttattcctcttttgaccacatctatatactcagttttaaaaaggttcttcctggtatccttcaattccatccccatgttttcatctacaagcctagtgcagctattccagccgtctcctgatcaggtcttaagcacctcccatatgtccttgtagtacccaccatattgatctcagtagcaatcacagtactctattgtaaatatcttttaaattattatcttctctttgagcttttgggattttatcttatttatttttgtagttccaggatctagcaacagcttgtcacatcgttcatactcaactaatgtttgtttaatgcacaatgagcagaaataaacatactactccatagtaaaaagaggatgaacttttctgcaaatattaatcagcaccattttatccaccttttgggtttagtacattggaagtataggagtataaagcagaatgtccaatgtttacagtgatattttgaaatagataaaagccagtgcgacatttccattctcaatttctctgagacatcaccttgaaaaaaaaaagtatttttctcttcctaaaattagtaaaggaacagtaattccacatttataagagtatgatcaacgcatcacagataatgttgtaataacacattagataaaagtgcttattttcctgaaattatatggagaaaaaaatctgaaagtggacctttgttggatacaaatgaaataaataaggtacatacattttttaaggttcgaaagtttatggcaactttagtttgggtttccatgctattctatttattatatgggaatttactgtagctttcaacatgtacgaaacaggctggtagggctcatgcttgtaggcttctgtctaataacttggcaactgaggtactttagggagtatggatggggctcttccatgtctcaacgtcctgactgccaaaaaattatagcaggctggttctcagaatcttatagttagttgttattacttaatttccctaaccacccgttctttactttttctgtaaaggctggaatttttgagtagaccttattgttttaactctattgttctgtttgttttctccagttcatggctcttcattatcactggtgtccagcacttcttctctttactctacagtaagtaatggctgttaagaaaaagcttgtgcttttgccatgcacacagatgatgaaatagatcattttactgtgaacagatcacattcatctatgacttgcacaggagttgtgtagcaaaataacggcatactctaagctgcccaatacccaataaagtgccaggtgctccacctgccattctttggtcacttacatgtgctttcacttggcttttgtgcactcatcataatcaatgagtggatgtagaattcgatttcataaaacctactgaggtatgacttggagtctctgaaaccatgtatgtagtctgctatactatcattttagtaatgacgagttgtccatgttttgttctttgagccgtgactgttaattgttctatagtattttcttctcattttttatttttaagtttattgttgagaggattatcgaagggtaaaagcagtaagggtaaagggtaaaagcataaaagaaccagagatgtttttttttaaatataccttttgaaagagtgtgatttttttaacttttatttttattttattttatttatttatttatttatttttgagtcgaggtcttgctttgtcacccaggctggagtacaatgacacaatcatagctcactgcaaccttgaactcctgggctcaagttatccttctgcctcagcctgtcaagcagctaggactacaggcatgcaccaccatgcccagctaatttttaaattgttttagagacaaggtcattgctatattgaccagactgatcaatacccatggcttcaagcaattcctcctgctttagcctccccaagtgctgggattacaggtgtaagccagcacacttagatagaaactttatttattaagagaaaaataccagtgtttcaagttcttttgcaaacgtgtgacattataattcatttttgacaaggagagtttttctgtttggtaaatacaattctatcttttttaaaaaagtagcctacaggaagttatattttatgagtgagtctttttagagctaggttaacagtgaggtatatttaaaagcagcctactgaatctcaatgggacttgagtactatgaataagccttaatcctgtactgtaaggttcatgaagagttcatagcctctgctgtcactgatcaactgagcatcatgggcagtatttttttcactcattatcattaggttcaaatgtttgtttgaaccttctctttatagattaatctcatatatttactgccttacatagtcattcaaaatctgactgttattggcagaggtaatatttttctaatctctcctttcaatgattaaaattacccatagcttctagaaattaagaaatcacgattagtttttaggtaaatgtactttttgtgcaaatggataaagtgaggaatgtgtaaacacacatgaaaaaaacacataaaagaaatatattaagacttagtgttcctcctgttgggccagcactgccatttgttggggaattgtattctgatttaaaccattgccatttacatctatgtgtaacatcaaaagatgtagcatcattattattctaaatacatacaataattaatatttggataaagctaccttcatgaaacctaagaaaaactaaattaaaaagaaagaaagaaagaaaaatacacttagatagaagaaataaggtctagtgattggtagcacaatagagtgactatagttaacaataatttattgtacatttcaaaatagctagaaaagaagatttggaatgttcctaacaggaagaaatgatattcttcctaaatgaagaatgggatattccactttcctagatttgatcgttacacagcatatgtttgtataataccacatgcaccccataaatacatacaactattgtgtatcccaatattaaagatttttttgaaaaatttattcctcaagaaaaggatcatgagtttaagaaaaaacagattactagtctaccagtgtccagtagacctttctgtgttaataaaagtgttctgtatctacactatctaatatagtaactatgaaccatatgttgccattgattatttgaagtatatctggcaaagagatgaattgacttttttattttaattaatttacattgaaatagccacatgtgcctagcagctactagattggatagtgcaagtttatagagaacacaaggggtacatttgtagataggagtgggatgtcaaaatgatgaggataattagaaagcatacatgagaaatattgttttaagagtagaatatgaaatgggaacacagattaaaatagagtatgtatatatatacatatatatgtgtatatatatacatatgtatgtgtatatatatacatatatatgtgtgtgtgtgtgtatatatatatttataggccaatatatggaggtagggtatatcctagtgttaagtgagtaaagaatggattaggtgatcgagccacatgagaaggtgatattattagaaaattgaaagttgtatttgagatgatgaaaatgatatatttgaattgaaaagtaaactgtagtaaaataattcaaataaatgaatatttggggaactacttaagagaaaaatcataaaacatgaggagtcattctttccccagtccgccatgatcaggccttaggatttaattggcaatgagaaaatacctatgaaaatgctttttaaactatcacatgaaaaagcaacttattatttttcatgccttcttaataactctcaatagagatttagttgatttgcatttttgcctggttcaatcaagaaattatcgcgtgacatcaggcaagttgccaaatttctttggactatacctataaaataaaatttgaaaatattagctagatctaacccatttgtctccggatgtctgcaaagtggttggaaatcacaagcctaacctgatctgcagaggtgttacctttggcaaacttatggtttttgtgtttgttttgaaatctaaggccaagcgcggtggctcatgccggtaatctcaacactttgggaggctgaggcgggtggatcacttgaggtcaggagttcgagaccagcctggccaacatggcaaaaccccgtctctactaaaaatacagaaattagcccggtgtagtggcatacgtctgtaatcccagctatttgggaggctgaggcaggagaatcgcctgaacctgggaggctgaggctgctgcagtgagcgccactgcactccagcctgggcgacaaagccaaacactgtctcagaaaaaaaaaaaaaaaaaaggaaaagagggagaggggagggagagggagagggaatctaagccaacactgtgaaatattgtgaaatatggagcttctacctaaaaattcaaaattttaaattccttttaaaaataattggaatatctatggaatatctagcaatactaagatgaaattcctctgggttttcagtcacctgtaattgacacctttagatgttggcatgggctctcaggaagccacagcctccaccaatgcttttcttcctgacactgaagctaaatttgggtggctagttttcattgtgctgttgctttcctcatgggaaagaaataccctttgctatttatattgctgtcaaatgggaaaatgaaagacagccaaggaagatcatgtgactatttaaatacttcaagtccatttattctttattagccttgtcctgttaggcatttaaatttttgatccctgcaatagatgttttttgattaactgtatattaaaaactatatttaacctgttttgaatttgaattctaaattgtattttttcatgagagcaagtgtcatttttgattcattgtggattgtttaacatgttgcctaacaaatagctaatactaacgtcataactttttaattaataaatttgaatggataaatggccacttattggcttatagaataaataaaaacatttttattcagtcaagtgtttcatattttttatcatctccaggacattgggcttgctcaaaaccattgttaaaaaaaaaatggcaaataatccagttccatcatgatatcattaatcccacacctaagctactgaaaaaaatatattaatattctggctcattgctttatttttatggtaacacccacctggtattaataaccacagagtacgaaagaaggcaaaggttaaagcaaataatagttttgaaaaattggtagtgaaaaaagtcatgctatacggtatgtatataatagatatttaatgattatgcttgctactagtatatgtaacaggactattatagattaacaaaaatgcggtgagtatatttcttgattattttttaaaagaataaattattatttaaaaatacatgaattatttattgattcttgaatctttaccagctttctataattctaggaagcctagaagcagaattgggcaggataaactggcaaaaaatgtaaaaagtaggccgggcacggtgggctacagtgagttgtgaatgcgcagtgcacctgagtgatagatcaagatcctgtctcaaaaaaaaaaaaaaaaaaaaaaaaaaaaaaaaaaagaaagaaagaaagaaaaacaacaacaaaaacaaaagcaaagtactagggaaaactaatagacatagttacatagttaattgtgccatatgttttaaggcaatgaaacttttatcttaatattccttgcttactttttattcaaaaaccaaactgtgtataaaaccttaaaattattaggatctaaaaaataaaatctttccttaaaaatctaaaattgagatgtaaattattcaagagtgctttttaaaacagttttcttataaaggctattaggattctaccacttagccactttattatttagccactatattactaagtttacatatttttaaaggtagtgaaaatatagggaagacaaagctcaggttaaaagagtttctggcaaataaaatatatcctgatggttagactactttgctttatgttttctgaaagaaaagcagtaaaaaacagttcaggtagttttgtgtcaattaatctagaactataccaaaagtagacatagaaaacgagagattgtttttcagctttggatctgcttatggcaataagcagacttgtactattcaacaacattatgcattcttcagcttttcccagaataagggagcttcccaaatgcaatggtgcacataactcattttctggcattttgcagcccagcatgaagaagaaaaacagagctaggagttttctggaagtcaagtcaaaaacaccctgcaaattcctatggcagtcctcctttccataagctgcatagccaaaaatgtttgccagacacttttatcactgggtgtttcagtgttttcattgtttaagcgttttgctgacttgtgataattaaaattattaataatcattaaagaaagaaaaagtagaagtaaataatgttaattatctgtggttatcagtagaggtctgtatgttaccccagctttatttgacattgtttgtgatcagtaaatcacagaataaaattctgacatctaaaccttggctagaggtctctataattttatggagtctgtttcctacaatctgtatgaaagatacttcaatattttaagtttacatgcacccatcttttttagagtataattttataactatttggtttatgttgcttatgatttacatcttagagtcttttaattctgtcttttgcttaaaggaatattatggatcaaatgacctatattttaagaataccttatggtttatatattaagaaacatttatataaaattctaaagtaacttgcttgtactatttcaattgaataacttaatgtatttcattctattcttctcatagtagataataaaaagtacatcatgattattgtattcatttatacttgtggaattaattgaaaatagtttttatagttaaagtctttctttttattgttttacaggctgaagaaaaggctcattcagaggtaaaaaaaaaatatgcaatattttaatattttctattttagtttgcattcatgatgaaattagtcttgtgaccactagagggctctgtgatacaatagcagaactccacaggactgctgaagtaaggcagctaattgataaatggtctttgatattgcctcttaaaaataaaatgaaaggaagtttgtatagcaagctgtcctttcacattctagattgagtcttagctcaacacctaataagttttctataatagtaagcactcattaagtcattgataaatgaaggtctatggtcttcctattttattacagtctttttcccactccctgtaagaccatctacacaggataatggttgaaacttgggcaccaagcctccacaacacaggatactagcatctcagactatctgttttgtgtcattatcttgttgcctctaactgccattttatgtgtggtgtgtcacctattgttctaatcacatatttcacaaatacatatttggttgcactcgtgagcaaatcaaactgcattcaggaaagaatactattttaatttcccttggtaaaacatttgtcctggtcaaagagagcaggaggactttaattatgactttattcaaggtgaggtaatggctgtttgattggtttacactgaggcaatcagacaacagagaaaaaaaatgccttaacaacagcttttgcaaaagtattcctttcctttgaagtcttattttattagcctttaaaaataaaatttgtgctatgtttaaaaatatttgaaaattattgattaaaccaatttgtctttataatctctgaaccaaagagtggatatgatttttaaaaatcaaagtggttttatttacatcacatggacatgacaaagcttctaacactgatcatagtatagctactgaagcatcgaaatgctacatctatttgccttagtagtagttattcaactccccttttatcattgatgctgtatcatgagttatggtttaaaaaaacaatttcaatcactttacagtttcctggattatattttaaagatactggaatcatgtaatagagactatttaatttgagaaatgctctttgagtttggattcatttatgaataaaatagacgctgtattttctgaaatcattcatagtcattatcttataaatgtaaagcaaatgttattttagactggggtgtatctgttccggaaaaaaaaaaaaaacaggaacgaagtagaatcacatttggtgaaattatataagtgtctactgtttccagcttagagttctctactttgttagagtgtttgagttgaccaccatttattttcaacaaaatctaatgcccggggcaaaaactagacagttaataaactatgtcaagaattctctttcaaactgagacagcattccaaaagttcaactacaactatagataagatttgtttttgaagaaatgagaagcatcaaaagtagaatgtttaacatccaagtaactgaaatcccttgagactagatatatacttatagaacctagtgtcagattgttataaatgttctatccttattagtcacaacatgagacttgcagaacaaactgcagaaagtgcttgaattaaaactttaaacatgatataatatatccttacccttttctgtttcagttttattggagtgtgaacttaactaaaaagaaagataccttagaatatacattatattggtttatctaattagttgcacctatcattggttttttcccctgatttttaagatgtggataagctataaagcatctctgagctaataataactcactaaataaaggtcttgataatacagatttgggaaggcttctctgcagtcattgaaactccagccaataacaatttaaatgtgaactgattaaatgttgaattaagcccaagttttagtgattgcaggatattccatagcctttgagaagttttcaaactatgagaaattaaaatgtacagaggaaaaaaaaacctaagattttctgaaaaagaacatggagtatcttttactaaaaaagaacaagaaaaatatgtgtgtatatacagtttttataaagaaaatatttttctacagttttattaccacagtttttctagaaggagaagaatcaatacagagggtaaactgctcttgagtcatttgccatttgagggatggcaaatggagcaagtgagcgtactttgatttgtagattagagtttgacacataacactttgcttttgaatgacatttgcttgttactgtggagtcagtgttcatatcctttattttcaggagttgctgctgatacaatggggttagaatgagctaaatacagcatttgctttcttggtttgaattctgggttttaagtaaaaatctacttgcctattccattgatttttttaattgcattcagcaaatccataaactgcggagagagctggttgcatcacaagaaaaagttgctaccctcacatctcagctttcagcaaatgtaagtcacttcatttttaaaatatattacaacaaatttttatagaggaaaatgaaatcattttagtaacaaacttacaaattttcagtgcctgatacagacttagattaccaactagcaggactcataaaaagttaacattttttgcctactcagtaataaaatgtaaatccaaactgatgagaggcagcaatatggttaaaatggcttgttgtttctaataagattggaaacaatagtaacagccatatgggttacttcttttcttgtttgctatttttattactcctcttgcataagattctctgacaatgtaagaggggttgttagtgtttgactttggaagataaaatattcctgtgcccagcctccttcatctcaatgtattgaacaatttgttaagcatccagttaattctaaaatatgaaattaggtctaaatagggatagcttagctgcactgtggatgagatatggtttgctcaaaaaaccttggcagccttctcatagcaatttaaaagggtacacttttactggcaccagagcagcccaggatggcagaaatgatgacaatgaagaccgtcaattaaattaacatttactgaatatcttccactgtgtcagggagcactcagagtagatgcagaatgataaaggagaaatgtggcactgttcccagtcctgaggagcaatggtgttaagaacagcagtgaggggtaaggaaatgcctgctattttgccatatgtcttacctctctcactcaacagtcctttgctcagttctgctgcatagctttgggcctgctctgtgcctccccacccctcccgctgctcctctactgagtttttctatctcctagacaaagcatgatatgtcaagagtgagcaggtgcagacccacagtgtaagacttgaataagagccatttttaaattttttttaagctatcattgtgcaatataaattctgagtatgtgtatcatttcattcacgatgtattcattttagcactgtatttgaattgattttattttctgaaatttgggagaattaattttggatttattctatttatttttaatagatggtgttaggagattcctgaaaataatagcagtttttagataattgtttaagcaatatgagaaaataagggtattatttaaccttgttgtgtttttaaagagatagtccagaggcaaccgtaaattttataatataggctacatgtatagaagtatgaaatattgttgtctaggttcctgaatttgtacccagaggaagtagaataatgtaaatgtcagaacctcctgggttgtgtttatctgcaataagaaaggctcaatggcaaaccttatttattagattgtcaggatacttgcagatgtcttgaatgattactcagggtttcattttatttttaatgtcccttggttgagctcatcatataattcagatattggaataataaatggctgctagacatagtggaagatgggctgatactttccatttgaaatgtaatgatgcttattgtcttcaaaagaaaaaactaaaatggtatttcacatttttttgtttttgtttttgtttttttttctctgagaatctcattcttactcatgattattggtttcttgtgtaccatttcaacatttttctattatatgctaatgtgtatatatacttaatacacacgtgcaaaagcttcctcacacacacacacacacacacacacacacacacacacacatacacacacatacggaaccaaattctaacataggggaataatcttcggagtgaactctgtgctgctgtttgaaaatggagatataattttagaaaggttcctgcagttggctacccacctcgtctgctctaattatgcttgtcacactattttcactgatgtgttttcatgactttagggcatgaattctcagctgggtgttaatatgaccaacaaagggtgaaaacaggttcttgcatttttttaagtactctttttatgtgaaaagcacagatatgcagataatacataactgaacatccagcatatctgtggctttaaaatatcacgaagaagagcacaattagggaaaagaaaacatctatagtgtttccctaggggaacaatcatttaaaaaaaaataaaaataaggaacacagactagaagcagcagtgccaaatagataattcatgctagtctttgtgttaatttaaaaagtgctagtcttggagacaaacgcccaaattgctctaggttccactcagctgtatgtgttatcattagtattaacttttgcacgctgatgggagactgatatatatcctgttttatgttcctttaaacaatttataatgtaatttagaaaccttctcaaatcacattagatccacacaaaaacctgtacatagcagctttattttttaatagccaaagaaaggaaacaaccaaaaatatcccttaataggccagttaataaacaaattctgatacatctatatcatggactactactcagcaatataaagaaatgactattgatacgtgcatcaacttgggtggatcccaggggtattatgctgagtgaaaaaagacagttatagaaggtcaaattttgtataattccatttatataacattccagaaatggcaaaattaaagaaacagagaacagattagtgattgctaagggctaaggatgaaggagagagagaggtagtgtgactataggaagagggagatctttagttttgtattttgaatgagatggccatcacatgaatccacatatgtcaatctattaatgtaaatcaatattgtattcctggctttgatatataatataattttataagatatataatcattgggggaaactggatgaaggatacaagggacctccctgtactatctttgcaacttcttgtgtatataattataaaatatataatgtattaaaatgtataaaataatattttaagtatcagatactgatctttactcagtatatgaagtgttctatcataacgtaacatgcttttcctttatttgtggtattttagtttcaaactaaaatataaatcacctaaagatctacgacagttcttttgaaaaaaaatcttgcttttaatttcccaggagtttcaaccttaatcctctctttagtgtttctttatttggtagtgatagggactatcaaagcttcttaccatcaaatacatttactgactaaaaatagaaaaataatttacattgtaaaaatgtacaaattgaatgacagtcaaaaggtacaggtaatgaagatatgcattaacatctacttttaaaaaaaagtttattaaaattctcttttagactaatgcagtatctgggaatttatataaatagatatgtatataaatgactattaaacaattttaatgtcagttatattttaaacattttaataatattgttataactatgggggtaaaattttgtatatatctgaacatttttgttcttaaggaaataatcatttttacatatccaggaatttgaattactctcaagtcacctattaattacaagtcattttgaactcattcattttctttgtgtttgctttataatgtcattttagatttcatgcatcataatcagccatcaaataatttagttaatacttgatttttcctcagttgtaagaagtgctgtgtttaaatttcattcagaatgtttcatttcatctgaattaatatctgttaatgtatgtaatatacacatatttttaacatgcatgtacttaaattgattatagggacttggtaaaattacttatttataggatattttaaatataatcaaggattttttaaatctacagttcccatttgaaagtaaaagtaagtctttgtttactagtttgttcacagtacaagtaaactttctaccttttggttaaatgtgagtgcagcccccacagtgagaaattgttatattagaactctaatagctataatttatagggatgaatttcaatgagtttggttctaagaaataatctgttggttttaacaacatttttaagtatcagatattcatctttactcagtatgtgacatgtactctcatagcttacgtgcttttcctttatttggggtgttttttatatattaattggtatatcgcatatttaaacttggcataattacatttatatggactctaaacaataacttgtattttaatttttaaatttgaaatgcatctatgtctctgttaaaatgcatttctttccctttgcccaaatggggtatggtaagtcaagagagtctctagttagctcacctctcatttgactggcagagtaaagcccttgttcagtagaatgtgtgttaagccttccctcccttttgtaaagttgttctgaacagagctgcataaaaccacaggtaaagtgttaagctgattctactagcatgtccttagaaaggagagcggttatattggcaggtcctattgcctggcgtttctgatcaataactcaccaacaaacagaaaacagaagccgcacaaggaaaggcagaactaaataaatggtaatagcaaacaataagccagatagcctctggcctctcgcccacaccttaaggcagctgggtcaggtgggatgcttttgtttgtcttttaacgtattttctttacaaatctcagccattacataatttggaaatggacacaaggctagttattactaacatttttaaagacattactgaatgaatgtgtaagaaaacaaaaggtcctttttgcctttcagcagataagtcttttaaccaaaaatctcttgggtattttgagattgtgttctacttctttgcttatttaatattttcataaaatttgctagttactcttgcttttttgcatctcttctaagagaaaacaattggtgcatattattaatgagaaacacttcagtgtttggacaattttttgtagtggaaaagaaatgtgaaactttatgttgcagaatcattcttggttcaactaactactaattttaaaacataaagtcttaaatatatataaagtttatatgggtaaatatatattacatataatatatgttttatatttatacataatatactatatatttatacatgatatactaaatattttcccatataaataataaaatgctctaggcatatatgtgtgtgtgtgtatatatgtatatatatatataccttcataacatacatatataaaatactatattatatatactctaggtatacatatatgcctatatatgcacctatatatttatatattactatataatatatagtatatattactatatatactactatatattactatataatatatagtatatatatagtatatattatatagtaatatattactatataatatataaatatatgtgtgtatatatatatatgcctagagtgtttttaatttgtcagtgggctgtctctgtaatctatatgaagaaataaaatgtagacgttatgtataatgatatttcatcttgttgtgtggcatcatagtaattctctttacatatctattcagattacttttgcaccagcctaatacattgtatgattccaaaaccaaagagagtatggattgaaatgatattccctttactaatactcagtcttgtctattttattacctttatagacttcacctaacacaagtcaggggatatttatcatcatattaatacaattttactctgaccttaaaattatgcaactgctaaaggaaaaatcagaaccaaataaactgtcattaacaacccccctgaaaatccatattttttaaaagtcattttatcaagtctctcagacaagatgtgataccctataagtttaatcagttttactttccattttctcttcattaaggtgataaagattatcattagtagaaaaattttcccttatttgcctccttttccatttaccctattgagtgagaaatttagcctctcataacttctaaagtagcaatgttaatctgataaactaaaccaaggtgagataaatttaagacaatattttttttcttcaacttttaagttctggcgtacatgggcaggatatgcaggtttgttacatgggtcaacatatgccatagtgatttgctgcacagatcaactcatcgcctagatattaagcccaccatccattagctattcttcctgattctctccctcccctaactcccactgacaggccctagtgtgtgttgttccccaccatgtgcccacgtgttctcatcgttctactcccacttataagtgagaagaagtggtgtttggttttctcttcctgtgttagtttgctgaggataatggcttccagctccatccatgtccctccaaaggacatgacctcattcctttttatagctgcatagtattccatggtgtatatgtaccacattttctttatccagtttatcattggcatttgggttgatttcatgtctttgctattgtgactagtgctgcagtgaacataatgcatgcaggtatctttataatagaattatttatattcctttgggtatatacccagtaatgggattactgggtcaatttctgcttccagatctttgaggaatcatcacactgtcttccacattggttgaactaatttactctcccaccaacagtgtaaaagcattcctttttctctgaaacctctgcagcacctgttatttcttgactttaataatcaccattctgactgctgtgagatggtatctcattgtggttttgatgttacccttttttttatatgtttgttggctgcatgactgtcttcttgtaagtgtctattcatatcctgtctattcatgtctttgcccactttttaatggggaagtttgttttttacttgcgcatttgttgaagttccttgtagactctagatattagacctttgtcaaatggatagattccacaaatgttctcccattctgcagattgtctgttcactctgatgatagtttcttttgctatgctgaaggtctttaattagatcctatttgtcaacttttgcttttgttgcaattgcttttggagtttttgtcataaaatctttgcccttacctatgtcttgaataatattgcccagattttgttctagggtttttatagtttttggattttacttgtaagtctttaatccatcttgggttaatttttgtataaggtataaggaagtggtccagttttaattttctgtatatggctagtcagttctaccagcaccatttattaattgttttttcagtttccccattgcttgtttttgtcaggtttgtcgaagatcagatggttgtaggtgtttttcactaacataatcataacatacatttcattgaaaacaacacgactcaaaatgttctttagtaaccagttataagtttttttgtgcataattacaaactgccattctaatcataaacattttgtggttacttatagctagaaaatgtgagtaatatagtttatacagcatactctttacaatcccgatttctttgtcaaactttaattcatattaaattgataaagtatacacaaagggtaaaggagagtaattttcttcaagtttcacatttaaggattcatagtagaatgattaaaccttacatttctccactataaggagaattaaaatggaaatattgagtaaaatcttacatttcatttagtaagtgctaataaagggtttctgccataattttccttattttaaaagaaaacacacaattttagttttaggttttagtaaccaattttatgggcatagtgggaatatttctaacaggttaaactgaagtgaccatcatgggcatatatatatattttaaattcacatatatgaatactatacagtaaaaactaacttatgctacataccacatggatgaatctcaaaacccatgtaaagcaaaagaaaaccacaaaagaatcatgccatttgattacacttgggtggtttttaaaacaggcatatctaaacatagtgctttgaagtgtaagcttgggtaggaaaaactataaagaaaagcaagaaaataattaccacagaagttatgtagaggttatctttggggaaggaagagggaataataagagagggacaaagaagagcttcttggttcttgaaatgtcctatttcttgacttggctggtgaatgcatgaatgttcactatgtgataagtcagggggctgttttcattttgttcacttttatatatgtgtggatttttccacagttgaaaaggtaaagttcaggtgtggtggctcacacctataatcccagccaacactttgcggggccaaggtgggaagaattacttgaggctaggagttggagagtaacccaggcaacagggtgaggcactgtctctacagaaaatgaaaaaaaaaaaaaaaaagtagctgggcatgttggtacatgcctatagttcttgctacttgggaggctgaggcaagaggatcactttagcccaggagtttaagcctgcagtgaactagggttgtggcactgcactccagcctgggtggcagcaagacactgagtaaaagaataaaataaataattaaaagttaaaatataggaaaaaatgagcatagccttatgctaatttttcagttactaggtctgatatcatcacattccttgcttgtcattgaaaattttttaaactatgatacttttttttagtggtatttatccaattaaatctgctaacaaatttggtgtataaatctcaagggtaagggtatgtggagagtgggtgtgtttgtgtgagagagagagagagaagagggggaggagaaaaagaaggaagagggaaggaatggaaaaagataataaagagttgttctgatagattaatctttagtagatgtattccctacaaattgtttttctccatattgcagtgtcaggtaaagaaaggcatcccaggatgaattcagagctaggaacatgcacctttgtatcataatgctaatggaaggaacatgtacattctaactgttaccaataatggaatatatttccgttattaagtaataagctttaattctttgtatttttgtgatccatttgatagtaggtgcctcagcatttccactctgctataagtacatggagatatattttatttaagtcatcttattcatgtctttcaaaaagaaattcatttttggccaaggatttccaaattttgccccatatataggtatagtttattatagacttcgtttgcaaaatattaaatccttatatccttttagggacacaataaaattttataagtttgagataatgtacttgcagttctacctcaggccgtggtgagagattgaagtgcctcttcattttaacattttgggttcaagttgttgcataagggcatgcaaatggaaactggcctatttttgagctttaataaaatcgtcaaatacttcttaatcttaagagttatagttatgtactacaatatgtataattctctaatatttaaaacaaaacctgaaagccacaaaagcttactgtgaaataaaatgtgatggaatattatttctaactggcttacctgtatttccttcattgaagggaatatgaagtagaaaagcccttttattgaaaagagtttggaaagtaaagataactcttttcaattcaattctttgtaagtagaaaaagagtaaagataatgttctagctgtcagcagatgtctgacacttgatggagcgtatcattacaatagagcagctaacaatatctgcaaaggtcatcatgaaagtataaaaatgaggaatatttgtccattgaccatttcagtgacctctttttgggctttaagtctaaaaatcttggcagatcagaactttatattcggcattttgagtgtcaaatctctacatgatgtgcaagtcagaaggagttattacttgcaaaataccatcttctttcagaagttaaactcacattaaatgccaggagactgaaacactgattttaagaagacaaagtttagaaaagatgaatgaaaatgtgtgttaaagaagagtcaccagtcagagctaactatgatagtcatagtatttaaagagttggaacacatgaaattaagcattttgtaaaatgaaggcttttcatccatccacataagattctgacatttaaactatgtttcttccattctgttcacaggctcaccttgtagcagcttttgaaaagagcttagggaatatgactggccgattgcaaagtctaactatgacagcggaacaaaaggtatgttcagaaattgccactggagactgaaagaagacagcaaattgcataggattcttaaataatacctgaagctccttaaaaataatattccaggctgagtgcagaggctcatgcctgtaatctcaccactttgggagaccaaggtgggtggatcacttaaggtcaggagttcgagaccagcctggccaacgtggtaaaatcccatctctactaaaaacacacacaaaaaattagctgggcatggtggcgggtacctgtaatcccagctacgcaggaggctgaggcaggagaatcacttgaacccaggaggcagaggacgcagtgagccaagatcacaccactgcactccagcctgggagacagaacaaaaaaaagaataataataataaaataatattcaattctatactaaattaaaacaatgataatacctttcttttcagattttaatttaaagattttatcagtttactccatattggaacacacaaaggcaaacaaaatccttgctgggcagtctattaatttacttctggatggaactagtaaaagaatactgaatgttaagaaagagaaacagtcacataagagaatattctgggggcaaactgttatgcagttgacaagaatcacactttgataagaactttcacaaatacatggtcactaaatccagctatagggcatggctgtaggctaagacacacaggaaggatgcctgggactctgccaagtaagggacttcaggttacagcagctatgaaacaaaggccaatcctgtgtaattttgaaataacaagaactagttgccatctagggatatcacctttgaagaaaagtcatttgttatatcaaaatacttaaaatgaacctaaaggattttatggtatgaaagaaggtataccaaaaagaaaggaacggagaatttagttcacgaagacaaatgtattaaaaaggtccatactgcatagaaagcctggtcacctttcctgtgatgaccagttagcttacttctctgctgttagtccagtggccttaacttccttggataggtatcagagataggtgaaacctatagaattctatggagtgtgtgtgtgtgtgtgtgtgcgtgcgtgtgtgtgtgtgtgtgtgtatgaaaactgtaaatgtgcataaatgatcaggtgtccagagctttcatctaattctcaaagagacccattatatcaaaagttttgggtattttcaagaatgcgttcctctatctatccataggaatggcttcagttttgtctttagattctgtaagttatgtgattagctttacaaaagtagtatgtattaccaaattttgtcactttacaaaagtttatttttaaaacagaatgaatagttcaatgaaatcaaaagagtaaatcgaatattcttataattgccaagtattattagcacattgtattctctctcatattctccgtataccctgcccgtgagagagaatattatccattcctggaaaatctgttctagcacagctaacaaactccttttgaaacataaattttcctttctttcctccctccctccctccttccctcccttccttcctttttccttttctttccttccttcctgcctcttttctatccttcctttctcctcccttacaccctttcttccttcttttccccctctgtctccctctctttcttttttgctgcagcttgtcacttcactatgtaatataagaacccagcaaatagaattagaaggctttttagagcagctgacgggaaagaataaaaacactgggccccagtattcttgaatgagaattctggctatgtctgttaaaagctgggtaatcttgagcaagtttatctaacctttcttgaacctcaaattcaccttcttaaaagtggggatgataatgactaccttgtaggatcaccatgaggagtaaatcagatactgttatcatgtcacatgctaggggctaccaaaaaatattaccttcctttacatttctctttttcccttgaaaattataagataacaccaaattcctcactgggcatataccaagcatattgttggaaatgagtgttagaatttaagtctcaatatctttaataagtcaaaattaatagaatttttgtcctccacccaatattttcttgaactctgttatatctgtaagtgaattttctcatagaaacatacagagaattttctcatatacatatagaaaaaaatgtagaggtatgttaatgtataatgcctatgattaatgcctgaatatttaaaaataatttctataacataagagattttataatgtgtctacattatccttaaaataacattgccaaaattataaaattttctcagaagatatcagaatgtctcatattgtccttatcacttttttaactgaaaataaaatcacttctttttgaattgcaaactgtatacacacaacaatcatggttaactagtttattaatttgagattataacttgcctattctcaaagtgatatttaaaagcctataaaattatttgcaatgtgaaatggtataattcaaagacagaatctaattaaaaccagtagaataatgtatataacaatatacctcagcctagataattactactgcaaggcactgaaatgaattgaatttcaaggaagctatagtacaaagggagattgttaggtgtgttttattctcattttctgaccaggagagcataatttagactgaggagaaaactctttggcactaaattcaaggacgaatttattgccaaggtttttaaattggggtcatggaataacaaaagacaaaatcactgttcaaatagacatttctctaaaagctaagggcataacatttaatcatatttcactaaaggcatttcttcagggagctgagataaaagggtatattgctctctggtgattcaacaatcctgagaaaaggcttgtgaagtatagagcagagattcttaaactcccttccccaagttataagtttcatttgtctatttagtcattcatcaagtttatattgaatttgtgctcttctaatgacaaaacagtacagacaatatagatatagaatgatagatataggtctatatctatagacatacctatctactagaactctaaaagcatattatacatgtatgtaatattcctcatggagtttatatttctcatatatatctcatatatatgtatctctttatcatggagtttatattttaggaggtcacagatgataataaaaatataattaaaacaggccaggtgtggtgactcacacgtgtaatcctagcactttgaaaggccaaggcaggtggactccctgagatcaggagttcaagaccagcctggccaacatagtgaaaccccatctctactagaaacaaaaattagccaggcctggtggtgggcacctgtagtcccagctattcaggaggttgaggcaggagaatcacttgaacctgggaggtggaggttgcagtaagccgaggtcatgccactgcactccagcctgggcaacagagcaagactctgtctcaaaaaaaaatatatatatataatatatataatatatatataaatatatatattatataatatatatataaattacatatttataaatatgtaatttatatatataatatataattaaaacatataggatttcaggtgatgataagcactactgaaaaaagtaaagctgagaatgaggatactgagaagctggtttggaagctaaaacacaaagtaacaaaggccaaggtggttacatgttcttgattacatactttaaaaatggataaactaaattaagactcagattctagtctttgggcttcacagtgtgattttcagcaatcacatggcattaatagcctgaaactacatcaaaattgtcatttgatttatagaccaaaataactcccttgaatagagagggattcactcctaacacttttcctatttccagatgccaaataacacggaatctcttgccaaatttgtgtggcagaacactggttttatatacttatagcctggtaagaaagaaaagacatgtatgaataacttagaaggcagaaaattatcatgctattagactcagtacaatgtcatgtgcattctcaaaggaaacatctgcagaggcaggagaattgcttgaaccctggaggtgaaggttgcactgagctgagatcatgccactgcactccagcctgggtgacagagagagactgcatctcaaaaaaataaaaattacaaaaataaaaaataaaaaatagtgatcaatctggcagcattttctgaaagttaagcagtattcccaatagctgctaaaagaagacatgttatataatactaagtctgtaagtaggtaaaaattaagagaattgttaatgtgcttgctggggagtgaaattatctctaggcattaccctatacctaacctaggactcagtagactatgatattggcgtagtttgaccaagaattttatcctgatttcagatcgttttctcttcaccagcacttcttcaccaggattatatgaaaaaaattaaacctgatgccctgaggcatccattatatgtgctgaaataacttcttttctcaccatctagaatggtactagctatgtaccactcttgtcagaatcaaggaaattgctactcaaatcattgtgcagcttaattttctcacagaaggccagttgagaaaggctcaacttctaggaatccagcaaactatattttttataagtaacatttttacagaactacttctaaatccttgtgttcaaatttactaaagctatattcacagctaaatatttcagaatttaaaatttaaaagactttcaaattagttccctgtagctgtcatgccaaggcaattagaacatatgttaaggtatgaggggtttttcttgttagaaggtcagagcagggcagagaagtagccccttgtatgagtgatgaagctcagatattgactcctatgctaaccataaagcctagtagtttgctcatttgttacctctctgaaacatttttttgggtgactacaaaacaggaattgaaaccttcaaaataagggaatttgaaaccaaatctttgaaaatagataatgctgcaactaaaaatttagttgaataggatttttacattaactctccctaatttacgttatgatatttgccatctagaagtgtttttaaaaaatatattgctggagtcagatgatgcatccattaatctttggggcatagaataatgtgaatctaaaattttcaaattatttacactactggtatttggtcaatgtaatttatttgaaactagatgcaatagggatggccaggttatttcagtagaacaactagcaagacttcagatgcatggtggagtggggaaaggaggacctgtttaaggaaactagagctgggaagtgtgagattaacttagtgccaatgtgaggacctaaaaagcagatgtggtggaaaatttaaacaggcttgcctagaaggtcaagttagttgatgacacttgatgagattgtcccaagctttgggattctcaacaaagtctttgttagtgagaaatttggaaagagatcaggtatagttaagaaactgggttggaaaggccaccaggaaaggcgaatattctgacacaaaatttgatcattttatttggaagcatttcaagcctgacctgaacgaattgtttagcctcagatacatgcataaaactgtgaaaagagacattgactcaatttagcttctttaacatgagaaactttcgtggaaaactagaactttacaagctcagctggtgttgggggcatcattatcttgaatagctcactggaggaaaatgaaatcttagtttggttctcaggttttaaaatatctatcatttttgaaaagtgtgaagtaacaaaatatgatctgattatcttattcctaaaatcctttgcagaattatcccagcctcaatcttctctttagtatttaatgagaataagaaactggaaatgactgaattggaagagtagactttaaatccatatcttgatggcatatacatttttcagttttttttctaaatgattaatgaggattctcaaaacttgagtatcttctatgtttcccttcaacataaagaaattgtatgaaaatattttaaaaatttctaatgattttatagttagctatcttgggaattcatttctaatcatgtacctcatccaaactccccactatggacaaaaataaaataaaaattattagttgcatctgaaggccacattacaatttctatgcattatagaaacctgagaaaatgtatcttaaaaaataaatgtgaacaactaaccataattatgaagaagaaaaatgaaaactagaaataaactattgaaaaatgtctatgtatcagttaagtttttattttaaaattctttatgtttatctctataatactattgggaaagagagaaaggaaaacctgactttgttctcatccaaaggaggtgattccactgatttagccaaaataagacttcctggttataataaataataaagtttttgatgttttttatatggtaccccactcactaggtgatcagacaccctcctgcaaaaaaaaaaaatacgtatgcaataaagttaaagttttatgttattctttcaaggggagaaacatctgtttaacacagaccagaatatttcaacaaagtcatcccaatatttatggagatcataaatcaagcgaaaaaatatattcatcaacaactaaacaaactacattaaatagtctcaaagcacattttcactttttttctgacaggaaaacaggtttcacaagtgtggagacattttaccatggcttttaacagtgaggaaggatgtttaaataaagggaaaaattatatggaaagctcagagaaaagagatgggtgtggcttgagtgacaaggtgagagcagatctcattaactgaaatgagagagaaggaaggaattttgcaaatatggaaagataactagtgcaagtttgaacagattatgtcaatcaatgtagaatttggctatctttttaatcaaagactatggaatattttataggtgtttgcttatactcaaagttttaaagaaataacagtatgaatttggttgaactaatttttttcatagataggattctcccaagttatatagcatatatatttcttaactagttattcttccttttacatatattgtgccacattgagtaacaactaacctgctaatagctattggtttttaaaagataattaatattagaaagtgatcatttttctgtttcatattaaacatgatattctgaaaaagcaacattgcctgaatgttctacattttatctttttgaaaacaggttttataagagatttcttgtgaaaagctgaacgttctgacactgaaataagtcagctaactcaaagctaagcttaattttttgacactgttggcatgaggtctcattcccaattttttcatttaaagccacaggcaaatgttttaacagattttaatccgtagtacaagcattattgatcttaaatttaaggataaaaacctgattttaattagaatttaatatgcattctagtatttacgttgtataattaatatttacattccatgattccactatgtaccatttatttctttttgaataaatttccagtaggagcagaataaattttcagtgaatattttatttcttgggggatatttttaaatggaaaatatattaagtttcggtaaaatctgttgctaatttggcagtggacagaatataaaaattggagagactgagtcattatgatgaattgggtctgacttttgtcatgacactggaaatttcccacaaatattatattcttcttttataataaatatagtcgaaatgaattgcagtcaagtatttgaagacccatctataaatttaggcggttactgttgatttttcattatgagagattcttccactcataagctactaaaagtacataaagaaggtctggttgtttgttttaaatgtgactgttctctatcaggaaaatgtcaggtatccgatgaaaatagatatatgaggtgccaggtatctattccaaacttggatatcacttcaattagcatcatctttttttttttttaaagtgtctaaggttagaatagtcaccagatattcccatgtatgaagcaattttctgcaaaggccgctgtggatgatctttttaaaatatatattctgggagacattgagtaaagagaaattatttaccagagaatgaagaaccgaggcccgattctttggctttctgccaaagatgctgaaggcagtgatgaatgacaaatacattaccaaggaattctccctctaagaggctgacaaagatctgatttttaggattatattaccaccaagaagataccccttgtcactgagcttctaatggaaatatggtctatactgaaacaattctcagttctttttctttctatctttttttgagttattttatcttccaaaaatgagttatttctgataaaataattcacttaaataattatgaaagttcaaatttgtgcaaatatttttattgggacatcttaaaattactctaaattcaaaaagaaaatatatgctttattaaaatttgatctgtaagctgctttgtttgtaatttaactattatataaaaattgtataatacatatattttatttactttattcctgtgttgctttggcttggtgagactaggtctccacattaggagttttactgaatgaaaaagtatcagaatgtaacatgactttgatatggcatcagaatttaataagatgacatttaataggaattaggggtaagttccaggttttacacttaaatacaaataatcaattttgcaggcacaaaatacttcaaacaaaatctgaaatcattcatttgacaaaacttcaggtttgcagttgacaataaatacaatacaatgcaacagtgcaatagtgatatctaaatatctaatgtaatcataggtaatattagtaagtgtgttatctgaaatgagtggtgtgatatcctgctttactttgtactggtgagttctgggtgccacctttgaaaggaataaagactattcatatctcttttataagacaataagaaaaacaaacaaacaaacaaacaaaaaaccacctcctttactttagctgagaaagaagttattaggtacagcttgacaagttcagctaagcatccaaatcttccaggaggttgttactacataaaatcaaacctttttaattcaactatgagcagggagattttatttttctttcgggtactaaagcttccaaactctgtttattccacaggaatctgaacttatagaactaagagaaaccattgaaatgctgaaggctcagaattctgctgcccaggcggctattcagggagcactgaatggtccagaccatcctcccaaaggtatatttagaaatcatttcatttccacccaatataatagacatctattttatttattaattacagtagaactgcatttactcagtgtcactgtgcattattaatacatactagttgtattaatagttgtattaatacatactagtagtattaatacatactacgttggtattaatgtgatcagaatcctagaattttagaacagtgacttccattatcagataatttttaaactgatcttaagaaatttggttctatagttgtatacacatctctctacttgattcagtggagatggagatggagtggttggttaatacatgcatatctgacttcaggcaaaacaaacccattaatgagtatgataatctagatctgtatttaaaaatgaaatagtcaatatgatgatatagtaagcagtgggcattgggaacaacttttcctggatggaggctataaaaaggtacatttcctgtagataattttgaaacaataaaaacaacgggtgaaaggtagctctgttttaaattattcctatgcttaagcaattctaaacaatgaaaggggtatttctgccactgcccctacccctgggttcaccactgaagaaatgctcattattaatatcgtgtcatttttttcctttacattggttctatttactcatttcctgacacttttcaatggccttcagtgagctcagctctttcccagcttaaaaaatcctgtcctaaaacatgaatgccttattatctctcttttcatttccagaagaattctgagaaaaattttatgaagtctttcaatgtcttcagccatctttagaccactggagtgtagctccttttccctccactccaccaaaacaatgctctccaggatcagcagaaacttacatgacactaaattcagtaaaacgtttataattcttattgtattagacagacatggaaacagcatttgatgctgatattcatttcttcctatgtgaaacatccggtttttctaatgttcgtgacatcatacattcttggtttttcttctgttcctttgaaatattttttcaatatttcttttgtaaattcactcttttgtatccatttgttaattgttgatatcctaagctctcttccattatgattctatgcatcctatttaaaatatatagaaaatcatctcatactctagctgtaatttttattaatgtgctaatagctaataactgtcaaatctaggtctccaggccaggctctgtatatccagctaccaagagagaactccacgtggatatctttggatgtctgttttgcatcttaaacctaacttctccaaatttgcacttgtcttctgtctcagacctgctgctccttcagtgctctttgcctcagtagatagcaccaccatccttccatttagccagaaatctaagtattcttcataactcctcctctcctcattgaataaattaccaagatccgttgatcccattccttaaatatctcttggatctgttaacttttctctgattttactcttgccatccatcacctctctcctgaaccatgaccacaaacccctaaatagccttcctcttcttaatcttatcctgctttacaccagtcttcacgctgaagccagaatagtcattaagaaacacatctacaggtatcccattcattgcctttagaatggaatacagactcctcagcatgacataatctctcttcaccagcttcatttattcaacaaatatttattcataaccaattaagtgccagatgatgcacatatagacttcttgttctgttgttgcattgcatattccatatttcagctatcctgaattgttttcaattattcataagttctttatgaattgtgttcattccatttggaatattctaccttgtttgatcagcataaagacttttcgagacactgcagcagcagtgaacctaaatatgtttccttgacccctacattgaatgacaccccctgtgatatgtttctggaagcagcaatacttcccttcttaaaattacattatactttggggcttttatttaaggtatgtctttcctgatttacaatagtagagcttgttttttcacccttttgaaagacatcaagatgcccatgatgatgtcttgcatgtaacaggggtttatttgaatttttaaaagaagaataaagtaatttttaaatgaatttcaatttaaattttaggaaaacaattatataaagtgagatatgcttaaattgaaggacaaagtagttctgtaggggctacttctttcaagactttagcaactttccatgtgggggagtgatttatgtgatgcatggaaaattactgcatatttaaagcttatcttagagctataataaagcagcttatgttctaaatcttcatgtcgtaaataggtccagaagggatttaaaaagccttaatccttactttaacacagcacaagtcactgaagtgaaacttgctgaaaggattccttttatgttaggcaacaggtagctgaatatatctacagaaattgaaaaattggaattcttttgctcagaaatgtgggaggggtggagcttaaggtaaaaaataacagttaatatctaaattgatcaagaaatatgaaaaaataatttgctaggttttaaaactaacaaaaaccatggttataaaggtttgaatatatataggatagttagattgtatttctgtaatattaaaactcagcattaaatttaatgaacacaaagtgattcttatcacattgaccattgacattacatggaaaaaatagtcagttggactaattatgtgtctttccatgggttattaaggtaattgtatggcatataaatttatactggaaatcacattgaaattcacttttagaggcccttaaaatatttctgtaatatatatttttaacatatgatcttaaaagatatatttggaatgacacaacagttttatagacaggcctgactatcacacaaccacacaccaatttgtgaatgtgtttctatttcctctaaattaatgcatcacattcattaacaaagtttgataaatgactatagtctataataaaatatttttgtttacaaacatatttaaacacctgctattaagtataggcattatcagatcttaaaatacaaagatttaaaaaattaccctgtggtcatggagctcacaatccactgcaaaaataatgtttgtgataagaaatttgaaagttgaaggtaatagaaaattttacctttatttttcaaaatgtaccattgctttctaagtcactacttctgtgtaaatatggaattgtttttccttaagatataccaaatatagttggataacgcatgtattaaaattctgtcagcactaagttgttttttagacatagtgataggcaaacatagttatattgaatgaaaaattagaatcaaatttattaaacactgtgtactgattgataccacatgccatatgcttgtatagcaatacaaggtttggaatttataatggtaaacaaaatagatacggtctttgtctccatagaacttttagtctagtgggagagcagaaggtaaaggaatgtatgtgatcattggtgaagctgaacatgtatacccaaacagttataagttccaagatggacaataatgggtgccatagggaaggagggtaccaaggaacctactggaggttacatagggaagattattccaaggtagtaatatttaagtgaatatccaaggaataattgtcaatcactttataagtactgagggaggagtatttcaaaagagctttgaggcggaaaataaattagttcctttatggaactaatgtaaggaaaatactaagcaaacatgtaataagaagaacacggttgatgagttaagaactgacaagattactgaaggattgtaggccatatttagaagttggattttttatctattcttattaaagtgagaagttattgaaaggtcttaagtgggggagtgatgatgaagtttgccttttaaaaaagatttttctagctattgtttatagaatggtttgaagatgaataagtccaatagctatacttgctgtaaagtttatgttggtagcttgaactggggcagtggtgacacagaggatgggagatggaaaatgacgagtgaacaaacacatacctgaaaatttaagtttaaaaatagacctctccattaattcagattgctgatattcattcggttagccattctttactgaactttatgatgccccatatactgaattaaatacttacaagcactaaaaaagaaattgttagggaacagtaaaatgcatttccttcatttcacaatattattaatattatggctttgctaatctttattggtgaatgcagtcataattgaaggtaactgatacttccaaggactacttttgacctaggattactatctttttaaaaatttagtattaaagaagtcaaacacaatttattaattctggatataataaaaattctgaaatactttaatactttgtgcttttctatttgtgaaagttaattattaggaacgagctagcaaatgctacttctttttcaaaaagctaatggccaatcacagcaaaaatttaaagcactaagaaatacctacacatattcttctattgcccatttatatgacttccataatagttgattaaaggataccggattcctttattgttgaattaaaacctcctacatgaaaaccttgatttaggtttagaagttggtaatgttttggcatgcaaaaccagttaatgttctcatcattactttttaaaacaatgttaagagatgaattctagggattataaaaaaaaaaaagctgtatgtgtttcttcctataaaatttttcagcatgattgcctcagtagaaaaattaagggacttattgatatatatgtatatgaaggtgaggatacacatatacacacacacatatatatgtaggtaaatacatatattacatgtctatcaatccatacatactcatttattatacgttttgaaagcaaccagttatagttttgttgccatggatcatttttactattcagtaaatcagtcaattgaagaggcttgattttatggtattagttttttggaaactgtcagctttatagtaaattttgacatcttacaacttccactgagatttttttgcttgactaatctgccttgatgccaataagtatattaacggaaatggactaaaagcaaatgtgacttgaagcacaattttgtaaattttcttagtgtctcagtaatacttaatactagtgcattttaggtaggaaaattttcagtttgttttattttaaataactataaatcttatagttgcttgtataaaagaaacagatacctttaacatgattaaatatcaaatgctattctcttcaaaatatcttaactaaagaagcactgcctgctcttagaagttaagcaaggccataccatatgctgcgtacatggcttttaacacaatggatattagaaacagcctaaggctgagactggctccactatttttcagctatgtgaccatgtgaaagttacatttagtaattaaactcatttcagtagtttgctttaagaataaaattaggtactccgggggcatatcaagcatattgtaaaacctagtttgattattatttgttattggtattactattactattctataataagtcatgggcaggcagtaggggtacattggaagaattgcactgtcttaaatatgtcctctgtttaactcacaaactcagtctacctaggctttctttggaggatctgcctttcattggctgtttgactttggccaagttacttaacttcttttcacttcagtttcctcatctgtgagattatgtgcttacatgacttcaggttttgttttggctctaatatggtatgattctatgaaatggaaagttaatacatttggctctagtaactgtatttgaagcacaaatattaaaaagcacaattaattctcattctgagtttccatttactcttttaaattaatcattcagaataaatcattttggaagagctgcttgatccaggtattcagtagaaatcactagcatagcatttaattttagacaaaactgagaactcattaaactgccagggctatggacttatatgagattctcattaaatcttaatgtagataactcagttaattaaaacaaatatggttgtactttattaaacttctaaagtcaaaactgcattgaaattatctgtacaaagccttgttgacctttattagagaactgcctctcaaaagacctaaaagacttatttgttcagatcgagactcttcatgagccgatgtgatactctccctctattgctagatcttcgcatcagaagacagcattcctctgaaagtgtttctagtatcaacagtgccacaagccattccagtattggcagtggtaatgatgccgactccaagaagaagaaaaagaaaaactgggtaagttaccatccttcatctaattcagaagcttattaatgcataatgtgttaggcctttttctttggggctttagtgatctgcagtagtttacaaagggtcccattcaagctactgagacctcaaatgctgcactcatcaccaaaattggagtggcatgtactgaaaagcatacattttaatgttgggactaaacttgggtttgaatcaccactatatctagaccttttgaggggcctgaattttctaaccaataaaaagacagttaatagcaactatatttatttgtgaatatcatttattcacagatgttatctaatttttctatagtataactatacaaactatgtagtataactatagagttatactaaagaaaaataagataacatctgtgaataaatggcttaaaataggggtttattgtgggcatagagatgaaggaaaagtgaaaaaatgatgatgatggtgatgatgatggtgatagtggtcttggaggaaaaggagaatgggagttaataaagggaaagaataaacaatgaaactctcattccacctttggaatcgacagggcttaccgtgtgaatagtttcaccctaaaagaaatcaaccacattagtgtctgcttgatgtttttaaccaagagaatatagcagaaatatagaaatgcactttaacagaactgtaccttaagtttgctagtgatataatttatgatattgatcaatagctaaatagcccaggggaagatactgttactgcgaaaaatttaaaaacaatggagtcaatgatttcttttaataccaaaaaaaaaatgtagattttgagtaaatacaactcttgatgaaatccagacataattatcagaggattttactggagtgctttctacaaataatgaaagaaatatctttttatcttaaaaaatgtttatacaggtaatattttaaaatactgatcagccttcattcccttgatttgtaattccacactctttcatgtttctgcaaggtgaactctagaggaagtgaggtgaatataaaccgtggacaatttggcatgcatctataaaaaaaccctaccttggcatgaatgctatccattttggcagtaggcttttataccttttaaaacagattaccttgtatgtcttttctttgtgtcttttcattttaatctcaaattttaaagagatgtaaaaccactttctgaatagagctgtaggggataccaattctggttttgagtagtctggggttggaaaatttgaatagaaaaatcacaattaatgaagtgttaggtgaatttgatttcattttgctttttaagtttgtactgtcagcaggacatgacttgattgtagcgctaaagtggccatttaaaacaaattgccttgaagagagaagcattgggaatggagatcccttcaaggtacttagttttaaatgagtgctctgacagccatgcccttgaccttgcactatttaaaagccttccatgtttgcgctgcgctggattaatacaagaataaaatgaacacacaaaacacggtatcattttttttttagagatactgtgctgcaattgttaatactctgcttgtacatactgaccccaggcagtggctaggatggcatctgcaaactaacgccccaaagcaaaagctctccaagtgcaaatagacaagaagggtaatttctgtccttgtttcagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgtaagttgctccttctgcaaaatgcagacatattttttaaaaacaattttagatgaaggccttatttatgttctaaccatatctgtaccaattattttcagatttttctgagaatgatggacagcattagtttctcttttcatatttctctttcactggtttctttcattttcatttttctttttcattttcatatgttagaattcaagtgtttcttgatctcattctccagttttctgaatcatgattctcacttcttttcatgggcatttgtccatgtatctgtctaactgtatgtacatacaggtcaccccttgtctggccaccaaagaaacgacaaaatggccctgtgatctacaagcatagatctcggtaaagtggagtgcgatgcatgaatactgcaaagatccaggttctaacctaagtagtgtttgcttttgctttttctaaaatcactcacatgcatttcaacaataaataccttctctttctgttttttcaactaaaatttggtttcctaaaatcaacctgcaatccagttttctttgattctattagttaatctaacctagcatttttatgatagcccactttttggtagtacagtagccccccgttatccaccaggggtactttccaagacccccagtggatgcctgaaaccatagatagcaccaagccctatgtatattatgttttttttttctatacatgcatacctacatatgataaaatttaatttaaaaattaggcacaataagtgattaacagcaataatagaacaattacaacaatattttctgataatagttatattaatgtggtctctatcttcctcaaaatagtgtttttttttttttttttgaaacaaagtctcactctgtcacccaagctcgagtgcgatgtcaagatctcggttcactgcaacctctgcctcatgggttcaagcgattctcctgtctcaacctcctgagtagctgggtttacaggcgtgcaccaccacacctggctaattttttgtatttttagtaaagatggggtttcaccatgttggccaggctggtctcgaactcctgacctcaagtgattcacccacctcggcctcccaaagtactgggattacaggtgcgagccaccccacctggcccaaaatactgtaatatttttggaccatgtttgactgtaggtaacttaaaccacagaaactaaaattgtggataaactataattgtgggggactactgtacaagaacgaacacatttcgaatatagaaaagtgttctggtgagataattctctgtgttatttactatttaaatctaatttccttgtatgcccatgacaacaactagcatagaactcatatagaacagggccactgtgctttgcctacataattttatcatttatgcagaaaggaagaacatgtcactgtcattttgtggccagtaaactagttgtcaaattttaaatggaaaatatgttagttaatataaaacaatttttttggcaaatttcctgcgaagctgtccacaaaacaataaaaacacaacaaggatacaatgtgtttccttcaaacagccctcagctagcctgctaacaggggctgaaacctttgatttagctgtgatctcctaaatcagctgagcccagtagggaggttatataactcacccattatttaaatgtccaaaagtaatatctctaatttattttctacaatgtttatattggatttttatggtaattaaagacagtattgtggcaaagctttttttttgcacaattttacaaaagaagaaatcaacattttaagaatgtaataactgctcttataaaagaatagtcacatgttgcaaatagaggtttaagtcccttgaaaatgttggaatgaaatgtagtaatctatgacttttctgcctataaatatcaccaataaaagaatttttaggattactttatattcagtaagagtagactatttttaaactttaaaaaatagaaaaaaagattaaaagaaaaagctacttccgttttgaacctgtgaatgcataaccgtttgtaaaactccttctccttttctctaggttttgccagcagcacaccatatctgtacctgctggagaatattgcagtgcagcctttaaaagaggcagtgcttttcttaatcctctggcttccccaggccactgattctgtttgtttccttcttcaggatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcaggttggtactgaagcactttcaaggaataaaatggagaaacaaaaaaatgctgcttattctgttctcttggttaacacagaataaattccacttggaaacccaccttagaaatgtactctgtttattcagtctttgcaactcatctgttagtactgaattgagaattttgtcaaatccaagtttggaagtgggagtgcaaactggcaagttgtattcaagaaccattcaggatactgtactagtaattggattcaggttgagagctaagcttttagagaagctactacaattcttgcttcttcacttttccatcatttacttttattttggctttttgcctgttcttttgaaatctgattttcacatactttcaccagttttctactgaaatacaaaagtaatgaggaaactatagaaattcaacacaagctttctgaatacagaagtaaaagtgatttagaatgccatctgtaaaagtaaggcttgtgtatttttttgaaaaacatctaaaggctaaattcagaaccagtctgtgctcagactaagttttcattttattattgtataccagtaatcacttggtaccacagatgactgcaataagaaaagctcattgctgagcagattcatctgccactgtatatgttcatctaaagacttttgttgtttttttatgagcttagtgtcccgattggaaggaaaaaaagaaactttttcagatgttagatatgattttggagtaattttaaatcaccttattgacattatttttgttttgctctgtctttcaactgtctacagatttataacaatattacaaatggcattatatgcttataagattttaacatcacctttaaaatgagaagtgttatgaatgatttcatcatatttttcttaattcaaatgagaccaagtcctcatgatttagttaaaaaataatgataagcatgtcgaatggttggattgtctatatttgtgaattcaggaatgtataatgtgtgagagagaaaaaggttaaatttccttcttgggaaggaaatcctatttcatatcttatatttctttatttaacatattaacatgttttatttaacaaacaagctaattaactctgataaaagacttggtgctattttctcaatcaaaccaactcagtttttttcatgttttccatcttcataacagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcaggtgatttagtgcacatgcttgcctgaatcacagcatacccatgagttaacgggtgggaagcctggaatttggagaactttacgtactcttaaaaatgttacactctaattctcagaaatagtcctagtttgatcttataaatctagtctacttagttataattttaaaagcacattctctgtccaaaagtcagtcttagagatatggtcttcataatatttttaagaaatcacttttccctaggaagtactttctccatgattctgatgatgaagaaatactctcagtgatgataattagtacttatggatataataataaccccaatgacttttattaagtgtgcaaaacccatttataagtgtagcaggctttattttctaaatctgacttgatgaacctgtgtgatgctgctctgagaaaacaataatgctactgtcacccagtctgcagctctattaaatttccaacaaagataaagaacacagtactagtgatggaacaagggtacagttttgatttgattgcaaatagaatcatatgacataatgtcatcttaatatctcatgaaccattcaagcataaagtgtagctgtttctgtggaacagttcattcaagagaatcatttcaaggatagagaatttagtctatataatatttacatgaggatctatggtaattgtgaagcacggccaccagatgacgcttggaaaccaataatatgtatgttcctagccaacgttagattccattatagaatggagatagtacactgcttgccttaaatcatattaaaatacagaaggagaaggagaagggaaatgacatggcatgctgatattgattacatttccaatgaatcacatctcttctaaaaagacagaatgttaaaaattctgctattatggctgctcttcataatataaaataatggccttcatcttatatgtaaaagacaagtgggcactccctgtaatttaagaaaacaacttttgtaaacttctggtggggattagagaaagaaaataaattctgagaataagcatcaagtacaactaatgtcagaagccaagtaaaaagcaagagatttcagaattaaatgaacttatagatcattaggtaaaataagactgtggaagtggatggtaatttgagtttgtaaattacacataaagtattatccacactcaacaaaatattctgcaaaagaaagaacgcaaatgtttaaatgtatagaatctggcagttctgaacaacatcctctatgttggcttgttgctgatggacctgacagagaagtgaagtaagatctacatctcataatgaccagtgcatttctggatcctcaggcttgtctcctaggaaaagacaaaggccagtaccttataggtcagactaatggtagggtttcactgccttttataaaattctgttttattttatgaaaatatgataaggtttgaaggaggcaagtttaatactgaaggtggtttagaaaaaacagacacatataaaaaaaacttagtatctaggaaaaatagaactcataaagataaatataaaatcaaagagtttaaatttacaatttctatgtttattggtcttaacacattgatggccatgattaagaatttaaggcaattttttaggaggagccaagttttacgtttttttaatacctttttttacccattccctaagttatttttaatatatcttatttccttaattatttttcaatagtgatacttatgtctgaactaaaaaaattaaatcacacaaccagaatattgttttcattactttcactcttgtggagtgggttcaacacttggaaatcaaaactgcctttatgctggggctttttaacagacagactttctaagtttcatgattaatcttaagataaagaaagtaggcaggagagaggataattggcaaatatctagttcctgaaatattaattgcatgttccttgcatccagtaaagacagacatttcagaagtcttcagtttttggccagaattttactcaattatagccagaatggcagacctctttaatttttccttcaaaatatagacagaggaccatgacttattttctagtaaaaaacaaaacaaaacaaaaacaaacaaacaaaaatacagaaggctctcacattaatcttgctgtttttcctggagttgtttcatcaggtgaccatcctgtcaatattctctgaactggggagattcggagtcatgatgtgagccacccacagtcaacagaaggagttagaataaacacaaataatggctggaagagcaaaacttagtaaacactgaggatgaagtgctttaaaagtattatcttttatgttctcaataactctaccaggaaggtgctgttaaagccccattttatagctgaggaagccaagacttaggaaagtgactgtaacaatttgttcaagatcatgaaactagtaagcagcagaactaataatcaaaccctggcttggatgaatccaggacctggacttttcactattgtgttaattttgctttaaatagccacataataaaagcaaagaatagttattcactcatctttggtaaatatttatcctactgttgtcaggagaaatttcatattgtaagtgtagtttttagaagtaaatatggcatgaaatgaataacatattccaaggcaaatttaagcagcttatgtggatcaacaatcaggccaacctcctttgctatggactacttggccatgtgtgatttggtccatacttatttccatccacatcatttcatactactcctcaccctccccttgtctctacattcctgctaccctaaacatctctgtgttcctttaacatacccagcttacacatctcagggttttgcactgtttttgttgactgaatctttttcccttgttcttcacttatctagcattcctcagccttctggtcttatctccaaataccacttcttcaaggaagccttccaggatgacctatctatctagagcaggctcccttcagttactttctgtttcattgtttggtttatattagcagagtgcttaaactattctgaaatacatactccaaaaaaacaaggaattcactttctttctcatcttggtattcattcccaatatgcagcaaaatttctgataccatttatacctaataaatattggtcaaatatttttgagcatttatgagtaattaagacaagtactaaagtaatttgatcacaaactaccagaagtctagatgtgaatagccaatggtaaaccactctaaacttcttaaaaaggagcaagataattaaaatgacacttaaggaagagttttatttttgagtggagtaggtgaaaaggtgaaagactattaagatgttaacttgggaaaataattaaactccagtgcaggagattatctttgatgatttaaaaatttattgcaaagctctaaaagttctaaaagttctcaagctctgaaagttgtttttaattgttatgatcttagagtatttttattgcttactttcaaaattacatatacttaattattaagataatagaaaccattctatttttggaggccatcttattagagtgttgatttctatgatgctatagtcgtaatctttttttctataaatttattgtcagagcagttgagtcctcttttcaccaggaacatgtgctctttagaatgtaatggagtttcatttatccacagaacattgtcttaatattaagcatggttctatgatagtattattattaaaggaaagcatatatttggaatagtttgccttaataattctccaaattggaaattaatctggtataatatattttgaaagttaatctttaatcaccatttaaaggctgatattttaaaggtagctaactttatcatgcttctgtaactcttagctgattactagaaatactattttggttttgaaactattagcataaaggattccggagagcaatcataattccagtataatgccacagttgaaattcaataacagtacctaataattataaagataaggtgagtagttatatagctggctgtgtcaaatgcttgaaaataatttcagttgacagtcaatttcagcacctttacatttataaattacatggatattgagcttggatattttagattggatagaaaaatcagatggctgtcagtttgtcatggttataatggtgactaaatattactcaggtattactcagacctatgtgtaatagaaaaagaaaattcttatttcctcatctaaagtcagtgagtggcccaacacttgagtgaagatctttgcaagcagaaataaattcttagattgaaactttagcccaaccacagtaattcatcttctggaaagctgaggcttttcaaatcagttaggctagaatgggaagcaaatcccattgaaagatataaaactatgagggagaaaagaatgacagtaaacaaatctgagctaatgttatactgttgtgtatgtctttcttttaaaatttgatagatattttgctagatgatgctggtgatgcaactggacataaagatggccgcagtgtgaaaattatagtctccataagcaagggctatggtcgagcaaaggtacttctttaatcttaaactctttattactaacaatgagaattaccatgagtcaagtgtattttatgtgtgaatatttgatctggtaaatatcctacaacaattgtggattggcattagcttaacatgtcatacaaacatgaaaaggacaataaaatgatgacatcatcatagaggtagaaatgtgtcttacatgtacctcacattcattcactgaaaataatattaacagcccctcatttctaaaactttaaaaaatagttatttctttggcaaacatcttgtctgacatattcttttggtttcacttatttgttataggtaatgtttatgatgtgcagtcgctagagctgtcaatatggtctttatacaaagggaagactctaaactaaatgaatattttagaaatcagaaagacacatgttctactgaacttggtaggacaaattccattgatgttacttgtctatttaagcaaggtcctagatgaccagacaagtattttaatttttttgcaatgaaatattgccttcaaattggcaatgccattctgactctatccctttcttaaaacaacaacaaaaacaaattttaagttaaaattttagttgagtggccaaaaatacaaatttctaagtatccaatttttttacatcaagcaaataaaaattctttagaattttaaaataaagtacttaagtttgaaaagtaagatagcacttgtgaattcttaccttaagccaatgttccaaggattccaataccatcaactttctgcttgagctgcagatgtgtacctacttttcccaagtgggtctttatgtgagagacagtaatactcttagtgaaacataaactaactttgatttaaaagcagctttttataaggtattgcataagcagtaattttaactgggttataaacacactgaaaaataagatttcctgttcacagtaattctaacagacaatgcctttgaacacttttttctaaaaaagcttccatgaaagtacttgtcttattctacttggacttccataataaaataacagactaggtggcctaaacaacagaaatttattttctcacagttctggaggctagccagtctaagatcaaggtgctagctgatttggttcctggtgagggctctctttttgcattgcaggtggtggaattcatgctgtgtcttcacacagtcttacctcagtgtctgtaggtaggaagagagaaagactacaaatcctgaattatctactttacccagtaatcccatcatgaaagtcccaccattatgatttcatttaatcctaattacctcccaaagacctcatctcctaataccatcaatttggaagttagggcttcgatgtatgaattttgaggagacacaaatatcatttcataacaatagtaacaaaaatcacaattgtcagctgtggatttctcaacttattctgcaaaaggtattagattctaactcagattatacctgaataattttgataaccatttatccttatggtgctaaatattacatattaagagattgagggtctgagccagctaagtgatttacctaaggtcacatttcttaattaggtggtaggtattatgtgttatagaatccatatcttctaactcatgactcagtgattattctaccacccgttaatgataacatacttggtgactagaaccaggattataatatgtcaactatctaattatatctactggaatcataatcactatttcgttaaccatttctggtcatcataatagaggctctagctagactacaaattttgaattatttacctttctaatatatgtagaaatttctcaaaatcccatcctacaaaaaagatagatttggaaccattatgtttattataaaataattacttgtttgatgaaacgaatcctgtaggtttctctggcaaggtcttttaaatagagaatttctgataaattcaaaatggaacctgttttgtaggtatgcaaataccttatattatcatagataacacattttaaagcgagattggattctagattaaaattaataaaacaactgagttttggacttatcaaaggtaagatcacaaaatagtaagataaagttctagaattcatataatatggttctgttctgtctctctcaccatttccctcctaccaagctgcttctctttaagaaagtatgcactgcattataatgcaagagtattctttcagattccttcacctttgccttctacagaacaggtcatggatcagttttcctcgacatgctgctttatctcatctctttctttcttgttgctgttgctattgctgttactttatttgtttggttggttagttggctgaaatatgttttatgttatataatccaccatgtgtgtctgttactatagaagccacaggtttaacaaatagtttagtcttaacaacaactacattaactaattttagtagaaaatgtagtaataaaaaagatacacggttggattttatcttactttattttgttcttatttaggaccaaaaatctcaggcatatttgataggatccattggtgttagtggaaaaaccaagtgggatgtcttagatggtgtaataagacgtctctttaaggtatgttgtgcaagacaccctaatagtacttttcaaatatgtttctctttaattgttttccataacttcaatagcagagacacatcttcttttcctctcctcaaataaggaaagctttctgtttgtgctatttgatattaacagttcttatattacccatttctaatattcttgacaactagctctatatccctgtgagttatgtatttgttgtagatgagttgaacctctgttttgattttattttttgtgtgtaccattgtaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggtaaaagcaataatgaaaagcaaggcagaaatataatttttagcaacattttattctgccccccgcccctttttggccagtttcccttaaaatttttctatttgaaaactctgtagtattttaaaaatcaatatgactcatttcataccaaaactattaaatactacaatcctactaaaaacactagaatataaagaaatttagttctttgggttctgggatttgaagattcaagactcacaaaaaggaatgtgatttaggaatttcaaatttctggattttcttcattatcatccttcattacaggaggattcaaaacatttagtgtgtattccaaagttacatattcattgatatatctttgattttaaaatgtgtatgcctaataaataccccccaggaagagggaatagaagttaagaatcaaggatggaaagttctgagaattttctttgctttagatgatgtgattaattataggctaatgtaatatctgaagcatctttgtcttcacaattccttgtttatttatgttaaagaatcaggatacatctatataaactgtgagttaatagaggaatttgtcaatatttgattttatgatgaaggtaattgagttcgtaaaatgagatactgttgctcctttcttaattccttgccaaacgtaacaatttgtattcttcaaaagcttgagtggttgtacaactaggatgcataatgagagatagaagagaataaggagatggggtgaagagaaagtaaaagaaagaacacacacacacccatatatatatatatgggtgtgtgtgtatataatcttcacatttattcttcacatttattcttatagtcttcacatttattcttaacaaagataatcatcttcaataaaagatgttatgatagcatttataatgcttccatttctctctggaaacataaatgaaaacaagaagtagacagtggagtgaagcctgaagaaaaagaaacagcttgcttttgtttagatgttcactctgccatattactgatatattttcttccttgaaatggcaacgcatatttgtgggatagaaatatctaggaaattatttttcaaggactctattcctatgactaacaatgctgttgctgtttagcatgatattttaaattctagcttatgtagaacaataaatcatgctatttttttgtttcttctttcaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggtatgttacagaattctaagagaacagctacaatttatccataagtgttttaagcaatcaaattataagattttgtgagacttccatgttgtacatggaaaagaatatccatcttttttttactagaattgtaacctggtgagtgatcaaactctgtttcatgaatttgaacaagactactattttcagtaacattcagttatcaggtactccctaagatattgggaatatacagaataatatgacaggtctcctatggcatggtttctcttagacatccacctagaaactgttacagtagaaagaggtccgtgcacaagcaacaaggaagaataacttttcttggaggcatcagagctttataaaggggtaatagtttgttggatcttaatagataagtaggaaataacatgggttttgcaggaatggagatttggcaataattagaatattccaagcagatattctgggagcagcaatttgcttatgtcacatctccctaaaatttttgtttaggaaccttaggaaagttaacaacattcaatttcaccaccatctacggtctaatgtgccatagtaatcagcctgaacactcagatattaaaaaggcatgagggcctatacggcgtagcctgtactttcttattttctgagtaaaacaaaaaatcctaaaaaggaaatagttgatggctaacatatttttaacactaacctagttttacctgtaattatttattaaagtctgaatcaatgaaacctaaaagtttctgtcgggaaaatgcaactattataagcaataccttgagggaatcccaattatactgggtcatattactctttcaaggataacctggttcaatgatctaaactgtcccagtttctcagaaacctgaaatctgcaaattttcagaaataaatgtgactcccaagagcagcccaaacccattagattcttgaaataagccaggcatatagcttaatgaacaaaaagtattaattttctcacctgtaaaatgagggaaatagtagggctattctaaagactaaataaatgagtgtgtatatgcatgtgtgtgtctgtgtgtgtgtgagagagacagagagaacagcgcaagtagcaagcacgatataagagttgcttgcaatttttaattatagcccttggctcccagtgaagatttctctcacaagcatacacacacatatgcacagtgcacgcgcacatacacatacaaccacacacacacacatctttgttcaaaaccgttttatatgtgtccttcaaaaacaacgatgtacataaagcacaatgggatctcttaaagttaaataaatgcaatacataaattctgaatatttccttggaactcagacctattcaaatgtggttgaaccaccatctaaagaaagacatagaacctgaggtagagtatttggctcttctctgagcaaaagtaggaagagcacaattgtctgtttgcttcagctgacatgtttaatgcttcctgtgaattctgtctcctcatatctttatataaaagccttttagcacagttttaaatattttcagccaaaaaatatgaaaggtttgaaaggcctcttagtcatcctcaatgtttgttttttcctcaatgttggtatgacaaaactctttacaaggtactttttttatggaataaaaaagtgtttagaaaataagagcaaaatagatttattggaggagaccatgacattttgataaagttgaggatcacttaaaatcgttttgaattaaatagatgaagtttcattagaatgtagttaacatgctaaaacaaaataggtaattcccattaattttaaaacatagctttccctaaaaaatatctatctgtctatctatccatctatctatatatgtatgtatatatttcagcttaggaaaaaaagtttattgcttagagatgttctgttaagaacatgttagtgtcctattaacttttttatgaaatatttccgacactcttattttttgctttttcagagtacaggctatttgtgccattattaggccagttcagtacttcattgcaaaataatgggcaggggaaaagcattgccaagcattggcagagctaatgatgctaggaaacagtcataggaagaaactgtttttatttttttattttttattattttattttatttttatttattttttttttgagacagagtcttgctctgttgcccaagctggagtacagtggcacgatctcggctcactgcaacctctgcctcctgggttcaagcgattcttctgcctcagcctcctgagtagctgagactacaggtgcccaccaccacacccagctaatttttttaatttttatttttagtagagacggggtttcactgtgttagcaggatggtctcaatcccctgacctcgtgatccacctgcctcggcctcccaaaatgctgggattacaggcatgagccactgtgcccagcccagaaagaaactcttgaacaaatcacaatagcattcattcccaagaaaacacaaattataactaaaaaatatttattttttatgttattccttatggtttgaagatatgaacaagctatcagtaatgctgaatacaaactcgttgccagaaaatttggacaatttttgccaaattgacagagaatacccactattttcctgggagttgggggtgagggtaagtgaggataaatataaaaaaagaggggatgacaagttgagattgtgttagggataccaacagtgtagatttactgaagtaacatgataatgaggcatgaaataataaatcctgttcctgaaaacctggagctgtgtaaatgctgacgcattttatgctgtgccatagatagcactgaagagacaaatccaaaaagcacttactgattcagaaaaaaagaagaaactcaaaccacaaatcatcaaatgaaaaacatcttttcatgttttcagtacctctgcactttacattctgttcctcttcccacacttcaagccctccctcaagctgccagctggaatattttgattgagagcagtacacataaacaattacactttgtgacattcgatatagtaggcccagagggctagaggtggatttagtagagaatacatggtcagctgaagccatttggaatgttaggctggaaaagatcagaaaactgtacctgatagattcctttttagtgtgtctggagtcagcatctgagaaagcagtgatctaccatttttatgtaactgtggtgttccacctgtagtttcagagtatgggattcatctcattgccaactcccatctggtagatatgcctgtttccttctacctgactagatctggaaaaaagacttttaatgccggtgcatcagtgcctcaatctaagatttcattttcatcaagctagagtgggtatcatgaagttatttcaagggaatctgtgaaaaactcctctaagttataggaaaaaagtttatttatgtttgcctgtttctacatccattgctttatacctaccatcagattcccaggggatccactaccctctcaagatgaaagaaagccacattataattagaacctaaaggctctgattgtccaaaaatgacccagtgacctgctaattacaaaactcaattcctttgtgcctccccactctctctctctctttctgacattcatgttatcattttctccttgtttcctgctccctggtaaattgcttttcagtttttttctctctgctcttccttcacttcccagtaaatgaaactgtttttctttataatgaactattctgttctctctcacttttattctcctttggatgactcttgtggcttcaacttggcttgacttgtgtggttgacttcaattaaacactatcagccatgcccattctcccaaatttgtaagctttctatcatcctacacatatgtttctattcacctactaaatatacctgttgagaattgacaatttcagccccaaacacatattataagtttatcctcttccattgctttccaacaaaaccaccctccaccccagattaacatcctcctctgttgtttcttggatttctacaattattttttaactacttgatacacgatttcctttaaatttcccttctctctttttttgggatatattcattcacctcatggaacatagaatatcttttcataattaaaatctgatcaaatttttcaatgttttcttatagatttctgtactacatcaaaaacatcacgttgttccttgttcagtcccttagtatctctaggcttcaataatttcaacattctcttggctggtcttgcttcttcctttcaatatgctcaccacatgttaaatcaccattgtgactacttactcaggtcaccagaagaatgtttcttcactgccaaaaggagatgtccagcgatcttactaatcatttaaggttgcagtttcctttacaatttcattaccaccatttcctttcacaaaacacatattcttagcttttttcctacatggatatcatattttcgtgtttctgactggttattcttctctatttggaaagctcttctgttgtgtttaagcatcaaggtattacccaatctttaaaataagggaataatagcaaatcatactgccaccacagtacattttccagacgctacaatcaatctttacatactataaacaaaatctttgatctatacttttttgaagtagtgtattattttgactgtgaattattgttatatatgtatatgcctgaccttctattccaggaaggtaataagcttcttaaatgctatttccttttctaattaattcttctatctttcacatttctgtttccttggataaataaattgctttcctctactgaaaacaaagaagcaaacaaacatatcaatgttccacacttctttatataataaaatgcaacttcttctgcatggattcaaagtctttttttcttttttattgccaccaccagtagcatgtactatatttttctataaccacagaacacttatttcccaaaacacatcatacacttacacttttcaggtttcactttttattctttagatttcaatcctttttattattattattattatttgcttttttttcccttttaaccactgtactctgtttttctgtgaaccttaagtctggattagatgcctctcttatgtctccctataatgttttgtgcatttcacttagcacactgtattgtgaatcacttgctcaccagcttctctgcttatcaactctaagtttctgaaagacagaaattatgttttatctctaaatccctggtgccagcaggatgtgccagttggaattaatctctttccctcctataggccacatgcctcctttatcctctctcatggaatgttttaccttgcattttgtaaattcatcattatttacatgtgtgcctaccaccccactcaggctccagtgttacctcctccagaaaaccattcttgacacccagcagctaggctaaatctcttcccttgacttctcatatctcataatatatttatgatattatattgatatcatttgtaacatttaaattccagtccctaatgtgacaactcttagagcttgcaggggaaaccagcctgattaccctttttagtcctcatgtccggaaaagtacttgatgcagttcataataaatgttaaacctacttaaactccattgatagcaggaatcagacttcactatttttgtatacccagggcttggtctaaggctatgaacgcagtagatagacagtgcatattttataaacgaatgaatgacttaatgtagctaaattagtgacataaattttattttttcttttgaagtaaatagaattctccagaatattcaacagttttaaacatatttttttctgcattctctgacttaggcaagatttattttatgtgattagctcaatagaaaacaaatagtactttatttccttaatacatttttatatttgaacataaataaaaattactaaatgcctcaaaatcctggcccgttgttttatctcctacttttatttccagcagtggtgttacagacagagagaggttgcatctagagtgagcaattcacatatttacctggctgccagaaaccaaaatcatggaattgttttataaccctgagcacgatttgcaaattgaaaatgtcattgtaaatatgcaaatattatggaaatgttcttactgattaggataattttaagaaacctaattatgttcctggcctacccatctgtgagagcagtcaatcagcaaactggttatcatatttagattaaaagctattagacaggaataatacctgtaaaagaaccaataaactcaggagatgctaaattttgtctttgtttaaaattacagcaattgcatgcagattataaataaataataagcatacttttatcaaggtcctatggctgtacttttagatataccccatctacctgaattagaattaacacattaaaaatattagtggaacctgagaaatgccattttgaatttagttcatacttgaaatattaaggttgctaaaatttacttttatcattgaataccaaaactcagaataaaatctcaatatatgtggtttatcataagagttcatatccagaactcattttggcttttctttcagggagaaaaccacttagaaatatgccgtcatgtttatacttttatatttgctgcaggtgtttggtactggatcttctattgctttcctttttcttgctttcatttaaaaaaattattctgtcagcaatatatggtttttgatttgtaggaaaagattttacatcagttgaataatctatgactttaatgaaagaaacggaatagaggacaaagagtgctattcctaaaatattaactgcttcctattagtataaatttatcactgacgtatctgttttcttcattttttaaaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatggtatgcttatcaaatattctgaataatgaaatatgaaataattatcatcaaatttgccttcttgtacctgtatgcatttttaaaatttgtttaatatttaatttttattttttaaattgacagataaaactgtacatattgattgtgtacaccatgatgttttgaagtaaatgtacactgtagaatgattaactccagctaattaacatgtgaactacctcagtagttattatttttagacttacaatggctgtcattaatttgagaaaccctctttaatattataccacagttttaaagactccatatgcattccttagaatatctatgtattcattcaacaaccatatcccaggcactcttatggaaacattacttccttgatgatgttagcttctgcagacatgatgaacatttgcgaaaccaacaacaacgttggaatagttttaatcaggaaaattaaaaactaactggagcctttagagctctggtttcattctcagttcatattaaagtttaaattcaacctttctatagagataaacttaatatattcagatatagctccctctattaatgagtatgatttttaactatttacaataaaaggaaaggttaaagtaaggtattaaaaaatcttaaaacccactaaagattcattgtggcatggcctctaaagaaaggacatataagaatatcaacataaaataaatagttttaatagtgtcaaatattccaattatctctgctagagatttttggaagttacaaacgatcagcataaaataaggaatgaaagaatacaaattttctcacaatattaatattctttaacataactatgaaatattaaaatagtaaaagttaataaattttatcataagcattataagatgttagagtgggacaaaacccctatgattatactaactaaactctttactcaaatactgtaaattacaaataaactcaggctcggagagagaaaatgccttgccttgattccagaactggaattagaaactcaagtatcaatttctagtccagtgatctttgtcattttccattacagaattaccctttaaaagacaaatattgaaatggaataatccatatctatcctagtagttttccaagataattttaatgaattaatcacttttacctccagtaaattaaaattttctatttatttttttctagtccatatattattggaacaatgaatcagggagtttcttcatcaccaaatctagagctgcatcacaatttcaggtaaagttaagttgaaggtttttttgttttgtttttttgttttgtgttggggggggcaggggagggggttggcattgtttcttcctgtttgtttttgtggtttgtttttccatttgtactttgacaaatcttgccagagatgacctgtggtgtgaaaataattctcacttctgacactctttctcaagccaacgttttgtgatcttcaacctgtaatcagatgtgtttctttaaacaaaaacaaaaaaaaaaaaaaaggaaagaaaaaagaaaagtaaagtagatgttttttctgttcactatgtccctggttaaagtagagcatattccttctaagtgtgagaaatgtgaagagagttgctatttcaggatttgtgattctcctacagaagagtgatcagcatttagactcccactcacttctgacgcacatgagcttctttttagctcaaaaagtagagttagctacattatagctctcatcctagtagacctcctaacacctttgatcatgaaaaggtggccaccaattgaaatgggaacattattactttctattggaaagtaataatgaataaataaataataatgataaagaatcactgtgaatgtaaaatttaatttatataaaaatgtctgattttttttctttttgtaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtgagttccaaaattataatatgccattttccaggaactaacagtgcttggtaaagacggccagattggatggtagaaaataacaagcaaagctaatgcttattcaagcttccaaagatttatttttttcccttctgaaagtttgcgttcttcttctttgtatctccaattaaatccattttgtcttgacagttatgttttactaaaatattaccgagatcagataagttcaatatgggcaaatatctaaaaatcagataaccactggaaatgaatagtatcgatttaggatactttttatgctaaaaacaaatttggctaaatagctcatgtcaaataaagttgtgaggaaagatgttagttacagataacttaaacgctttgtagataatttaagtgttttgtgtttttcatgaagacaaaactgttttgagttatttctcttttagtttgcataaagatatttacatttttattccttctttaattgcatgtacagaagtctctttcacattgttatgcatcataaaaatgtactcactgtcaacacagtttagattaggaagaagaattctacactgggaccagaacactcatgccaggtcccaattctgcaaataatgacgtgttttatatttggcaattcatttcagcacagctttattgcttgtaaaatgaaacaggataactgcattatgacttttatcatttctcctgactctagtatattgtgccctagattaatatttattgtaaaaagatagaataggctaggatattgggtcttcagtaaacatgctttaataataatcaagctggccaataatacaattttctaggaattttgcaagaaatatattatattccaaaatggtgtctagatatgtgtttagattattaaatataactcttaaaatattttgttatttatttcttatcaggtccccgactattccttccttgccccatggatgtagaaggttctagagtatggttcatggatctctggaactattctttagtaccttatattctggaggcagtgagagagggtcttcaggtatagtactcaattttcattgctatttttttttaaaaaaaaaaagcaaaaaaaattactttaaaagcaaaaaaaaatatctgggtatttatgcagaaaactaaaggcatgaactatatgaatagagcaataaggttttcaagagcaaatagtttgtaatattttgcctgttctgagaacaaatttgtaagagaaagaaaaggcacagttatttcaacaactatacatttaagtccaaatggttgtcatggatgtttacaggttgtttttattagacagctagttaattgcacagttctacatcttatgacacagccatgtttacatgagccttgaccatttatattcttatcacataatttcctttatctttttcttcttttctttctccttccttcctcactccctccctccctccctctccccctccccactctctctctttctctctctctctttctttctttgtttcttctccttcttttttttttttttttttgagacagggtctcactctgtcactcaggctagtgcgcagtggtagaaccatggctcactgcagcctcgaacttttgggctccagtgatgaggctttccaagtaggtgggagtataggcacacaccaccacactcagttatttgtattgttattattattattttagagacatggtctcgctaggttgctcaggctggaattgctttttcctttttttcacataatttttgacaagtagcttttgcttgtaagtttcctgtttttagtatacttcattgttggaagccctttaatgtcacttgcaggatcctttactattttggagagagtactctaaattctaagagagtcagttggtcttttgatctatgacagattggtttcacagcatctttgctcttcctttcatgtgccttctatcttgaggccctgcaaccaaggcccttctattttttcctaactaaaagatgaaaatgtatcactaaaaaaaatccctacttctccaacaaaatacatgtcatttttccataagtattgctatttccttaagtttgatttgaaattgtagaattataaaactctttaaaatctgtgtaacataatcacccaatttattgaggaaggatctcatctccttttcagtaactcagccaagacatctctatttctggtttttacaactactattagaattaagatatagtttatgttttccacattcagtcatctacaatagtgtgttgtctttattttgctatctaaaaaaattgtccatctatttttccctcttttactcccttttactgtcaggctctctttatctattgaatggcatggcagtatttggaactaaaatgatagttctggtgaacatgatgaattttatgaggatactctgaagcctcagagataaagctaagatcctaaataatgctattgattggttctactctagatttaaataaccaaatttaacacttttaaaggtatgagccaatctaccccaagcagaagcctccaataaaataaaagcttatacagatgtttttatttttcaagtataacatattgtgtttcagaattcttagaaaactactataggatatacattggatctttcaatgttgattatttgtaccaaaaaaaatcattttatgaaaattttagaactcataattttgaagttaatatttcgatacattatttgttctctagctatggttttggttttaataaaccattatctaagtatttataaataaaattctcctcatttaatatttgtttactaatagaaagcaaaggaatctttgtaaaaaccttgaaatgataatagttaaaatgcttagcatccttaggtcttatttcaaaaggtacatgggttcttttttcatatttaaattaatattatttatagaacattatttggagaattataattctatgaagtttccatttgggcaaaagtataatcacttaaggattagtttctcaaactaaaactgagagatatttcaaaattatttttgaagagggataaaaatgtctcatttcttgctatggttcaggatgtttagaagtaggttagtgtgaaagatgaatcaaccgtgatttagggctttttgggggaggggaatccagcacatgggaagggaaaaattggaaagtccttttgtgggtagacagttttcattgctattgaagactatgctgggccagaaaagtctatcagctgaaaatatttctaggggagcaagaagcaaaggaattatatctgtcgtgatccattcccatggatttactggcaacaaagaatcttggattggagaaagaagtggagaaacaaagcctggtagcaaaaatgacactcttaagtttagagtaataaaataatatcttcagatgaaggcggatttttttggtgaaaaaccttatggggaatgcactctgccagatgttttagttggaaaaaatgttggtgatacaatggattttgatttttttctggtggattctttcttaactagtcagctatcaattcatctcattctgaatatttagagttctctttgttcaattattttttctacaatatgtgtttcactcggaaatatagtgtttggcccatttagcttttcactggtctcttccaattttgctgtcctggatggttctttaaaaacctagaattaattgattctagacttacattaaaacaaacaaacataattaagctttccaagaattatacatgtttttcttcaattggtttaagttgtgtagcatgctatatgttacatctataaagtaagtttgtaactgagaggaaacttttgctctaaaacaagataactatttttaaaaaaagtataatgattgtacctctgttaccatctcctaaggaaatgcacagatatcagtacctagactcccttttattttaggtaagtccaacttctccagaagaaactcaaaagaaaactccaaggcagtccatgaagtttttatggtgttaatgtccaccattttcccttttgtctttactgaaccaaaacaaactatacaaaacagccatctaacaacaaaccaaagtatgtcatctgagaccaaataggcacctactaaccaggattgtccttggtaaagcaagtcaaatggggagggaaagtaatttaaggaaaaagtgtccctatgttactgcccccttctcttaattttcactttttttctgtgcccttgtaatattatacttttttttttttttcacaatgtctcattcttctcttcaggctgccctttctagtttgggttcagctttgcttgcagcttaaaaatgtttaacatctcttggatttatctgattcttccattccactgccagtactttaaccaggctatatcagctcttacttattgggcaaattgcacaataagggttcttgcaaagttgataattcagtttcctattttttatcctcttttactagtggcctgaaacacaaacatctaaaaagagtttttccaaacaccgcatgttctcactcataggtgggaattgaacaatgagaacacatggacacaggaaggggaacatcacactccggggactgttgtggggtggggcggaggggggagggatagcattaggagatacacctaatgcaaaatgacgagttaatgggtgcagcacaccaacatggcacatgtatacatatgtaacaatcctgcacgttgtgcacatgtaccctaaaacttaaggtataataataaaataagataaaaaagagtttttacagaaagcaatgggattaaagagcaagttgatcacaggaaaattgttatcagagaaagttttcctactctaaaagacagtttgagtagagtgaattaggcagagaaaaataagttacttttattttatttccatctttccaaggtacactttagtagagaactctacttaatatcaagcatattttttaaaatcttccataattgaagcttttatttttcaacctttagttttctcttggtttgtcaaattactagtaaatgtgggcagtcatttctatgtttatttataataaacctcccgtatattctcccccaaaagttgacatctattccaaatattcagcttcattttgtctagccttcaagtttaaagtgagctatgtagacagatacatgttttaaatctgcaaaactgtatacagatacttaattctcttgaaagtcccttaagaactcaatatgtcaaaaaatcacatccaactagcagtccccttttttgctgaatagaaatgcattttatatatatcctaaacgcgtggtcaacttttagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctggtaagaatcagatgttcatttcttcctatgtaatcttgactacagtgtatagtcattaatatttagttatttctagcgaagacatttgttatcctaagcaacatttggaacagttttaaccctattatctttggcctgctttccatggatgaaaatcttaaagtgaaaaccaaacttgtatgcttaaaaagaaatcaagaaatgctacaaccagaatgaactcctagactataatgtttctcttattatgcattaaattgtgtatataattaaataaatataattttctatattatgactcaattcaataggcatttaagagaaaactcaatttttttcttaaatagaaaaacaaaagttatggtataatgtactcatggagaactaaaaaatattttgcctatatcaactaacctgactaattttatagaatgggtcttctcttgcctactgtagcaaaggataaactgacttggaagtcaaatggaagttatggtttatttactttctaaaatagtggaataattgaaataaaagtctgtaaaactccaaagtatgaatattctgaaaattttaagtatgtagtattattaggaaaaaaaacactttttatatatctatttttatttttacagattactttcaatatattggtatcaaatgtgaagtgttactaactcaccattctatgagtatagagcttattggacttttacaaccagtacagaaagaaaagatactgaaataaaaattcattatgttgcttaaatcaaactaagacaaaacataaataattaaaaatcataacctatggctatacctaaggatataaaattacttgatattttaaggaatacccttacaccaacaaccctgacacacacatcatcatcatcatcatctcagctgaacattttgggagtttcttgtggaaaacctgataaactttcaagatcctttacccagcaaaatgcatacacactgaaaatttggcatacaattttaagagtttcataaaatcactgaagtatatatatagacctacttagattccagggatttcctgctgatttctgatctaggcgatatcttccttaagagcccagacttatatttttataacatggtacctggccttttagatgattcatagttaggaatcaacagtgctgatgaaattggtttggattcagcataattgtgagcatatactaaataattgctgatagaatgattaacagagtaaatataagctttagaatatgagtatggattatttaatctgaattcctcaaaaattccagtcctacctctgcagtttttatataatatgtctgttttataaggagaggtgtttataagatttgttctcagttttagtctgtagagtatgaaacccttaggaaatgcccacaactttcccaattctcatagtccagctcagctcaccccataaagcactttttttcctggttctgaatgcacttgtcttctagtagaggaaacaaattcaaggttttcccttctggcatgagaattggggtaaaaaaatttcctggttcctaacctgctgctctattaaacatcttaagaaacagggagttatgaggtcttacatgctaaatggtaaaagacgtcatctaaaactaaatatttggcaggctttctctggttttaaaaaaataaatatttctatcttttttctttctttcttactttttttttttttttttttttgagacagagtttcattctcgttgcctaggctgtagggcaatggcacgatcttggctcaccacaacctccgccccccgagttcaagcaattctcctgcctcagcctccagagtagctgggattacagtcatgcaccaccatgcctggctaattttgtatttttaatagagacggggtttctctatgttgatcagactggtgacgatctatctgtttttatttctatgtatttttgtaattactagcatgaagccaacatatattttcagtccattctaaatcagaaatcctacaaaatatccactatttagtgtcaagaaacatccactatttagtgtcagaaatccccatagcaatgagtgtagcaaagaaacagggaagaagagaggagagagactttttgaatctgaatgaggatgcaagtttttggtatatctcacattattttaaaaatacaatgtgtattcaccattaacaacaaagagaatgttaataagtatgtccttaatgctaagacctggtgatcaggagataactacagtatcatttctgatctcaagaagcttaaaatccagtagtgaagagagacttctacctatatgaactgcagtaacataatagaggcacatattaagtaaaattgtgagttcattgaggaagcagttagaataaagctttacagaggagatgcttgagctggatcttgaatgattaataggagttcaccatatggttgcagggagaacatccaaaattaaagaaatagaatgtgaaacattagaggacagtgtaatagaaatgatgagtttagggaactatacaccagttggtggtaggaattaaaactgtggaagtatacaattgctagatcatgctaagccttgtttatcattgcaggaagttaaaacgttatcacagagacagtggagaactgtcaaaggtgtttgagccatgatttacctagttagatctgcagtttctaaagatcactttaataacagagtagagagaggacagactgaaggagataggatggaatctggaagcttagcagattagatggtaccagtgatgataaggacttgatcaaggtgttagaaatgataaacattaaatttatggctatagatgccctattccatttagtgttgctataacagactatttgaggctgggcaatttgtaaagaaaagagattcatttggctcatcgttctggtggttgaaaagtctaggattgggcagctgcatctggtgagagcctcatgctgcatgaacttacggtggaaagtggaagaggagtgggagtgtgcagagaggtcacatggtgagaaaagaagcaagactctttaataacctgctctcgcacatgaactaatccattccctccagagtgagaactcactgacccctaaccagaatgccattaatctgttcatgaggaatccacccccatgattcaacacctcccactacgactcacatcccaacactgccacaatggggataaaatttcgacaagagtttcggaagtgatatatcacacgcaaaccatagcagtgagtgtggggaagaagtggggaagaagagaggaaaaatattaatactttttggagaattgtgatgtatcacgataatgactaaatcatacgtaatcttctcttgtaaactcccttgatttgaatgcacaaaataatactaggcaaaggcaaagtaaatcccacgtatacatttattatgaatctgagatgtggaatgtattataatggaacatatttactatatgacaccattttaaaaaattaagactttaataacaatactattacacagtgaaacttttacaacatccagcattcaagtgatttcaaacatttgtgcctaagatacaactgtatcttttttaaaagatatcatttatcatttctactcttactaaatcactagggtgctcaaaactcagttttattttacagatcagtttcacccaaatgcttgaacatacaggcagctgctaatgagtgacagatagataaaagaaatgggagaaggaatatgaatggacatgaaagtaggaaggtaggggtgtgggtgacagagaaagagagaggagagtgggagagaaagaaactatgttgaaggagacatttgactttttggcttactgggtttaaaaagttatcacctactacttttatttcataaccttatgtagcttatttaataaattaggagagtcagattgaaaattaggttaaaacatattttcctgagactattaaaatgatttcaaattatgctgtaactgtagtctctttgtcagaaaggaattcttgctgaaattggtgattaccagtttatcatttatttcacaagcatttatcaagcacactttctgtaaagagcacacaagcatgcatagcttaacatatgaccaaggaatcgttttttagatttctcctttctatttctgtaagttggaaaaaaaaaacttttgattatagaataataaaattagtatgcattaggtaatataaaaattgttacaatttataaaaacccttgatatgaaaacaagtccactacccttgtaaagacatgtgccaatttttctgtgctttctaaaatcattgaaccatttattcacaatttgcctttaaacactttttttccgaaaaaaaaaaaaaagtccatctctaacagtggagctccagatctatcaaaattcaagcaatgtgactgctctttattttataatacatggaaatgctagctgcctttctccccaggtgctttcatgcatatgtcccttttactagaacaaacattaccattctcctataaggctgggaaacttgagacagccactattgttccagatgatagtttttgttttcagggatgtatcaatcatattttagccagaaatttaacaacacaaacttgacagtaattctttccttctccctcttcaaacactcatggtctgcttcattcagtcacctcctcccgaggtcagctcctaaacagcagatggtgtgcttgtgtgcagcagctggcttcattcctctccataccctccttctctcaagggacagtgcgtgtgtgcctctgtgtgcgtctgtgtgtgtatgaacattcacgactttcagttgccattcaatgctttctgcttctcccagccaaaaagctgggaagcttggcgtactttccagcaacgaacccagatgtccagctgtgatacagtttcctttccagtctccctgctggagcagtattcattcacaaccccaaataaaagagttatccagaggccctattttgtccttatggtttggtgttgtagtcatgtttgggagaaacagcataggagccaggggcaacgagtaaaaatctaaaattattttcccctgttacttggatgggataagatagctcttcggtgtggctcagggccttgttttttatgggctggcttactcaatgcatcattgcctacatcgatgtcttttttctttcttcagatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcagaagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattgacaacatggtgtggtttctatttatggaaaaaaatgaataattttgcatcaagaagtgtcaagctttaaaatgttgcttgcactattaatatgccatcaataggactgtatgcaaatttctattttataaacataaaaagggcttcagctttcaagtaaataaaggtaatcagtttatctttttcaatgatagttatttagtgaatattttagaaaactctgaatagttttcctaaatagccgatgataaagtaagaatataaaataaaatgttgagattcactgagttaaattaactcaataaatgtttctttgtttttattgcattaaatcctcttttgaacttttagctctaaagattattttaaagcaaactaattatttgggtggtagtttatttattttaatagagaagattaaaaaaagaaaaaagaacctgttttaaaattataatttctttttaagtatcttggaaatctctttaacctcagtaattggaatgtatatttctgatggtataagtaggattttaattctaaaagcaggaaaacttccgaattagaatagttttagagcaaaaaagaaaggtattagttaaaatagaccaatcatccataatgggttataatcagtgcatttgttccttcactcaattgggagataaggaaatttccacaatttatcttattcagacaaacattgaatttagccaaaacttcagtacagttctgctaaatgcaatttcaggctgcctaagtatacatcctaatattgtcattctttgtgtgaccttggccaatttactcaaactctatgtgcctcattttcctcactcataaagtgatgataataatagtatccacctctcacagattactctgaagatcaaatgggttattacatggaaattccttaaacggtgcctagccctccataaattgtaactgctttaacaacaattaattaacaaaatagtaagaaatatttattattttattttcaaacattcttgagaataaggtgtaaataaatttattttaaggttttgaaagaatatatattttaactcaatttcctcatttataaaatgggcatagaaatagtacttattcatagggctgtggagaggattgagtttagatctgtaatcagaataatagctatcactcaagaaactttcaataactgttagcttctatgttaacactgccgttactataaatgagtaatatcagtaatgtaatagtctcaggattcaatttactcatctataaaatgagattattatagtatctatctactcataagattgttttgaataatgaatattttaaaatatgtaaaatactcagaaaagattctgtcctggcttaaatgttacctaagtgttagctgttattatacctaatatgtgccaggcaattttcctaggaatcagcgccattgagacacaggctatggtcctaaaggatttaacagttagtaaaattggccgggtgcggtggctcaggcctgtaatcccagcactttgggaggtcaaggcgggtggatcaggagttcaagaccagcctggccaacatggtgaaaccccatctctactaaaaatataaaaattagccgggcatggtggtgtgtgcctgtaatcccagctatctgggaggctgaggcaggagaatcacttgaacctaggaggcagaggttgcagtgagccaagactgtgccactgcactccagcctggcaacagagcgagactctgtctcaaaaaaaacaatcagtaaaattgagtctttgttcctctcacttcttcctttgatgaatacctaagttctccactatgaggttgactgtaaaaagccctgtgaatagtccactgaatagttgtacaggatatattttcagatactgatagaatcaatgataccagtgaattttgtttacatttggagaaattcaagtactatctttatttcaggctttggatttttcacattaaaaaaagaaaaatattatttttataaataataggccaccttaaaaatgtctatttctatttctttgatcagtgaagatgtttaaaaggaagcttcaggccaggtgcggtggctcacatctgtaatctcagtactttgggaggccgaggtgggcgggtcacgaggtcaggagttcaagaccaacctgaccaacatggtgaaactctgtctctactaaaagtataaaaattagcaattagccgggcgtggtggtgcgtgcctgtaatcccagctactcaggaggctgaggcaggagaattgctggagcccaggaggcaggggtggcagtgagctgagatcgtgccactgcactccagcctgggtgagagagcgagactccatctcaaacaaacaaaaaaagcttggattatgtttttattttgttttctgtttttgggagggacagcaattaataggtaaaatattgccttagtgaattcactattatttttaattcagtgaatatgatttggataagtaatcattaagaggatctcttctctacataaagtatacattatctctcaattacccaggaactcatcaataagaaaacctattcatagaaattaaacagagcacattctaaactagaattttattagagaaaaatgaaagttctccaagtattttccatgaaattgtaaaaacaaaatactaatattaaataaatctttctccatcatttaaatttttaacacttgtccttaatattccagaatggcatggtagatttgaacttgataacagagtaaatactttttacactgattacatgttaagaatagtaatatttccaatatattaggctatattaactataatattaaaattaattcatctgattctttttattttttatttttatttttattttttgagacacagtctcactctgtaacccaggctggagtgcagtgtcatgatcacagttcattgcatcctcgacctcccagtctcaagcaatcctcctacctcagcccctctaagtagttgggactacaggcccatgccaccacagttggctaattttaaaaaaaattctttgtagacacaaggtctcactatgttacccaggctggtctcgaactcctgggctcaacagatgctcccaccttggctccctaaagtactaggattacatgcatgagccattgcacctggcctggtttttacttttttaatgtggctactaatgaaaaatttaaaaattaaatatgttgctcatatttgtggcttgcttgatatttctattaatgctgatatagagagactgatctttacaaaatataaatgtgatcatctctctcatctcttttgtattttgcttttaaaaataagactcaaataccaaaggacaacaattccgtacttaaactgaatcttgcttatccctcggcttcctttatcaccatatccaccacccctattttggtacattagcctaattgtagaacctagaagtaattgttgaaacaataacaacaataactttataactttccagacaatgtagctatgaccatatgtcaaagttttgttataatcttgcaggatggtagaaagtctctaggaggccaatttaaagtttctcttaaaatagagacatctatgggaaaggaaaattagacaaaatagagaagaaaatttaaacatccccaaactcttgactgccaggtaggtgagggtgtgactagttccttccttgtgacaaatatcatctcataattaaataattatttaaaattcccaaatgttttatcacaattcaaatttattcagtgaaggagattacaaactacatcaagagataaataatgttttgttccagaccaggtttggtacaatatttcttttacagtcatttcctttctcttaccccaagacctttatacagtctcaaatgtcgtttccttagacaaacctttctgatccctcagatgaggtcaaaaatctatgttatttgcttttccagaaaaaaaattatatgtgtatatatatatatgtgtgtgtgtgtgtatatatgtgtatatatatatacatatatatacacatatatacatatatgcatatatatacacatatacatggaattatattcgatatatagatatatttaattatttatatataattatttcatataatattgtggaataaaaatatttctgaacatggagacagcaactgaattttagcatatgttaagcaaatgcattaaatttgagaagaatgacttatacaggtgtccagcgtctcgggaagccagattagtaattcgaatgctgactgggtgaccagagaagaagcagataacttgaggactagtgttatttaaagcactgcctcatgtttgggaattttttttcccctttagatataatgtgctccatactttctatcaagttttctttttctttcagcttttcaagtttttttttttaaagatgccttagttatatatagtgcaatttcaatgtgtggggttttctgggggaacaaagaaaatacaccaagcagtagaaatgtaatgctagagcctagaggacaggtggcggctggaaaaatcaaaataggaatctttggcacagaaatgagaagtgaggatgtgaatttcactttgggattatcccccacaagagagaccttgaccaagtaaagactgagaatagatcttgaagaatatggtgaaaatcttcatagttcttttagtcattatttgtcaatttccctaatatatttgtgcacatttaacataacatttataaaggaatataaggggaaaaccattgaaataagagtcagaaaaatctgtatcctagttaagttttgtgatttctcctagaaaaatcacctgatctgctatttgtgttcttgtagattttataccctaagatgatgacagatattaaaattcacccaatgtcactggagtggttctatacattgtttgtgatacaaataatgtgtatctatcagatattccgggggagagtaaaaactctaggtatctggtaatagcccaaccaaaaacacttgagtacagttgtgttcagtctagtttgatctaacttgatatgctgtgcagaggcagctgagtatataagcgggttttgcagggtgatgttcacagtgtagaagctggaccaaactcccttataggctctttgtggtagagtggccatttgcctagcattagcaactctttgagggggcaggggatccctacttcccaggcaaaaatctttcctgataagctacttacattcctggttcagcccttcctctggttgcagcagaatgtaggcctagagattctcttcagcctcttactggtggggctagggactcagcgatgaagcaatgctacacagaagccagattttggtggaacttctgaggctgaaagccagcactatgaagagctagagtcaggtgcatggtggttggagataaagtctccaatttggctaccacataaaagctagagaagagtcttttccaatattagtggtttctcaagggagggaaattcacctgaactatataccccaatcataaggctttatgattttagactagagcagcattttcaagagaaatatgagtgctacatatgcaactcattttattttttaaagccagggtctcactctgttgtgcaggctggagtgcagtggttcagtcagagttcactataatctcgaactcctgggctcgagcaagcctcttgctgagtaggagtacctgagaccaaaggcatgcatcagcatgcctggctaaaatgcaatttaaattttccagtagccacattgataaaagtaaaaagaaggaggtaaaattaattataataatatattttgttacttaaatgtattaaaaattagcatttcaacgtaaaatcaagctaaaatacttttaaataagatcctctaaatattttacatactgctctctctttttctttttttgtgctaaaacttcaaaatgtagcatgtatttttacacttatacctagtgtgaattcatatgctaaattttcatcagaacaatttgatctgtatttagaattgaaaatatttacagttgatagattggcatgcttcggttgttccaaatacagttaaagtaaattatcaattttaaatgtaaacttaggtaattactatgaaataaggctgaaaattgtattcctaaattgatatactcatcaaatgctaattatccacatatgcccagtgattgctactaaatagcatagctctagccacacttggtaaggagctttctcgatcacttatagcgcatcttcccagctggaagtgctaacctgaggctttgagttggaagtttttcaacttaccgagtacagacacatttcccttcatacccagtgctggcttccagtagttcattgtaactattgcagggattctgttacccttctttattctcaagctttggtaaagatcaccttggtgatcttttgtaacactttcccttaacttcaattattaggtaaaaacacatggactccataataaacgtgtccaccccttctccagaaaagctcaaaattttatatatgtaatattcttgctctgtaatcccaggatgaaagtttcctactgtcttagtctagttgggttgctgtaacaaaataacataaactgtgggggttataaacaacagaaatgtatttctctcagttttggaggctgggaagtccatgaccaaggctctggcagatttagtgtctgttgagggcccgtttcctcatggagagctgtcttctagctgtaccctcacatgagtgaagggataagagagctcgctgggatctctcttgtaaaggcacccgtcccatctatgaggactctgccctcaacacctaatcacctaccaaaggccccacctgtcaataccatcatagtgtggggttaggatttcaacatatcaattctgtggggacacaaaaagttggtccatagcacctacgtattctacatttggattaaaaagacccttctcaaatattcttttgtaagatagaaaatgattctcttctctagattaaaaaacgaaaggaacagtataaagcacaactacccaaagaaatttgaaatacaataatgactcccagaacaagatcagatcaccactgcagacttatcaataaatgtaaagagacaatgctttaaaaagcagtataagagagaaaaatctacatatacactcaaaatggacatgcagactgaatatgacaaataagagagagattaaagtagtacttttcctcatctggataaaatatcacacagggctatcagctgcttttgtccccatcccttattcaccaaacaacattctaattgctaatatgatttcctaagaacccccgaacctataaaggtacttctaaaatgtaatgcttcttcttatatattaaagttcttttccttacatattaaaatttagtggctatttacttccaaaataaaaaacaccatatttcctcaacaatatacattttctttaatatctgctactagaaattttgctcatctgcagaagccttggggctggcgatagagaacaggctgtaagtaatccctctgtgaatgcaacacagtaattagccttttttttcttatggtgtgccctttagctgtttgttttttttttcagcatcaactgagagtttttaggaactagcttgaggaagagatgtctcttatactaggggcacacttggaaatttgaaattattaatatccccaatacacagctgcattaggatttaagtaaaataattatctcatcaaataacattataattgtcactaatgctatctacattgccaacttgaaaataaaatgtttatatgccattaacataggacaatagtggaggaaagtttctgggtgaccagctggtgtactaactacatgagggcggactcccacattaatcctgcgggacaccatggatttgcagtctgctctggaaatttccttctctcacaatgaattgcaaaagatatgcaagacctcaagagaactagaaaatagatcatgtgcaaacagatgaaaacatttctccagccaagcaaatattgatactgttagaatcagacctacagttactatgtgactattaatttcaaagaaaggtcaagttgcagatctcaacaacatcagtaaggcaagaatggaaaagaagtttgaaaataatcataggaaaatgccacaagtaatttccttttttgggaaatcagtccaagtattaattttaaaaacaaaaacatgaaagactgtggttaagcaattgtaacttctagcatgtcataatgttaataagaccatagaggcatagctactaaatattgtagccaagttccagaaaatacacaaaagtatctattaaataaccttatattattcttcaaatagaacatggcatgtaaagtgaagaaaagttgtctgtaatcccagcgtaaatacaccgtgcaatcaaagttaaatgcatgcattatttagtatatataggaagttaataggaaaattccaaaaaataaaacagagttagttatattttgacataagctttgggatttccagattttaataatcatctgtagcctctaaagataaggaatttgtttgatttactgaacgtacattattttaaatttcattaaatagataaatggttgatttttaaagaccaaataagtactcatgaaagagaaacattttggctctgggccataggaaatagaaatttcatcaggaaagaaccatggagggattgtctgtccctctctagtgccaaagcaaggggattgtacaaataacagggcctggcattctggaaaggaagggtgaatatgtaggacccagggcccaaaaatgttacgtttgtaaaaattgcatgtaaagaacattaatcatattttccccagtttttctctagggccctagtctgctcttgaagccctactccttaaactctcccagagcaggaggaatgacttatgtgaatgataaggcatgcaagtggtcacatgcatctgccatggagggcagaatggtaatccagcttaccggtttttatgtagtcagcatccctgggcaggtttctccagccatggaggagacggaaatcttgccaaccctcagcttcacctgcaactgagtgggttcaactgccttcttcgaattgatgtttgtgtgtgtggttggtggaagggaaagggtggctaggaaatctcagtagcatctttaataaagccaataaatgtccacttcttaactataatagacaagttttaaaagagaagaagatagtaagctacttaaagctagatagccatcctatctttttggccttctttgtgcttagcattctctttataacacagtgacctcaacaaaatagatgttcaattaatgatgttgaatatatgaagagagtcttgtgagagctgcaagagacagtacttactgattaattgttttgatatttaagaaccactttggttgaagaatattattggggcaaggaaatgagaataaatgtattccctggaaataatctttggaagtttgtttactaaaagagaaagaatatcttagggaatttctgaacttgtgctacttttactacatgtgattcaagctaggcgatctttgggaatgcaaatatttgccatatattttaaagaaacatcctcaagaataaatgaagcagatttacggaggcatacaaagagttttaaaaaaataattatactggaattatttttaggaaaaaatgataaaaaatttccttttacttgatttacctagattacctcaaataaccaaatacaaaaaatattcccaaagcaaattgtctctcttaatgctcttacacatttcaccattttatgtttttacccatcattgctttgtgaactttattttcatttctatcaaaatgtatccatttaatcaaaggaattcaatcaaaagttatttcagactgactttaaatgatgatcacgagaagcacatagcacagttggttacattagaagatgaaaaaatgctcataatccctttcatctgaactcttaccttaccttaattataccaaagattgtaaacagatccttcattgactggtatgtgttaatattcctactaaagattttaaattattttaaatgcttactgcattatatggtttggctctgtgtccccacccaaatctcaccttgaattttaataatctccatgtgtcaaagtgggaacaggtggaggtaatttaatcatgggagtgtttttcccaatgctgttctcgtgataatgagtgagtctcatgagatctgatggttttataaatgtctggcgtttctcgtgcttgcactcattctttctcctgctgccctgtgaagaggtgctttatgccatgattgtaagtttccagaggccttcccagacatgtggaactgtgagtcaattaaacctctttttctttataaattacccagtctcaggtatttcttcatagcagcctaatacactgcattaattttctattgctaaataacaaataaccatatacttatcaatataagacaatacccatttattggctcacaaatctgtaagtcattatttatgttgcactccattggattctctgatcggaatctcacaagatcaaaaagaaaatgtcggctgggatgaacacttatttgaaggctttcgggaagaattcacttccaagctcattctggttgttggcagaattctgtatcttgtgaatgtgagattgaggtccccattttctggctagcttaccagccccagactgtgctcagatcctagaggctgaagatatagccccctgtatcttcaaagccagcaaagatctgtggtatccttcttgtattttcctctttctgattccgtggttagattgagcccatctagataatcacctttgggcacataacagtcacaggagtaatacgtcattatattgacaaattccactcacattcaaaggggaggggttacacaaggaagacagccaagagaagtcatttttagaattctgtctaccatacttaccaacatttaaacatcagggtattttatatagatatccaaaaattttgtttttcttaaaaatgaggctatctgtcaatgttgggctacattccaccattgcaacaattggctagacctgataagtgacagtccctttgttccgaggagcattctcaagtagagtttgcaattcgctgttaacacacactcacccagttcactctctacgtacttcagttttcagcaacagccttacagtataaacgatactgcaacacaacatttctaacagagcacatattcacacctcttcaaatctaaatttatccaggaaactaatcatctcaatgatatctgcacttcgaagataatgagaaaatctcaggctaagcactgatgttccttttgcctctcaagacgaattcttgtaataacatttcaataaacttagtaatgccgagcatgtacttagtcttttggtctaataagtgaataatattgcacaaattaaatcctaccactgagttagcccattcaaaagacacaaacgtactctcagtggataaatgtcttcccgtgtaatcatgccagcagcagaaaatggaatctgtcataaaaaataaattatccaagagtctgaccatgtccacacagcttggcactaaatttcatttttcttgttcttcagctgagaacctaaatacacacttataaagcagtcagaaagattacgttgtttgtcaaagttggattctacagcctcagcattcagatgtatgagactgtagcattcggaaggcctgctgctttttatgtgtcggtttactgtgatcgcacctgtagttagttaggttttccagtttcaggagacataaaggtgcagagagaggcagcacaaagcctgcaggctcatttcttagggaactatgaggggagatgctggggtttataaaaattgaagtaatgggatttgataaagattgttgtgggctagactgtgggagccttccatgtcagggtaagacatttggaaattatctcacagtgaggaggcaactgtttcatttagagcagcagaagaatacaacagttagaagtacagcctttggagccagactatgtggtttcaaaccttaccgctatggtatgagtgtttgtgttccttcaaaatttatgtcgaatcttaatctccagtgcagtagtattaagaggtggggcctttggagctagttaagtcacggagtggagctctcatgaaagggattagtgaatttataaatttgtctggaggcgactagtgttcgtttccttttgctttctggacacagccttcatcccctttggaggatgcagcaaccaggtgccatcttgaaagcagagaccaggtccttactagacaccaaacctgctggcaccttgatctttaacttcccatgttccagaattatgagaaatatatttctattgttcctaaattttttctttaaccccaatttactttgtggacctagacaaagttgataaatctaccagcgactttccaattaaaaggacgatattagtggctatgaactgaatgtttgtgtcctctgcaaatttattcgctaaatccctgacccccaatataactgtatttggaggtagggtctttatggaggtaattaagcataaatgaagtaataagtgtggggtcctgatccaatagcattagtgtcactataagaaaagagaccagagctctctgtctctctgcacttgccagaatgttgatcttgtcatcccagcctccagaactgtgagaaataaatttctgttcttttagccaaaaaataaaataaaattacccactttatggtattttgtcatagtagcacaaatggacaaagatgctgcctctgccactcgctagctatatgacaggaagccagttagtttgataccatgtcttcacatcttcatataaagtgagaagtgtaacagacacatgctaatataattcaccacttagaacagtgctgatgcctagtaaccatccaagaaatgttagctatcattattactgtagaaaccaggttagcgctgacattgaggtaaataaatatatgaataaatgataaaccctaaataaaagttgtcgaaagatagaaaacacaatttatatcctttttagtaggtacataagatccctccattgcgaggaagagtcacacttgagttctcagttaattagactttgttttaaacctagttttcttccttgtcactcagggctaatcacacaaggcttactgccttataggtcttcatctctaggcttctgctctctctactcatttatttccttactaagtgtttcacagttaaatttcctagaaaaaaaaaaaaaagagtgcaaggggttttctcagtcaccattaactctggatcccttagcctggactgtgtttctgccaagccacttctcagattcctgctcatcctgcagatggctgcctttatgtcagacaccagttcctggtccagtcacctatgtctggagtagcagagaaaataatcatatatgtagatcccccttctctctaactgccatgaaaggttgtggattagtagattattttgctgtttctactgctcttatggtcattggtgctttgggctctggtgacgaagagtctgtgcgtgaagaagcagaaaggacaacagttccgttgccaaattcttcagcaagagtggggagaaaagcatagctaatatacttctgagcagttacaggcccaaagaaaaacgtgtgaaagcacacatggtgggtggagtgggagaggcggagaaagtggggcatggaatggtggagagaatgcaaagcattctttcctcagaatgatgagaggctctggggcgtttccttggtatttggaattttagtaagaattcatgtcaactatgtacttgaatcacctttattattttttgagagatcaagtaaagattgtaaacatcattcaaactgtgcttccctgattgtaccacttccctgagcataactatgtggggcacatcttaagcaggaatatagaagagactgtcaaagaggagtttgggcatggctgtcactctgaggtttcctaaaaaagagaagtttaactggaatttccggaaatagatactggaattccaaacaacttgctggttgttttaccttctttgtgagcttaatatctacccaatttcttaggaaagaggaaaagtttcaaatgatgagactataatgtcaaattgcacttgggaacttataaatagatttttgaaatgctatgtctttttaaaatcaagaaaatttaaagtagatacttacatttagattgcatttggtttctaaatgtgctctcaagagataatacattagaatatatagttttcctaggcactggagagctgcaattaaaacattggttccagactaagactgaaataagttcaaatgcaggcttttccacttattagttccattgctctagataagttaacatgtctatggtggatttaaattatgcacacaaattctctaatattcttgccttcaagagatggagcctaattcctctcctcttgagagtaggttggacgtagtgacttgtttctagtaaagaaagtgacaggatgtgaatttagagacaatatcttaaaaagcacgttgacttcctttcttggatggcacactctggaggaagcttggattacatgctctaggggaagctagctgccatgttgtgaggtcacactgaacagcctcatagagaaatccacctggcaaggaaatgaggtctcctgcaacagccagcaatgaactgaggccttctgccagcaatcctgtgagtgagccattttagagttaatccttcagccacagtcaagccttcagattgctgttagcccacacaaacatcttggctgcagcttcatgagagaccctgagtcagactcacccagctaagctgctaccaaattcatgacctatggaaactgtgtgagctaataaatgcttgttgttctaagttactaacttgtgttaatttctattataccatgttattttagtactattttggaaagccaggatttaatgagggtttaataaaaaatacagcagtgctgactattccagtagccactgaccctatgtagctatttaaatttagtcaaaattaaataaaattaaatattcaatttgtcagttgcattagctgcatttgaaggaactctgtagccatatgtggttagcactgtattggatagtgcagatatagaacattttcattagttcagaaagtttttcttttctttctttatttttatttatctacttttagagacagggatagctctgtcatccaggctggagtggcacaacatagctcactacaaccttgaactcctgggctcaagcaatcctccctcctaagccctccaagtaattgacacacgtgccaccatatctggctaattaaaaaaatatattttttttagagacaggattttactatgttgctcaggctggtctagacctcctggcctcatgtaattcttccgcctcaaccttcttaatacctataattacaggcataagccactgtacccggctgattgcaggaagttccgttagacaacattgctctgtagcaatgtagtttaaattggagcctgcaaatgcaaatactaaacatgaataatttttgaatgttgtaaatttttgaatttaagtatttaagatttttttaaaaaataaacatactctggatcatttggacaaccatcttaaaaccaagttttgctaattgatttctgtgctcgattttagaccttgaatttttatgtttatgatggagttccaggcagactgtgctactcttaagtgttgagggctattgttaaaaggacagagtcaaaatcatgcataaacaataggtgattaaaatgtgtgtgatgaattcagtccacggtgtcaagcatgctctctgagtgaaaactcagtagtggaaaaattcactcatcacatgactcattaagcattcaacaattcactttaagcaagacaatattctctttatgttaaatttatactcttcatttgactagtctcaattttataattttactggtatttgtaattgcctttgatcttatagatgcatagtggttataaatacaaatacacttttaaggttatacatgcctcagtatataataattctatacataattctctcatgccaccttatttgaattgggaaactttacaaagaagaaacctggggagaataccccaaatttgccatctgcagtgaaattaaccattacagataaggatcaggcctacaaaggaagtcgagtttcaccttcagttaacagacttgtattttaacctgggtcttcaaagaaaagaacgcctaaatctgaaagatcttgttggaggaaatttctttcacattgacacacggatgaaacaggtatttcaaaatggaggaacttcttgcacttcacagcatacccagtaggtggcctcacctacacttttgccaatgcatgtgaatgtaagtgcttctttgatgatgcatttcattatctctgtgagacacctaactattgagaagaacaggcttctaaacagagaaaggcttttgatgaatgcagtagaattatattaagtaatcggcatatcttttgttatgttgattgtgtcctgatttttatttgaatccggtgaaaagtaaaaaggtctgaatttctccctcagctatgcacgtgttaattctttccaacagcacacagagctaagtcaaccctttctgagtaaaacagcttggctttgagacctgctgttttctccagcttcctcttttcctgtgtcatggagtggccttgagaaatgcctctccctgttattgatgggaacaacccaacagcttttagtaactgccaatctcacttactcttttccttcttttctccctcaggtccatttccttccactctgtcttgtcacctccccctattctgcattctttatccttgcttcatttcttttttgctttaattacactaagctgtaaatattttttagttctctgagactctcttcacgtttttcatcctgaaagtgttgcaattagcttttttactgactgctactgacttcccattgatggcatttacttaaatggtaatgttatctttgtgacatatgcattcaaagaagaaacagggcttgccttcatatgtctgaataaaggaagtgcctattttctcactagattattttctgaatatcagaataaattagatctcattgaaacataatgtatttctcaaaggaacaattttatgactggggaagtcacataatctgacaatgaacatttagttaggtataacaaattgcgtcacatccctggtcaagtgcttacctaccttgtaagagttagaacaaatacacctgattatttggggacacccaagaagaaatgaaattttactgtactttatatactatctcattctagttcttttaaaatattattttgtatgtatgttgcaacactcacaattgcaatagaaacactcagagtgtttctagattaatcacttagcacagtgacttctaccttgattgtaatttaaaatagtaaagttaggtgacagtgctctaaatggccacaattgcatcatacttgtttctgtacaaagctctttcctatttcttaaaatgttaaaaaataaaactctgtccatttgtatagaattgggtcattaagtaatgaacgacctattgaaatctcatatgttagctaaaataaacatcaatttaaaattatcagactggtctcgaactcctgacctcaggagaccaggctgaccaacatggtgaaaccctgtctctactaaatacaaaaaattagctgtgcatggtggcacatgcctataatcccagctacttgggaggctgaggcaacagaatcccttgaacctgggaggtggagtttgcagtgagctgagattgcaccattcactccagcctgggcaccaagagttaaactctgtcttaaaaaataaataaataaaattataaaattatcagattatattttccttgatatttaaaatatggaaggtttattttaaaagggtttatctttttgttgttgatttctttttaaagaagtatgcagggaagtttatatagataatttcctcataaccaatattcaaaatcctttcatggatcctttagtgacattcacatctgttctcaagctattcaaaataattcctgaaagactggatagattattattttaatagttaatgtaagtatttcaatgccttttagcaatgaacactcttaccttttgcagttaaattgatattcaatttattagagttacaaattcaataatcacatttgccttaggttttcaagctatgttttataaatcttatgtcattcaaaaatctaaatacattttatttgaaaaagaacagtcacttatactcttttacttactctttatgaaacaggaaaatagggtgaagaggcagggaaaatagggtgaggaggcaggaaaatagggtgaagaggcagggaaaatagggtgaggaggcaggaaaatagggtgaggagctaaggtggattcacacttcagctaggacaggaaatatcctctccatagggcgtaggctgtaaatgactttgtaactttacttcattctctccatttacgtagggtgtaccccaactaaccaatggaatcctctagagggtatttaaactcccagaaattctgtaacagggcctttgagccccactatgctcaggcccgctcccacactgtgaagtgtgctttcattttcaatagatcccttcattccttccttgctttgtttgtgagttttgtccaattctttgttcaagatgccaagaacctagacaccctttaccattaacatttaattaacatttgatcagctcaagtttaatggtttaaactctcaaacaattaattccttgaataaattagttaattaaatccccttaaacatgttaagctgaatttctaaatttagtgttttaagtacttcaattttttaaagtactggcctgacaaactattagcatttgagaacctcaaaaatgatctccttgcttcttgcctgaatttgaaatgtagttatttatttcacaattaattaatgtaacagttttacagtgcttattctgtctcagactgccccactgagctggccacacagccagacagatctattgttcccaatattaccaagtagctaatgcactcctcccctgaagaggaggagatggaacagttatctacaggaacttctgcatataggaaggtaaaaccaaggaaaagatgggtctaatttgcccagccaatgcatttgtatgagtgcgcatacacacactcatgcaaacacacacaaacaccctctagttttgtgttcttgttatgcttggggcctaattattaaaactatggcccaaatagggctgtgactgtctccatcagtggagaatatcagcctgtgacttctcaaagaaaaattgcactgggtgcagttaaacaggcagagaagacttcatcaagtcttctactgtttcaacagtagttaagactgttggaataaagagaaagaatgaattcaattccactgaaacaaaaggcagaagagttgttaaacactggagtgagctattgggtaaatccttgaagacctaggatggggcattgggcaatatgattaggccgtctgtgtttgctaattggcattttcccctagttaggctcttacactctcacaaagacttggagaccggggctctacttttcttaatgtttctacttcccaggtcttagagaaagccatgactgggttgtagaacatttacatttcgaagcaatagggcaaaaattagcaattgcaagtttcctaaagtaaataagaaaagggaggacaagggcctatagtcagggattaacctgtctaaagctgagagaaacattacattcttcttggtctgacctcagttggttggttccagttttgcacccagaagactcagatatagataaaaacattaatctgaggaatcagaactgagctactctgaacccaagagagaaaaaatgaggaaaaggcagtcattctctcctctaggctaatatttggggttgtctaagagctatttgtgtaatagatcaggcttaaatctattctaatcttttctttaatgtgcttaaaggtataatttcatccttctgcttcttcctcccatctctcaaatgctacctcttttaggaggtacttaaagaacacaataagcacaaaaatgtgtattgatacttgttattctaatatatttagcgagcattataaagggtagaattttgctttctgattgtaatgtagttagtattatagatcaccttacaaagttctgttccaatgaagaggatgaacaattcgtataaaaaaactcatgcgtggagagttttattttgttgaaaaaaaactcatgcttggagagttttattttgttgaaaaaaaactcatgcttggagagttttattttgttgaaaaatatagatttacttagtagtctttttcatgatggtctgagcttttgtaccaactcacaatttaattttttcaattctttctaaggcttagcatctaaacctaagagcaaggttactagctttgatttaatgaaagcggtgagtatgacgtagaaggtaagacaagatggactctattataagggaggaaattaaattttcacattttgattgattctggaaatccatatttttggtgataagttgataaggtattttatgtaatgaaaaaatgaattttgaaaagtgcaaatgtaagtatgctaattgaaaaaagttggagaacgttagaaaatcaattcattttgtaagtgcactgattaaaaaaggtgcggcaaggggatttacgtaaatgtagtgaattaaaacatttatcttgcaaacttgataaactgcagtaggtactttagagggtgaaaataattagttcctcagctcccacatgtacctgaatcattgttaaaattaaatttgtttattgcttcaaaatgactttattttagtgcaacacagacttagaaacctataatgggatgaacttttttctactaacttttgttttcatttactgtaggggatagattctcatctttaataacattgttatcccttttctctctctccttaagacacagtaaccctgagagttatcttattgtaggcaagatcattttggaaacaactattcctcttcctagcccctctctaatatattatctaaattgcagtctctgattagattttagagtgaaaatatgaccttgtcactctttttcttaaaatctttcaatatttccccattatctagtataaagttcccatgagacgttttctaatcaactcctgcagattaatctaaattcattctacactatttgcctccacactgaactttacatttttcagtcatgctgaactcttattgtccctttaacatgttatctgttttaggccaagtttctgtttttgttatttcctctgccttgaataatccctaacaaacttacattgctgataccccaaattctaaaacttcctttaattctgattaaattcgaaaagctacttccatcattaaaccggtattcttgagtacctactataggccaagcagtattctgggtcctaggatacaatgataaacaccctctcttctccgatacacacacatacacacacagacacacaaacacacacacacacacacacacacacaagttttacctgcagagctcatattctactgggaaaaagacaatacttaagtaggtaagttacacagagttagaaaagaaataaagcagggaatgggaagtgaagtatgcgttgtgacagatgacagatagggccagggaaggttgaactgggtggggacttttgagttaagaccagagaagtggctgggtcagtcatgtggataggcaaggctaaagtcttcctggcagagagaagaccaagggcaaaggccctaagtttgggagcatacctagaggatgcaaaagtagaaggagggaaacctagtaggaggtgattgcaataatccagaagaaagatggtgataaattagaccagagtggtaagtggagtggatggagttggggagtgattggattttttgggtcaagaaaagtcaaggatcaatcccggaatagttgattttatgtcaacttggctagactgtgatgatcagatatttggtcaacattagtccagatgttactgtacaggtatttttaaaaatgtgattaatgtttacaatcagttgacttaaaggaaattaccctccataatctgggtggtcttcatccaatcagttgaatatcttaagagcaaagactgaggaattctgactacagactggaatataaaaattctgctgaatttccagctttcagactcaagactaaaacatcaactcctacctgaatctccagcctctgctaacttgtctatagaatccagacttactagctgccacaattgctgctgagataagcccttaaaatctccacctctctcttttcctttgtatttacacacacacacacacacacacacacacacacacacacacagtgtctccctctctgtgtgtgtgtgtgtgtgtgtgccttctctggagaatcctgactcctaactaatacaactccaaaggttttggccatgtaaagatgaaatgtgaaacgatgacactacagctaagcagttggctggtgggtactattaggagtgtaagtttgacatattaattttaagatgcttacttgaaattgaagtggagatgtggaggttacatgtatgtgtccgaagttctggagagtggtctcatctggagattatgaaatgaggccctctttattcaacagagtttcatataaccggttttacacattaaagcaatcacacataacagaaagatcctctgttttaatcacttgttcatcttgatcatttaaataatgttcaatctcacatccttttttgatctgaaaaaatattatgctttaccccatattttcagttgtatatttgactacttttcaaactaatgctttctttcaaatagcctctttaaagtttatctgtgagttcaaggcccagcctgttttgtgagtcataaagcaatcctgggcgcatttgtgtgtgggaagtagctaggtagtgagagaccttgtgcatcaaagagagcataaaatttttgtgtgagatagataccagcttctatataacacaacatttaagatttagatcaaaatgtgggagttttcacagggtagatggtgtgtgaagccatgccactggatgagctcatagagagaatgagtgagatagaaaagagatggagtccaaggacaaagccctggggactccaagatttagagttcaaaataggcaaaatatatttagtaagagaatataaaaaggtataaagaataccaggtagatgccaaaagaagaaattattctaaggaaaatgtgatgaatagtattaaatgctattgacagtttctcgtccatatttcagtggtaactcaacttcatgattaaccttcctaagtctggtgcatttctcccatttccatatctctgtgaaagaaacctccagcaatatagttgctcaagatagtaatgtgggactcatttttcattcctgcttctttctgtctccaagttttgtccattagtgaggcctgccaattttatcttttagatttctcttgaattcactcacttctctctatgtccgcttagactactataataatatctgctctatcagtggccactttacaaattgactcaccaagttgatcctttggaaatataaatctaattcccattatatcctcaattagccatcaatagcttttactacacttttaagattaggacaagactaacatgtactacctctacctccagcctcatcttatagcactccatgagtgtcactgagtaaaaatgaatgaatgaatgaataaataactacccttgttcctctgaaatttaccacagaatgacatgttatcagaggaaacaggacatttaacataaaaacccaatatttttatttgattaaatccctcaaaaccaattgtattagtccattctcactttgctaataaagacatacctgagactggataatttataaaagaaagaggtttaattgactcacagttcagcaatgctggggaggccccaggaaacttgcaatcatggtatatatatatgtatatatatatatatatatatatacacacacacacacacacacacacatatgtataaatactagagatacaaggcaatatacatatatatatatacacacacagggatatagatatgtatctctagtatttttatatatatatttgatatttatatatatacacatatataaatactcgagatacaagagatatatatatatattttgagagtgaaggctatgctatatagcactctcaaaataccactaaaatataaaaggaaacaaatatttgaagataaagtttggacaaagcactgctatacttagcacaggagaggtaaaaaattagtgttgtgggaagagatcaattgcttgcaactggattcatgaagggtttaaactaatggttgttggatctatacaatcatatttgttgttgctgatgtttttaaattaaatctcatactttatttggattactgtggtttttgttgtttaaatcaaagaaggttcatgcaaacattatagcccttatataatactgtatttgtttatgtgcctgtcttttgctcaaagtatgagatcctactgaatgtattcacatttgcctgcccatgtttttacaattttattatttttaaatgaataagtaaatgattgtctgttggggaaaagaaaaccgaccaggagggtaagaaacctgtacaaattttggtcttcacagtttttcctagttcctaatatagtcctaactatcaccaaacatatttgcattctaacattggcccgtatcgaatcaggtaatgtttgttggaggctcatttaaggtgaaggtagtttagctttttttttcttttctttttttttttttttaattaatactgttaaatccctggtgaagatagaaacgtgtgaggggccacaatagatgacaaaagctgcagagaaaggaatgaagagagaaatgaattagaaagttggtgttgaagatttaaaatgagaaaatagatacatgctggtgagtaaacacttcccactctgtttgatgtcattctgagatgcagatagagtggtgtaaaagggacttccaggcagagtgagacaagaagtggagtcatagcacattaaaattgaaagcagtaacaattattaccaaataggaaagttttcttctattatcgcttcttctgtctacatccttgtattttaaattaaaaatttccctaaatttcaaagcatatttcaattcttaagacaataagatgtcagcattttgtattaaaagaaagaaaaaagatcacattggacccattttaaattttttcttacaacaaattttccacttgaacacggaaacattaaaccttgaaatagaattgaaaagtctatcctttaagctagccagtgtcaattatgtttctttgattacattcaaataaaaattaacttcatttgtcttgaaaaaaaagatatattgaataactgtgggatggctgtacacacactcaaagaaaaagctgaataactgggccttctaaagggtaggtcatagtgtagttccaaaagtagatcatagtgtagttttgaaattttgggtggcaagaagaaacaattagattctttagggcattactgatgagataaatcagacttcacccttttttaaaaaggtttttaaagttgaaataattttagacctactgaaaatttacaaaaatagcacagataattttcgtacagcccttatttataatccttaactgtgttgcaactatcaaaatctggaaattaacattggtgaaatactattaatagatgcatgtgaattgtcttttatccctttcttgcatgaaggtagcatactgtagatacttgtttttttaatttagtagtatatcctaaaaatccttatcagtttatagagatcatcttcattcttttgttatagctgcacagtacaccattgagtggaaatgctagtttattcaaccattttcatatgtgtaaatatttagcttgtttcaatactttgaaattttgcaagtaatgtatcaatgaatgatgcatatttgcatatgtatttctgcatcattggacgtgtcttcagggtgaattccaaaaactgtgattgttgggttgaaaggtaattacatatgtagtttgttaggtgttgctaaatatccctctagaagggttgtaccactttgcattcctaccagtaatgcgtgagagtaattttttcccccagggccccaatgacagaatgttctgttgtgtttctaattttttttccagtctgatcggtgaaaaatggtaccttagtattgtcttatttgcaattctctaattacaagtgactttgaacagtttttcctgtttgaaaataatttttgtatcatttttatgagaatggtttgttcaaatatttttgacattttcctttggtttttatttttctctctcaattttaagagttttatatgtgctagggattttagtcatttgtggtatgtgttttgataaattcttccagtttgttaaattcctttagacttagtgggtttttgtgtgtatgcaaactaaaataaaaattatatattgtcatattcaccaatcttgggttttacttctaactcttccatttatttattgtgaactttgttatttgaactctaaaattattagagccaattacccaatatcctccagtttttgtaactcatagtctcacctttagtcagtgggcagagttttataaatcatgtatagagctagatatctatcataggctgtgttccttgagaaagacaaccctgagataagaacttgtgtctaagtagtttatttggagtgggggggtgatcttaagaagcgccaatagggcagtagagaaatgaaacagggaagagcaagaagtcaatacaaaatgcatttaagagcaagttaacgctgaactaacatgcatgttgtgcacatgaggacattgagataccatgcattgaatagacttgcttaaagggaagtttaagaatagaatctagaattgttcaatctaagcaaaaaatgttctctgcacactaagctgccatcctacatgttagtgaggaagagaaggatctgcataatagtgtcattgtacatggtccataaacactagaatgcgagttctcaacatagaaaagaggctagcaccataggaggtgctgaaaaatgtggaattagtattgagtgattcatgtacacattaaaactgcaaaacacctgatcttcagggcaccaagaaataggcagaaattgcaggccagtagctcctatgctggttgatatctgtaccaactggacaaaccacttctaaatcttcttgctctccctgtatctagatttttttcacttctattcaatgccctccctttcggtccaaaatacaaataccttcctgtcaagtggtaacaaaagctttgttggagacttggggttaagctaagattactaatcagataagtggtttaggatttgctcaacctggttgttttgaatatttattagacctaggaaactctcttaaaaagatcctgaggattaggccctgtagcaaaattcatctgcatttctttgttaattcatctacacctccaaagggcatgtaatggggcaggaaacatggttggggacaagggagcagaagtaaccaaataattgtgaaatttaaactacagattttttactccttcctgaggttttaatggccaccttaagtacacaaacctatgtagcaactctccagtcatcaaaattgcctcttctcacttgtttgggcattttagttgtccactgcttactggggaatgaatgcaactgcaaatgtagacgctcggtgcagtgagataatacattgaaatactgaacccacacttcctcgtgtatgatcctttccctaggtagtcagaagcatgcacattgcctggagaattaaactgttgtggcaggaatgcagagagaaagagacaagctttagtttttgacttccaaattggctctccaagcccacatcagacacaatagtcatcaccaggagactgctgaacactatcagtctcccgtgccacggagcagtgtgggatacaagccaaggcttgcaggccatcagtgccatttgagcaagctcatcgtgttcccagtgctgaagagcctcattaacggttcttgtcagtggcaggtgagttttccatccgaacatcaaaaactgcctgcacttatccaggtgatgcccactgtgcttgaagactttgagggcacctatttgaatagcctcatgtagacagccactccttttctcactcccctttttaattgcctaggatatttgtatatcaaatgctcaaaaaagaatgcagtgcacaataaaatccgcagatttaataatgctgtaataagaatggtacattacttggagcagtggtgtaacccttaacgtctatgttagaaggcttttaaaaatacatttgggggaaagaaaaaacagacattctagaaaccttggctctgcaaattctgatgatttagaatagagaagtttttcactgggtatatgtgctttgggcggagtaaagagaaaagtcaaaaagaattataacactgtggtaagactgtagcaatgtctggaaaagaaatcaagcattttagcatttctaatgcattcacctgaatggattcttcacattagctgtctctcacctccgaataaaagccaaaatctttacaatggatttctaagctatagctcattggctgatgtactctgtccctagaccctcttccttgtctctctgacctcacgtactttctgtttacttgctttactcaggccacactggctttccttctgatcaagtgcccatctatgggcgcttttgaagtgtatcctcaaaacttctgtagttgccattatatgggcatggaactatctcccctacacactgttgcatggcttgctcttttactatctgcggtagtctccattttggcctccaaaggcatccaggttctaatccccagaacctgtgaataatactttataaggcaaaggggatttttcagatgtgattaagttaagggttttaagatgaagaaagtagcctggattactcaggtgtgctctaattgcaatgattagcgtgctttttcaaggaaggcagagggagatatgctgtagaggaaggtgatgtgactactgaagcaccgtgccacattgctggccctggagatggaggagtgtcctgagccaaggagcgcagctctagaaactggaaaaggtaagaaaatggattctcccccagggcctccagaaccaagtacagtcctgcctacaccttgattttctcctagggaaactggtttcagacttctgatatccagaactagaagagaataattttgtgtggcttgaagtcactaagtgtgtgagaatttgttaaaacagcaatagtaaaccaatacaccaatatttgctcacatatcaacttgtcagtgagcccttctctcacaactttactcaaaattgcaacccactctatttctctgtgttttaaattttctccgtagcttttttcatcatattatataatttatctgttttttcttgtttctctttttcccccagtgaagtacgttgcatgggagttgactttttgtttgtttggtaactgtgggaaataattcactcagcaaacgaggtggaacaaatgggtatctcttagcagagggggtgtgaaaaaggaaaggaatataggacaagaagtcatggaggatataatggacgctgaactcaagaatgtgtatgttttgaatatcctggaataagagagagagcttgcttagaggaggttataaaaaatcttttggaagtagtgtaccgagatggaactggtgagaggtgagcaagtgctccaactaagggttcctaatttgccttccctattttgcaaggactgctgaaggatagaacagaccaatgtgggaaatattaggataaatcctttggggacaaaaacaaaagaagtaaaataaatcttgataccttcactttttttttttcatgagaacgcaacggtagaaacacacaatttcttttatgtcgagtccaaagcatacgagctttattttgaagtagcagaaggaggaaaaaaaatacattactttaagttctgaaacagaatcctgcctagggagagaggagccctattcagtcataaatatcaggatatggccccttgggcatgagcagatggtttctaatgaagggctagcccaactattctgcagcaggaattatctgaaaccttgggtgggagatacggctaagtgagcttggtctgaggagaaaaagggacagcaacatgatgcaagtccatgattgtagtaggaaaattaccatcacaaataccctacttaactttgaaggccaggtgtgtcccatagtcaatgttaggttgtttgtcctcctatgtagctaaataaatttacctctcacctcctaagttttttttttttttttttttttttttttttttgagacggggtctcgctctgtcgctcaaggtggagtgcagtggtatgatgcaatctcggctcactgcaacctctgcctcctgggttcatgccattctcctgcctcagcctcctgagtagctgggactacagccacctgccaccacgcctggctaattttttaaaatatttttagtagagacgggctttcaccgtgtcagccagggtggtctctatctcctgacctcgtgatccacccacctcagcctcccaaagtgctgggattacaggcatgagccacagtgcccggccccctcctctctaaattcttaagtacaatctgaaatacacatagccttgagttggagaaatttggaagataaaggcattgagtaagattcagtggggcagtggggcctgcaaacataaaaactgtcacttgaaatggagatggagaataaagctcaaccaacctggagaaatgcaagcttgcccaccctatctctacccaaataatcataagggatttgaagaattcaagccaactttatgcaaatattaaatatattaccacctggagaaattaagtctgtccaggaggcaaatgtttgggttgtaaatttaacaggaaacatttctattctgtttttttatgtattccttttctctccccctttctccccttggcaccaaaaaatttctggcctgtataggaagacatacctggcatgaaagttgaaaggattatgaaatcttgcattggatattttagtcgacagttttcctttggacctttcttcttaaaaactaagctctggcacattgttgtgggttgttttctttctttctgtggctccatgcacatgctgttgcttttgtatttattctcagcagggcgttctctgacacctatatcaatcagaaccttcctttcaaaacagagccaatgtggagaagatctggaggtctgtactggagtcttgctttgagatgggcttggaaatcaaacaagaaatgcaaaccttattaatcaaaatgggctcaaaggagatttgtctgacagcactgcagagagcagtaataaaattaaataagtgtctgtgagtagttacacaggaaaaaatgtttcttgtaagacaacagataaatggtaaagcacattaaggtttgaaagcttcttttggaggagggctgtcagagtggccatttacatccttcagctgggtgccagagtcttctgtgcatcctaatagctcctctgctgtgtctgccagaactgtcattcagagatcataaaataa

SEQ ID NO: 97 - DNA, 13705 bp, Homo sapiens
aaatgctttcctctaaagtataaatctgtccttaggaactaagatgaatttcggtgtgcccaaggacggctcagcaagtgcaatatgtgtacactgtgaggctgggatgctatgttttactgaagtgtgtcttttacactgagaactatttctaatttgagggaaaaacaagtatatcctctaaataacttgtataatgccaaataaactatgaagataggcatttagaaaatgtattctaaggcatgatgctagatgcttatataacagctatctgaaatttgctttactgcagtccttgagctttgagagaccttggtcccatggggctaatgacttcatctgtgtgctaactactatcctaattcagtttgtttattatcatagactcagatgattatatttcactaaagactacagtatttaaaaaagtattatttcagagattgaaaactttttctctaagatcagggacagcccacttttgacacttctattcaacatagtactggaagtcctagacagaacactaggtgaaattaaaaaaaaaatacaaataggaaaggaagaagtaaaattatctctgttagaagaagacatgatcttcttatatgtagaaaactctaaagatttcaccaaaaagttagaatgaattcagcaaaactgtaagataagaaatcaatagaaataaatcatgtttctgtacactaactgtggacaattttgacgataaaattagaagacaaatccatttaaatcgtgttaaaaataatataatacttaagaatacactaaaccgaagagtcaaatatttgtaccatgaaaaccagaaaacattactgaaaggaattaaagaagatgaataaatggaatcatgcacatggattggaagctttaatattgttaaattgttttaatattgttaaattgttgatattatccgatgaaaactttttcaatacaccaactttttttgcagaaatagaaaaattcatcctgaaatttgcaagaatctcaaggaatctcaagtagctaaaattatcttaaaaaagaacaaagttttcccaacaccacttattaaacagggaatcctttttccactgcttgtttttgtcaggtttgtcaaagatcagatggttgtagatgtgtggtgttattcctgaggcctctgttctgctccattggtctatacatctgttttgttaccagtatcatgctgttttggttactatagacttgtagtatactttgaagtcaggtagagtgatgcctccagctatgttctttttctttaggattgtcttggctatatgggctcttttttggttctatatgaaatttaaagtagctgtttccaattctgtgaagaaagtcaatggtagcttgatgaggatagcattgaatctataaattactttgggtagtatggtcattttcacaatattgattcttcctatctatgagcatggaatgtttttccatttgtttgtgtcctctcttatttccttgagcagttgtcagtagttctccttgaagaggtccttcacatcccttttaagttgtattcctaagtattttattctctttgtagcaattgtgaataggaattcactcatgatttggcttttcatgactaaaacaccaaaagcaatggcaacaaaagccaaaattgatcaatgggatctaattaaactaaagagattctgcatagcaaaataaactatcatcagagtgaacaggcaacttatagaatgggagaaaatttttgcaatctatccatctgacaaagggctaatatccagaatccacaaggaacttaaacaaatttacaagaaaaaaaaccaaacaaccccatcaaaaagtgggcaaagcgtatgaacagacacttctcaaaagaagacatttatgtggccgagaaacatatgcaaaaaagctcatcatcgcttatcattagagaaatgcaaatcaaaaccacaatgaggtaccatctcacaccagttagaatggcaatcattaaatagtcagaaacagcagatgctggagaggatgtggagaaataggaatgcttgtacactgttggtgggagtgtaaatcaattcaaccattgtggaagacagtgtggtgattcctccaggatctagaaccagaagtaccatttgacacagcaatcccattactgggtatatacccaaaggattataaatcattctactataaagacacatgcacacgcatgtttattgcagcactattcacaggagcagagacttggaaccaaccaaaatgcccatcagtgacagactggataaagtaaatgtggcacatatacaccctggaatactaagcagccataaaaatggttgagttcatgttctttgcagggacatgcatgaagctggaaaccatcattctcagcaaactgacacaggaacagaaaaccagacaccacatgttctcaatcacaagtgggagttgaacaatgagaacacatggacacagggaggggaacaatcacacactggggcctgttggggtgtggggggctaggggaggaatagcattaggagaaatacctaatgtagatgatgtgtgcagcaaaccaccatggcacatgtatacctatgtaacaaacctgcacattctgcacatgtatcccagaacttaaagcataattaaaaaaaaaaaggacatagttgaaggtctcacacttcatgatttcagaacttacaacaaagctacagtaatagaaacagtatgatactagtataaggacaaagggatagaccaatggactagaatagagatctcagaaataaattctcacatatatgatcaaatgattttcgacaaaagttcaatggagaaagagtcttttcaaaaaatggtattggtgaagcaggataagaaggtgtacattttaccatacacagaaattaactcaaaatggatcaaagaactaaatgtgagctaaaattataaaattcttagaacacaagtgagaaaaagcttatgacattggatttggcgattattttttggaaaggacccaaaaagcatagccaccaaaagaaaaaaaatgaataaataggactgtatgaaaattaaaaacttttgggcatctggagacacaatcaacaaagtgaaaggcaatccaagaaatggaagaaaatatttacaaatcatatatctgataaaggcttcatatccggaatatataaagaactcttacaactcaacaatagcaacaaaaacttgataaacaattgacaaaacagcttaaccatacatttctccaaagatatacaaatggtcaataagcacatggaaaggttttcaacatcactaatcaccggataaatgcaaacccaaaccacagtgcgacaaccacctcacatccattggcgtgattaccatcaaacaacaaagcaatataaaacaaaacaaaaaacaacagaaaataacaagtgttgaagaggttgtgaaaatgttggaacacataaactgttgttaggattgtaaaatggcacagtcactatggaaaccacaaaagacgttcctcaacaaagtaattatggtctagcaatttcacttctgggtatgtgcccaaaagaatatatcttgaggagatatttttacatccatattcatggtagcattattcactatggacaaaaggtggaagcaccccaaatgttcattgacagatgaatgggtaaacaaatgtgacatatacatacagtgcaatattattcagacttaaatagaaaggtttgctgtgtgttacaacatggatgaaattttaaaacattatattaagtgaaataagatattcacaaaaagacaaatactgtattattccacttatatgatgttcttagagtagtcaaattcactgagaaagtagaatggtgtttgccaggtacttggtgaaaggggaatgaagagtcattctataatggatacagagttttagctatgcaagaaaacagctggatgttttcttggagatggatgatggtgatggttgatggttgcacaacaagcaaatgtacttaataccactaaactatagacttaaaaataactaagatggtaaattttgtactgtgtgtattttaccacaatttaaaatttgttaaaaataaatatttttcaggctagtaaatttgtaattaaaaaaaccctgaaattgcaatttctttgttagaagtaatgtgcaattgtaattttgatgaatatgaccaagatgttttaaatgtgttatatgtcatgcctgtttatgcatagggcaaaaatgtactagaatgtttcttaacctacatctttaccaataaattatattgtataagttgtatgatactttccagtataataaatgaaatataatagctcatcagtttttaatatgcatatctcttactacaaatgacactttgtaaattttgtcattttcatttacctttttctgcactaattttatgcattaatatcttgaatgctggttaagtaattttccttttattgtctattcataaacctctgtatattaatattttgaaaggttttttctattttcatttgaattatgttgttttctttttagccgaatatttctttttattttatttaaataaattcatcaatgtctggagactgttttgggttttgcatcccagatatcccagctactcccaaatacaattttcttttaattctcagtttttatgtgctagaattttatatcattacttaggtgaaaagcttcgctgtttgggaactggtttgattaaaggagtacacacctttatctatctatctatctatctatctatctatctatctatctatatctatctatcgtctatcatctgtctatctattgtctatctatcatctatcatctatctatctgtctatctatctatctatctatctatctatctatctatctatctatctctatgtaatctataatctatctgttggcctattttcttatactattgattaaatagtccatattttccttaaaaaatgcaacgctttttttatatattgaatttttccatttatttgggtctacttgtgatttttttcacagatatttctaagcaagtgtcatacaaatctactatgtgtgtgtaatatgaagcaatgatcagggtttactttttcctccaaacatatccagttgttttaacactagactttttatttattatagtatctctgctttagcataatttagaacatttacactatgatctgtaatcataattcttatatttgctttagttttataattaaagtagtatcaatgattgctgctaatcttttactatcattttgatctatatttttgttttctaatgtttgtctttcaataattttgactttatttctggataagaggttggctggatataaatttttcgaggcacaatttcaaagcctgaggactttataatgatagttttacaatctcacattatgaatgctgccaacctaatgttctgcttaaatagatgacttggccatttttttgccaagtctggtgaagtccagaattggtctaagagtatttagagtattttgtctcagagtaaaatactctgtcagctttcaatcagtagattccaatttctttaataactagaagtttttcttgagaaatattttgaatttgtgtgttactgtttattttctcattcccttcttcaggaaagattatttttcaatagttcttaatttgtttttcagaaatgttttccatttgttttataatattctctcggttattgttttaatagtttgttttacttaattttcttttttcatatgtccgttgtgttgcttccaatgtggctttatttctgttttcttttctacgtccttcctgattcagctagctcacgttatgtttttgtatgtttcttaagcccatatcttcattaattctaccctcgttgttttaaaatttttggtggtttcgttgatcaccttgtttatggtgacatgcttgtatatgctttctatttgctcagcgatggtgttttcttctgattagtgtcctgtgtctgttttttctttttcctaattctttgctcagtttatcttatatcatctttgaatgaagagaatttttattaatacagctgccaaaaattcatgctagttcacactgcacaccactacactactttccctatgataaagaagaaaaaattgtgtatgtgtgtgtatgtgtgtgtaggaaaggagtcattttaatcctttttttttttgccacctaaataatcagatttgtagggctgtttacagttcagcctatcaactcggtatggccttactgatgtgctgcatcctagaaaaatgtagccttgtgtttactcattcagcaccaccttccctattactcagtcatgctcaacagggtccagggaagcaaccacctccagccatacacactgtgattgttttgaccctcaggatgtattgcttactttgggggattgtgctctgccatctgtagctgaaatcagctgcaatcatactttcttggcatcttcccacactcatttgattttctctgtatttggcagcttataaatatattggtttgagacaacagatgtagtttcctcaaaggtgggtttttatctgtttttttgtttgttcgtttgtttgttttttcgtcttctttgatgactatttctgagaagagaatgtggcaaaacccaataattctgccattgaaagagaatcaccattcttattaaagagctattttcaatattattttaaaatataattattcctctactcaacattttagaaaacaatgtaagatcccaaattatgcctacctcgtactccgcagcaattattctgcttataatctgtttgaatccaaattttcttaatcattccttggtgttactgaatcctaccatcatagatttttatgtgctccagaagcatgataaagtacaacaaacaagattgttgttcaagtcataactagagaacttttgtatatttttcagtttctgagaagtaaaagtttaaaattacctgcttttaatcagattgaaacacagatttttctaccacaaattattattacacataagtcttgttcatccttcatatatgtaaaataattaacaaatcaactatacagtgctggtctcagtctatgaaagtaaaattttagtgccacatgaagagaatcctaatgatcaactgagcattgactatatcttatggcttaacagagggagaaatttgatatagaacagttctcatcactttgaccagtaagcattgcacattcatttaatgtgccacataaatgataatattcagcacttgtgagattccaaactggcaacagacgccaccaatttctgcctgaatggtcacatctgacccttctaagcatgagcgggtcatatttccttggttcattaaatatacagccaccacatttatccatttcagagtcatttatacatttactaataacccattcaaaatataccaattctactaatcactgggagcatcatagatgtcacacgttccaaccccctatccattgcaagaataattaattcagtgtgttgatttcagcttttatttgaaaccaggaagggatggttaatttagttacccccaagaaaattccttttgttttttggaccaatgtatatattcaactccttattaagttaagcctaaaacacctttcccagactaatagataggtagatagatagatagatagatagatagatagatagatagatagatggatgtacagatacatccatccataatggaaatcctcagtttcttcagctgtgctctacattgcacaagtattctgaccgccacccttcctgattacctatttttgttgcactttttaaattcttaaaatatggctaccaaaatataccataatggccccaaggcattctaagtataatgaatagcaaatatctcctttgtcaaaatgctatgctatgattatattaaattgtctaatcatattgagttgaataaaaatttaatttgttgcatcaattctttaaatgtcctgctgttgccatcttgaagttcttttttttattttcttcttaacttctattttagattcagtggtacatgtgcaggtttgtcatataggtaaatagtatgtcacaatgatttggtgtacagattatttcattacctagttaataaacatagtacctgataggtagtttttcagtcctctaccccctctcaccctccatccttgtataggccctggtgtctattgtcccttctttgtgtccatgtgtactcaatgtttagctccaaattctaagtgcaaacatgcaatatgtagttttctgttgctgcattagttcacctagaatcatggccttcagctccatccatcttgctgcaaaggacatgatcttattcctttttatggctgcatagtattccatagtatatatgtaatacatttttttaaatttgaagatgaagcattcgtattgatggattgcacaagtattatttcaaatgctctcagataacatggacttaagcagcctcatcatcctggttgtcctaaggcaatatttatttataacttttattgtttgctctagcatctagtgagcattttgataagcaaagtataaaagaggacccattcattctccttccttgtacattacagtcatattaattcaatttacacttcaatagtattttgagagggaaaatagcatggtgtttcaagcatgtcagcttggaatgaagttacctggactcataaccagactcaaccacttgccagctatatgcctggttttgtcatccattaatgcatgtgatacgaactttgtgggtttttttagattaccatgagataatatgcacaaagaacatcaataatgcctggcacacaaagtaagacctcagctaatattaattattataatcattgctcctttgaaaacctctagttttcatcatcaactaaattttccagcatcaaaaatcacattcaacgtttaaaaatactgttactgtcccattatcaccttactcttggttaattctacctactcaatgaatctcattgccaaattaaatcaaagacttatctttcatatgaccccttgatatcaaaagaatctattcagacccagagattatcttggaataatagatgctaaaatttactttctttgactaaagtagcataaaaaatagtagcagcaataataaaatggtttaatgagtgtttcctatgtgccagtcatcaaacaaaaacttatacaaacacaaaaacatatatcaaacataccacacacacacacatactcacactcacattatcttcttcgttttcccatcaataacttagaaataatatttatggcagtgatagtaataccagcagctactacactcctttagccacagagacattagcgagataaagagacaatatctgaatgtgtcctttccaggctctgccacattagccagcaggctttgcattcatgattgggactgtttcataggcaatttcttccccattgaaaacatatccataaggccattccaaacatcagaacactttccctttagcaaacgcatcacagctctgaatattttgatataattttaatactaacaaagtaatttcataaacattagctcattttagcctcacaaaaactctacagcaaagaacttttaaaaagctttacaacccttgtatcaaagcttgcaaaatcacctgtcaggtgttggaattaagcattgagttgatatccatatgatctctagtctctttcatcctcccacccaaagatgctttctgagagccttgcctggaaggtagctggcctaaatagggtctaccactcactctggctctaccactgacattgtgtgtgtacttgggaaagtccaatgaccccctcagtatctgcttcctgtctggagatggctcaaatccccctctcatagaacagtgttaaaggagatagtgtgaataaaagtacagtgcaaacttacaagtgtttaacagaggttcatcgcaaaatatggcatatgaatgtcatattttacaaaaaattcaaactgatttccataccgtcataatgacagctattatatgattgttgctgtcaacagtttaagtcaccattttgaagtgtgtgcctaataaaaatgcaaacaatttgtagtcacttataaatatttaagtgtgagaaatgacattattttacagtttgggaaatcttttccagcatctctgtattagtctgtttttacactgccatagacacatacctaaatctgggtacttataaaggaaagaggtttacttgattcacagttctgcatagctgggaaggcctcaggaaacttacaatcctgcaaagggggtagcaggcaccgtcttacatggaggcaggtgagagagaaagatgtcaagaaggaactgtcaaacacttataaaactatcagatttcatgagaactcactcactatctcgagaacagcatgagggaaactgcccaagattcaatcacctccctccctcaacatgaggggattacatgtccctccttggacccactgggattacaatttgagatgagatttcagtgggaacacagagacaaaccatgttaatctcttcactcatcttaatttcttcttcacacaatagcatcgattttgcctctttagaaataaatatttgataaatatgcaaaagtacatcattggggtaggtaattagtgctattctgtgtttcttgatgttctacccaagcttaataaggctttttttttaacttttatgttagattcaggggtacatgtgcaggtttattgtacaggtaatttgcatgtcaccagggtttgctatacagattactttgccacccaggtaatcagcatagtacccaatgggtagttttttgcttgtcaccctcctctcactctccaccttcaagtaggccctggtgtctgttgttctcttctttgtttccatatgtattcaatattcagctccctcttataaataaaaacatgtggtatttgtttttcttttcctgcattatttcgcttaggataatgagctccagctccatccacgttgctgcaaagaacatgatcttgttctttttatgactgtgtactatttcatggggtatatgaaccacgttttctttatccaatctccattgatgggcatttaggttaattgtatgtctttgctattgtaaatactactgcgatgaacatatgcatgcatgtttctttatggtagaacaatttgtattcctttgagtatatatccagtaatggcattgctggtcgaatgctaattctgctttgagttctttgagaaatcaccaaactgcattccacagtgactgaactaatttacattcccactagcagtgtataagtgttccttttatctgcagccttacctgcaaatctgttattcttttactttttagatgatatctcattgtggttttgatttgcatttctttaatgaccagtgctgttcagcattttttcatatgcttgttggtttcatgtacatcttctttcgaaaagtgtctgttcacgtcctttgcccacctttttatgggttgtttgcttttgcttgttgattggtttaagtttcttaaagattctgatatcttcctcctatcgtatttgtatgatgtttatttggaatctgtgtttgcctcaggcttctaactcttaacatttatcttttgaagggttataattgtgcctgtaaagaccacttgatcatatagtacaccatattagtatctcattagttctgactactccaaattgtgataagcatggagaaagtacagggatagtctcaaaagcctgggcctgaatataaaagctgttgactcttcctttgactagctgtaacctgtggcaagttacccaatctggacatcaaaagtttccatgttagtaaaatgaggatgtgaataccttatacttccttttgttgttaggagcattagatgagatagtacaaggtgcctggcataaagtaagtttctcataaatgctagtaataaaacattataaattttattgtgtaaggctgaatctactggtttgctattgttatcttacattggttcatgagagctaatctcttgacaacatgagttcatgttggtagtttggtagattaaatgtgtgaaactgggtaaatggtatttgcatgttttttgtactgcttttattttttgtaacttttctgtaagcttaaaattatttctgaatagaagttataggaaagaaaaaaaaagaaagtggccatgggaaagtatttacaacaataattgccaaatattctacatatcaggaacttttttttctctctttgattctattctttctttccttcattcattctttttttatgagcccacatgaatcttatgcatgctattaaggaaactcttcctattaaaaaacttgcatttgctatatataacacaatgtctcaaaatggacactgatccattagtcatcattctttggcctatgagcacgttcagtatactagaaatcagaatagccatactatcatccaggttacatatacaattcttcttcaaaaggataacttgggaaaatttgtcacgtgacttgccaaaatctacacaaaacgtgtgtttaggatagcataattttcatttctcttattggaaccactagccaaagaataaaagtttgcttgctgtggatagcactttaaaaacctaggagagtgctaaatattcaatattttttaaaattgtagtagtactagtagtagtagtggtggtagcaggggtaagagtggtagcagcggtgatagtagcagtgcttgtactcatggcttacatttattgaatgttttgtcacacaaactttctacattgttctaggtactccatcttaattattttgcttaatcatttctacaaatctataattcatgttctattattttgctattttaaaaatgagaaaaattaggtaaggagagttaaatttgatccataacatataatatttggagtagactgttcttgaaggcaggaattctctccctagtgcctacttttgtgcttgttctgctgcttccttttatgctaaatcgtgtaattgttttttcaaattatgttacaatattctataatgatggacagctagttcattatttgagagtttaaaaatctattatttttattaattttggaaaaaaaaaggcaacaattttctactcacaattgccaaacactgctgttttctgtgatcctttaagaatggctgacaatagtttaactctcagaagggtagattctgtctaggacataaatcatctgaatctgaaattaatttgaaaccttcatattatttactcatttgtcgtagttttaattgcttccgaaattgctttttctatcctttccaatttagaaattctattctctcagaaacacctttgggtgattctctttttattctgccgccatttatctttatctcatcatcacaaaaaactgagtcttacattttatttgcctttttgctatggacactgcctttagagtactgtttcactacctttagattg

SEQ ID NO: 98 - DNA, 51480 bp, Homo sapiens
tctgcctacatgtaagatataaaaatgatgtaagtggctataccttctctagtttctgccttttatttctacaatgttcattaataaaagtgcctgatccaactgataaatcagaaaacacctctcatttaaatacatccggtctctaatattgtagcagcttctcaagaaattttctgttcactgtaccatttaatattttaaattaacctatagtcaccctttttataattcactattttcataacataattttatgtatattttcagtcatgttagtacactgggaaaagcatgcaaaacagggacataaggatatacctatttcaaagcaaaatcatgctgatgctaaaagggaggtcggaaaaggaacttggataatagaaaaaaaatacacagcataactgtcccacttagcatatcttagtaaccagtaattagaatagaagtttgcatcattctttttaaaaatatgtggaatgagttacttctttgttctgttgtttaaaacttgctctggtgatgttaaagaatttctcctctccaccctggcactcatagtgccttgactaatcttcccagtcagcagcaggagtcctaaggcaaagtcaggcagatgcgggaagggacactcatgatcgctgatgaggcctcctaggaaccacaaatctgttatggggggatttgatgctgcttatcaagtatctagtgagaataaatgactggcttcaagttagcaacgctctgtcatttgaggagtgagaggttgggcaaaagattatccagtttgcggattacccagattctaactctcatcccaaccttagggagtttaaaagtcatttgattccttcaagaagataaaaaaaaaaaaaaaaaaaaaaaaaaaaaaggagaggagacaaaatcagcctatctttatgttcattagtagaagtgctgggttaaaaaagaagctgaaaccaacagcaaaattcatattgatgtgaaatatggatttgatataccagattcttaattacataaaatgacagtgtgctgaaatatttatatggtgaaaatcattagatacaatgtctaataggtaagataagtggtgcagtataacctttacttttagtcttgtttacagtaagataatttgttttaacacagaagatatataaaagaagtcagaaagactaagataatttctgtcactaggggcagaaagttatcaggaacatggcagagataaatctaggaatgcaaaaagaaaggttacgatggaaatggaaacaataagctttgagaagttcaggggcattttgaagacagtattaccagagctgaagagtaaatcaataaaataagtttaccattcatagactatggctgaaataattacccaatgttatgcttttgtaagaaagatgataagtccagagggaagaattgagataaaagaatcaataatgagcaaattaattgttacttacatggagtaaattaaaataggcactaaatataaatatttgcaataaaatttgagggtaaaaatataggaagaattataatgatgtaaaatgtcattatgatttgggagagagaaattttaaaagcatttagaatcatcagcatgaggattttatctttatatacttggaagttttaagtttagtttcatttgataaaaggaaaaaagctaataatgtaaacctttcaaatgagtcattgggatgtaaggttaagaaaatgtaataaattcagttgaagttcagaaaacaacatagaaaaacaaaataaataaaaaagtaatttataaatgagaaaaacaaaaaaattgtagaaataaacacaatcagttccataattccattaactgtaaatgaattaacatcataatttcaaatatcaagattaactgacaagaaaaaaatacaaggccaatatgcttacagttaatatatctcaaacatattaacacagaagagttgatcataaatggatagaaaaaatatgttaggaaaatataatgagaaaaaacttggagataatcaatatgattactgaaaatagactagtttatatgcttagtttgagatgaaaagagtccttcataagattaatccttgataaggattagtaagtccttgataagtttaatctaagtacatctattagaaagcacagtaatccccccttatccatggttttactttctgcagtttcacttacctgtagtctggaaatattaagtggtgttcctttggccgtaacaatcagcagagccttctatttggccatcctgttcccgatttctgtctgtctttttaggttttaagttatgtttggttatattcatttttcataacttatattttcatagatgtcttagaaatttaagctgtatgtttaccaaaaaaatgaagtgacatttcaaaagcctgttgtaactagaggtacagttctatattgtaattactatagccttaagtttcttctttattttttatgataaatattgttaagggtctacttatttgatcagcactattgtttcctcacttcccatttttttaagcttttatgttgcttatttccttatgtgttattaggtttattcaattgtaattgtcctaacttcttttttttatttttttgagatagagtttcgctcttgttgcccaggctggagtgcaatggcgcgatctcggctctctgcaacatccccctcctgggtacaagcgattctcctgcctcagcctcccaagtagctgagatcacaggcgcctgccaccacgtccggctaattttttgtatttttagtagagacggggtttcaccatgttgttcaggctggtcgcgaactcctgacctcaggtgatccactcgcctcggcctgccaaagtgctgggattacaggcgtgagccactgcgcctggcccctaacttccttatttagataattctaatacatgtccacatgtacacaagtctatacatttatctaaatcacttaaactgcaaaccactagtttgatacattgtgtatatttgccatttagtaatatgtatttgctaatttctacataatttttctttggccagttgttatttagaattgtttcaaaaggtatagggtaggggtgtgcctgcgtgtgtatgtgtgtgtctgtgtgtgtttactccttttttgttggggagatggaaataatagtatgcagtttgtaaagtaaaaactttctattttgtcctatttctttgtaggtttctgttttaaagctattaaaatattactgtctcatttcgtttgttttatatatggacttttaaaaaataaatgatctatgtgtgcttgaacagaaagtcttatctctaacttttttctggaacaccaaatttaacaactatctacacacacaataagcacattcataagaccaaaaatcagatgagcactcacagcacctggttttaacttcacttcactgaataggcaccagagaaggtaggaaagagacttgaactgccgatgccacccctcctccaagccacaacagcagccatatgacacagaaaatctgtgctcttgggagggggagagcatggtgactgtgagactttgcattaaactcagtgctgccctgtcgcagtagaaagcaaaactgggctaactcaactgatgcctgcctgtggagagaacgtttagaccagccctaaccagaggagaattgcacatgccagtggttggaacttgagttctaacaaaccttgccaccatggctaaaggctcttggggttctaaataaacttgaaaggccgtttaggtcacgaggactgcaactcctagacaagccctagtgttgagctgggctcacagtcagtgcacctgggggcacctgacttattgagacagcagtctgggtggctaagggactgcctatgccacctgtctgcaaaccccaagcagtacagctcttggcttcaaaagagacttcttccattccacgtgaggagagaagaggaaaaagtaaagagtaattccttttgcatcttggataatagctcagcgacagtaagatagggcagtaggtaggcttgtaaggttccccgctgcaggctttagctgccagatgacatttgtagacacacctggttcaggaaagagatggccacattgaagggaaagacccagttgcgacaggacccattacctgctgaattaagggcccttgggtcctgtataatcagcagcaatatccaggaaatacgctgtggaccttgtgttagattcagagatgctctggcttcagacaagacttagcatatttccagctgtggtggctatggtgagagactccctctgcttgagaaaagtggggcacaaagtaaaggggactttgcttataccttaagtgcaggtagagcacaaagtgggctcttggcttgcccagttctaggtgttggcccttggacagcatttctggacctgccctgggcagaggggaacccactgccctgaagggtgagttccaggccaggtagcatttaccacaaactgactgaagagcacttgggccttaaatcaatggccatgatagactggtgttactccctaagggcctgtggtggtggtggtggccatggggctagggtcctctgcctgtggaaaggggaggaaagagtgggaaggtgtatcttgtggtttgagtgcgtatcttcgtttgagaagtgcctgttcacgtcctttgcccatttttaaaatttttttaaaattttactttaagatctgggatacatgtgctgaacctgcaggtttgttacgtaggtatacttgtgccatggtggttttttgcacctatcaacccatcatctaggttttaagctccacatgcattaggtatttgtcctaatgctctcccctttcccccaactccctgtcaggccccggtttgtgatgttcccctcatgtgtccatgtgttttcattgttcagctcccacttatgagtaagaacatgcagtgtttggttttttgttactgtgttagattgctgaggatggtggtttccagcttcatccatgtacctgcaaaggacatgaactcattctttttatggctgcatagtatttcatggtgcatatgtgccacattttctttacccagtctttcattgatggctttgcccattttttaataaggttgtttgtttttgcctgttgatttaagtacattatagattgtggatattaaaccttgcacagttcacaaatattttttcccattctgtaggttgcctgtttgctttattaatagctagcattttgttgaggattgattgttacctttatgttcatcagtgatattagcctgaagttgtgtctctgccagattttggtatcagaatgatactggcctcatacaatgagttaggaagagtccctccttcttgactttttgaaatattttttagtatgttggtaccagctctcctttatttgtctggtagaattcagtaatgaatctgtctggtccaggactttttgtgtttggtaggctttttattactgatccaattttggaacttattattgatctgttcatgcattcaatgccttcctggttcaattttgggaggttatgtttccaggaacttatttatttcttctaagttttctagtttgtgtacacagaggagtttgtaatcatctctgaggtgttttgttttgttttgttttgttttccctgtgggattggcagtaatgtcacctttgtcatttctgattgtgtttatttggaccttctctcattttttccttatttgtctagctagtggtctataaattgtatttgttcttttaaagaaccaaatgttatttttgctgatgttttgtatagattttcacatctcaagttcattcagttcagctctggttttgtgttatcttttgtcttctagcttaggagttagtttgctcttctttctccagttcttgtcagtgtgatgttaggttgcttattttttctaattttttgatgtaggcatttagcactgtaaactttcctcttaacactgctttagctgtgtctcagagattcaggaatgttgtgtctctgttttcattagtttaaaaaatttcatgatttctgccttaatttcattctttacccaaaagtcattcaggatcaggttgtgtaatttccatataattgtatggttttgagaaatcttagaattgagttctatcgttattgcgctatgagtgtgattgatgtggttctgtttttattattattattattttttgagaattgctttagggccaagcatgaggttgatcttagagtatgtggtatgtgcagatgagaagaatgtatgttctattgttgagtgtagtgttctgtaaaagtctattaggtccatttggacaagtgtcaagtttaggtactgaatatctttgttagttttctgccttgatgatctgtctaaaattgtcagtgtagtgttgaaatcttccactattattgtgtggttatatatgtctcttcatgagtctctaagaacttgtttaagaacttgggtgctccagtgttgggtgcatatatatttacaatagttaagttttcttgttgcattaaaccttctgtcattatgtaatgcccttctttgtcctttttggtcattgttgttttaaagtatctttttttctgaaataagaatagcaaccactgttcttttttgttttccatttgcttgatagatctttctctatccttttactatgagcctgtaggtaccctttcatgtgagatggatctgtcaaagacagcattacagttgggtcttgcttctttatccaactcgccactgtgtcttttaagcaaggcatttagcccatttacctttaaggttatttattgatatgcaagcttttgatcctgttatcatgttgttacttggttatgtagactagattatgctttacagtgacagtgggctatgcacttaagtgtgtttttgtggtggtaggtaatggtttttcatttcaacgtttagcactcccttaaggacttcttataaggcaggtctcatgataattcccccagtgtttgcttatgaaaaaagtattttatttctccctttgttatgaagatcgatttggctgaatatgaaattcttggttgggatttcttttctttaaggatgctgaatataggtcctcaatctcttctagcttctaaaatttctgctagtaggtccactgtttgcctgatgaagttctcttggtatgagacctgcccattctctctagctaccattactattttttcttttttgttgcccttggaaaatctgatgcctatgtatcttgcttgttctctctccctctctttctgggatgccaatgtgttttaggcttggtctctttacataattccatatttctcagaagatttgttcatttgttaaaattctcctctttaaatttttgtcttactaagttactatgaagaactggtctttgagctgtaagattctcttctcagcttagactcttctcgtgttgatacttctgattgtattttggtattcttgtagtgagtttttcagctctagaaatcattttggttctttcctaaaatggctatttcatcttttagttcttatgtattttataggattccttgggttccatgggttgtgtttctactttcttttgaatctcagtgatcctcatttccatccagattatgaattcagtatctgtcgtttcacctatttcagtctggtttaaaaccattttcggggagctagtgtgatcatttggaggtaagcagccattctagcttttagagttgccagagttcttgtgctggttctttctcatctgtgtgagctaatgctcctttaatgtttgaagttgctgtcctttggatgaggctttttgcttttatactttttgatgcccttgaggacttgactgtggtataagttgggtttggtcaattggctttgtttctggatgattcaggaggccaaggcttagctcagcactcccgggctgcatgccattaccctatggggctggaaccaggcatgtggctttgttttctggttctttgagcttaagcacctgttgtactggaggggctgaggtgttcccagtccactggtaacagcattctgatatgtctgatattgggtacccacacatgtgcttcagcagggcagtagcaggatgactggggttccctcccacacatgtgcgtactgacatcagggcagagatgtgtcctgtgttcacatatgtgtgcaccagtgacagggtggtgatggggtgagcatacacatgcataccagtgaagctgtggcctgggtgttgggggagcctgctagtgggtgcatgccagcaaaggcctacctgcagaagctctttgacttttaggcagggtcttctggtgaaagggctatggcagtggccattggcaaagacgttggctggtcagccaaggctgtgctccaagcaggtgtggctaggaagggagcctgggacaggcaaggacatggtggggtgttcagatcagactggccctgttctacaggcaagaaagcctggctctgtccatgtccagcagccaacaaatgctaaagccacctagagaattgtgagccttcaagaatggtctcccatggccatgctccactgcagccactcctacacccaactctgtgggctccatgcaggctggcgttctgtctgaaaactctctgggaagttctccctacctgctcaaatgtctgtggggatcatgaggtctcctgcagctatgattccagaggtctgtggcaagagtggaccactctatacctcctttactcaccccttccctaggatgtgctcagggccaggaatacattctggtgctcagcaaccccatacagggttcccagcttcctctcctttcagcctggggtctgcaccttccctctgtccactttcaattccatctttccaaagacatgtttcgagtgtgctggttctcttgatgatgtggtctcatggtgggagaagttctttctgtcctcatgtattcagccatctaggctcttctctcttgaatatatatttgataacattttagaatgaaattcttccattgaaaagcaatttggaaaatatagttaggttgaaatatatatcttaaaacatagcaatttcactttcagatatattacctacagaaacatgtatattgtatgagatgtgtaaaaaacgattcaggcaaattttgtataatcaccttagggagaagaaaaatggcattaagtaggattattcagcatcctcaaatatatccatatttttttaaatataagtacattatgcaaatatggtaaaattctatgatttgttaaaatttgtttaggagtaactgttgttcattatgtttctattcctgtatatttgaagtaatatattactaaagataatttgaaaggataaaagcatgcttctttgagcgaggttataatatattatacataacatattaactcatcctcatttctaagtgttttgcaaaacagaaatatatgggagtaggattccagaatctggagcggactttagggtaatgaacaaagtgagttgattctgcagtgggagaagacagcgagttgacctttgtccatctgtcacctcatatgtgccttgtatccgaaacgagattctcgtgttccatgtcctacattctgggcaggccacgattcatgttccagaatgtaggaacttgggaaatgctaggagtcatggagaacaccaagtaagggtggacaccggtccaccccagaacaccagttgctgaggtaccctgtctagtagattgacccatgcttctccttttctcaccaaaaagaaaggaaggaagagaggaagggagaaagagatcacatgaaattaaaaaaaaaatatcaagccctgtgataattttccttcccaccccagtacaaaaagaagcacgggacatctgacaattaatctcacctattatgataagcacccagtagagaatacaaaatatctaagaagtaatgcactagaagaaaaagtgaaagtagaaaaagtaaagaacttgcaccagaagaattaaatcctttagaacaaacaggattcagaagtaattatatcaatatgttcagaaaaatggagatatcacctttaaaagcattcagatgtgaaggaggaagagattattatgaaatgattatcaagaagaaattctagaaattgtatgtgtgtgtgggtacctgaccatatatgcagacttttcaaaatgatacatttagcagatgggaagaattgcagtgcagtatagacatagctgaagaggggattagcaagcagaaagatagagctgaaaatattttagaatggatcacaaacctataaatggaggaaattaagaaaaaaaaacccaccacggtaagaagtatgatttagaatttctgattattctcttttaggaataggcattccagagggagaaaacacagcaagtagaaggcagaaagtatttataaaaaaacaattgggaaatcattttaattgacttatggaagatataaacatttagactaagatgactcactgaatgcaaagcaaaatgaataagaaagtaacagaaaaaatacacctatgccattgtagtgaaatttcagaaaattaacagaaatgcctggagagaaaaatatgaaaccctgcaaagaaataagcatcacagtgaagtcagatttctcattccaaacttaagaaaaggagacaatggagcaaattacattcaaaatgagaaatgatgaacattgaagaggagtagattagggacaataaatattcacaaatccattgctatttttcagtaatattggtagaggcagatgaatcttgttaagaaaacaatctaaatgtcttagaatctgcactaatttcctctgtattaaaaaaaatccatatctcctgttaaagtcataaactactaaatttatttagataagggaaagaatatttttcatttttaaaacacaattctatgagcttaatgatcagtcttaccagaagctggatagaaatctcatgcattttgcatgattacattcaaaacacagtttggataattggaccattcaaaatgatttaaagtggcttgacaaattctgtcttaagttttataggagcaaactattccttattcatgatagacttactaattagaatgcttctgagacagaaaatcatctggaaatactctttctatatctgcaaatgtatttctgccatttttactttggaacaaagtaaataatttgctattaattatgaccaatttcaaattctggaaattcacatgattttattcaatgatctaatttgcatgttttggccaaagacaagaagcctccgccagatttaaaacaaggacaaaagcagagtctaatatcatcaactccacaaaacacaagcaatattgtttggataaagcataaagttgcctttgatctttagtgggcatattaagcaatttccttgcattcaaaataggtaattttgcattatttcctgtactaaatataaatttctaaaccatttgcttgcatgtatagaagcatattattaataatatttatacttggaaagccagggaagagcccttaaattttcatttttatgtttggtaaatcagtagtatgactacagtaaacaataatttattgaatattttaaaatagctagtagagattaatttcaatgtttgtagcataaaggaaagataaacatttaaggtgatgaatatttaaattatcatcatttgattattgcacattatacaaacatatcaaaatattacatgcacccctccaaaatatccacatttattatgtatcaataaaaacaaaatataaacaaggaaaccttttatgttgaacttcatgtttcagtaagtctatgagagaatgtactatatcttaataagaagaaattatatgccatgttaaaaataaatacactttagacaagttgcctccttttgagtggagagtacattatttatacaaaaaaaactcttaatgtttactaagctatggaaataacatttagagaaactaaaagctagttttaataagggtttatggcttctttctgctggtcgatgaatcatacatttacttatattagaacatgtgaatctttattgattatgctatggcactaatttcaaaatagggatttcaatttgcatttgtttttgaaagtaatacaggtatattatataaataagtagaaaaaatcccattctaaatcatccaacattcttattgaaaatgaatttactaagaatttaaaatactgggatttcagatatcctatattttctcatcatgttaaatcataagccattcattttgttcttgaagatacttttaagtaggtaagcagtaaattttatcaaatgtcttttttgcatctaacaaaaaaagatctagtcatttttaaaaacttggtatgcattctatattaatagtttttaaatattgaattattctttcctgtttataataaatataacttagcaatagttttttgttcttttaatttgttgctattcttgactttaagaactttgtagtcagtttatgagacgcacacatacaaccaaatgcaatttaatgttctggttgctatgatagtattttgtaaaagccaatatgaaagataaaagggagaggaggctgacaacacccaaacctaattatcaatcaatgggatggctagacataacctgccttgtgacatggtggaatagaaagtacatagcaatgtctgtgtagtagtcttagtttaaagaataaagcagaaaaaagaacttcatcctcaccaccccttcaatgatagagtgcatgggggataaatggacaatttagacaacacgagaagcaaccattcggtcaaattcagaatatgaacattaagtccaaatgatatttaaattgagttgtttaaaaacacaccttgaagaaagacatggcatgaaccatggagggttgttaaggaataaagatttacaaaactacaagtaagacattatgtatgtaccttgtctgatgctaatttaaacaaatcaaccataaagaggcatttagaagtcagtcttgaaaatctgaatggagtctaggcattaagaaattaattgtgatgtgtaataatagcacctgggatgtattttttaaagttgctataaaaatacttaagaatgaaaggtaaaagaatggttgtattagatttgttttaaaacatcaagctataacactgatatagaaaatattgataaaataaaattggcaaaatgttatatttattggaaccacgttatgagtacattgggtttcattatactgttttctctcattttttggatatttaaaaatttttcaggataaaattttcaaaataaatataaactaacagacctgagggaggggtaagcatctgcactcaaagaataaggaaacattttctcatagtgttaaaaatattgtttatttaaatggacattattttgtaatctgctgctaaaacccatgccatgctatatagaatcactgctatgtgctatatgaaaataaattttgaaaagatactatccagactttatacaaatagcattcaaaagatctcactcagaactcttgtcttgattataaaatgcaattttgttctatttattatgcactatggagaaaagacataacaattggagagctgttttctccccattagtgttaacacagataaaatatttattttttatgttttaataaaaagtatatataaaataacaactaaacattattatgtttttttggtagcaaatataactccatctgaaacaatgtaggcaagaaaaagtaaacttcacatgtaaaggaatatattcaatattaaaaatggatttacacttatcttttaaaaaaattaggttttcaggtccaggagaaaaaacagacccagcaattgtgctaaaataaaactttttctaggaaacaacttcaaaaagatatatttctatgacttgttttctctgtctaatcagtgaatttataagacgttcttctgctatcacctgatgaagagagcattataaactttcccgatatgaggcagaggttttctgtaccatgacgccgtctgtgttgagcgaaccattggaaagtgtgagagagctagagaatggccatctatcttgtttgccatccttttttttttttagaaagttggcactgctagaacagcaagagaagagaaagaggcaagaaggaaggtataagaaataatcgatcaaataaaaagaacgaatgaaccaggtagatttttcagatagatgagaatatgccatttgtagcccaatgcacgattgaaacaagtaaaatttgttactctttttttttttttttggagacggagtcttgctctgtctcccaggctggagtgcagtggtgtgatctcggctcaatgcaggctctgcctcccgggttcatgccattctcctgcctcagcctcccgagtagctgggactacaggcgcccgccaccatgcccggttaactttttgtatttttagtagagacgaggtttcaccgtgtttgccaggattggtctcgatctactgacctcgtgattggccctcctcggcctcccaaagtgctgggattacatgcgtgagccaccgcacccggctttattccccttaaaaaaaaatttttttttttgccacttctatcagaactaatttttctatatgaaattgccctagtttcagaaaatattatgttaacctatttatcattacaaaaattctagaaaatgtgtgtaataccaggtaagtttttctgacatataattgtgtcaaaaagcttaatgaaaatagtctaattaatagtgtctgattatcctatcccaattattcattggaataaccacagaggcctccgagatacaaagatgaacaggaacacaaagaatgcttagtccagcttctggaagctccctcccagcttcgagtcttcctgcctttgcttcaagttgtcccacctttccagaccgaactaatgtaccgattgatgtctcatgtgtccctaaatgtataaaataaagctttgccctgaccaccctgggcacatgttgtcaggacttccagaggctgtgtcacaggcgcgtcctcaaccttggcaaaataaactttctaaattaactgagacctgtctcagattttctgggttcacgctatcgttttaatcccggaaacactaaatccagggcaaataagactaaaaggaagaggtttccaccactgaaacacaaataaaaacttcagtgtctctacctccttccactgagaaagagagccttttaacgtggtgagagctccacccacccaacctctttgtgcattcaactgcaatgtgccactcagtcatctcacaaaggcggggtgaaaagcagagttcacagggcatgaagtagcccacaggcagctgccctccagtgggcagcctgtggttttgctttttgccaacctcacagcagagcccagcactttttctcctgaaaaagaaaatccactccaaaaaagcactggggagaaaagtagattttacagaagattctgtggggacacagcaaagaggatttatgtcacagtagaaagtaaacaacctaacgcagagtctcacattatttttccccacattcctcttttgctagtggccattagcccctgtctttctttccagagtctttcccacaagaaattaccctcccagctttcctccttctgactagacctgtttgaggactcacaggccctgcaggcccaatttagtatagccttatctaatcattcatttaatgaactactctagctgtctagggggaatctgctgctaagaaaacagttttgtgtcattatcaccgcatcctggatgtgaaataagcaactattaagacagagtctagaaggaccctcaatgaagcgtatgaatatgtgtgaatgctttcctgtattgcatagaaccagtgcagaacatctaaatgttgttcattactaagtgagccaagttattttatccttactgcaaagctgatttcaaaaaaagcctgcttcattagatttcaggcccctcacttgcagagtctatttaggtgctgtaagtaggtggagctatgcagtgttcaccaacctttcatgtgcacataaatcacctgaggaccttgtcaaaatttgcagatttggatttagtaggtcatagctgggacctaagattttgcatttttaacaacttcccatgcttttgatccatggaccctactttgagtagcagggaggttttagggggttagtggtaaacgaatgggagcgggagagataccaaattgtaatcagaaagtacttctatgtaatatttctggtaaaggaattatagagaaagagactcagatttctaagatgcaagtcatttgtatggatttactttttcattctaaatactctgtatatcaattttgttgctaattctatattcccaattccatactctttttcttaaacagaacccctagaattatataaacttcaggctccagaaagcctggatctgtcactgccagttgaaccaaaaatttggtttgggttgtgcatatccccttagccacataatcaacatctgaaaaaaagagtctatcattaggaagtaaggcaatgaggagaaaataatacaatctctgtatttgattgctgccaaaaaacaaggtctagaaacatcgcttttcaatcaaggctgagtaaaaactgaggggaaaaaaaggaatacatggctttactaaatatggctctacaacataaagaggcatgttactataatgatggaagaaaaacattaatttctattagaatgaaaacaaaccctattaaagtataatttttttagttttcaacaatataacagagaaaattatgaagtcttagaaaaaaagaaaagaggtactcataatgaagtttgaaatataaaacatcaaaactatagaagtccaggtttagtccattcaatggaaagaaaaaaaaatccacacttcaaaagaatgaaaaagaactaacaaagaaccatatgtatactcataaaataagattaggtgatgtcaagtaatattatgaattatgacctaaaatatcaactctaaagccttatgtaagagacatcagaacagaagggagattattttgctacaggatgtcacttacatgaaagacaactgaaacaaaattcgaaatgaactgacaggaaataaatcattggaaaaaatatcagcataccggtattagtctatggaatcttaagtagacaaacttacaaaagggaaatagtggccataaaaaaacataatttatagaagggattgattatatattaaataaattattccatggattaagaatagagctcttttcaagaagtcatagctttattttgaacatgtgcatgttcttagattaaaatcaattacatataaaaacaaatgcatacaattcacatattttgaaaacatagtatgaaaataattgtacaaacttaaaaaatgtcaagcttataaattaaaaaatgcctttctgaacatatcaagcaatcaggtatgcaatgaaagatattttgaaaagaagcaattatatcaaaattaagtttcacaacctaagttgcactgagaaataatatcacaatcatacatgctctagtttttttttaaaaaggagactaaactttaagctttagtaattagaaaagaacaaatgtatagagaaaaataaaacacaagtatattttttaaactacagtacaggacaaaaataaagggaagaattagaattgataagtcggagagccactttaaggaaatctaatatagtcggcaaaattctagtgaatatacatttaataaagaaaacactcaaataaacattataaatagagtacattaaggcttctttagcagaagaagaataaaatctgtcttcaacatttttaaaggaaaacaagtgaatttaactgctgatgctggagtatctcatagaaaattacaaaaataaacaagattttgaaagggtagggatgaagctaggcttcaagatgaactaaagcaagggccattcagatcagaattcctttcccaggaattatttatgttaacagaagtagcctatttaccagggctgatttttatatatttatttattttacattatacctcctgtaaaactcagttgcctatgattttcatttttgacaattctgagtggaaaacaaaattgaaaatcttgtaggatcacattgactttctgttttgtttcttaacacctcattggggctgtacccacttaatctaagtttccagtgttcactctctctgggcataactgaacatttgtgtctactaaagtccagcatttttaggttaacatgccccataatgttaactcagacccccttgcatgcattagatttgattttaactttacaaaggtacacattattccaaaattatgagaatagcaatagttgatgagtggggatcaatcagatttcactgaaaattttagctaatccacaatattttggctaatccgatggccaagtgaccatcagctgacagtttggttattatacattaactagagtttataaggaaatctggcctaatacatgatgatttgtttctcatgaatttgtgtcaaatcttataccacaaaagaaaacatgttttttgacaaagttaaaattattccattatttcctcctcatacacgtgagccagtgagtatttgagtttatcaatctcatgatacctttatttaggcgagaagaaaatagtcaacagactttatattctcttatctgcaatatgcaagggtgttccggtcacaggaggcacagccccaagacacacctagtagtagcttattattttactgtataaatgtctgccaggccgggcatggtggctcaagcctgtaatcctagcactttgggaggccaaggctggcagatcatctgaggtcaggagtctgaaaacagcctggccaacatggtaaaaccctgtgtctactaaaaatacaaaaaaaatagctgggcgtggtggcgggagcctgtaatcccagctactcaggaggatgaggcaggagaatcgcttgaacccgagatggggaggtcgcagtgagcccagatcacactactgcactctagcctgggtgacagagcaggactctgtgtcaaaaaaggaaacaaaataaaataaaacaaaacataataaaataaaatatctgccaattgcccaacctaagatcagggaaactcactatccctatcgtgctaagggaggaaataaaaaactaataagacaattaggaatcaaatagaaagatggtagtcttattgtgttaaatgggacctccatttctgggcaatacgcagccacaggaactggatgtactttcataggggaaacaactaaaaatagacaaaatatataaaatttatatatatatatgaaatacataaaaatgtttataaattttatacagtgaaattaccaggaacccaggtagagctgaagagtgtccctcagttgagggtatagttggaaatctgagcagaccaaagtgactaggggtcacaggccaaatagtgtatgtagtgtttgtgcctgttaccctatgtaaattttgcctcaactggataaaaaaaaatctgaaaaagtgtaatgctatatcaaagttatcagttatctaggggaaaataagatcatgaccatataacaatattatcaattaaagcactaaattgagtaatgtatttaaccagtaggtactgagggcctgtggtatactagatgtcataatagatgatgagcatcaaatgtggaacaagagaaactagtttctggatcagaaatcgcatcatcaggatactacagtgagactgagggttataagtgtgagaatgatgtaggaagagaaagtatgaggtccactaataatgcatttaggtaagcctagcctcattttggggtcaataaggtctttttgtagtgatttgtctaaatcaaaacatggaggagttaatgaaagtgagagtaatgaggttgggagagtgtcctagtcaggaataagttcatgcatgaagacccataggcaagagaaaatactgcattttagaattttaaaaaattaaataaaatcaaatttacaagttcatatttttaaaataaagattatatatctgaagctgaaaggccaggagaaagtgccataaaatgaggtttaacaacatactgttgggaatgtttttatagcaaataacatttaaaatcttttattaaaagaggctcttccagctccatccatgtccctgcaaaggacatgatctcattcctttttatggctgcatagtattccatagagtatatgtactacattttctttatcaaatctgtcattgatgggcacttgagttgattccgtgtctttgcgattgtgagtaatgctgcaatgaacatatatgtgtatgtatctttataacagaaggactaagtgaggggttcatctgcgcagcaaaccaccatggcacacatttacctatgtaacaaaactgcaaatcctacacatgtaccccagaacttaaaatgaaagttgatatatttcttttaaaaaagctcttttttcacatgaaaagaaattactctgattcgttcatctgtttaactatgtaatggggtacccagactttgtgtctttctgatgtggctgttcttaatgtttgacttttggtttccttttgacacttatagtctcaggatggccactgtagcaccaactattattttcacattcaaggcaaaaagaagggagtgacaactttttattcagagaaaaatacatttttaaaaatccacccctacaaagagtataagctactttgatacgttgtttcacctcacaacctatatgtgtaagcaaatgtatatattgaaaagctttccagctgcaagagaggctaataaaatgagtagattttccaaaaaagaaaaattattttggaatgagttgtgggtctgccacaaagcagactgaagcttcatcttcaagggcttgtataccctgtttaggacttgtctttacctttaagagaaataaaaaagatatcaaaaagctttaggcatgcatcacatgcttttggaaaggttgctattgcaggtgttcagagaaatgataaagtgacttgcagtagatgaaaagagtagtggaaacaaatataacttgatgattgaagagatagaaaaagcacccccaaagtatgaagattgattggattttaggagaaaaagagatggagtatcaggaaaggttttcatattttctacccaaacatttgagtgaactttaatgctgtggatttagatgggggccagagctggatggaaaatagatttgatgggtaaagaacatggacttcttctcagtaattgagtttaagtgtctgagagacatctacctgtaaacgattggacagacagatatttggaattgaaatgaaaaagaaaatgttaaacatttatatatatacatgccttaaacaatgttgcatgccatgcatgagaagagagcttcagaaggagcctcaagaaataccaacaatgaaaaattgattagggtaacaaaataaattgagagagacttcatggagtggaagaaaaccaggacgatggacttccacagaatcaaaaaaaaaaaaaagtgagttgaaaagtgatccagcatgccaaaggctttccatatgtcaaaaattaatggaagaccgtagatacaaaagtgtaccttagaattagtgacatcttagcaggagagattttttgttgaatggtggtgatttatattgtgttatgatgtgtctctggaggagtgcagagaagtaaacaatggaaatttggggtaaaggcacgtttcaatacatttgactgtaaatgcaagaaaagagtagaaggaaaaggtgtgaacttgaggaaaatgtatgtatgtattatttctgagttgagagaattaagtacgtgtaaatgttaaggatggccagtcagaaggtcaagggacaacccagatgtgggcatggcaagagaaagatacaagaggataggatgagggcagaagtaggctgacttgcaaatatgggtatgagaggctatgagtcctcagcatactttttggcttcttttttctctttgaagtgagaagtaatgtcgttattcgaataggagaggaggtggagggttgaagaatgtaggagagttttgaaatatttattttaaagaatgtgagaagcaactaactagaagagacagcattgccagaaagttttggaaaagtggttgatgttgaaccataaatttatagtggcagctgggtttaactatccaggtgcaagctcagagaaggcagttaattggattcatccagcactctagggttttgccaggcaagtgtgctgaaaggacaaagtgacaacaaggctttatagatttttcagaccatggtgaaataatgaagcattcatgatcattctgaaatttctgaggaaagggtggtatgataatgattgtatttaatttacaaagttcccaaactttgtatggttgatagatatcatttcttttaagtgaagcacatcaaataattaactttcaatagtttggaaattctagataacctaaaacaataggcaacatatatcaaacattattatcatacaagcccatagaactgtgaatttgtaaatatcatcaatagtcataatatcatgcccctcactctcacttatagcaaagatttgatcacttccttggagcacatgtgaagcttgtgctgcactgcctttcctgtctgagtcatatacttgcagcttgtcctagccatcattttcatatacagctcatcatccatcttcaagctgtcctcaaggtagcttcagttgtctctgtagcttttccttccctccttttagccctgacaagcattcatcagcgagaaaaacatacacagccctcttctcaaaaagttgtcatcaactcctctcaacgatgcctctgtttctatatcctaactgtattggactgtgttctatttccatcttcatagaatgcatatgccagttaatgattgctacttccatgtactcaaagtctctgatttctccaaagacattagaaatgcaactcattttacatcagtgaccctcttttttttctgtacttctatatcttcctatttataacccagaaaaaattattattttcctcttctcatcagaattagagctccaacagtctctctgacaatttcccgatttctaattttctctatttccattttttatataataattttatttcataaattcaattgtttctataattttaaatttttctttgctgatttcttagtacttattaatagctgaacaagtttatttcaaaaatgatagtttgtatctataattctgagaactaacaaaacctttctttaaatcaatagttggtagggtgcagtggctcacacctgtaattctagcactttgggaggccaaggcaggtggattccctgagctcaggagtttgcagaccagcctgggcaaattgatgaaaccccgtctctactaaaatataaaaaaatagctgggcgtagcagcgtgcgcctgtaatcccagttacttgggaggctgaagcaggagaattacttgaacccgggaggcggaggttgcagtgaaccgagattgtgccattgcactcccgctcccgcctgggtgacagattgagactcaatctcaaaaaaaaagaaaagaaaagaaaaagaaactataaagaagtcgttaagttagtttatgtatttatttacatatatttatttttttaaaacaaagcgaatgacaatcacccacgtgtctaacagcaaagagagtggaacaattcaaaataaaattttattgatgcaagtgaaaagagacataataaaagaaatttaaatgtacttttaaaattaattcccataatgccaatatttcagaatgatcatgactgtaattctctctcctgtttgtcagaagtgtttcgtgacttagaccataattttcaaggttgcatagttttctattatatccatatggcatgtatagccatctatttagaacatttatatttttctgattaactttgctattataaatagtataatgtgcataattatagttcattattttcatagacctcagataattttattagggtgaatttctaaaaataaaattgcaaggttaagtgacatgcacattaaaagtcttgtgacctaacttaccaattaatctctgaaaaacatttccagttttattgccataagcagtacataatttcaatgaaaaattaataaacaaaacatttatttttaccaagcatcatgatgatcactattagggaaactcaagagtaataaaaaaccaggaagaatgaatctaatccatttctacagttatccttatctgaaaatccttctactgattctcttttcttttaaaacctacaaagggaatgtggcatattttgttgttgatgttgataattatatcatttataacatgaaaattttgtatatctaaaatgagaaaggatttcatctttcacagtccattttctttgttttcagctttgacaactcttttctacctgatagagctttttaatatttgtttctttccttttcccttttttttttccttaggccatatgtaaattgatgtaagtgtgaagaaatttcaggaaactatgttacttgatttcaggaagcaacagatagacgtgtctggcgtgtgtctgagcaaggatttagataacagcagaaagagtcttagcagttgtgtggcacgagcattatttggatcattagcaatatgtgttgagataagaataaaagcacctacactaagtgtctaatgctatatttactattatattcacctgcaaaccagacaacgtcagtacaggtggaacaagaagatgtcttttatccaaatctcttacctgtggacaatctcaaccttgcaaattaaattaacattttaagggattctaaagaaggatattttacagtttctctcaggagtttattagaaagttttctcctataattaaattaaattcactgtctatagagatttcttaagtatctttccattttattttgctctggatttgaaataatgcgttctctactcttaaggttttctctcatttaaactattccattttaaaaaatctattttaaagtgcaaaaatagggaaagcatttcccccctgtacaaagaataacatgagttaaaatatgatcttttgtttctttataatcaaagctatttaatacctcttttgaatgaaattttacttgttaattctcatgttcaatttcctctgcaactcaaagtagttgtttaagtttgaataatttacttgaatgttaattataattcaaagctaatggatatgaaatatgtttgctttggtgaatgtacaaataaatatatctcgaagtattttatatgcagaagagaatattaatttattataaaacattgccatgttgtattaaaataatataggaacaaataagactgtgtacaagaggaaggcatcagttagatgtttaattaaaattaaagttgaaatttagatatatttactttaatatctatatttgtatattcttgctctgtattacagaggttgaataaaacatactttgtctgtaacaaactattgtgatgagtcatttggaacctaaaatgacagttttaatttagctttctttgcaaatctgaaaatagttttaggcactgtaaatagctctgtattagaaaactatttactttcatgatttttctgagcataaacactcataacaacaatttttgaaaagttttattcagttattttgtactattagtttgctagaaagccactgaatatttaccagtaaagaaagattgaatattagcattgtcttaaaaatattattttagtattatagatttaatttggttcaaaatgaagaaaaaaaaagaggcataacacttgatgatgtgaaggctgattattgttattcatattctccttaccacttatttatcttttgtgttaaagttactaggatacacaaaaatgaaaaaaggaaccctcaaaattagtattggctctttttttgtatatagtaactgatacaattaaaactctttataaaagtaagaaaataggatttaattttgaagtcatttttttctgttttcactttttattaccacagttgattgagagctgattatacatctcgtataaataactaacataacattgtcacacaacctctaaattgtcacattctgtgtactacttgtactctgtaactctctgtgatgatatcaggtgtcatctctttctcttattttcagtctttctgactaaaacctaccttagtatatagtgtacacagtttctttccatgggcaaagctagtgttcttagtgaatacgtcttttgaaaaatgtcaaaattttgatggggtggaaaatgcttaatgctttttcccatgctgtcaaaatggtgacatttgacagtgtgggataatgtttaatgttattcctgggaaatgttcataattcttgtctataaaaactcttcattttgtttttctataactccatttttatctcacaaaatttaactctaaagtaacaggccaggagtaatagttttgaatctagggtactaaaaagtgtaattctggaccactccttctgaaactccatagttataggacatttatgatctaatgagatagtaggatgcaaaaaatgatcattcagtggcattttagtgcataatagttaatataattgtgttgtaattatcaatagtgcgagcctatggaataattctgcatttgtataagattattattctcttttcagagacatttatccaaggaaacatgtctagaggataatagtacttatctaagcaacttatcatgaatattaaaatgagtgtgtgtggctaaagagactggcaaaaagagatacaagttaccacaagtcattttttgaatgaggtagaatataaagttttccacaattttaaagaaatggaagatattttaacaaacagtcataaagatataaacatctgcaacaaacagtggtaaaatagatggtttgcaattgtagttctgtatgatgaagcagtacaaaatgacaaatgtttgattttgatgtggtttgttgttttgttcatttcctcaccaagtttaaaaaagccagggaaaactttctatgcatagtaaaataaattttgatcttctaaatatggagaattgtgtcttagagaaaaactttttcctattgcatagttgtacagagcttcccgggttctgcagaagtacaagtactgctgcagggtccagtgatgattaggtggggatatgagccatcagcctcagctaaactctggcagctctatacgaaaagaggatgcaaacaataccaaatcgtattctatttaaaaattgttgaaagacactaatctaaggcagtttgttaattaactagtaaaagaaaaaatatgggctgggcacagtggtggctcatgcctgtaatcctagctctttgggaggccgaggtaggtggatcacctaaggtcaggagttcaagaccagtctggccaacatggcaaaaccctggctctaccaaaaatacaaaaattagctgggcgtggtgccacatgcctgtaatcccagctacttgggaggctgaggcaagataatcacttgaacccaggaggcagaagttgcagtgagccgagatcatgccactgcactccagcctgggcaacagggcaagaccctgtctcaaaaacaaaacaaaacaaaacaaaacagaaaaataattgtgtatcccaatattctatataatacaatagacatcattgaatggccagcccatctcccaggactgtgcagcataatggaagagaaaacttgtagctaatgaatgtgataaatggatttttgaaaattagatagagtttttggaagtccagatgtaattaattttgtcttgggagaaaggagaggaaataacactaacttgatgtatcaagagggaaaagtaatatatttcagctaactttgatgctgcagggaggggaacattagaaccaaaatgaagaaggatgatgattattattggtgaaattactgtaaatatataattaacataatataacaaatatacctatattaatactacatattaataacaatgattattatattttattatattaatggaccacttatgtaccaggactatgctacaacgtattttacatgtattacgcatctaaccttcaaccaatcctgtgtgataggcactataattatcttcattttaatgatgaaaaattgagttgcaaagaagttataaaactttcccaaggtcacatagtgggaaggaatagagccaagacagaaatgtggacagccaatttcagcttttataatctgaatataccacatcaatggaataacagtttgagataatataatatgaatatgttaatgaaatatttatcaatcacctcctataatcttgttattgtgctaggcactggcaatacaaataaaatatctgttcttaaaaagtatgcattcatgtgaaaggaaggcaataaaataaaagttaaaaaatatgcattctacctaacatatataaataggcaatgatattaaaatatagtaactaataatagctaacatttatacagcctttactactcaaagtgcctcacttacatttatttaatgctcataacatttctatgtcagaagaactattctaataccatctttgcacttcaggaaactaagacccagtgacattcggtgacctgactatggtcgcagttggtaaatagtggagacttgttagaaaccaaggcaaactggatgtgaagtcattgtgataaggagggaccagttctttctttctttcttttttattttttattttatttatttatatattttttgagacagagtcttgctctgtcgcccaggccggagtgcagtgctgcgatctcggccactcccgggatctcgccgcctcccgggttcaccccattctcctgcctcagcctcctgagtagctgggactacaggcgcctgccaccacgcccggctaatttttttgtgttttttagtagagacggggtttcaccgtgttagccaggatggtctcgatctcttgacctcgtgatctgcccacctcagcctcccaaaatgctgggattacaggcgtgagccactgtgcccggccaaggagggaccagttctatgacagcatcctcaaatagagaaacaaaaacagtcttaaaatcaagaagttgccttcagcttggagaggaagaaaactgtaaagagtttggcttgcagcctaataataataaaagaaggaaaacagaagagagaaggaaggaggagagagaagaggagggaaaaggaggaggaagaagagtagaaggaagacaaactcctagtgcacaactttctcaaacccatcacagagttctggggtcataaaataattaactagccccaaatctaaggagatacaagatcctacagggagaaactagacataagcactgagttacctatgaaagacacagccagaaaccagtgacaggagctcaggtaaagtgattagcaaatcggtggagggcaaccaactgtgaaatgaaagagatggaggagatcctggtgatggcaaatatgggtgatgggatttcttttccatggcctcttccagcttccatgaaccctaccacaaataataacaacagtaatatccacatataagctaacaaaataaataaatacatgaattaaatattatatgattatacattatcaacatattattaatatattatgttatatgtatgagtctatgaagacaagagcatactgagaaagtctcttttcaaacgcagtgtttgatgaggggaacagcttctgtgaagggactagggagagtgtcaagaagcttcatttgggattagtcaccactatctccactctctcttgtggaacaaaagccttaatctatggaggtaagggccacaaatacttttaccttttaggacatgaatgaaatcccattgcagctgatgagaaggtacaaaaaccaaaatttgtgttccattgtgggctaagaactatggcaggggtgtggcaggagtattgagaatgccaaccctcaaaaccagggaatatggttcctgcttacaacagggacatgataaaaacaacagagaatacactgtcgaaacccacactcatcttcaagctgaaaatcacctagcacaaaataccttgccagagatctctctggtatgtagcacaaagaaagatctcaagctaacagtatagcagacacttggggaaaaaaaattagacaaatcagatcctaccatacctggtatagctaaatgaatttaaaacatgtcgtataatgacggtaaacatagttaacaacttcaactcccaattagattaactctaacctctcacactaaaggcctagcagaagataaagtgtgcccatttccagtgataaaaattgtttgcctcagtctctgccatgctatacaagatgctcatctttcaacaaaaaaatggcaaagcactcaaaaacaatctcaagagatgaaacaattatcaaaactagactcagatatggcaaacatattagaactaatttatagggaattttaaataactatgattaatatgttgaaggttttaaagggaatgtggacaacatgaaagatcatatagacaatttcagcagacagaagcaaactagtaaaaataaatgataagacaataaatgaaaatcataataacagagatcagagttgaaggatacatttgaagacatcatttgactcagcagaggaaagtcaatgaaattaagtctgtagaaattatatgaacagaaacatattgagagagagagaaaaagagaggtggaggaagtagatccaaagcttctgggacaatatcaaatgatgtctcatttgatgagggaaaaaatagggaagattaaatacttgaagaaacgatgagaattttccaaaaataatgacaaatccaaatatagatgtgtcgttatgcaaacataattcccaaaacacagaaagccaaaaaaggatttaaacttatctcggaatactatactcaaaccaaaattaaaaaaaaaaaagaacaggaaacaaacaaacaaacaaacaaaaaacaaacaaaaaaaaacaccaccacacacaaaaaaaccttaaaggcactcaagattaaaaaataaataaataaataaataaataaataagacacactacattgaagaaacaaagaattaccatagaattatcttttctgttttgttttgttttgttttgtttttcttgagacagagtcttgctctgctgcccaagctgtagtgcagtggcgcaatctcagttcaccacaacctctgcctcctgggctgaagggattctcctgcctcagcctcagaaatagctgagattacaggcgtgcaccaccacgcctggcttattttgcatttttagtagagacagggttttaccatgttggtcaggctggtctcaaactacagatctcaggtgttccacccacctcggtctcccaaagtgctgggattataggcatgagccattgcacccagcctagaactatatttagcaaacacattctacaaaagaagatatactgatgacatatacacctatgaagaactacatatcattagacattgtgtacatggaatgaaaagccacacttattggaatgaataggaaataaacaattccaagtgctagagaagatgtggtccaactagagttgttatacattgctcatgagaatgcaaaatgggacggcccctctaaaacacagcttgtctgtttctttaaacacacatttaccatagtatctaagaattttacttaaagacatttacacagtaaagtcaatacatatattcacataaaaagttgtacacatttgtgtgaccactttattgattattgccaacaaacagaaacaacctagatttcattcatggtgggggtggggggtgggtaaatggataaacaaaccatgttatgtccatgcaatggaataccacttattaataaaaaagaacagactattgtttaatatgacaacataaatgactcttaaatgcattttgctgagtgaaatgactcaagcataaagggtatgtattatgtgattccacctgtgtggcattctggaaaagcaaaaatataagaatggaaatcaaatcaaaggttgtgttgcaggggtatagagtggaggaggggttttctacaaagagttagcatggggaaaactttggatttctggaactgttttgtatattactgtggtggcctatacatgactctaacatatgtcaaatctctgagaattgaataccatgagttttatggtattgagatttttaaaaatcagcaaggatgttaggggaatgcaagagagaatgtggattaggacaaaacaatctacttgtattacaaatgaattaagaaccataatgaagaagctgtgtgggagaatagagctgaactgattaactttggaacacatttgttttgcgtggattcttcaaggctaaagacaaaaagaaatgtaaataaacattctatttgctttttcccctcaaagacttgtatgcataaataattttgaaggtacttgaataacaaccacaaagtgatagggaatagagggtttgagagtgtgggttttgttggattttgtttgtctattagttttaaaatggtgggtcatgtccttttttagagaaccagtacagaagaggtctcagataggaaaagaggggaactgagagctaaggagttccagaggggtgaagggaaaacaagcaagaaatttagttccagggttggtcttgaacagatatagaagcttgtcatactctaaagctgtgacacattgaaggtaagtatgagagagaaggcaaaatgcttcaagaggcaaaaaccaggaagttcatgcttactgatctcaattcactgaataaaatagtgaagaaatatttctgagaatgaagagagtgatgaactaggagcagtccagtatagcacaatcttcattgaaaaaaaatatgtatatatatcccatgagagacgactataatagtcttctcttgaatatctggaaaagtgaatgcatttaattttaatatctttgaaagtatttacccactacagcaaaaaccaagacctttttattgtttaacagaaacaaaaatttaatctattcagtgacttgtcttgcttgacatttttaacacaagtgtttaaatgggctttgaattttaaaagcaaagaagcaacactggaatgtgtatgcctgccatgctggggaacatgaaataaaacagggcatcagctaagtctgaatatccatgaagtcaaattatgtttttcttaagtaaatattttaatcctgaatactcagcatttgcaaatggtgaatttcttaaagagaatccaaagggttcatttgttaaaaaacaaaaacaaaaacagaaccttagtgtaccaatgctgaacagctaacttcacccaaggttcccaaaaactacctattttaaaatggaaaggaatagtatagttacatgcatataacacaagtaccccaaatttggaaagagatagtaccctcttaaaacaacaacagcaacaaaacagaaactcccatgacagcaatctaaatctgttggccacccaatgcagtacaaaacactaataggatgtcagcaaaatttcatcctccttcctccattagttaattaataaccagttgatatccctatcacggaagcatctcccagccaattttggtagaattctccatggacagcagtgttaaatgattggaactattgtaggggtgagttctgctaaacagcttgctcaagtttatgtaacacaaaagtagaattcaaagagcattttaatttccttttattttctggtcaatgttaagcctattttatacgaaaatattttattaagcccaattacagagcagagaattccactatatttagattatattttaattttatataacactataaactgcaataataatagtttacttatcaattacgcatcagtggctaaattaattattcttcagaaatactcatttactttcatgaatctagatctctttaaataaaattgaggcaaattttctattttacaaaatactaaaaattaatatcactcaatccgtctttccaagaatttcttatttttaagtgttgcattctcaacatacatgattaaattaacatctttaaggatttaagataatttgtatacgaacaattactggcttggaattgttaatatgacataattttgatacaatgtctaaataacatttcgctcaattaattgtaaagaacaatagctcaatattttagatacatgctcgtattttcaaggactgacagacatataaagcaatcagttggctgttttcccaacatacatgcaaatattatcccaatctatttctgaatagttttcaacacaaaattatgttcgttccctagatactaaatgattttttaaaaagaaagtcaaattaaaaaggccataccatctcatctctcttttcgtccaacagccagatgatgatctgactccttccaaagatggagtctaacctctgaattcctgccattttggagtgaatttatattatcagttgtgctctgccacagcacacacactgcaacgtctggttacatggtgcctagcaagtctagccatgctccaatgaatctggttggtctcaagagctcccactgatctggtactctatgctaccaaccaaatctaaactgacaagtgttttttgttctcctcagcttaagtcgtgggaaaattctttagttatctaagtgaaaccaaataaaccaaatgttaatgaattataagattgcatcaggatcttaacactcatggaaaatgataaagaaataacttagcaactagggtttcagttattcagccactgtggaaggataaagacaattattttggaaaagcacaagaagttacaaactattgtctaaagatacctttgattagccaggcgtggtgttgcatgcatgtcattctacttacttgggatactaaggtaggaggatcctttgagcccaagagctctaggctgcaatgagccctaattgtaccaatgtactccactttaatggaagtgtttaaatgggctttgagtttcaagaagaaagaagaaacactggaatgcttaagtctgccatacttggggaagattaaataaaacaaggacttagttaagtctgcgtatccatgatgtcaagttatgcttttctgaagtaaatattttaatcatgaatactcagcattttcaaatggtgaatttcttaaagaaaacccaaagggttcattagaaccctccaaagaacaagacctcatctcaaaaaaaaaaaaaaaaactaaaaaataaagaagcctttgagatttcttgctggtagtgcttcaaaaattacctaatagcttgtaattatttgtaaagctgaaaccaaaatttactaaaataaacgcttcttaagattttccatcaaatatcaaaagtgataattattcctaatggttaaaaaatataaaattttgcacgttgaactaactaacattgtatcctggggatgaagccaacttgatcgtggtggatcaactttttgatgtgctactggattcagtttgccagtattttattgaggatttttgcattgatgtttatcagggatattggcctgaagttttcttcttttgttgtatctctgccaggtttttgtatcaggatgatgctgacttagtaaaatgagttaggaagggctccctccttttcaattgcttggaatagtttcagaagaaatggtactggttcctcttttacttctggtaaaatttagttgtaaatccatctggtcctgggctttttttggttggtaggctatatattactgcctaaatttcagaacttgttattggtctattcagggattgaatttcttctcagttcattcttcagaggatgaatgtacccaggaatttacacatttattctagatttcctagtttatgtatatagacctgttaatatattctctgaaggttgtttgtatttctgtggagtcagtcgttatactccccttatcttttctgattgtgtctatttggttcttctctctttttttctttactagtctagctagtggtctatgtaatttagtaatttttttttcaaaaaaccagctccttgattcattgattttttgtttttttcatttatctatctcctttaggtgcactctgatcttggttatttcttgccttctgctagctttggggtttgtttgcttttggttctctagtaatcttttagccgtgatgtcaggctattgatttgaaatctttctagctttttgatgtgagcatttgatgctataaatttccctcttaacactactttagctgtgtcccagagattctgatacattgtctctttgtttgagttagtttcaaataacgtctttgtttctgtcttaattttattatttacccaggagtcggtcaggagcaggttgttcaatttccaagtactggtgtggttttgagtgagtttttaaatcttcagttctaatttgactgtgctgtcgtctgagagactgttgtgatttcagttcttttgcatttgctgaggagtgttttgcttccaattatgtgatccgttttagagtaagtaccatgtggtgatgagaagaatgtatattatatttttgggtggagacttctgtatctatcaggtccgcttgagccagagctcaatttattcaacatatgcaaatcagtaaatgtaaattcatcacataaacagaactaaagaaaaaaaatcacattattatctcaatagacagacaaaatgcatttgataaaattcaacatctctttatgttaaaaactctcaataaactaggtactaggtattaatgaaacatacctcaaaataataagagccatgtataacaaacccacagccaatatcacactgaatgggcaaaagctggaaacattcccctcgaaaaccagcacaagacagggatgccctctttcaccattcttattcaacacagtattggatgttctggccagggcaatccggcaacagaagaaaataaaggtattcaaataggaagagaggaagtcaaatttgtttgcagattatatgatcccatatctagaaaaccccatcgtctcagcccagaaccttcttaagctgataagcaacttcagcaaagtgtcaggatgcaaaatcaatgtgcaaaaagtgctagcatttttatacaccaaaaacaggcaagcagagaaccaaatcacaaatgaactccaattcacaatttttacagagagaataaaatacctaggaatacagctaacaaggcaagtgaaggacctcttcaaggagaactacaaaccactgctccaagaaattagagagggcacaaacaaatggacaaacatcccatgctcatgaatagggagaatcaatatcatgaaaatggccattctgcccaaagtaatttatgggttcaatgctattcccactaaactaccattgacattctttacagaattagaagaaactgttttaaaatccatgtgtaaccaaaaagagtttgaatagccaagacaatcctaagcaaaaagaacaaagctggagccatcatcctacctgacttcaaactatactacaaggttacaataaccaaaacagcatgatactggttcaaaaacagacacatagacaaatggaatagaatagagaacttagaaataagactgcaaacctacaaccatttgatattcaacaaacttgacaaaaacaagcaatggggaaaggattccctatttaataaatggtgctgggaaaactggctagccatatgcagaaaattgaaactggacccctttcttatatcttagacaaaaatccactaaagatggattaaagacttaaatgtaaaacccaaaactataaaaatcccagaaaaaatctaggcaatatcattcaggacataggcacgagcaaagatttcatgacaaaaatgccaaaaacaatagcaacaaatgcaaaaattgacaaattagaactaattaaactaaagagcttctgcacaccaaaaaagaaactgccatcagagtgaacagacaatctgtggaatgggagaaaatttttgcaatctatccatctgacaaaggtctaatattcagaatctataagaaacttaaaaaaacttaaaagaaaaataaaacctttaaaaagtgggcaaaagacatgaacagacacttctcaaaacaagtcgttcatgcagccaacaaacaaatgaaaaaaagctcaacatcactgatcattagagaaatgcaaatcaaaaccgcagtgagataccatctcacaccagtcagaatggtaattattaaaaggtcaaaaaataacagatactggcaaggttgcagagaaaaagaaacattttacactgttggtgggagggtaaattagttcaaccattgtggaggatcaaagagctaaagacagtaataccattccacacaacaatccaagttgtgtggaattgagtatatgtccaaaggaatataaatcattctattataaagatacttgcacatgtgtgttcattgcagcactattcacaatagcaaaaaattatggaatcaacccaaatacccatcaatgatagactgaataaagaaaatgtggtacatatacacctatgcagccataaaaaggaacaagattatgtcctttgttgggacacggttatagctggaagccattattttcagcaaactaacacaagaacagaaaacaaagcactgcatattctcacttataagtggaagctgatcgatgggaccacatgggaacactggggggaacaacactgactagggcctatctcagtgggagcgggtgggaggaagagcatcaggaagaatagctaattgatgctgggtttaatacctaggtaatgggtggatttgtgcagcaaaccattgtggcacatgtttacctatataacaaacctgcacatcctgcacaattaccccagaatttaaaagttaaaggaaaaaaaatttttttaaattcaaggtttttacatagttgtgattatgtgatcatattatttgaggctatatatcctaaagtgtagcagcaattgtcaaatggagaaatggagaaaaaattactggctcgcatatatgtttcccatatatttcccatgtggttcacatatatttcccagtgcaaaattttgtggtacagagaagtttgtttgaggtaatgtacctctttggaaaaaaatggctgtctatgttgtaaaagatagtatggagatttgtttctattgaactgaaattcaaggtgtcaaccataatatatagaacatgcatctcaaggtctaattcatgtgatcaaaatcaactgaatctgtgtaagacacaaaggaactcatacgaaattatgatttcataaaatctatatgagtaagatcaggatgaaaacttttacagggcaaaatcctatgtaaatggcaacttcagaggttttgctctccgggctataaaagtcaatctttgtggctttttaaatgtgtttaacctcattttgaaaataaaaataacacttggcatcttgttctacaccatggcaataatatctgtgaagattaagaacataaacatctatttaattgaattctcaatttatttgttgttaattattgttattttctctacaaatttcagtaagtggctatagacaatagaaattttcaggatgaaatgagtatatctgtttcataaccttatatttttgcatttgtttttagtacttgtgaacactagtttagcatggactgcatgtgatatggctgtgatcatagcctacgaaggaaaaaaaggcataaaatcaatacttcagagaagggaggagaaaaagtgaaaagatattttgacctctataagagatggtaaaagcatgcaaataaagaacaacatatgttgtaaaagaatagcctcatagagatctgagaatgtggataagacaaaaaaatacacatctcaaacatttagcatattaacgtaaaatagaggtatagactcagtgctttatgctggactagttatgtatgatcatgtgtacattttcatcaatttgtgagaccaagttctttctcacaataggatacttcaatggcattttgatacatcatgtctcttcaatctgcaagcctgtactaggccttattctcatagttgatttttccttgatcagcatagtttttgcacttaatagattgtttcttacaactgttgtatgccatgaataacagtttacattattttataatttttcaccaagaccctttttaacctgccttattacagaatccacagtactgaggaacttatcttgagaaatcaaaatagaaaaaaaggaaattaaaaaattattttagaagtgagagtgttgacagaagactgatgtaacatctctcatgatgtttctttctttgtaattgaacaaatatcattgtcctacattttgaacataggaaaataaaattccagattattactatcttttatttaaaaaataatatcccatgggtcattaagaaattgagaaaagttaagcagtcaggatggccgagtggtctaggcgctgcgttcaagaaattgagaaaggttggcttttatttccttgctgtgtttcagaaaagtatgacatgtattcattaatatgagtatcataataataaccatgatcgtgagaccacctttgtaaatgatttaccattgacaaatattttatctatgtgcttgcccctgttgtaaccagcaggtgggtacagtattgaccacaaagcccaatgtcttctctgatagttcaattttacctcatgtaaattcctaagcagttggtctgtctcatgacgttttggtaaaagggcacttttgctcctctctcacaatgttaatttgctcacagaaacatttttttttgtgtgtgtgcattatgtaatttctctactattgattctgagggcacttattacctaattaatgttattatttctgtgtcagtgtgtccagtggctaaaatattgttggtgcttaacaaatatgtgttgaattcagtttaaacaaatagtagcattatctttcatggtaagattttggatatttcaacaagagcttttctgttactttctctttagggtaaactgactccataggtaaattttataagtctttaagcaagatacttaattgtctaagtcagctgagaaaatagtatctaaaatgaattattttgcgcattcaaagactctataaataagaagaaacatgatatactttttttcttcagataaccacatgatgtgaacaaggggcctctcataaagtattccaacggagcaaaattctaatactttgaaatagtcttcacctggtgaaacattattgcaagacaggcgtccttctgagaataataaagtactgttttcaagtgtgttaataaggtcagctggtacttataatatgctaagacagattattatttaacatcacttgctaactcaaagaacttccttgtcattcaaatataaacatttaattacatcatatttacattttaactattatcattcctcaaagaacatttttaaaaataattaccattctaaattgcttgatttatcctgagagttgtcagtgatggtgatgctgagggattatgagtactcacacaggtattatgaggtgtgtgtttagtttgtacacacacaaactaaagtttgtgaaaatatgaaactaagaaatcatgttgataacagtgattaggtgtgggtttccatagtattacattatggttaccctccagttggtgtattatctatccagattcacagagattttaacaaaggtgaaaaatgctttcctctaaagtataaatctgtccttaggaactaagatgaatttcggtgtgcccaaggacggctcagcaagtgcaatatgtgtacactgtgaggctgggatgctatgttttactgaagtgtgtcttttacactgagaactatttctaatttgagggaaaaacaagtatatcctctaaataacttgtataatgccaaataaactatgaagataggcatttagaaaatgtattctaaggcatgatgctagatgcttatataacagctatctgaaatttgctttactgcagtccttgagctttgagagaccttggtcccatggggctaatgacttcatctgtgtgctaactactatcctaattcagtttgtttattatcatagactcagatgattatatttcactaaagactacagtatttaaaaaagtattatttcagagattgaaaactttttctctaagatcagggacagcccacttttgacacttctattcaacatagtactggaagtcctagacagaacactaggtgaaattaaaaaaaaaatacaaataggaaaggaagaagtaaaattatctctgttagaagaagacatgatcttcttatatgtagaaaactctaaagatttcaccaaaaagttagaatgaattcagcaaaactgtaagataagaaatcaatagaaataaatcatgtttctgtacactaactgtggacaattttgacgataaaattagaagacaaatccatttaaatcgtgttaaaaataatataatacttaagaatacactaaaccgaagagtcaaatatttgtaccatgaaaaccagaaaacattactgaaaggaattaaagaagatgaataaatggaatcatgcacatggattggaagctttaatattgttaaattgttttaatattgttaaattgttgatattatccgatgaaaactttttcaatacaccaactttttttgcagaaatagaaaaattcatcctgaaatttgcaagaatctcaaggaatctcaagtagctaaaattatcttaaaaaagaacaaagttttcccaacaccacttattaaacagggaatcctttttccactgcttgtttttgtcaggtttgtcaaagatcagatggttgtagatgtgtggtgttattcctgaggcctctgttctgctccattggtctatacatctgttttgttaccagtatcatgctgttttggttactatagacttgtagtatactttgaagtcaggtagagtgatgcctccagctatgttctttttctttaggattgtcttggctatatgggctcttttttggttctatatgaaatttaaagtagctgtttccaattctgtgaagaaagtcaatggtagcttgatgaggatagcattgaatctataaattactttgggtagtatggtcattttcacaatattgattcttcctatctatgagcatggaatgtttttccatttgtttgtgtcctctcttatttccttgagcagttgtcagtagttctccttgaagaggtccttcacatcccttttaagttgtattcctaagtattttattctctttgtagcaattgtgaataggaattcactcatgatttggcttttcatgactaaaacaccaaaagcaatggcaacaaaagccaaaattgatcaatgggatctaattaaactaaagagattctgcatagcaaaataaactatcatcagagtgaacaggcaacttatagaatgggagaaaatttttgcaatctatccatctgacaaagggctaatatccagaatccacaaggaacttaaacaaatttacaagaaaaaaaaccaaacaaccccatcaaaaagtgggcaaagcgtatgaacagacacttctcaaaagaagacatttatgtggccgagaaacatatgcaaaaaagctcatcatcgcttatcattagagaaatgcaaatcaaaaccacaatgaggtaccatctcacaccagttagaatggcaatcattaaatagtcagaaacagcagatgctggagaggatgtggagaaataggaatgcttgtacactgttggtgggagtgtaaatcaattcaaccattgtggaagacagtgtggtgattcctccaggatctagaaccagaagtaccatttgacacagcaatcccattactgggtatatacccaaaggattataaatcattctactataaagacacatgcacacgcatgtttattgcagcactattcacaggagcagagacttggaaccaaccaaaatgcccatcagtgacagactggataaagtaaatgtggcacatatacaccctggaatactaagcagccataaaaatggttgagttcatgttctttgcagggacatgcatgaagctggaaaccatcattctcagcaaactgacacaggaacagaaaaccagacaccacatgttctcaatcacaagtgggagttgaacaatgagaacacatggacacagggaggggaacaatcacacactggggcctgttggggtgtggggggctaggggaggaatagcattaggagaaatacctaatgtagatgatgtgtgcagcaaaccaccatggcacatgtatacctatgtaacaaacctgcacattctgcacatgtatcccagaacttaaagcataattaaaaaaaaaaaggacatagttgaaggtctcacacttcatgatttcagaacttacaacaaagctacagtaatagaaacagtatgatactagtataaggacaaagggatagaccaatggactagaatagagatctcagaaataaattctcacatatatgatcaaatgattttcgacaaaagttcaatggagaaagagtcttttcaaaaaatggtattggtgaagcaggataagaaggtgtacattttaccatacacagaaattaactcaaaatggatcaaagaactaaatgtgagctaaaattataaaattcttagaacacaagtgagaaaaagcttatgacattggatttggcgattattttttggaaaggacccaaaaagcatagccaccaaaagaaaaaaaatgaataaataggactgtatgaaaattaaaaacttttgggcatctggagacacaatcaacaaagtgaaaggcaatccaagaaatggaagaaaatatttacaaatcatatatctgataaaggcttcatatccggaatatataaagaactcttacaactcaacaatagcaacaaaaacttgataaacaattgacaaaacagcttaaccatacatttctccaaagatatacaaatggtcaataagcacatggaaaggttttcaacatcactaatcaccggataaatgcaaacccaaaccacagtgcgacaaccacctcacatccattggcgtgattaccatcaaacaacaaagcaatataaaacaaaacaaaaaacaacagaaaataacaagtgttgaagaggttgtgaaaatgttggaacacataaactgttgttaggattgtaaaatggcacagtcactatggaaaccacaaaagacgttcctcaacaaagtaattatggtctagcaatttcacttctgggtatgtgcccaaaagaatatatcttgaggagatatttttacatccatattcatggtagcattattcactatggacaaaaggtggaagcaccccaaatgttcattgacagatgaatgggtaaacaaatgtgacatatacatacagtgcaatattattcagacttaaatagaaaggtttgctgtgtgttacaacatggatgaaattttaaaacattatattaagtgaaataagatattcacaaaaagacaaatactgtattattccacttatatgatgttcttagagtagtcaaattcactgagaaagtagaatggtgtttgccaggtacttggtgaaaggggaatgaagagtcattctataatggatacagagttttagctatgcaagaaaacagctggatgttttcttggagatggatgatggtgatggttgatggttgcacaacaagcaaatgtacttaataccactaaactatagacttaaaaataactaagatggtaaattttgtactgtgtgtattttaccacaatttaaaatttgttaaaaataaatatttttcaggctagtaaatttgtaattaaaaaaaccctgaaattgcaatttctttgttagaagtaatgtgcaattgtaattttgatgaatatgaccaagatgttttaaatgtgttatatgtcatgcctgtttatgcatagggcaaaaatgtactagaatgtttcttaacctacatctttaccaataaattatattgtataagttgtatgatactttccagtataataaatgaaatataatagctcatcagtttttaatatgcatatctcttactacaaatgacactttgtaaattttgtcattttcatttacctttttctgcactaattttatgcattaatatcttgaatgctggttaagtaattttccttttattgtctattcataaacctctgtatattaatattttgaaaggttttttctattttcatttgaattatgttgttttctttttagccgaatatttctttttattttatttaaataaattcatcaatgtctggagactgttttgggttttgcatcccagatatcccagctactcccaaatacaattttcttttaattctcagtttttatgtgctagaattttatatcattacttaggtgaaaagcttcgctgtttgggaactggtttgattaaaggagtacacacctttatctatctatctatctatctatctatctatctatctatctatatctatctatcgtctatcatctgtctatctattgtctatctatcatctatcatctatctatctgtctatctatctatctatctatctatctatctatctatctatctatctctatgtaatctataatctatctgttggcctattttcttatactattgattaaatagtccatattttccttaaaaaatgcaacgctttttttatatattgaatttttccatttatttgggtctacttgtgatttttttcacagatatttctaagcaagtgtcatacaaatctactatgtgtgtgtaatatgaagcaatgatcagggtttactttttcctccaaacatatccagttgttttaacactagactttttatttattatagtatctctgctttagcataatttagaacatttacactatgatctgtaatcataattcttatatttgctttagttttataattaaagtagtatcaatgattgctgctaatcttttactatcattttgatctatatttttgttttctaatgtttgtctttcaataattttgactttatttctggataagaggttggctggatataaatttttcgaggcacaatttcaaagcctgaggactttataatgatagttttacaatctcacattatgaatgctgccaacctaatgttctgcttaaatagatgacttggccatttttttgccaagtctggtgaagtccagaattggtctaagagtatttagagtattttgtctcagagtaaaatactctgtcagctttcaatcagtagattccaatttctttaataactagaagtttttcttgagaaatattttgaatttgtgtgttactgtttattttctcattcccttcttcaggaaagattatttttcaatagttcttaatttgtttttcagaaatgttttccatttgttttataatattctctcggttattgttttaatagtttgttttacttaattttcttttttcatatgtccgttgtgttgcttccaatgtggctttatttctgttttcttttctacgtccttcctgattcagctagctcacgttatgtttttgtatgtttcttaagcccatatcttcattaattctaccctcgttgttttaaaatttttggtggtttcgttgatcaccttgtttatggtgacatgcttgtatatgctttctatttgctcagcgatggtgttttcttctgattagtgtcctgtgtctgttttttctttttcctaattctttgctcagtttatcttatatcatctttgaatgaagagaatttttattaatacagctgccaaaaattcatgctagttcacactgcacaccactacactactttccctatgataaagaagaaaaaattgtgtatgtgtgtgtatgtgtgtgtaggaaaggagtcattttaatcctttttttttttgccacctaaataatcagatttgtagggctgtttacagttcagcctatcaactcggtatggccttactgatgtgctgcatcctagaaaaatgtagccttgtgtttactcattcagcaccaccttccctattactcagtcatgctcaacagggtccagggaagcaaccacctccagccatacacactgtgattgttttgaccctcaggatgtattgcttactttgggggattgtgctctgccatctgtagctgaaatcagctgcaatcatactttcttggcatcttcccacactcatttgattttctctgtatttggcagcttataaatatattggtttgagacaacagatgtagtttcctcaaaggtgggtttttatctgtttttttgtttgttcgtttgtttgttttttcgtcttctttgatgactatttctgagaagagaatgtggcaaaacccaataattctgccattgaaagagaatcaccattcttattaaagagctattttcaatattattttaaaatataattattcctctactcaacattttagaaaacaatgtaagatcccaaattatgcctacctcgtactccgcagcaattattctgcttataatctgtttgaatccaaattttcttaatcattccttggtgttactgaatcctaccatcatagatttttatgtgctccagaagcatgataaagtacaacaaacaagattgttgttcaagtcataactagagaacttttgtatatttttcagtttctgagaagtaaaagtttaaaattacctgcttttaatcagattgaaacacagatttttctaccacaaattattattacacataagtcttgttcatccttcatatatgtaaaataattaacaaatcaactatacagtgctggtctcagtctatgaaagtaaaattttagtgccacatgaagagaatcctaatgatcaactgagcattgactatatcttatggcttaacagagggagaaatttgatatagaacagttctcatcactttgaccagtaagcattgcacattcatttaatgtgccacataaatgataatattcagcacttgtgagattccaaactggcaacagacgccaccaatttctgcctgaatggtcacatctgacccttctaagcatgagcgggtcatatttccttggttcattaaatatacagccaccacatttatccatttcagagtcatttatacatttactaataacccattcaaaatataccaattctactaatcactgggagcatcatagatgtcacacgttccaaccccctatccattgcaagaataattaattcagtgtgttgatttcagcttttatttgaaaccaggaagggatggttaatttagttacccccaagaaaattccttttgttttttggaccaatgtatatattcaactccttattaagttaagcctaaaacacctttcccagactaatagataggtagatagatagatagatagatagatagatagatagatagatagatggatgtacagatacatccatccataatggaaatcctcagtttcttcagctgtgctctacattgcacaagtattctgaccgccacccttcctgattacctatttttgttgcactttttaaattcttaaaatatggctaccaaaatataccataatggccccaaggcattctaagtataatgaatagcaaatatctcctttgtcaaaatgctatgctatgattatattaaattgtctaatcatattgagttgaataaaaatttaatttgttgcatcaattctttaaatgtcctgctgttgccatcttgaagttcttttttttattttcttcttaacttctattttagattcagtggtacatgtgcaggtttgtcatataggtaaatagtatgtcacaatgatttggtgtacagattatttcattacctagttaataaacatagtacctgataggtagtttttcagtcctctaccccctctcaccctccatccttgtataggccctggtgtctattgtcccttctttgtgtccatgtgtactcaatgtttagctccaaattctaagtgcaaacatgcaatatgtagttttctgttgctgcattagttcacctagaatcatggccttcagctccatccatcttgctgcaaaggacatgatcttattcctttttatggctgcatagtattccatagtatatatgtaatacatttttttaaatttgaagatgaagcattcgtattgatggattgcacaagtattatttcaaatgctctcagataacatggacttaagcagcctcatcatcctggttgtcctaaggcaatatttatttataacttttattgtttgctctagcatctagtgagcattttgataagcaaagtataaaagaggacccattcattctccttccttgtacattacagtcatattaattcaatttacacttcaatagtattttgagagggaaaatagcatggtgtttcaagcatgtcagcttggaatgaagttacctggactcataaccagactcaaccacttgccagctatatgcctggttttgtcatccattaatgcatgtgatacgaactttgtgggtttttttagattaccatgagataatatgcacaaagaacatcaataatgcctggcacacaaagtaagacctcagctaatattaattattataatcattgctcctttgaaaacctctagttttcatcatcaactaaatttt

SEQ ID NO: 99 - DNA, 2245 bp, Homo sapiens
tcccattaccagaattcacattcagtttatcataatccagtgctgatttttgaagtcacatattagaaaaaccaaagttttaatacatacattcctggtaatgaggagttgggggttggggaacaagggagcagaatttaactgtaaaattacacttttttgtttatattaagctgtgcactagttggcccccttgctttctcaaattagcttatatttcagggatttttctcttttgcaactcaacattttattatagacaagagaaatctgaaacacaaaggtaatccagaacagaatttgatattactttgtgaacttttcgttcctttcttggagtcaaacatgagatcatgtttagaatgatttagcccatgttctttttccaagagttttaataaatgagtttagagttaccaactataaaacatacaatgatgatgatttttcccttatttttattagaagactatgttgtgaccaagctaagtgtgatgtagaggtagcagtagtattaaacaagcatagggattctgaaagcactaagcaagctaatatatcaaacagccataccatgggttcattgtcattaaagtaggttagctgccagtaaaggttagctatgtgtattgttactaatagaagtttgttcgatttcagatataaatattaaattccattatggtgcacgccccagcatgggtgaggagcctgagtgtccacctgcctagctgtatggaccgaccatttctaaagatgcctggttgactggggcaagggccaactgtgaaatcccctttcagtttttcaaagtctatgattagttccttgttgatatgaaaattcatattgcttgcttgcagctaagtctttgaaacctatgtccattgtcactaattttccttattagcatacttagtatttttctcttataggagtctatctatctttatgtaatagataatattctgtgtaatgtgtcatttgactttgccttaatctatttgtgtttttgctaattttttttctgctttatatgaagtccagatactttaatctcttcttatctgtgtcaaccttacttgcccattgttcctctttaacaaatcagatcagttttcttactaattaaggtcattcttatttttctttccttgagcattaactccttcctcaagacactccctgttttcactcccttacccaagttctgtacattcttcactgctatggggtctttagccccaggatgctcttccttttcataattactcttcactggcaattcagatcaaacagattgtacttaccctatatgccatctgctcccagaattgctcacaataattgaagatgtatcctgtagcattcatcttcccaatgaataggtttgttgggtctccctaccccagcagagtatgtcttgggttttttttttttttttttttttttgagactgtgtctcgctttgttgcccaggctggagtgcagtggcatgatctcggctcactgcaagctccgcctcccgggttcaagccattctcctgcttcagcctcccgagtaactgggactacaggcacccgccaccatgcccggctaattttttgtattttttttagtagagatggggttgtcttggtttttttataccttacttcatggaatatgggtatgaatcagttctgtgtttatataccaaaaaaaaaaggcatataaacatttcacaaaaatatttgttagattttcaacaagcatcctaaaatgatagttgatgatttacatgttagcagattactatgttttaattacattttgggaagttgattgggattttggggttgacatgtactatatcaaaatatttctcatttaaagtaatgggaaataggttatcagtattttcatggagaacattggcttttcagatatggataactgacctaaagtgagcaatgcctatatgaaccatcattaaataaatagatccctgctgctaacaccctggaggatgttgtgtggagctacatagagctgcccacaagaaaagcagccctacaaccagtatctaccttcagaacaatgcctgtaggttagcacttcttccattatgaattttgatttgagaatatttgaaaaccaatgtgttttctctgctgacaaaacatagtactctaacatgtttgtttctaccaatcaccctttacacacgcctctcattttaccatgattttttgtggcctttca

SEQ ID NO: 100 - DNA, 5945 bp, Homo sapiens
gaagccccgaaagactttacttccaggataataatcatcaaattagcactctgtttgttttttcctgtttgatcctgtaaaatgggaaactttcagctgactgaaatccctcctctcaaacctttgttgccatttctttcttgtcataatctttgctatactcctaaattttttcttggtgaagaaaatgcatttatggcataaggattattttcagctggttatttcaagacccttctgtaagaaaaatttatatctataaagaaatctcaatttgtaagtgtgtctccctctctatactgagaagacagagagagctaagtcactagaaacttttacaatggagaagccaaacgcttaaatttatataacatgcctcacttaggaccattttatttactggactcacagttccacttggctgaggaggcctcaaaatcatggtgaaaggcaaaagacatgtcttaaatgggggcagacaagaatgagagccaagcaaaaggggtttccccttacaaaaccatcagatctcacgagacttactaaccaccatgagaacagtgtggggaaactgcctccataattcaattatctcccaccaggtccctcccacaacatgcgggaattatgggagctacaattcaagatgagatttgggtggggacacagccaatccatatcactaggcttattatgcctttgtctcagaaaataatggtatttaggcttgaaatttgactacagtgagcaacctagctaacaactgcttagggcaatgaaacaggtaattgaaagagtgatagtgtaaagggtgaagaagagttatttggagactggcaaatgaaaaatcttaatgatatttctaggatacgtttctgtctgtatggctgtgtatatctatatatgtctgtatgttatatatgcgtgatatttttctaaaatttataaagagctttaattggctttaaaaagtaatttaaacatttaaatctatgttaattagtatttatgaaatgtctgagtaattttaagtatgtttaaacactgaaactaactgctatatatatacttcggcatcctgtttttgtatggtgcaaagaagctacatatattatatttgggtctattagttgaaaaaatatttttctatggggaagccccatatgttgttagaaactctgaaatgtgtatacagaaagtgttactatatgacagaaagttcaaaactgctttactttacttcctaggtttttagtagaaattaagattactaagagttaaatattctaatgactatatggtaactgaaactggaaatagtagggcaaatgactccatattcggggaaagtaaacacgtttttggtaagtgaagctatgaggtataaaagatttttttttttttaagagaaaaagagtaatttttgtcctaaaaggactggttgtttcaaaatgagaaagaagtataaggccaatgatgaaaaggatattagaaggttgtggaggatttgtagaacatggattttgtgaagggaattttaggtatgaccaagctggctaaaattagaatggaattatttgtaaggctttctaaaaattgaactttactatcaaaactacactgatgcaaaactagaacttggtcctttctgtcaaaacaaataggttttcttgaagtatttatttgctcttaacaggaaatggtaaaaggcttttatcttttaggtaattggcctaggaaacaaagattctatgttttatcacgatgaatccttgcgcttcattttgtctttcttaggtctttgattatgtaagaaaactgggtcctctctattaaaaataagacttttcctacaattatgtaactttctttatttgtctttgaagtctttaatgatcactctggctaaataaacgactattatttcacagtgacctgtgatcccattttgatcaagtgttttaaacctttgatcaaacttcccaaaaggaaattctaacaaacttcccaaaaggaaattctaaattaagactttttgccttagaattaactctggaattttcctattgagtccctgaaaccctccaaaaatgtgtctctcctcttgtaaaagagatatactcaactaattaaggttatttgatatattaagttatatgggaagcactgtcaaataaaagtgattctaaaccttgaattatatttgcatggatatgttattggtatgttccagaaactgtataaaattcttagaaatccgatgttagccataattttggttattgtgttgaattattgtatgacacagaaataaccaaatttccttgtcaacggcatcattattttaaggagctctaatcagatctttaaccaggaccatttgaagtcttgtcattcacagatggttatgtactctggtacattcctgagcaagtataaatatttcatcttcaaggaggttcatggaaagaactctgacaagtacaagtttctgataattttaagaacctatcattggactgggtaagaattctcagaaatctaatgaagaaactgatttgttttataaaactgctaaatgaacatcaagcagaacaagaattatttaaataccaaggaaatgctttggcagactttcatgctaaaattactgaaatttcatgctaaaagtactgaaattgctaagaaatgaaatttgaggccaggcaaggtggctcacgcctgtaatcccaacacttcaggaggctgaggtgggcggatcactcagggtcagaagtttgagaccagcctggtcaatgtggtgaaatcctgtctctactaaagcaatacaaaaatcagctgggcatggtggtgtgcacctgtaatcccagctactgggtagtcgaggcaggagaattgcttgaacccgggaggcggcagttgcagtgagccaagatcatgctgccgcactgcagcctgggtgacagggcaagactctgtctcaaaaaaaaaaaaaagaaatttgaataaactgttagattgatcaaggtcaaattacctatgataacttatttattaatagtaagcagtcgaatgcacctgaattggacaatcgaagttggtatttaagaggatataaatccagtattaagtgtaggctcatgaagaacctgaacagttgcctggtcttgagttcttaaagtttccattattaaaagttctatacttcatcactcatcatggagtagaaaaaataatacaagtcatggaaaaaatattggtttggtgattgttctagaattgctaaggtggtttgtgacccctgtttggtttttcaaacccatcatcttgggaagataatcaaaacttcaagtcatataattctgctatctgatggaccatttacacatgtatttcattcagttaccatttcaatgggatgtaaatatgttcttgtaacagtgttctctggttggatcaaagcagtacatgcaggaaagccaatacaataacagtaaaacctcatgtatcacccattcttataaactttgataccaaggcatatttttatagctaaaacaagcctttcataatccattgatgacaatctgacctttggtgatctggaacccaaagactggatcttttggacaagacatgacagagagagacagagagagagactgctcttgaatcccagtgggagggaccatagagttcttctccccgtatattgcagtaaagcttaggaccttgccttggttcaaggttaaaatggcccctccaggctcacgcaactgtatacctattgaagactttaaggtaaagctgattagggaaaagtttccctaggaacagatgacattttagcctggatggtgttttctaagaaatcagaacaaaactcttcatcaaaatgtgacttttatccctcttaatttttccttgtttatgcctacttttttcacttggaacttagaactttataaccagtatgaaatgtcggatctgttatgatctcagagattccttagtatacttagtgttaatattagcaacatccctaatccgactgtttatttaaattttcttagtgttctgttttatagatttggacttctagacccacttattttcacttcctgctttgatttggcccagtcatggaacgctagattgcttattggctaagtaggagtctgtgcagttgctagtattttttgttgtgcataaatatcttaagtattgtagacacttggttacaaaacaattaaaagaaacaggctatttggttaaaacaggtgaactcctcatgtagcttatctatttgattttagttggtttgattttagttggtttgatttatgggggcccttgctaaggcactaactccaaactcttggtattatcctcctgagagtcataatggcaatctccctgggtatgctgtactttctcaaaagttttaaatgtttgcctataaccaaccatcaaacaccaaatggtctctttggttggaatgacaaaaacccaaggaaatgcatgaacatgatgacactgtaacttatgaataacaggttaagactggaaatgtaaaatgataagaattgagagtagcactgatgacctaagttgtggtcatactctcacctaagtgacagcctgaccaaaaagggggaaataccattgatttggactaggctcctgtacttagtccaacagaccaaactaatatggagtcattcatgctaaaggaaactaattaacttaggagtatactcatgagacaagtagctgggtttcagatagttaacagcccctgagctttagttaatcataggcagccaactaattcaaataagattataaccaattaaactctataactaacttccattttctatccataaatactgtctgaccaagttgcagccccagagttctccgaacctgttctggttctgagggctgcccaactctagaattgtgaataaaagccagttaagatctttgaataaaatttgttgtgattttatcttttgacacatacacataggtatgcagatatgcaagcatatttatgtatgtttcatatatgtgtaaatgtatgtatattatatatctgaacacacacatacacatttgtttgaatcagattccaatgagattggttgataggtctcttctttaatctatgtattcttcatcctctttttcctttcaaacttttttgtggaagaaactggatcatttgtcctacattttcccctgcgatctagattttgcagattcaaattctctaatttcatgtaatatgatcctctgcactctgtattacttagaagctggcacatctagaagtttgatcagaccctggttttttttttggcaaacaagttcctatcaggagtacataacaacgcataacagatagtcttccttttagtcactgatgatcatcacttagatccactatttcaataagagatgcaaatttctataattcctcctttacttatcatcatcattattattatttttgagacagagtctcactcttttgcccaatctggagtgtagtggcacaatctcggttcactgcactctctgcctcccaggttcaagcaattctcctgcctcagcttccgtgtagctgggactacaggcgcgtgctaccatacccagctaatttttcatatttttagtagagacgaggtttcaccatgttggtcaggctggtctcgagctcctgaactcaaatgatctgcctggctcagcctcccaaagtcctgagattacaggcatgagccactgcgcctagccccttctttacttattaactgcagtatttctttacagaagaacctgcctatctaatatagttaccctaaagtacagtcattctagaaaaagcaaaacaagcacttgattctttctctttatctttttcaaaaccataaacaaaa

SEQ ID NO: 101 - DNA, 16169 bp, Homo sapiens
acctatcacgataaactacggttaataaatcttcaaaactcacattctatcactccaagtatctgaaaattcttacattttcggctgaaaaaagcctttccacaaccttcgaaaaggagatgtgtttgagatattttttaagtagccccaggaatcatgcaactggacagtctcttagagatcaactaatccaactaggcccaagattttattgttgaggaaaatgaggtcacgggactttaagagagtagactacatctggacgaaatcagaaccccatgcttcctgccctggacactagctcttgcccttgacactacacaagggcattcacttacacagatcagttattatactgttggtgcctaaaccacctttcatgacataaagtaatcaatcaattattgattgacacttcatatcagactgtactcagtgttgcaggagactcatatgtatatagcagtcctcaacatacatttggggtgtgtgtgtgtgtgtgtgtgtgtgtgcgtgtgtgtatgcaatccaagggcttgggggctgtaagtacagttggaagcagatgaggaagtgcactgagtaccaaagagtgagcgacaaggaataaaaatctaagcagaatttaatctaaattttccttaaagagactattataacataaatcataatgtttaaatctacatctttcaaaaagtcccatttagcttgtgaattcaccttgttctgcctactttagacctatcacttcatacatgcagaagatatagctcttactaaaacattaatatgtatatacctcttccttggcatggataaggttgtttaattaaaacttacatgtatttagttaaatacaaagactagcatctgctcaaattaactgatgtctttttctgaaaaattaaaataaaaataaaattttagtagaaaaaaacagaaatgtgagacacagtgatttgttggtaccaattatgtttcaacttaaaactcttaacttgaaaatacttaggttctagcaagtatactgctgtcagagcgaaatacttattcagatgacaaaatccaaatttaaaaatctatcacatttttaaatggctgacaaaaaccaccaccaaatctaagcagtgcctaaacttgattacttttttgtatttgagccaaaagaacaaatctgaatgttaacctgggaaaaatggtagtgtatatacgaacacaacacttcttaaataacagctctgatttttaaaaatcactcttctaacttcataataaccccttgaaaagaagatggggattttaatcacttaggattaaaaaaaataggatttaaagcaagattaactgttgctttaagtcttgacatttccctattaataaccctaaagcttaatgaggcacaacagatttaagaattgaaattgttaatgaaaaagaaaattaaggacagtttggtgctctataccatcatgaaaataatctgctccagaaagattttagtctctacatgtaaaaagcaagaaatatctaaaaagtatttccttgtaaaatctcagtctgaacttttagaaggttagggcagactttgatgaaagtataaaagtcagaaagtacctatggtttaatatatagtgttttaaaaacaagtgaggatacataaaatactgtttttcaaattacacctagtatgtttgtaacctttcacctattagtaatgaccgcatgcctcaagttaagaaaagcaaagaaatatacataactgtgtctagtaagtaaactctgaacaccaagttaactcttcttattttcacaagaacttatgtttcaaaagcacatgaaaatcaaataaatactgagaataaacacgatttacacttaaaatcactgctgaatccttgccacattctagaacaaagctgcttctttttatgtatacttcatatgttgaatattaatttctttaaaatctgtacctaataggtgaaaaacacataaggtttatccatcgtttttccaaggtcctcacgcagggttgaaaccaggatctgttaagtcttagaaatgaatttctatgaacattaaaatactgtcctagatgccccataacccatacaaacgtatttaaattagaacaatggggttatgcaattaagatgtgaactagaaaaacaacacaggtttctaatatattaattaactaggtcaatggtaaaagcaacattgattttttttcttaacaataaacctatgtaaagatttgaaagtcacttgtattatttaaaaggaaagctagttataactttgtgatataatattttatacttttatcaggtaagctgaatgctcaaattcggattttttaatataaaaaaggctaacatcttaaaataagactaaagaaaatcttgatgttgaacatcataacatgcaagattgactagaattatgtaaatctacataacaagactaactaaactagtaatttctctaagtaaaataaggtacacagacacttcagttaacaattcaaggcacagagtcctttgaatattcaattatatttagcttgtaaaaaaacaagggtgctccgtatctgcactaataacctacatattctcttttctaaaactatcggctgcttagtctggaatttaaaaaaaaaagaaaaaaaaaacctagactgttaatagcagctgactgcaggacagccactttcaccttgcagatagagctttgttgttcgggcgtgtaaagcagaccattagcacaaagtcatttctaatctcagttgtacaatccacatggtgcacttaaccctaaaactcatgttgcgtaaactgctctgcttccactcctaatgacctttcaaatcattcaatgttactgcttgacttgtactcatgaattagaggactgccaaataacttgatgagaaagttataatttctcctttcctgaaggtttaaaaaagtcaacattggtatagaagaaactgagaaagaacatacaatggaaaagcacattatttaatgcttataaacgatatttttagaaacacttaagaaaaaactgacagaaaattcacacctgacttcaaggcagatgactaaaacagaaaatgagagtgctccacttgtaacacacatagatttcccacagtattcatgaccaacaaatgtctcttcgtgtcctaacttcgctgcacagtattcaattaaaactcacttttagatgaaaaagtttgtgaaaataaccatctgctgctggattcacactgaggatttactgtctgtaaataagacgacccaatgctgtccaaaaattagtgtttttaaagtaagatttgtaaaaaatgtatcacatctcctttgttaaaaaaaaatcctaatacacaggagtctttaagtttgtcttgccttccatttaacttcaaatactttagaagcaggacttttttccttcttcctccttcagcctaacctctttaataaaccccatttttaaagaagaaacaataaatgaagtgacaggaggtcaaagaatgaggagtgtgcgctgggagaataaagggcggttttataacaggaggtacttttgttagcaagtgactggcaggtctcctcccccaagttagaaggaattccatccactctccaaaactgcaaaggccaaaaatgtctagtctaatagttctgaaatccccgagtcaggagagagccgagtggcggatggcgagtgggggaagggagaaagaccggtaggagactaaagaacaaaagaagaaatccaagaaagggaaaaggaacgctgggaccctggcctgggaggcaggggtggggagagacaaagtgagagagcacgacccgggaggagagcgtggagccgggcagggacaggcgtgccgcaccatggcgcaccatggacagggctccgcgcggcggcggcccacgaccgtctaggggttgcgggagaaagcgcgagagactgcggaggccagccccgtccagcccctgcccccgccccagcagcactcaccccccggcgggccggagcgcgccaggccctgacccgtgaagaccacggagcggggtaatccacaccacctgtctccacccccggagcaggcacttccgagctgcgtccgcacttttcggggctgccagctggcagtagagcacctctccccttgccccgagggcgacaggcagggggaccctccgtggattttcctgccccgcggcgagggtgggcacgcccctttcccgcaaccttcgagggaccccacggcaggcggagaccgacttgggaccagggcactgcacccgcccagctagagggtcccggccgaggctgtgtgaagtggcctccaggcctgggctggctggtcgggaggagcctgggggcatcctcgggttggaggcggcggaaagttgggctgcccccgggctgggaacccgcagcgtgcagtggcgagggaacctgcgcccggactggagcaggtgcttcctgccgcggaggagcctcttagtagagattaaatgaaaaggctcgctggctctctcccgagggtatgaaaagtacggaaggctccaggcaaaggcgcccccggggcgcatatagggcacaggcagccggacagagaaaggagcagccgcgtaacggaacttctcgcccgggggagatactaggcgtgagaggccagactcgttctacaggcaggcgctgaccggcagagactcctccgggcaagagggccagattttctttccaggtgggacgaacacagaatattgtgagggcaagagaagaagaaaaggaggcaactccagactgggataaagacaataggacagtagagcccttgagcaccgggaggcgcacgggtgcagggtggggtaaggtggaggcaagtcccgtaactaagacaccagagtgagaattcctactgtaaactcgcgacccatccctgcagaaataaacaaaaaaattggagcaaagtactatgcgaggggcgaaaggcacagaaaactgcaaaacctgggagttatcctgcctcaccctcctgctgcctggggacaccccccgcgagcttgctcggccccgaagaaggagcagaggggacccgcaatccagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacatggaggcggagaggggccgagcgaagagccggaggaggcggcggcggcggcggcggcggcggaggaggaggaggcagcggcagcaccaacagcggcgcggagaaacggctccaggcagtttccacccccttcccttcccctcccctccccacccccttcttcgctgctctccgctccccgccaatggagagcgagctgatgacaaatagcgggccgcggagtccgcgggactcgcaccaggagtaataaaacagacccagagatcaaggagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggcgctccccaagagctccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgcaccggcacccgcccgccggtcctcgccctgcgccgctcactcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgccgccgccgccctcgcccccgcctccctcctccgccgagcctccccgcccgcgtcgtggccaatcggaggccaccaagctgcggctgtagccggccggatccgcggcagccgcccgcccccgccccgccgaagcgccccgtattttgctgcagcccgcggggggtcgccggagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctggagctcgcaccttcagctcccacccttgaggatgtactggaacagcccaagtttttgtgttcttgttttgttttcttttgtcccctctgggagtttgagagtgcatgtttgttattttatttgaaatctcccgttttctatttctattactacctgttagtggtactgttcacatttggggccaacagtttcagggtacttttaccctctcctaccacccctaacaacaatttttaaaaaagagagaaactaaaagccggaacttgagaaaataggattatataaaagataaaatgactgatacagaattctcaccacgtaaaggatttctgctggcttcctttaaggcatgaacttcaagtgcaacacagtgagagactttacaagtttgagtcacaagcatttgtggaatggagcgggggatggggagcagtttttgttttttctaattctggtgaggtaataaattttccggaaccttttttaagaaaggtttacaagtaaatagaaatatccgttttatgtaagcttttcaacacttgggagatcggtgaacttcattgcagttaatgaatattttctgcctttattgcttgcttttctgctttgggtgactgaaatattaactttatttgagtttcaagataccgatcatttaagaatctgatgatgaacctttaaaaaccagctactaatttcttgacataactgatacagcttttaataatgtactgttgctggctaggcttttaaaaatttaatattcatagggaggcttattcaattttaattaaaacataatattgtaagttttttatgaaacaaaatttttcctggattttctttcttttcaaaagaataagaaaggttatgttaattaaatttaaaagatgagatgaaacacttaatatagtaatcagaagtgcttgttcttaccctttctcttctttttttgctagatattattgtcacactattgctagtccgcctaaaagttatctttgcaatagagtatttataaattatgctttctgggagtcatgcaaaataatagtaaaaattcagttgagatatggggatatgtttgttgtattccagagtgagatgtagagatctcatctccatggctaagatttaagcttcgaccctcgtcgtggggtttcgactgtatcctcatcactcctagcagtacccattgatgtttattgccattctgattaatttaaaggtggaacaaatttcaacatgaataactctatttcttgttagtagtatttacttgaagctttaaacatgtcctttataaattaagcacttatgatttcaaaatctcctttggaatggctgtcagtcaaggaattctctgattccaacagtttttgatcctttaagtaagcacttgcagcatgttttaaaagtccaatttgcatgcctctcactcttcagtggttgtgaattgttttagcatcttgcctcactttaagttgatcacctggtcagccaaatcttgctaataataaataataggcctctgattacaagaaggaatagtctagtctaaaatcatgctgttggagactttgtgcatccatttgatgttaatgaaagtagatctggtgttgactatgatatccaaacacagctttacctcagtaataccatacctaagattagctaacggggccattcactgtcctgggcaactgatgaccaaactcgcagatttttagcccctgctcaaagcattacttgtctgaagactggttttccatcagcctgtagaactccagggatgtaggggattgtcagtgacccagagaaacaaccaggtgttattaggggttggatggatggagacaagaaaaaaatatagaataatataaaacatgactgcattcacacatcaaaaatcaacctaatccttcatttctgacctatggagtgatgcctgttgactataagaggtctgcaaaccgttatggaaacctgattaaatgatgtgctctgaacacatggcccgtttttatatatatgtagaggtcacgatgattcatttctaagcattcatttttatatatgtgtagtttttatatgtgtgtagagatcatgatttgtttctaagcattcatttcgaaaatcgtaataatttttgttctggtgtgttttgtcaggcaggagatgctaaatgtacaaattcaccatgtgggtgtttgtgtacaagggttcttgctttggacataaatgctcagcagtagtagtctaatctagagcctcctctcccccacctccccttccctaccccctatagatacacaccgcaaagacaggccctacacttgtctttgtctctgacacctagcgcagtgtccttcccaatgttgaatgaagacccccttctccactcttcctcctctccccatcttcagagcaaactaggattgtccctctcccttagaaagtacccctcaaattacattttctccataattagctttagtgtacattaaagctgactttccctgggtaatatccctttcatagagtcatagaatgttctaaatgaaacattaaagatggtctctgcaaccccttcattttacagatgggacaccctgagacttaaaaaggtacacaaggccaccagctggaaagtagggaatgcagaatgggacccaggtccccttactcccactcttacctatgctctctatcttattctgggaagttcctttaacattgaaaaattcaactatatgggatgaaagggagatttttctttttaaagaagaaaatataatgatgctagggattagtctactatttttctcaagttttttgttcttcaaagtatgtgtgaaattgaggacataactcttcactgctctcagttttcatatgcttttcttagtgtgattatcttgtgttatttattatgattttggcatttaaagatccatatatttgatacaacctggctgctaaacacaagatagccattcatctggtgctcagagaagtagtgatctgatccaatattagaagaaaaacctggttattttaaaaaaatctactcttgtttgaagatattatttacctattgtttttcagtatttgaaaatcaaaatcaacattttcatggaaaatataaccaaagaagtaacttgaagtatgtatggtcacataagtgagttataaagttgccagatgagcaactcaacagaggcgagtaattcataagcaggccctgaattacaaggaaccccaccaaacaaacaaacagaaaaagaatcccattctgactctggaatgtagaggggtatagtataataaacagatatggctataaattcaagtagacctagctctatgaccttgagtaaatttcttaacatgtctaaggctcttttatctcgaaaatgcagtatttctttataaagtctgatgggaacacaatagagcacagtagggccttagcattttatctatagtgtattaggtatgctgatttccacagaggattcagagcacagttacttaagaatctgagggaacaccctttcacctctcccagttgctgtctgcaattaaaaaaagtgcttttaatcaaaattttatttgggaggttcaaattttacaaaacaacacaaaacctctaatgtaaaaaagcaatggctaagtaaataatctacagactggtaaaagaaataaaaatttggtggctttgtaatgtgcagaaaaataagtctagacaaagtattcacaggaaacaatataatcagtattaatgtattgatttggtgtaggagaatgaattcatatttgaattaactcataaattgataataccgagaccagggctaaaactccattttgcttaggacctttcctggcttttatggtttcttgaatgctttctgcctgtgtgctcccagagtcgggtttgcatagttgatttcatgagtcttgtttaaagatcagctatatttgagaaaataagatttccatgatatccaagaaatctaccttctgcaccagaagcatggatacttacagcggaataccagcactttggatcacttaaaatacagaaagcctatttcacaagataaacaaatcttgagaaaataaaacaaatcatgctgaagactttggtaactcttggtgccaaacttttgccttcatgtccttttaaaagcaacgatctgtcttcaggaaagttctgaaacacaactgtcagtatttagaggatagcaaaacatatttactatctgaacttatatttgattgtgccctttcctccagtgaaaattgaggcaatggataaagtattggcttgggttcaggagaccagttttctcttcccaggtctatggctgactgaataatcttacgtgtgacacttaatttctctaaatgttttctaatccatagaacagaaataatgccactattctcataagaatgctgagaggactaagaaaacaatgtcagtaaaatccacttagttcttcatagagaggttctacataagtacatgttattctttaaggctgtggattcaactataagaggaatgattggtgtctaatgttaagtcacattttaatgatgtataatcaacaagccaagtgcttattaatttttttatcctttttcccacttattcataaattttaaaaataagttatctttctcattacaaaggcaacattcacagatatttgagaaaattatattgttaaatgcatcataaacattcatagattatgcttacccatccttatattccagtaccagctgggcagatatggtctgagttttccttttaaacagggaatgtaaaatatcaacaatattcctatttattacagaatttacaatgtatgtcactctgacccattttttacatagtaactaaaaagagctgagtgattatcacagataagcatgatctctgggaggtctattattttgactcatccttgagaaaggtttttaaagacctgtctgcaagagatggggatagtctcatttgtaaagtatttactagagccaataataaaagtgcatttgcattccaagaccagtttatccaagccatgtgaaatttccaagtcttgcaggccaggacacaggctgtctcaaattgagggaagagggctttgaggagcctgctggtcagtgctgtgagggaaaggaggtgagagacagggataaaggtcacaagtggacatcaggaaggactaaagcacttgaggtttgtattctgtcagcagaaggggctcatgatgtggatacagcgtggactatggtcaaacgataggatctggggaaggtcataatcgtagcaattgctcaataaatacttgcccagatttaggagtgagtcatacaggaaaataggacatggatttggacaggagggtggggacaagtctttcggtatccagaactgataggaagctccacacaaagggagtacctgatatgtaacagttcatccaggccagttcaccctgtactgtccctagatttgcacagttcttgatgagggagagcagcttctcatgagatgcttgctggggatgtgtggggttatcctcagttctaaaattgctacttcaacaaatgtgaaatacctatttatacttctcaacttgtttttataaggatggaaatgatatgaaatggtttttgtactttacagtctttttcagtcaaaaataagcactatttgactgaaaataaatgggatagtataagctttaactgaagaagatgtaagttggctttcttaattttattgcctcattttctgaacccgtttttttggatgcagaactttccggagtattgatttttaattttttgatctttcttttttctcttcctccctctttctcttcttctttccctttctccctctctttccctttttctctaaaataaaaaaaaattggagagtttcttcacctttttttcctacctttctgttgagatgatatttttgatttccaagaggttttaatgttctctgatttattttttatagaactttgctctcatttaataaatgtaagagcttctcctaactctacatattgttcaaagttttcttctgcttctgctttatctgagtttcttctctttctctttttttttttttgcagtgtttgtttttgtctcatgtttgaggttttcttgaggatattatttagtatgcagaatttcatttagtcctaccaggttttatttatttatttatttatttatttttattttattttattttcgaaaaggagtcttgctctgtcgcccaggctggagtgcagtggcgcgatctcggctcactgcaagctcccctttccgggttcacgccattctcctgcctcagcctcccaggtagctgggactacaggtgcccaccaccgtgcccagctactttttttgtatttttagtagagacggggtttcaccgtggcctcagcctcctgacctcgtgatccgcccgcctcggcctcccaaagtgctgggattacaggcgtgagccaccgctcccggccctactcctaccaggttttaatgaggcaccctaccctgcctcatttttgcttgaagcaagaggtcacagattgtccctaaggcttcttcccaggaaccttctcctccacacttcttctaaccactgtctcctcccattctgaggaaacaggggttgttattccctcacttagaccagatgcctcattcccatctgcaccatgggactagttcctgtcctgtaaaggtgtttaaagaacctccccaggtgagactggctcaagtcacactgtgctccgcggggggcttgaccttacttatctgtgacaagatgtcacctgtgatttattccttgataaaaagggaagcaggagccctaaattattttctggatgactgctaacgcttttctcttgtctgagttggtcatctacctcttcccaaggatgagatagacatcagtatcataagaggctttcagcttaggactccttttgtgacatggccctttctgaagttaatgatgggcctcccgtgcttcatgtcctgtgagaaatagtgtcgtctccacaaattacttcaccccaaattatttgtatgggcccctatagttttcagcttaaaaaaaaaatctaaatgctttatcctcagcataacataataacagttacatgggctgggcacggtggctcatgcctgtaatcccagcactttgggagaccgagatgggtggatcacgaggtcaggagatcaggaccatcctggccaacatggtgaaaccccgtctctactaaaaatacacaaattcgctgggtgtggttgtgcgtgcctgtaacgccagctactcgagaggctgaggcacgagaatcgcttgaacccaagaggcaaaggttgcagtgagccgagatcatgccactgcactccggtctggcgacagagcaagtctccgtctcaaaaaaaaaaaaaaaaaaaaaaaaaaaaccagttatgtgaaatcagatttccaaggttttatgtggaagcagtctatggaggtaccttcaccctaatgcgttcactccattcccactaacggaatctatccagagtgaagtagccatttccataatatgaaaaaatgtatgtgttcaatagacaataagaaatataaatttataatattggtagtgcaaccctgctatttatagtaaataggatagaaacacgtcagtaactaaagcatttagtagaattatcttcaattttgttgttgttgttgtcataatgtatttgctaacatgtcctagaaatagcatctttcatttggaaggtgtactttataaatatacgttgatcaataagtgcttttattatactttatcccaaatattgtgacatgttcctcttagggaaggtcattgctacttttcctgctaacactcctcctgttgaaaatcgcaatttaatatttaattgctcttcactctcatttagtataaatcttctgtattcatttgaagtctcatgaggttgaatgttatcttgctattcagtggtgtgccatcacttcaccttataggtatttgtgaagattttattcacatgatgctctcaagcttggagttgaaatactacgattcacttaatagattaggatattagggtctattgaacagatgcatagaaatcagtcaccatttcacccgaagttacatccaaatacttagttttattaaatgcatctctactgcttagaatatccagttttgccttacagtaaaattgggtaggctgaccacctactagtaacacatttgtaaacataccagaggaaaaaagcctacttttatttacatagcaaataccttctcttaaaaagaggtaactttttaaagattgtgtccaaattgaagaacttacctgagaataacaaaaaagtacaagaccaatactgcctatctttttctttcacccttagccatatggaggacaagctggctttagcacagctatggcacagactacagagtgcatgagaaaagaaacgatggggtcaccaacagtgtggaagggaaggagcactatagtgagctggagcttggacacatgaaggatccaatgagattcttaaactctgtgtgtccggcaaacgctagcagtgaagagatgttaagttcatatatcttctccttgaagaaaagcaacatcctaagatctcaataaacaaaaaatccttcatttggttcagaagatcctagaaaagttaattcaagatgctgactaaaatcttaaagatgttccctggtagaacatgtttttgttcgtttatttctaagaatcacaaagtcaatccagttccttgcacattgcaaacctctaagagatccctttgcaccctctaagttctgcagtttggattactgacagcatctcctataatcaatacagcataattggattattaccaaaggcaaaataatatatttgctgttttttagtttttaaaagctaatattttaaaaatacaagtttaatcatctttaccatctaggtaataaaatacatatgtgcccccacatgtgtttaaataaccaatatcataattaatattttttccagaaataaaattcttaaatctttataaaaagttttgaacatacaaatactttgtatccctagctattattttcttaacttctgttttcatttagaaatatttg

SEQ ID NO: 102 - DNA, 1591 bp, Homo sapiens
tgtatgaaaattttatcttaaaagaaaaaaactgaacattagttaataacatgcatccttaaatgctgatgtttgtaacctacttagaaatgcattaaaaagatggggtaggttatacctcaaggaaactggaaaaaggatttgacagttatgtctagtgtatttctataaatttgcttttaaatatcttatcctatgtcaaataatgtagccttctttactccttacaatatgctgagcattttcccaagccattcaacattttacaaaatgttattttaatggctacttaatatcccagtgcatgggctgggcacggtggatcatgcctgtaatcccagcactttgggaggctgaagcaggcagatcacctgaggtcaggagttcaagaccagtctggtcaacatggtgaaaccctgtctctactaaaagcacaaaaaaattagccaggcgtggtggcgcatgcctgtagtcctagctactttggagactgaggcagcagaatcacttgaaccccagaggcagaggttgcagtgagctgcgatagtgccactgcactccagccttggtgacagagtgagactcagtctcaaaaaaaaaaaaaaaaaaatcccagtttgtaacacaaattattcaggtgtgtccttacaggtaagcagattatttccacattttcactaacataagtgtactaccaggaaaacccttaaatgaaaattattcaatcccatttacttcttcagcatggctaaagggtaggaacagtttatgtgtgtgtgtatctatatatctatacatttttaaacagacctaagattgcatttctcatgcaaacctctcctgcatcaaacattatgttcaatttttttttgtcagtgatgtagacattggtttatcattgttttcatagaattccattatcagtgaagtctgccattcatatttttagatgaattgtcggtgtttgttctccagttctgcactgtgatgttggtatttttctccttattgacttccaaaggttctttgaataagcctgatgtgctttccatcctggaacctgatcctgtttgtaaattccttagtatgtctaaaaggaatttaatataaaatgtatgatatgccgtttcttcatttggtgaagcattaaagctattttgacacccaactaaaggagtccttccaggacagaatgctaacatgggccaaacactgaaccctagctgccagcattttgcttttaagtctaacaaatcctaagtaattcatatgctgttgtaaacaattaggtatgatcctaaatagtgataaagtaatatagagcagtgttgtaacaaggttttatttgaaattgttttctaaaatgtgatgcattactgattttgacactgtttgaagcaaagtccatcatcaaatgtgatgcttatgatgagaagatacatgtatttgtaacgtttaatggaacctaaactcttttaaaaacaacgtgccatttgtgggtatgtttctaatctcctatcataaatcgtgagataggcctttttttggagatatttgggcttgcactaaagcctttttttttttaaactaa

SEQ ID NO: 103 - DNA, 8637 bp, Homo sapiens
ccactatttgaggcacaaacttagtatcaaaggtaacgtggtaaccattacatttttgcaattacaaacacaagctcattttattaataaaagcagttaacacagtactgagtatatatcaggcactgtgctaagagcttcataaacataatctcatttaatctacaaaactagtgtttcacagagattacctgctttatccatggtcacacactacaggagcaggatttaaatcaaatcaggtttaccaaattccagagctgatctctttttcctaagaaagccaaccacttttcattaaatgattttatcactgacatctgacacctgtagtagatgcagaagtttgattatttctaatggttctaaaccaataactgtaaaccatactctgtcaactgagacttggaatcttggtgttggggagaacttatcagcatagagccagaaaaggccacatacatacttcaaaagcctaagagatagatgctgcagaggcattaacacttctttaagtcatgccaatagcaaaattgaatttaactgtcctcttctgggggaagacatcactgatgcccccaccatgtataatcaaaacaattttacagtactgctcaccttgcagtatcaatacctactttattgttctactcacaccactgccctctgcctttttacttttgtgcccctgctgcccaaagagttactggaaaatagggcatctgtttgtggccacaatggtttgcttggtgatctcacccagtaattctttcattcagggataaatagaatccacctgactctaacctttcaatctagctgacttcagcaactaggcttcaacatcaaaatgtgaagaaacctgaaaaagacttttcaatgtgcagcttttcttggctaagtactgaacagtggttacagtggttaagagtcaacagttttaatatgggttgtcccattaacgttctacgtaatcataggcaagattacccattgatgtgatcctcaggtttgtcaacaggcataaagacacattctagtgataaagcagaagtgtatcgcctttctctaaataaacaagaaattaatcttttacatctctggagtttggttcctctcttatgacacaagggtatttaagtatattattataaaagattctgacctctttctttcaaatctataatctatgctccaaatctaagatacagaccatgcggcaggttaagaatcattgagcataaagtgaggtgaataagagaaaaattgggcaacaggaacatcaacagccataatggtgcacaatgctaactgcttaaaacagctttcacttttatgagctataaaacagcacctttacaaaatactctaaaagaggaacacacagtctgtagtaacatgctctattttagagcaacatctataaaaaagttttatatctcatcttcctgatgttctgaaactaaattatattctccaaaagttttgcacatatatatacagaaattctgttagactaaattaggtatagaataaaaataaaaatagccattctttgaaatacctatctgaagtatcttcattaatttctccttacacatgattcatctaaaatgtcacttctaaaccaggcatggtaaatcacgcctggagtcccagctactcgggaggtcagggtgagaggatcacttgagcccaggagttaaaatccagcctgggcaacatagtgagccctcgtcactaaaaaaaaaaaaaaaaaaaaaaaaaaaattaaaaaaattaaatgtcacttccttgtccacatttttgctgaatactagattgttatttacttacatagaacttcctactatatcacttaacatctaataaaaattatttgtttgtatatatataccgtatatgtttgcagatgtgtgtgtgtgcacatataatcttttattactagattgaactgctgtattagtccgttctcacactgctacaaaaaactgcccgagactgagtaatttacaaaggaaagaggtttaactgattcacagttcagcatggctggggaggccgcaggaaacttacagtcacggtgaaaggcgatggggaagcaaggcactttcttcacaagacagaaggaagaagtgctgagcaaagggggatcacgagaacagcatgggggaaactgcccccatgattcaattacctccacctggtctctcccttcacacgtggggattatgaggattacaattcaagatgagacatgggtgtggacacaaagcctagccatatcagctcctaaatggaagaggtttgggtctttcaccgatcttcttatctctagcagcagtactcatgagtttattaaataaactaacagattttgaaggcatcctacatgaatacgataccatggtgctaggccctgaggcagactcaagtgatattaaaaaaaaatggtaatttttaggctacgtattatggaacccaaagttttatgaaatcctatttagaatttggataaattatactaaaaataagcttatactgagaaacagataactccatgattcaaagcttctcattatagataccagttattctcatgtgacatcaaggttattgctagactggctgatttcctttgaattactttagaatctttgggaagaaggtgaagggaatttcttcctagcagatatctccaatataactgaatttattttgtatctcccaagcaatgactcaatctgattgctcaccttggtccatgattggtatttaaaactatatcttggggggaggagccaagatggccgaataggaacagctctggtctacagctcccagcgtgagcgacgcagaagacgggtgatttctgcatttccatctgaggtactgggttcatctcactagggagtgccagacagtgggcgcaggtcagtgggtgcgcgcaccgtgcgcgagccgaagcagggcgaggcattgcctcacctgggaagcgcgaggggtcaagaacttccctttccgagtcaaagaaaggggtgacggacgcacctggaaaatcgggtcactcccacccgaatattgcgcttttcagaccggcttaaaaagcggcgaaccatgagattatatctcacacctggctcggagggtcctacgcccacggagtctccctgattgctagcacagcagtctgagatcaaactgcaaggcggcagcgaggctgggggaggggcgcctgccattgcccaggcttgcttaggtaaacaaagcagccaggaagctcgaactgggtggagcccaccacagctcaaggagacctgcctgcctctgtaggctccacctctgggggcagggcacagacaaacaaaaagacagcagtaacctctgcagacttaaatgtccctgtctgacagctttgaagagagcagtggttctcccagcacccagctggagatctgagaacaggcagactgcctcctcaagtgggtccctgacccctgacccccgagcagcctaactaggaggcacccccagcaggggcagactgacacaaggccaggtactccaacagacctgcagctgagcgtcctgtctgttagaaggaaaactaacaaacagaagggacatccacaccaaaaacccatctgtacatcagcatcatcaaagaccaaaagtacataaaaccacaaagatggggaaaaaacagagcagaaaaactggaaactctaaaaaacagagtgcctctcctcctccaaaggaacgcagttcctcaccagcaacggaacaaagctggacggagaatgactttgactagctgagagaagaaggcttcagacgatcaaattactctgagctacgggcggacattcaaaccaaaggcaaagaagttgaaaactttgaaaaaaatttagaagaatgtataactagaataaccaatacagagaagtgcttaaaggagctgatggagctgaaaaccaaggctcaagaacttcgtgaagaatgcagaagcctcaggagccaatgcgatcaactggaagaaagggtatcagtgatggaagatgaaatgaatgaaatgaagtgagaagggaagtttagagaaaaaagaataaaaagaaacgagtaaagcctccaagaaatatgggactatgtgaaaagaccaaatctacgtctgattggtgtacttgaaagtgacggggagaatggaaccaagttggaaaacactctgcaggatattatccaggagaacttccccaatctagcaaggcaggccaacattcagattcaggaaatacacagaacaccacaaagatactcctcgagaagagcaactccaagacacataattgtcagattcaccaaagttgaaatgaaggaaaaaatgttaagggcagccacagagaaaggtcgggttagcctcaaagggaagcccatcagactaacagctgatctctcagcagaaactctacaagccagaagagagtgggggccaatattcaacattcttaaagaaaagaattttcaacccagaatttcatatccagccaaagtaagcttcataagtgaaggagaaataaaatcctttacagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatggggactaggaagaaactgcatcaactaacgagcaaaataaccagctaacatcataatgacaggatcaaattcacacataacaatattaactttaaatttaaatggattaaatgctccaattagaagacacagactggcaaattggataaagagtcaagacccatcagtgtgctgtatttaggaaacccatctcatgtgcagagacacacataggctcaaataaaaggatagaggaagatctaccaagcaaatggaaaacaaaaaaaggcaggggttgcaatcctagtctctgataaaacagactttaaaccaacaaagatcaaaagagacaaggccattacataatggtaaagggatcaattcaacaagaagagctaactatcctaaatatatatgcatccaatacaggaccacccagattcctaaagcaactcctgagtgacctacaaagagacttagactcccacacattaataatgggagactttaacaccccactgtcaacattagacagatcaacgagacagacagtcaacaaggatacccaggaattgaactcagctctgcaccaagcggacctaatagacatctacagaactctccaccccaaatcaacagaatatacatttttttcagcaccacaccacacctgttccaaaattgaccacatagttggaagtaaagctctcctcagcaaatgtaaaagaacagaaattataacaaactgtctctcagaccacagtgcaatcaaactagaactcaggattaagaatctcactcaaaagcgctcaagtacatggaaactgaacaacctgctcctgaatgactactgggtacataacgaaatgaaggcagaaataaagatgctctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacgtacactctcccaagactaaaccaggaagaagttgaatctctgaacagaccaataacaggagctgaaattgtgtaataatcaatagcttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcatcctgataccaaagccgggcagagacacaaccaaataggagaattttagaccaatatccttgatgaccattgatgcaaaaatcctcaataaaatactggcaaaccaaatccagcagcacatcaaaaaacttatccaccatgatcaagtgggcttcatccctgggatgcaaggctggttcaatatacgcaaatcaataaatgtaatccagcatatcaacggaaccaaagacaaaaaccacatgattatctcaatagatgcagaaaaggcctttgacaaaattcaacaacgcttcatgctaaaaactctcaataaattagggacgtatttcaaaatagtaagagctatctatgacaaacccacagccaatatcattctgaatgggcaaaaactggaagcattccctttgaaaactggcacaagacagggatgccctctctcaccactcctattcaacatagtgatggaagttctgtccagggcaattaggcaggaggaaataaagggtattcaattaggaaaagaggaagtcaaattgtccctgtttgcagatgacatgattgtatatctagaaaaccccactgtctcagcccagaatctccttaagctgataagcaacttcagcaaagtctcaggatacaaaattaatgtacaaaaatcacaagcattcttatacaccaataacagacaaacagagagccaaatcatgagtgaactcccattcgcaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactctcttcacagaattggaaaaaactactttaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaacctgagaaaaacaagcaatggggaaaggattccctatttaataaacggtgctgggaaaattggctagccatatgtagaaagctgaaactggatcccttccttacaccttatacaaaaattaattcaagatggattaaagacttaaatgttagacctaaaaccataaaaaccctggaagaaaacctaggcaataccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaaacaaccccatcaaaaagtgggtgaaggatatgaacagacacttctcaaaagaagacatttatgcagccaagaaacacatgaaaaaatgctcaccatcgctggccatcagagaaatgcaaatcaaaaccacaatgagataccatctcacaccagttagaatggcaatcattaaaaagtcaggaaacaacacgtgctggagaggatgtggagaaataggaacacttttacactgttggtgggactgtaaactagttcaaccattgtggaagtcagtgtggcgattcctcagggatctagaactaggaataccatttgacccagccatcccattactgggtatatacccaaaggactataaatcatgctgctataaagacacatgcacacatatgtttattgcggcattattcacaatagcatagatttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaaccatcgcaaggacaaaaaaccaaacaccgcatattctccctcataagtgggaattgaacaatgagaacacatggacacaggaaggggaacatcacactctggggactgttgtggggtggggggaggggagagggatagcactgggagatatacctaatgctagatgacgagttagtgggtgcagcgcaccagcatggtacatgtatacatatgtaactaacctgcacattgtgcacatgtaccctaaaacttaaagtataataataataaataaataaataaataaataaataaataataaaa

SEQ ID NO: 104 - DNA, 79765 bp, Homo sapiens
tgagttactctgagttaagtcacactacctgaagttacatttggaacaccaacatcttaattattatcatgaaatagctacctattatttttaagtaaatgtactaacttctaatcatatctgttattttaagctttgaataatatgaaactaaatcatgtaattaaggatatagaaaaatgcaacagaatagctttataacagaccaattacaacactttatttcccatactgttacttaacaaatatctgtgctattttataacattttaaaatcttaagactagaaataattacatcttttactagtgcttataagggctgttgtcatctttaaagacacaacatctttaaaattagaaatgcatacaattttatatttcaaaatgtattaactcaaagacaataaaatacacctatttcttaagatctattttaaaatactgttgttgcattggattaaatgtatatatgtgattaatgaatgcttccaatataaagatttaagtctatttttccttgccagaaaaaaacaactcagcttaatttttaactattttattatacccttcagaacttaaaattatatacaaataatgtaacctgagacctgctctggtcatctgaggaattacaattagagcatgaatctccacaattctgcagcaccttaagtaattttataaaaaaaagtattttttgcatatttctttaactccattaagatcatttcctgggcttcttacagtgaaaaaaaaaagtcatttgttttagaataaagaatacagcaaaaatacttcgtcatccaaaagactatttttcctacactatggtcaggcaaccaaccccactaaatatagaagactgacatttgtaggtaattcaatagtcagatgataattcttcagtagtttcacagtagcataatttttcacattacttgaaaccactgttaaacctataacacattttctgtttctctgtgggtatttttttctgtctttaaccctaaaaggaatatgtttcatctgacagcagtacaaaagccattcataattcagaaatgttttccttttttgcaatcaatacatgactttgaactcaggtttttcaaagattagttaaacattatgtttctttaagtctagagccttatttatgtgagtctgtggcttaactgacaagaatttttctgttccaaggaaagtcagtcagtttgtatctgaaatactataatctagcttccgtccatataaacatctgcaaagactcactcagtcaaatgttatacaccccatcaaccaaatcagagactgtaagaatcattattctgtgcgacagataaaaatcttctgtgcaatagagaaaaatgaaaagcaaaatgatgaaagaaaaacatttataattttgaaaattaattagtaacaatactcagtgtaaatatttgttaacatttcttattcaattctacaaatgtttaataaaatcctaaaatgtaaacataatgagtgctgtatttatatgttctctaattgtattatcatacaaaatattgtttgtataactgccatatatattttgtctatttctagtaagttaccattaaatgaaagttaaattgttcaatgttgaatgaaagcaagtatgacttattacattaataaaaaattaacccatgatcaaaatgtctaaagtatatcccattttgatgcacattttaaaaatattaacaaacttaacaagatcctaaagcctcatattttttaggtgcagctggtaaaaaaactaacagatatcatatgctaatagtacttatgatgtgcaaagtactgtttgtaagcactttacatttttgaaccttcttaatgctcagaacacctttcactttagagacaataaaaaatgaagctcataggggttaagcagcttaccagaagtcacacagttattaagtgacagtttggttccaaagtccattctctttaggcctaccctgaaaagcatcactgtaatataagatttttttttaatttgaaagaagaaaactgtggtattcactgacataatgcctagaacaaatatgtcaaatattcttatttgaggatgctaccataaactttatataaattacatactggtaataaatgtaccttatttgtaatcattttcattcaaagtaacaaaatcaaagtttctctcttgtcaatttgaattaaacagtcatgtgtacaaatatacacataagcacctatgtattacttccttatgggaacaatacgaagatttcaatataaacgaatttactaaaatcaagcataaaaatattttctgatgattagtaacttacataataattaagtatacatgttaacttgcatttcattaaccaaaattttaatatttaagcttaagtgaatgatacgggtaacataatcattcattttatttgtaatgtgaactaaaagttaccctttcaactgtcttattttttaaagttcagtgtaatcctagagtttaacatatgaattggtaaatgcaaataatctcatactgcaacttgccaacttaaaatgcaagaattcatttctaattggttggtttattgctcactcagaaaatttttatttctttttcagtgaatactgtttcacatttggtaaaatacaggaagtcacaccaccaatggaatgcgattatctataatgagagttagttattccatattcccatttttaaaaataaattaatatatcaacacactctgtaaaatttatataaacttaaaaatactagtgagctgaaagtggaaaaaaacataatcggaataatttcataacatgcataatcattcttcacagaatttttattacccagtatggaatggattatagtaaatgtacttcacacatgctgtttcttattcaaaaggaaacacagaataggacagagagaacttccagccaaatcttcattctaatccaacagtcatggacgccactgtaattgaaagacatttccaaacagatagctgtggaccccattttcctttaaaataatatgtctttcacatctgttccaactaaaacatgtgtgttcttaaaatttaccaaactaccttatgcttagtttttaaaatattaacagttttatattgttctgcttaatttgcaactagttaagcccataaaatgtacattttcaaattatgttaacatgttaaaaagtagtagaatatgcacgactaatcaacattttacatctgtgatttccaaagttaggaaacctcaattgtttttcactgactcaagcaacttcttaaaatggtacaaatcatatattttgccattataatattaaggtgacttcattttattttcactttgaatatcttccaaaataagaaatccagctctcaaaatcaggcatcaaaagcaatactattaactcttttgacatacccaataattggaaattaaaaataaatcatgcaatatttagacattatctgtcataagaatcttttaataatgatgataccttccttggaacgtttacaaaattataaaattgcagataattatgaaacggtttaaaaaaaatttcacatccagaatataaaaataaaatagtataaaagaaagaagagcagaaaacagaaaaaggaaaacaatgaaggccttacatacttgttaaagtcaaaactactgcaacaaaaatttaggattactttttatataacagtatcttcaaaagcatttacaaagttaataaaaacttaatcagattgcttttacccaatgatcttttgtataacgtagtcaaatatcccatttagaagtttgcctaaataattgtatccataaacttttcctagtcattagcgtcaaaaaataccttgtacattattactactcgtactatcaaaatctctattttgaaatatcattgtcattccatttggagcattaacctagaacggacaaaaaatgtttatcaatattataaatctgacatttataaataatatacaattctatttaatgaactaaagagcaaattgatttaacagaggtagttagtacttacacattttacactgactttcaggtgcagatattcataatgtagaaataaatgataatataaattgaagaaatcctacaaatgtatgtgtgtgtgtgtatatatatataaatcactagagatcaattacagagcagcatcaaatacaagacagtaagatatagattatacacaaatactgataaaatataaggtaaagataacataatcaaggatgagaatattgatgaaagactccatgaaggaagtcttgcaccacagtttggaggaagatctcgaaataaaataaaatacaggttttataaagcagtcatttaagtggatagagaatacagggcatggagtaaatggcgaggaacacaggcactgaggagacagaaaacaccatgtaaagacaacatgcaaaacaaccgaaataaaggaggtgcagtccataaagtttataaacggcattaacatttacccaactgttcaggtcaaaatctaagctgtcatcaatgatactttcctctgccctacactctgtacctaaatgatcaccaattcctgttaattctacctcttaagtatatcctgagttgtctttagttccccagcagcaccacctgttattcagactatctctcatctgaactatttttgtaaactccaaggcagtcttactgcatccccttgccctcaatttcacttctccctcacttgaaaccttttctgcatatttctgcccaggatgatctgtttgaaatgcaaatcaggtcactttatgccctcactaaaaaacctttcagtggattaccaatactgtcaaaataatgtccggaatctttaacacgacatgtgttgctgtggtcctaatctatcttaccagttttactttgtacctctccagcctcatgcagagccttctgccccagccatgaaggacttctctcagtttttcatacaacctatttgtgcactttctctctcatctccaggcaagatcaattgtaacttttccaagaaagccccccttgaccatccctcttatgaaacatgacagactacactaagtctacttaaactctgaactactaatacttctctgtcacagcttttaaatggcagctttctataataaattattagttccgttaagaagggccacccaaacacagtggctcacgcctataatcccagcactttgggaggccgaagctggaggatcacttgaggttaggagttcaagaccagctggccaacattgtgaaaccccatctctactaaaaatacaaaaattcgccgggtgtggtggtgcatgcctatagtcccagctactcgggaggctgaggcaggagaatagcttgaacccaggaggtggaggttgcagtgagccgagattgagccactgcattccagtctgggtgacagagcaagattccgtctcaaaaaagaagaagaagaagaagaagaagaagaagaaccacctgtatctcttttgtattctatacatcttcagagccaggtaagagtctaaaataataaacatttgataactgctaaggtgagaagaaacaacaaaagatacagccatgcagaagatacacaggttatcacagacaagcagttcaccaaatactggatctacgaggaacacttataaagaatctactttggtgatttctgactatactcatcagagcctttgggttcaaggaggacaagagtcaggaagatgctcgttccttccacatatattctccacctctgcatcaaacagatctgcttcaatcttatgtgtttttaacatatcgagtcatcacataacatttcatttggggggaaaagtttgaaaacctctatgctgaaaaatttccaaatcttgatgcagtccttccattcaaatacaatcctttcctggaatcactcccaggctactgactgacagaaaccacccctaataactcaggctgaaacccaaaatcaccttaatttttgattccttgactcctccatatctaatcaatcaccagatcctattattattcctttcttacattaacccatttttctcattctcactattgtcagtttaaaacagattcagacccttcttattcctgaaattactataccaagtaattttacttcctaacttgcttgcttaactccaatctccccttcattaaatatgcccatgttgggctcaactttctcatgcagtactttcattttaactatagaaataatatctcgtagattccagttttatactgtactataaagcaaaaccaaattcccatctctgacttttgaaatcctctttctataacctgcccaaactagctactcaacctattagatttccttctccttctatcagattggttttttagttttctcaaaagtacattggaatcatttaagcaggatattttacacttctatctacagatgcaaagtagtatgccctaagttactgaagaccatcagacataacatagaaggactccatgttgccagttttccgagtttgcactattggaatgatctttatttattcccacattttctatagtttccacctccattaggtcatggcataccattccacaattacataatataaaattcctgaaattctgataaactttatataatgtatagcttacaaaatgcaattcatagataagaaaaggaagctcaaaaaagcaatggttgcgggtggtggctcatgctgtaatctcagcactttgggaggccgaggatggcggatcacttgaggtcaggagtttgagaccagcctagccaacatggtgaaaccccatctctactaaaaatacaaaaatgacctgggcatggtggcaagtgcctgtaatcctagctacccgggaggctgaggcaggagaattgcttgaacctgggaggcagaggctgcagtgagccaagattgcgccactctactccagcctgggtgacacagcaagactctgtctcaaaaaaaacaaaacaaaaaaaaaaaccagtaagcaatgtgttcaaagttacaccactaagttaatggcagtgctgaaaacagactaccagttgagatcagctcactgcctttttcttatgatcagctacaattattttcacagaaggccttaaaattcaacaattatgagaaataattctagagtcacagtgctggagtttgaaaataggtcacaacacttacttgaaaataaaatttgacattccattatattaatttttagctatgtatctatgcagtatgtaagactcattcatttaaccagcatttagcaagcacctaccatgtgtgagagatacaatactgaacaaaactgactaaaatacatttatgaagaacatgtgttagtaaggaagaataatatatgaataaatgaatatgtaaattagatatttacagtgtcacacagagataaggctatgaagaaaaattaggtagaaatggcaagtagagaagggaaagactgctatttcaaatatggcgatcaatgaggtcttcaatgatgaggagacctttaagcaggaacatgaggaagagagtaagaagatatttgaggaaagaatattctagcagaaggtgagggcaagagcagaagaaactgagatcagaaaagtagtgaaaagtgaggacacacagcccatcataaaatatgtgacttttactctgaataaaatgagaagccattaaagaatttcaaattataaaagtaaaaaaaaaatctaatttaaatatttaaaatttcactcaatatcacaggaagaataaaacaaggggcagggggtagaaatgaaaaacaggagcaaaagtagttgcagaaagacagacctattacaagaataaaatccaagtaaaagatagtaatgactaagagcaatgtgtagcagtggaaagaaatgtgggctgtgagagagttaaagataactccaaagattttgacctgctggaagtaaagaattgccaaatagattgctgagatgagggggagatggcagcaggagcatgtttgagggaatataaggacctggttttggctacactaaatttgagaaatctaccagacattcaagtggagagagaggtatagtactgatttcaatatgtgaacaaggagttcagaggaaagctctatgtggagtagtcagaaacagttgggtatatggtatttaatattgaaaaccacaggactggatgagatcaactataggttaagtttagatagagaagataagaaacaaaggctgaaacctagcacaatccattgttcagagatccagaagaagaaaagcaaacaacatctaggagatgagtagaaacgacttagtgaagttaaacctaaataaataaaaataaaccagaagactgaggtgttctggaagtcaagtgaatgaagtcttttaaagaggagggtgaacaactgtgtcaaatgctattgataggtcaaggaagataaggactgaaaactagccactggatttagcaatataaaggtcagtggtgaacctgagaagagcagctttggtggagtgataaaaggaaaaagtctgactgaagtaaattttagaaagaatgggaggataaaaactggagatagggagaaagcaattcctttgagaaattatgctaaaaaggaagcaaggtaatgggatggtaaatagagactaatgtatgatctagatgttgtgtttgttgtttaagatgagtaaaattcatgcaagtctgtatgtcatttgtggcaagtctacttggtgccatttttcaacagcatgggctcatttcatatctctgtgtcatgttttgataattctcacaacattttaaactcttcactagtttcgcacctgttatagtgatctgtgatcactgatttttgatgctaccactgtaattgtttgggggcaccaagaaccaggcccatataaaatagcaaatttaattgatacatattgtgtatattctgactactctaccacctggctattctcccatctcacaccctctcctggagcctacctattcctcaagatgcaacaaaattggaatttggccagtcaataaccctacaatggcctctaactgttccagtgaaagttaaagttttacttcttctactttaaataaaaagctagaaagaattaagcttagttaagaagatatgccgaaagtcaacacagtccaaaagctaagcctcttgtgccaaacagttaaccaagttgtgcatgaaaagggaaagttattggaggaaatcagaagtgctactccagtgaatacaagaataagaaagcaaaacaacttcattgctgatatggagaaagttttagtggtctgggtagatgataataccagttagaacattcccataagccaaagcctaatctagaccaaggcattaattcttctcaattctatgaaggctgagaaaggtaaggattcagaagaaaagttagaaactggcagatgttggttcatgaggcttaaggaaataagccatctccataacataaaagtgcaaggtgaaggagcaaacaatgatgtagaagctgtagcaacttaacaagaagatctaactaagatcactgatgaagatggctatacaaaaaaagagattcttgactgggcgtgatgcccatgcctgtaatcccagaactttgggaggccaaggcgggcagatcataaggtcaggagattgagaccatcctggccaacatggtgaaaccctgtccctactaaagatacaaaaattagccaggtatggtggtgtgcacctgtagtcccagctgttcaggacgctgagacaggagaatcgcttgaacacaggaggtggaggttgcagtgagtgaagatcataccactgtactccagcctgggcaacacagcaagactctgtctcaaaaaaaaaaaaaacaaacaaaaaaattctcagtggaaacaaaacaaccttctactggaagaagatgccatctaaaactcccatagctggagaggagaagtcaattcaaagcttcaaaagacaggctgaccctcttgttaggggctcatgaggctgatgacttaccctcttgttaggggctcatgaggctgatgactttaagttgaagccagtgttcatttaccattcagaaaaatgtcaggcccttaagaattatactaaatgtactcttcctttgctcagtaaatgaaataacaaagcctggatgacagcatatctacttacagcatggttcactgaataatttaagtctactgttgagacctactactcagaaaaaagattcctttcaaaatattattgctcattgacaatgtacctggtcacccaagagctctggtggagatatacgaggagatgaatgttgttttcatgcctgctagcacaacatccattctgcagcccatggatcaaggagtcagctcaactttcgaaatctatttcatgaggctacagttgccacagatagtgattcctctgacagatgtgggcaaagtaagttgaaaccctctggaaaggagtcaccattctagatgccactaagaacatttgtgattcatgggagaaggtcaaaatatcagcatcaataggagtttggaagaagctgatttcagcgctcatggataacttttagggattcaaaaattcagagcaggaagtaactgctgatgtggtagaaactgtaagagaattagaattagaagtagagcctgttgtgtgactaaagtgctgcaatctcatgatcaaacttgaagcaatgaggagttgcttcttatggatgagcaaagaaagtggtttcctaagatgaaatctgttcctggtgaagatgttgtgaacattgttgaaatgactacaaataatttagaatattccataaacatagttgctaaagcagatacaaggtttgagagaactgaatccaattttgagagaagttctgctgtgggtaaaatgctattaaagagcatcatgtgctatagagaaatcttttgtgaaagcaaaagccaactggtgcagcaaagttcattgttgtcttatttgaagaaattgcctcagccactcaaactcagcagctgtcaacatcaaggcaagatcctctgccagcaaaaagactatgacacattgaaggttcagacgataccagcaaaaagaccatgacacactgaaggctcagatgatatcagcaaaaagactatgacacattgaaggctcatatgatcaagacagcattttataaaaataaagtatttttgtaattaaggtatgtatactgcttttttttaaagacataaggctactggaaaggaaaataaatctcgggaccccaaaatcactaagccaaagggaaaagacaagttggagactgttaggcaaatctgccatccattttattcctaaataagacagctacaaagataaaaagctacatactcacctcacaatttgcccagaaggaaattgcttttagacaaaggacagacagaactcaaagtcatacttctgttcacctaggacaaatgcatatctgattgctttctctgccctattgtttcactaagcctgacaaaggcataagtgactattcctctaccctcctctcacatataaattgtgtcttcagtaaaaggctaagaggctcaaaagaatgtaaccatttttctcttatctacctataacctggaagccccctctcccacttcaataggttctgcctttctggacagaactaatgtatatcttacacatattgattgatatctcatgtctccctaaaatatgtaaaaccaagctgtgctctgaccaccttgagcacatgtcatcagaacttcctgaggctgtctcatgggtgcatccttaaccttggcaaaataaactttctaaactgattgagatctgtctcagatacttttgcattcacagacacttaataaactatagtatagggtaaatgtaacttttataagcaccaggcaatcaaaaaattcatgagactgacttcattgcggtggtctggaactaaacccacaatatctcagaagcatgtctgtgcttccagtctttctcttaaagatccaagaccaggtccaagtacaagaatggaaaagagaagaaaagggagcaaaaagtaaagtaagctcccatctgaacaagcctctttcaagcaccagtcccaaaagttttccacccagtgactttcactttaactgaccattccacaaaggagcatgggaaaaggtgttttttattagactcattttattacacttccattttttttaaacaaagaagaaaaaaattttaatgagtcaaaatttcccaacataactgtctttgaaaataacaagtataaaagttacaagcaaatacttacatggttaaaaaatctaatttttataaatgtaagtaaacttttatttcttaatgttctacagtatctcgatatccatctctgtaaggtgaagttgtaacagtaaggctcctactctctcccctgccctttcatggtcctcatactttatgtttatttttatactgtaaagtttattaagattcatattatctcccttaaatacaaacaagtcacttatgttttgaccacagaatgactctaaattctaaaaatcaataaaaatgattatttttattataattatgttctgtgctttccaagtagaggacaacgaacacatctccttcggtatttgtccaataacatggtctctaggccaattaaaagagaattctgggccaggcgtggtggctcgcacctgtaatcccagcactttgggagaccgaggcagacagatcacaaggtaaagagatcgagaccatcctggccaacatggtgaaactctgtccctactaaaaatataaaaattaggggggcgtggtggcatgtgcctgtaatcccagctacacgggaggctgaagcaggagaatcacttgaatcccggaggcggacgttgcagtaaactgagatagcaccactgcactccagcctggcgacacagcaagactccgtctcaactaaaaaaaaaaaaagagagagagaattcttcagccaggcacagtggctcacatgtgtaatcctagcactttgggaggctgaggtgggcgaatcacaggaggccaggagttcaagaccagcctgaccaagatagcaaaaccccatctctactaaaaatggaaaaagtttagccaggtgtggcagtgcatgcctgtattaccagctactctggatgctgagatgagagaattccttgaacccgggaggcagaggctgaagtgagccaagattgcaccactgcactccagccacagagcaagactctgtctcaaaaagaaaaaagaaaaagaaaaaggaaatttttctagcagcaagatcaaatatacacacttttcttatgctgaatcaattgcttaaaaatcatgcttcattttactatacttggttgttcttccccgaacttttaatataacttttagggttggaattttacttcttttcattcttcttgtttaaaatgaaaaatgtatctcaatgagtttaagcattccactcacttcatcatggctttattaaaaggagtttccttttcttcctggaaaatgctctcttcctcagccgtaggttctgaaacttccctccacctccactatgtgtgtgtgtgtgtgtgtgtgtgtgtgtgtgtgtgtgtgtgtgtgtgtgtgtgtgtgtgtgtgtgtattgactctactactcactaggtcctatgactttgtttttcttgattttcttccttatttattggagaaagtcttcaagaaacttccaaagggtatatagaatgtagtactaatcacttgaatacctaaaaataatctttttctgtcttcagggctgacaatttgcttaggtatcgaattctacatacaaataaccttccctcacagttcttaggacatcattcattgtcttttaggatctactcttgatacctgattaaataccattcttgtttaccttaaatatccttctgtttacaggtgatgtccttcccccaccatggatggatgcatttacatgatcaaaaattatacaaggttgtttccaggtaaggcaagtttattttccaaggatgacaaaacccaaataccaaaacatgccacaatcagcacaagaaaggaagccgattttgaatgtaaacgcaaaaatatactggtttagccaaacaaatgacaccaagctcccaccaatattctaaaatatgagagtcaaaaagacaaaacaactgtgtttgccacacaattcaattagcatatatcctgaagagtgacatgagtctaagttccctcatgattcatttagcttgagcttctcaccacaggaagtgcgcctggaagagtttgagtatgcattgttcaagcaacaggacccctaaaggcaagcattctggtgatgaactgaatataaagaaaactgaataaaacatataacaaacatgtattttttaataagttaatgtctttagcatataacaagccatgtaaatttaatatgaaaaaaagaatgctccaaaagaaaaatgaactgttttataattcacagaagaacaaacataaatggccaaaacttttttttaaatatttaacatcactgagggaatataaattaaataacctattattcttcattggcaaagataaaacagataaatactgtgttgtaatatgttggagaaacaaatatttatagccactgtaaataagagaatgaacaaaacattcataaatcaattaggtaatattaatcataagtgaccaattctgctgaaacagtaagcaaacttttaaggattatatcctacgataattaatcaatcaaattattaagaacaaggaagcccattaaatgttcgttatttattaaaagctagaaaaaaatctaaatttttataagtttttagtccaagtcacacaaaaattattccaaattttgaattaagacagcagtctttattaccaaatctctatcattttaaacagaagataaaaattctcgtctgggaatcaatttgaaagttggtactaaaaagggcttatttcaaatttctaaaatacattaaaatttacataatttactatttaaatgtaatcagccatgtccataatcatgttaataacactcgaaagccttttgagattttgaaatgcaaaaaaaaaaaaaaaaaaaacaagtcaatagactaaaagcaattaactccaggaagagattttaaacaataaaccaatgtataaatgagcaaacacagctcacagctacagtatcaaacgattcagtgaccacccaagtacataacagctcagaaggaaaaaatcagttttctacaacaccttatgaaaaaaatttaaataagtgaccacacacattctcaatccatgctgagaaaagtgaaaataacagagaaaaaaataatctaaaaatgaagaaaaagcaaaaattgccaaatgggaatgtaatgtgattgacagtattcagaaaactaatgatagtaaaagctggggcaagaaaatcaggattacttggagaaaggaaatcagcattaaagaaaagaattacatacaaaaaaaaatgaaaaaatacagaaaggaaagaaatacagaaacttgtatctaataattaaactcttcatgtaaaacactgaaaataaatatttaaagatggatcataaagtacagacaattttgaaataaagactgaaaagccaggtgtggtggcacacatctgtaatcccagctgctcagaaggctgatgcaggaggatcacttgaggccaagagttgaagaccagcctgagcaatacagtgagctcccatctctaaaataatttatttcatgttagctgagtgtgttggcacatgcttgtagtcccatttactcgggagggtaagggaggaagatcacttgagccaaggagtttgaggctgcagtgagctatcatcatggcagtgcactccaaaataggtaacagagacttcattaatactggagccaagacctgctgcttgtaaccccctcacgaccgagagtcggcactccatgccccttcctagtgatactacctctgcaaccagcagagccgctgtgcccagtgtattccatcccagacctgagaatcaacctaccccgtggctcctactcccaggaaagctgcacgacagcaacaacaaatacccacagcctgggccacaaagccaatcacagacaccactgatatcaaatagagctgaagaaatcactggaaattcatactaccactactgcactaactcagaaccaaaaatcaaagcctactcaaccaacatgataggacacaactagcaggaaaaatgttatccctaattaacaaaattaacataaaatctgaagagctgattgtcccactagatttacagaaaccaaggtaaagacacaagaaacatgaaaaagccagaaaatatgaaactgccaaaggaagacaataatcctcagtgacagaccctaatgaaaaagataactatgatatgcctgaaaaagaattcaaaataatgatccttacaaaactcaatgagatacaagggaatacacagacaattcaacccaatcaagaaaacagtatgtgatctacaagaaaaattatatgaagtgataaatatcggggaaaaaaatcttggagttaaagaattcaatgaatgaaatttttaaaaatgtagtacaattgagagcactaacaataaactagatgaagcagaagaaaaaaaatctacattagaaggcagatcttctgaattaatctagtcagacaaaaaagaaaggaaaaaaagaatgaagaaagcctacagaaattatgggaaattattaagcaaaccacagccacattacagaagtcccaaaaggagaagatacaggaaagggcacagaaaacatgtttaatgaaataatagctgagaagtctggggaaagatatggacatccagattcataaagcttaaaggccaaatagactgaacccaaaaatatcttctctgaagcagaatatagtcaaactgtcaaaagtcaaagccagaattctaaaaacaagcaagacaagtgtcaagtcacatataagggaatccccactagactaacaggatttctcaggagaaatcatgcagtccagagagactaagatgatacattgaaagcgatgaaaagtgtggggggatgggggtaatggtagccaagaatatcatacacagcaaggctatccttcagagatgaaagagaaatatacacattcccagactagaaaactgaggaaattcatcatgactagaccgaacttacaagaaatgcttaaggaagtaaaaggatggtaactaccatctggaagtaaaaggatggtaactaccatctggaagtaaaaggatggtaactaccatcatgaaaacacacaaagtataaaactcactgatacagcagatacctatgagaaagtgaaagaaatcaaagcttatcactgcaaaaagaaacccacgaaactgtaaaaaaaattaataaaggaacgaagtatatataaaacaaccagaaaacaattaacaaaatgataagagtaagcccttacttgtaaataataactttaaatagaaagttttaattcaccaattaaaagataggctggataaataaactgaataaattattttgaaaaagatgcaaacacactacctacaagaagctcacttcagctgtaaagacacacatagactgaaagtgaaaagatgccaaaggtatgccatgcaaatggaaattcaaaatgagcagcagtagctatatttatatcagctaagacaagctttaagtcaaaatagtaaaaagagacaatgaaggtcattacgtaatgataaatggatcaaaactgcaagaggatataacagttgtaaatatatttgtacctaacacaggaacacctgatatatattttaaaattattatacctaacgagagaaacagactccaatacatgtatgagcctggaggatattatgttaagggaaataagataggcaaagaaaaataagtaccacatgttctcactcacatgtggaagctaaaaaatttgatctcacagaagtagggcatagaatagtagttattagagactagggagggcagagagattacaaggtaggacaactttggttaaaggatataaaactattctaatttgatcattacacattgtatttaaatattgctcaatgccccatagatacaattattatgtgttaatgaaaaataaaataaaaagccaaaatgtaaagagacctaaataaaaataaagtttctacatttccttagaaaaataaaatgatggccaggcatggtggctcatgcctgtaatcccagcactttgggaggccgaggcaggtgaatcacaaggtcaggagtccaagaccaacctgaccaacatgatgaaaccccatctctactaaaactacaaaagttagccaggtgtagcggtgcgcgtctgtaatcccagctactcaggaggctgaggcaagacaatcacttgaacccaggaggcggaggctgcagtgagccgacatcacgcaactgcactccagcctgggcgacagagcaagattccgcctcaaaaataaaataaaataaaataaaatataaaatgatgacatcagtagactagaataagtcacatgtatgtataccctaagcaactactaggaaaattatacaaaatatagtcaaaaatactatatattttaatctggccgaatgtggtggctcacgctgtaattccaacactttgggaggccaaggcaggtggatcacttgaggtcaggagttcaagaccagtctgatcgacatggcaaaatccagtctctacaaaaatacaaaaattagccaggcgtggtgacgtgtgcctgtagtcctagctactagggaggctgagacaggagaactgcttatatctgggaggcagaggctgcagtaggccgagatcacactgctgcactccagcctgagtgacagagcaagactctgtctcaaaagaaaaagaaaacaaaacaaaaaaacatatatatgaagcaaggtggaatctgaaaaaatgttctagtatacacaggaaggcaaaaagaaagaatgagagaaatgagaaatagaggaaaataaacagaaaacaataaataaaatggaagaaaagctgtaacatattcataattaaatgaaaattgttgaaatataccatttaaaggggcaaagttgggcagagtacataaaaacacgtgaaggtaatcctttgaaagcaaaagagtgaaaaatatataacatggaatattaatagaaagcagaaggagctgtattaatatcagataaggtgaatttcagagcaaagaaaattactaaacatgagaaaagatattatataatgatcaaaggagcaatctactaggaagacataggaatcctgtaaatacaaacaaccaaaaacagagtctcgaatacataaagcaaaactgatagagctggaaaaaaaattgatatatccacaactatacatggggatttcaaaagccctatctcaacaattgatgaaagtactagtggccgggtacggtggctcacgcctgtaatcccaacactttgggaggccgaggcaggtggatcacctgaagtcgggagttcgagaccagcctgaccaacatggagaaaccccacctctactaaaaaaatatttaaaaattagctgggcatgatggcgcatgcctgtaatcccatctacttgggaagctgaggcaggagaatcacttgaacctgggaggcggaggttgcggtgagctgagatcacgccattgcattccagcctggacaacaggagcaaaactccgtctcaaaaaaagtactagtgagaaaatcatcaagaatatagaaaatctgaacaacacactcaacaaaatcaaattaaaacatacaaatactacaccagaaaaaagtacccattgaatattcactaagatagaccacgtcctgagccatgaaacaaatctcaacatatttcaaagagttaaatcaatatagaacatgttatctaaccataattgaatcaaactattaatcaataacagaaagataatgagaaaatctctaagcacacttctaaataatccatgggtcaaagaagttacaaagaaagtctaaaactcataaaactgaatgaaaataaaaagacaacacaccaaaatatgtttgatgcagctaaaatcaagaggaaaaagaaactcatatcactacatgcttacattagaaaaaaaagtcttaaataaatgatctaagttcttatctcaagaaagtagaaaaaaagcaaataaacctaagcaggtagatggaaggaaatcataaagataagacacagaatttaaagtaggaaaatagtagagaaaatccataaaagaactggttctttgaaaacagatgaataaaatagataaacctacaggaagaataacaaaaatagagaaaagacacaaatcacaaacgccaggaatgaaaaactaacaaaaatagagaaaagacacaaatcacaaacaccaggaatgaaaaaaacgacattaccacaaatcctgcatctactaaaagattaaaaagggaatactacaaacaactttagacttacgaatctgacaagttagaagaaacaagccaattccttgaaaaccacacagtaccaaaatacaaccagtgtgaaatggataatatgaactgtcctataacaatgttaaaaattgaattcataattttatagctccccccaattccaaaacaattatctaggcctaattggtttaagtggagaattcaaaattctctaggcctaactggttgggtggagaattcaagtaaacttttaaaaaagaattgccaggcgcagcagctcacgcctgtaatcccagcactttgggaggccgaggtgggtggatcacgaggtcaggagtttgagacaagcctggccaacatagtgaaaccctgtctccattaaaaataaaaaaattagctgggtgtggtggcacgtgcccgtagtcccagctatttgggaggctgacgcaggagaatcgcttgaacctgggaggcagaggtttcagtgagccgagaccatgccattgcactccagcctgggtgaccgagagagagactctgtctcaaaaaaaaaaaaaaaaaaaaaaaaaagaattacacccattttcacaatctattaaaaaaaagatgagaaaatgcttcccattttatcaggcaaatataaactgaaactaaaaccagacagaaaaagattattgcagaccatcttctctcacaaatacagacataaaatacctacacaaaaattagcatatcaaattcaaccatatataaaaataattacatatcctaaaaaagtgggagttattccacatgtgcaacacggttcaacattcaaaaataaagcaatgcaaacaatcacatcaacaagctaaagaagaaaaatagtatgaacatatcaattgaggcagaaaaaaaaatctgacaaaatccaacattatttcatcaagggaaactttcccaacaaccaaaaaatgacagctaaaattattcataatgatagaagactaaatgctttacctctaaaattagtaacaaggcaaagatatccactctccccactctttctcaacatactacttactggaagttctagctagtacaccaccataagaaaaagaaataaaaagcacacatattggaaacaaacaaaatataactgttcctacttgctaatgacattactgtctgcatagaaaatcacaaagaatctacaaaagcctcctggaaaaaaataacagagtgaaccctagaagaaaacctaggccataccattcaggacacaggcatgggcaagacactgttggtgggagttcaaccattgtggaagatagtgtggcgattcctcaaggatctagaactggaaataccatttgacccagcaatcccattactgggtatatacccaaaggattataaatcatgctactataaagacacatgcacacgtatgtttactgcagcactattcacaatagcaaagacttggaatcaacccaaatgtccatcaatgatagactggattaagaaaatatggcacaaatacaccatagaatactatgcagccataaaaaatgatgagttcatgtcctttgtagggacatggataaagctggaaactattattctgagcaaactatcacaaggacagaaaaccaaacactgcatgttctcactcataggtgggaactgaacaatgagaacacttggacacagggtgggaaacatcatacaccagggcctgtcatggggtgggggcatgcgggagggatagcattaggagaaatctaatgtaaatgacgagttaatgggtgcagcaaaccaacatggcacttgtatatatatgtaacacacctgcacgttgtgcacatgtaccctagaacttaaagtataatataaaatataataataagagtgaaatagttacaggatacaagattgacacacaaaaatcaagctgtttataaatgctaacaattaacatgtgaaaacagaaattaaaatactccaaagaaattataattactcctaagacaattacttaacaaaacataaacaagagttatatactcaaaagtataaaatgttgatgaaagaaatcagacaacctaaataaatggagacacagtttatgttcatagattagaagactcaacatactgaagatattaattttccctaaattgatatataagtttaatttaattcctattataatcccatcaaggttttttctttttgtagacatagggaagcttattctaatttgtagtgcttttctcacttcatggtcacaataatttaagaaaataataatttgtagaacagctacttctagaacagctaaaacaatcttataaaagaagaacaaatgaaaggactcactctacttaatattaaagtctacatataactacaacaataaatacagtgtggtactgtagatggacaaaaacatagatcaatagaacagaatacagaacgcagaaatggaccaagcaaataatggctcacagattttttagaagcttaaaagtataattcaatataggaaatataaccttttcaacaaatagtgatggagcatttggacattcataggcaaaaaaataaacttccacttaaacctcacagcatatataaaaactaaaaaatgtatcacaggtctaaatataaaacataaaacttaaaaaaaaagtagaagaaaatctttagaatctaaggctaggattgacatcaaaagcaagatccctaacattagatacattgcacctcatcaaaattaaaaacttttgctatgcaaaagagcctgttaagaggatgaacagataaactacaaaccgtaaggaaaacactcaacgcttgacagtaaaactacaaacaatccaattagaaaatgacagaaggcaggaatggacatttcatggaagatgacatacagatggcaaataagcacacaaaatggtgttcaacatattagccaacaaggaaatgcaaatgtaaaccacaggagattatcactacaggaccatcagaatggctaaaatttaaaaacagtgacaacaacaaagactgataagaatatggagaaagtgaatcattcatacatttctgatgacaatgtaaaattgtacagatactctggaaaacagtttatcagtttctttaaaaaattaaacacacaattaccataatgacacagcaattatgctcttgggcatttattccagagaaatgaaaacatgtgttcacgcaaaattctgtatataaatgttcacagaagctttatttttaatagcccaaaactggagacaactcagatgtccttcaatgggtgactattaaagaaactggtacatccacaccatggaatactcttatcaataaagagctaataactactaatgaatgcaacaacatggatgaatcttcatggaattatgtttgagtaaaaaagatcaataccaaatattacatattgtaatccatccatttaacattcttaaaatgtcaaaacaatagaaagaaagaacaaatcagtgtttgccatgggatagggaaagaggtagagaatatgagagaagagttggtggaggctataaaaggggaagcaacacaaggaatttcatggtaatagaactgttatgtgtcttgactggtgtagtagatacatgaaaccgtatgtgagaaaaaaagaactaaacactaaacaaacacacaagttcaagtgcagaaatcttcacaaaatcaatggatgttatcaatgttaatattctaattttaatagtgtactataattttacaacctcttaccattgggggtaactagataaaggatacacaggatctgtctgtattattacttgcaactacctttgaatctacaattatctcaaaataaaaagtttaattttaaataactaaaatgaagaaacagaaatgataccatatactattgtaaaagttcagtaaggtgtgccatactaaattcgtatgtacctagaaattccaatctaaaatttcagattcccagaattaaaacatcaattatagaacttttttctaactatataaatcataccctacaaagcccctaaattttatatttaataatgaaattttttcttaatctgatatatatcttctcaattaatcttaccctcttataacagataaactaaagctaagttgcaagctctatcaaatcctagcaaattctgaatgagtaaagtctaaaattaccaaatatttaaatttaacttcaaggatacatttactgtaattatcacatcatgatgtaaattattgcaaatataagtataatcaaagctagagctctacttacgaatttactatgaagcactaaattactagtttattttaaattcctcaatttaaaacattaatataatcttaatctaacaatgttaaattacaagtagaatactaaaaatgatagaaatacttaaccaacagtaaattacaccaacaagccttaataaaatatatctaatatcttaatatatattaaatatacatattaaatataaaatatatcataatgtaccaaaaacaaatcatttgaaaaaaaattccataaagaaccaaaggcaatatattttcagttagaattcactcacaggattgaaagacaaacataatatatatatatacatataaatgtaaatgtcattaaaactaatatcattcttaccactcactatacaggttttcctgttcccattgtattgtctatttaaagatgttctcattactcatatgtaagtactccctctaaaatgcataaaattctctcaatgggattgttaaaagatctacagtacttcatggtttgagcagaacaaactatgacatgctgaaagaatgtttctcactgtgtggttctgtcaccacctacatactgagtttactattttaaataaatggtagtgacacttcacagtgtacagcattttagtatcaatacatcttcaaaaaaatttaaatctctatatattaccatcatttgacaaaaggatgaataggcaagcaagagttcattcaaaactatacccaactggatcaagaggtcaggagttcgagaccagcctggccaagatggtgaaatctcgtctctactaaaaatacaaaaatcagctgggcgtggtggtgtgagcctgtaatttcagctactctggaggctgaggcaggagaattgcttgaacctgggaggcagaggttgcagtgagctgagatcgcgccactgcactctagcctgggcgaaagagtgagactttgtctccaaaaaaaaaaaagaaagaaagatagaaagaaaaaaactacacccaacagattttattaactattagtcaaggtaagataatttttcatttattataatatctatcattgccactataataaattttgacacagaaataaaagttatcattatgtgtatttctgaacacataaaaggtcccatacatttaagttattaaacttctaaaaatatacaatctgccaggcgtggtgactcacacctgtaatcccagtactttaggaggccaaggtgggtggatcacctgaggacaggagttcaagacaaacctgaccaacatggtgaaatctcatctctattaaaaatacaaaaattagccgggtgtggtggcatgcgtctgtaatctcagctactcgggaggctgaggcaggagaatcgcttgaacctcggaggtggaggttgcaatgagccaagatttagctactgcactccagcctggacaacaagagcgaaactccatctaaaaaaaaaaaaaaaaagacaataaaaatatacaatctatactgtcagacaggatttttatgttcttcactaacaaggacaaaagaacatttaggcaaatacagctacttcatttaatcgacattttgtgaactatcttatatgccttaattttcaatattaagaatcaacaccaaatctttacagatagctactgtatcataatcaatattggccccagctaaatctatacaaaatttcttataaaaattaatatttttgaccattccacatatggagagagattaactggttggattactactttcttccactatcttcttcctcatcactgaatagatggtatgctagtatgttttttggcaaccctgcaagtatcttggaggtttgtttcaagtcttttattaagtgtatataacaataatccactttttaacagagtctgctgtagaataaaacatacaatttagtatatttctgtctcatcacattattaaatacatacaaaaatctcttttatacccacagatcaagcacaatcccaaaagacctgaagaaataacagccttccacatggttgtagtaatttatcaatgaaactaaaatacaccactaaaacattccctactctacataacaagcaataaacatggagccaactgtttagtacaatgacaaagagggcataaatttgttaaggagaaaaaaaattaacctaaacactgtcatcttcacaagacatatacaccaatgcaatcctcagatatgtaagaataagtcatacattatattaagcacttacaatgtgtcaagtagtgtgccctttacatttatcagtgaatttaatcctcttgataatcctataattttacagcagatatatgaagtccaggaaatggtgatatttttcagttgggtatattaaaactctaagttttatttcagaaaagtattcctattttaaggcagctaaattgttttgctttctgccaccaggggatgtacactatacaatatgactctaagcatacaatatatatttgtatgtgtgtatgtttgagtgtgtgtgtgtgtataacgtttactcaaatacagaaaaaaattaaattttaagcctgcatgatgactgactgtggtattgtgctgtgctggtaaaataggcttattaaattgtcatgctttgggaggccgaggtgggaggactgcttgaggccaggagtttcaggccagcctaagcaacataggaagacccccatctctacaaaaaaaaattttttcttctttttgagacggagtcttgctctgtcacccagtgcagtggcgcaatcttggctcactgcaacctccgcatcccgggttcaagcaattctcctgccttgagtagctgggatttcaggcccatgccaccacacccagctaatttttatattttagtagagacggggtttcaccatgttagtaaggctggtctcgaactcctgacctcatgatccgcccgccctgccctcctaaagtgctgggattacaggcgtgagccactgcgcctggccaacaaaaatattttaaaaaaactacatgtactctgtggcaagtgcctgtagtcccaagtgactagggaggctgaggtgggggaatggcttgagccctgttcgaggttacagtgagctacgatcatgccactgcactccagcctgaatgacagagtgagaccatctagaaaaatatatatatatttaaatatatactaaatatatatatttagtagagaaaaggttttgctattctcaaactcctgagctcaagggatcatcctgcttcagcctcccaaaatgctggattacaggatgagccacaatgcccagccaaaattatcaaatttttaacctatttaatgatagttagtatatgaaataatactaaaataaattccatgattgaaggaaactagaatatgtttataagagaaaaatttctggaattaaaataattatgaaaaattatttatattagatatcttttgaaaaacatattctacttcagacattttcaacattagtaatatgttaattagtttgatgattccttaactctgtgatgtttatgtgcttatgccttcacaattatgtttaacttatttaacttaactgtagatttcagctttaaaaataatcataaaactagatactgctcataaaaaataaaattcatgcaatttcagttattagcttttcccactagttttaaactatttccaggctccctccaaaaaagactatttatacttggacttccttttccattttatgtttcagattaggaacctaacacataatattaaacaaaaggttacctggacacctgttgcattcctagatcacaactggtttcccagtgagacaggacacccaacccaccaggcagctttatgccatgaacaataagattcaaaggtagagaataataagaaaaggtccaaaacacaggtaccaatcacttcaatgattaaattattccttaatttaacattgtgtctggcctgactaaaaacacactaagcccattaaggcaatatagctaatgttttcagatgatacagtaaagcttgctgagagtgaggaatatattaaaaataaaacaaaatgaaacttttatattttaatttttatcaagataataagaatggcgaagaaaacaagcaaaaaaaaaactacactcaaagtacataatgatctgttgccaatatgaaaacatacagagcaatgctatggcaatatcacactgtgaaggtgtaacttctacaggtgaatcattttctatctgctcctcaagtgcaatcagtaagtgaagccaaaaatgtctgcttttattattttctgcttaccttttacaatgttcaattttatgtgtgacttaaatgggccaaagggcaccccaatatctcatgaaacattattctaagttattctatgagaatgttttgggatgagattaacatttaaatcagcaaactaagcaaagcagatagccctccataatggcagtggttctaatccaatcagttgaaggccttaatagagcaaaaggctgaccctcctccaagtaagagagaattttgctgctttatagccttagaaatgaaacatgagctcttcttgcctattgtcttaaacctgaaacattgccttttcctggttatataggagcttctagccttcagattcaaattggtatgttggctctgcagatgttaaacttgaatcatgtgagccaactctttataataaatctctttctatgcaaacacccgcgcgcgcgcacacacacacactattggttttctctgaagaatacaccttctaaaaataaaaataaaaaaaattttttttttgagatggagtctcactttgtggctcaggctgcagtgcagtggcacagtctcggctcactacagccgccgcccccagagttcaggtgattctcctcccaaagaagctgggactacaggcatgcaccatcacaccaggctaatttttgtatttttagtagagatgtggtttcacaatgttggtcaggctggtctcgaactcctgacctaaggcgatccacccgtcttggcctctgaaagtgctgggattacaggcatgagccaccgtgcccaacctaaaaataaattcttaataatcaatttaccaataggattatcaaacttttgctatgatgataagaagatataatcttgcatgaaagcatttaattgaatgaattaacaagcactccaaaatatgctaagattaaaccctaacattttttaaaatcatatataaaatcaaaattctggaatccttttttataaaaatcatgagtttggtaaaaactgagttatttgaaatattacttactggtttgggttttttaattttattttttaattttaattttttattattgcagtaaccatttttaccaaaatagccattatttaactaacttcttgggactcattgtatcacagcaggagttatgtctttaaactcattctttttcctaggagaactacaaatcaacttatactgagagagttttcttttgcattctgaaaggtgatactgccccactgcatgaaatacacaggatgaaataggagtatgagccatgtattctactatagcaaaatactaaaataaaaataacaatatctggcatgaactgagtacttattacattccagacatagatggtgttctatatatatataatcttctaaaacagattatcttgctgatacaattatcagccacattttacagatgagaaaactgaggcccaaagataacaactattccgagaacacattaaagactaagtagctaaacctccttcaaaccccagcctaactctaagcccacattttgtttctctcttttattaatacataataatttatatattttggggatgtatgataatgtttgttacatgcaaaaaaaagtgtaatgatcaagtcaagataaatggggtaatccaacatcttgactatttattatttttatgtacaggtatcaagtcctctagttactttgaaatatatataatattcttactagtacagtcaccctattctgctatcaaccattggaatttatctattctacctaactatacatttgtacccataaccaacctctattcatggtccctttcccccaccctcccaacttaccctgtctctggtatctattcttctattctccatgtccattagatctagtgttttagtcccagatatgagtgataacatgtggtatttgtctttctgtatctggctaattttcatttcactgaacacaatgacctccagttccatccacaaactggataaagctgttagataaaatgacttccagttgcattcacaggattctgcagttagtggataaaatgttctatcaatgtctgttaagtccatttggtctaaagtctagtttaagtctaacgtttctttatagattctctgtctagatgacctgcctaatggtgagagtgggatgttcaggcctgcacaattattttattagagtctgtctctttctttagatctagtaatatttttgctttatgaacctgcatgccccagtgtggggggggcttatgtaacaattgttatatgaattcttcactttatcattattatataatgaccatctttgtctttttttatgggttttgttttatctaagtatatctacttctgctcacttttggtttctgtttgcatggactatccttatccatccctttactttcagtctgtatgtgtctttacaagtgaagtacacttctggtagtaaacatatagtgaaatcatgttttaaattcattcagtctatatatatatatatatatatatatttttgagatggagtcttgctctatcaccaggctgcagcgcagtggcacgatctcggctcactgcaacctctgcctcctgggttcaagcgattcccctgcctcagcctcctgagcagctgggattacaagcatgtgccaccatgcctggctaattttttgtattttagtagagacagggtttcaccatgttggccaggatggtctagatctcctgacctcatgatctgcctgcctcggcctcccaaagtgctgggattacaggcgtgagccactgcgcccagccaatctatatcttttaagaatttaaatcatttacacacaggttattatggatatgaaaggtttttccccgtcaccttgttaactgttgtttagttgttttgaatattctttgttcctttcttattttctgattgattgtccttgtagtttgctgattttctgtggtgataccatttgagtctttttttcttcctcatttgttgctttaccagtgagttttatactttcaagtgttttcataatggtaactgtcacccttttgcttgcttctaggtttaggactcccttgaatatttcttgtaagataggtgtagtagtgatgaattctctcagcatttgcttgtctggaaaagactttatttatccttccttcatgaagaatcattttgctagataaggtatgcttggctggcagggtttttgtctttgagcacattaaatatatcctcccattctctgctgacctgtaaggtttctactgagaaagctgctcttagtctgatggggctcttttataggtgactaaacgcttttctcttacaatttttaggattttctatgtgtcactgactttaggcaatttcactataatgtggggtggagaaacctttttacattgcatgtgattgggggtcactaggctttctgtatctggatgtctaaatctcttgctagacttaggaagttttaatctattaatttgtttaataagtttccgaaccccttcattctctcctcaaccttcagggatactaataactcatacatttgatcactatgtggtgtccatatatcatgaacactttgttcatcctttactccttttatttttgtctaagtggattattacaaaagatgtgtcttcaagttgagagtctctcttctggttgttctagtctattgctgaagctttcgagtgtattttgtatttcataaaaggaattcatcagttccagaattgctatttgattcttatttatgattatctgtttgataaatttctcataaatatcctgaattctcattttttgtattttcagaattctcttgtatctctctgagcatttttagtttaattttacattctttttccagaattgtgtaaatttatttttgattgggatctattgctgagggattatcacattctatttcatacttcctgtgtcctaacattgatatctgcacatctggtggaacagctgcttcttcaggttttctgaatttgccttcttaggggagaactttttctgaagatgtaccaattgtgctggttgggtaggcccctttggctttgattatcggtgtgtgcagtagtgtcatcactatatgatttctccagctgtaaatggcttcagtggtatctgtgctttccctggtggcttaggttatggttatcagtagatcctatggtaatgttttgttgaagacagagatgccaggtgggctagtcttaagatcccaatgatggcagtgatgagctgactgtgcctgatcatgggctccagggcagtgtacattggtatgagggtattactgggaccaggcaggccaattcgtgggcacccaggtggcctgctcaaatactggtagtggaatcagtggattgagcagatgagagggttcttgagtcactggataacctgtgtgatgtgggtgatggtagtagtgggatgatcctctggggcccaagtgttgcacactgatgttgacactggctacagtgcacggtcaccagccagagtcccagacacacaactctcaggttcttccactctctgtgacaggagcaccacagcactgcataagggttagggggaggcacccagcccttcacacacaaactgaagatcccactgccagtgagggtgccgtcaccactcacagccctggaaagctaaccctccagttcgcctgccccagcctccaggagcagcaacagtggctgggcctacagaagcgtctggagtgagacaaagggtccctctctacatgtgagagcctgaacacagtgataactcttacggggggaagagatcatactctctgtgtgctaggccgagcacacagtttatttcagctgggggcagggtcacttctcacagcctgagacaggagtctctcaggttttagaaattacgcgctttagttttctttgtacaagaggctgtctttggtgtgctgcactgtccttactccagggattagtactccctgtgggctagagtactgaggacccttcagcacttttgggctgggtccagccagcgctgtgctgctacagccctccaaatggactctgggagacatcagtggtggctcacaggatgtggaaatatgggagctgtggtcccgaagacaggatgcagctccatgacagctatgtgctcacgatggtgctcagctgcagtcactcaagtctcaggtgtgtgagtgagccagcgtgagtaccctgtccagtctaatgccttggtgaggtctttaaatggctactcatgctagtgtcagaatttgtgaaggtagagaagctctctctggttccaaccacagtactgtgcagtggcaatgttaactgctgaggttctctcacttactctttcaccacaatatcaagcccctatgggctcccaaccaatctcagccaagtctccaatggcttccttcttctgtgccgcagatgtttcctgtgacttctctgttggattctggtgttctctcctatatattctattcaaggtatgattgtctatttgtaattttagctcttctttctggagaggatgtgtgtctgatgccttagccatttaaactgggatctctaaacccacattcctaaccactatgataaagccacctacagctactctaaaggaaaatctttccctttctattaactcttttagaacagtatgactaaaactataaattaccttaaaaatagatgtcctttattgggataataaaaacacccttgctgtcactaataaattactaaaaacaactaaaatggatacattctcaaattcttactgtctaaaaaatagtcacctagtccttgcaaggtatttgaatatgtactaaattctaaactggctcaatgttattagaagtactctctttctttttaaagctataaaatccccttttcctatgtaaatattacctatgtataattgactttcataaaatatattgctcagtaaatactaacattatattcaattattgtctggagtgagtatcagttacaaaggataaaattctttaatcctttggtaaaatacattgatgttgttgaataaaaccaaagatacactttgggaggccgaggtgggcagattgtctgaggttaggagtttgagaccagcctggccaacatggtgaaaccctgtctctactaatactacaaaaatcagctgggcatggtggtgggcgcctgcaatcccagctactcaggaggctgaggcagcaaaatatcttgaacccaggaggcagaggttgcagtgagccaagactgcaccactgcactcctgcctgggagacagaacgagacgctgtcacaaaaaaaaaaaaaaaaagaaaagaaaaaaaagaaatacatatatatatacacacatgacctgaagttctaaattattattgggctgaacaaatgcttatcttcaaataactgctgcaatttttaaaaacttattttttccttacctagtcacaacccttatagcatgccaacttaaaattattccacttaaaaactttgaaaatgtaaacaaactatagctatcaagttacccacttttatatccaactgataattttcttcatttaagtggcaacttttctggagatctctgctgatcagaaactgttccatggtacaacagatttttatgaattttaacactcccaagtccttaaaatgcctagaaatagtttaacaagatacaaaacgcttcttaataaaatttaagagctgaatgaaccagtagtttacaaaattctgccttaacctgtctaacatgaaaatacctctcatgagaattttttcggatttaggaaaaaaatgacacagaaattagatgagaaaaagagaatggaaagaaattaaaattaacactggaaagaaagccaatgatacaagtgacaaatgctttatctaaaactatggataaaacatttgaaattacaaattaaagggaaatgatatatatgtttccaatgaatttttctgcatcagtataaacattattataaggccacattttaaataaaatagccccaccttataaacacttatgaataattctaataactgaaaagtttaaattactgataaggacaatctccattctgtactgtacataaatatgtcttcatttttacacaaaagtcaccattaattctcttttgaaatctgggaggatcaagtggcattaaatttgtagattctaatataaatattattagggaaagagctccttagaaacagaaaaatgtaatatatgtatttgataactttatatttacaggatatatacatgtgtgtgtgtgtacctgagacctaaattgtacccagtacctaagaccctaaattgatttactttacaaacacacacgcgcatttatttttaagtaaatcaatttagggtctcacgtactaggatggtgagaaggtggaaaattgggtttctactggacaagagaattaaggaactggagaaaataaagttaatcttaaagaagaaggcagattaggagtgtgctgggaacagacccccaaatctggccataagctgacctcaaaaccggccataaacaaaatctctgcagcactgtgacatgttcatgatggccatgactcccatgctgaaggttgtgggtttactggaatgaaggcaaggaatacctggcccaaccagagcagaaaaccacttaaaggctttcctaaaccacaaataatggcatgagcgatctgtgccttaaggacatgtttctgctgcaggaaactagccagagcccatccctttgttttggcccatcccttttttcccgtaaggaatacttttagttaatctgtaatctatagaaacaatgtttatcactggcttgctgtcaataaatatgtgggtaaatttctgttcggggctctcagttctgaaggctgtgagtcccgatttcccactccacacgctatatttgtgcatatgtctttaattcctctagcgctgctgggttagggtctccacgactgagctggtctcggcaagtggaacccaacgttggggctcaaacccaggtcgaaaggtcgccggggcaatggttggagaacatggaactaagctggaggacacccgagtgctcttaagcaatccccgtggtgagtaaaaaggggagctcagaagcatcagggtaacaatgggacaagtgtgggctctggttagttccatcttggaaccttttcacactgatgatgaggaggaaggagagtataacaaagtaacagagcaggtttgtttgccaggtaaagctaaagtggcaaaggaggcagatgttcatccctacccttctgcaccccctccttattttgaagaaaaagagtggcctaaccctccagatctttcttttctggaggaccttgggtgaaaagtagttgccccagtgactgttcaagcagtgcctcaagcaacctctctcagttctattcaggcaggaatccagcaagctagaagagagggtgatttagaggcttggcagtttcctgttagaatacaccccccgagatcaacagggaaatattatagctacatttgagccttttccttttaaattactcaaagaatttaagcaagcgattaatcaatatggaccaggttctccttttgtaatgggactgttaaagaatgttgctgtctccagtcagatgttgccagtggggacggtaggattacttctaggtaggtctggtttaaatttaaaaggagtgcaagtacaaacaggagtcattgattcagactacaatgggcaaattcagattgttatatctacttctgttctctggaaagtagagccaggagagcgtatagcacaactcctgactgtgccatatgtggaaatgggaaaaagtgaaactaaacgaataggaggatttggaaacacaaataaacaaggcaaagcagcttattgggtgaatcaaattactgatcaatgtcctacccgtgaaataactattcagagaaagaaatttaaaggttcagtagatacaggagtggacatttcaatcatttctctacagcattggctgttcacgtagtcaattcaacccactcaatttaacatagttggagttggtaaagcccctgaagcatatcaaagtagttacattttgcattgtgaaggacccgatggacaacctgggaatattcaaccaattataacttctgtacctataaatttatggggaagagatttattacaacaatggggaacacaagttctaattccagagcaattgtacagccctcaaagtcaaagtatgttgcatgaaatggggtatgtccctggtatgggactaggacaaaatttgcaaggtttgaaggaactgcttcaagcggaaagacaaagttcccgccaaggtttaggttatcatttttgatggcagccattgttaagcctccagaacctatacctttaaaatggttaacagataagccaatttggatagaacaatggctgctaagtaaagagaaaatggaggctttagaggacttagttcctgaacaattagaaaaaggacacatagcttcaatattttccccttagaattctccagttttcataattaagaaaaaatcaggtaaatggagaatgttaactaacttaagagccattaattcagttatacaacctatgggagcattacagccaggattgccttctcctgctatgattccaaaaaactggtctttaattgtcatagatttaaaagactgtttctttactatccctttagctgagcaagactgtgaacactttgcacttacaattcctgcagtaaacaacctgcagcctgctaagcattttcattggaaagtgttgtgacaaggcatgttaaacagtccaacaatttgccagacttatgtagggcaagcaattgaacctactcgtaaaaaaatttttagtgttacattattcagtatatggatgatatactttgtgctgccccaactcgagaaatactactccaatgttatgatcacttgcaaaattcgatttcttgcactggtttaattatagctcctgacaaaattcagactactccttactcctacttggggacctcagtaactgacagtacaattgtgccacagaaagtaaccatatgtagggatcaatttaaaacactgaatgactttcaaaaattaccaggggacattaattggatatgacctgctctaggcattcctgcccatgccatgagtaatctattttctacccttagaggagatcctagtctcactagcccttggcaattaacaaaggaggctgaggcagagttacagctgattgaaaggcaagtccataaagctcaaataaatagaatagatcccaagaagactctagatttgctaatttttccgactcagcattcacctactgttgttattttgttattgtccaagaacaggacttagtagaatggctttttcttccacatgtgaattcatggactctataactccttatttggatgaaattgctactatgataggaaatgggagaacttggattgttaaattacatggatatgatcctggaaaaattattgtccctctcacgaaggcacaaatacagcaagcttttataaagagtcttacttggcaaacccatttagctgactttgtgggtattctccatagtcattttttcctaaaatgaactgtttcaatttttgaaattaactaattggattctccctaaaataactaaattcaaaccaattgaaggtgctgagaatgtttttacagatgggtccagtaatagtaaagcttcttattctggatcgaaaggtaaagtttttcagatgccctatacttcagctcaaaatgcggagcttgtagctgtaattgaggtattgactgcttttaatatgcctattaatgtgatttctgattcttcatatatggtttattctacacaattaattgaaagtgctcagttatgatttcatacagatgaacaactgatgactttatttacccaactgcaaacagcagttaggagtagaatgcaccctttttacgttactcatattacagctcatacatgtcttccaggacctttaactgaagggaatcaaatggctgattgcctagttgctactgcagtatctaatgctacacactttcacaatttaacccatgttaatgcctctggtctcaagcgcagatacagcattacctggaaagaagctaaagctattatccagtgatgcccaacttgccaaatggtgcattcctcatcttttacaggaggagttaatcctcgaggactggaatctaattctctttggcaaatggacatcacacatgttccctcgtttgggagactagcttgtgtacgtgtatgtgtggacaccttttctcactttgggctacatgccaatcaggagagtcttctgcctgtgttaaacatcaccttttgcagtgttttacagtgataggcattacagcttctattaaaacagatgatgccccaggctatactagcaaagctctagctacatttttctctatacggaatattaaacacattactggcatcccatataattctcaaggacaagccattgtagaacgaatgaatctctccctaaaacaacaattgcaaaagcacaaagggggaaacagggactatggaacaccccatatgcaacttaatctagcattattgacttcaaattttttgagcctgcctaaaggccagatgctatcagcagctgaagagcatctacagaaaccagctgcaaagacagaagcagaacaactggtttggtggagagatccgataacaaaaagttgggaaataggtaaaataataacttggggtagaggttatgcttgtctttctccaggccaaaaccagcagccaatttggataccatcaagacacctgaaaccttatcatgagccagatgccaaagaagacattctagcaggattgcgaggaccccccagttgcagccatgttgacactgatgctgaggaggaccccagctgtcacagatggtggaagaaaacctgaggaaagcggacaacctgtcacaacgagtaatttaatgatagctatgatagcggtggtcactactgccgtgagtattccttcaacaacggctgacacagagaacaattattcttattgggcatatttatcaatcttggctggcaataatgcctggatgtaatcactctatgacacatatacacatgctttctggtctcagtatttaccataataaatctgctcctataattaggcgtaccgccctcaaaaacctatctgtaaacagaattggacctggccagaaataatgaacttacttgtttgggaagattgcattacagaacaggcagaggtgctgcgcagcgattcctatggaatcattgattggtcccctaaggggatgtttaatttgaattacacctctcagtctgcgtgccatggccacactatgttcagctggtccaaacaaaacaatcagatggtagaaacagtaaaaaatacggcaagttcctattatttggaaacatggtggtatagaggcacctcaacctcagatgatatgcctgctgtaggagcttaacataaggatttgtggaaactattaatggaaagaataaaaaaacatctagaaggacactctacaaacttgtctttggatattgcaaaattaaaagaacaaatatttaaagcatcccaggcacacctgaccttaatgctaggaactggagtgcttgaaggagctgcagacagattagcagctagtaacccattaaaaaggataaaaacacttggaagctgggtgatttcaatgatgattgtgcttttaatctgtgttatttgtctttgtatagtctgcagatgcagatcccgactcctgcgagaagtagctcaccgtgacaaagctgcctttgtttttatcactttgtgaaacaaaaaagggggacatgttgggaacaggcccccccccaaatcttgccataagctggccccaaaactggccataaacaaaatctctgcaacactgtgacatgttcatgatggccatgatgcccatgctgaaggttgtgggtttaccagaatgagggcaaggaatacctggcccacccagggcagaaaaccacttaaaggcgttcttaaaccacaaataatggcatgagcaatctgtgccttaaggacatgtttctgctgcaggaaactagccagagcccatccctttgtttcggcccatcccttttttcccgtaaggaatacttttaatctataatctatagaaacaatgtttatcgctggcttgaggccaataaatatgtgggtaaatctctgttcggggctctcagttctgaaggctgtgagtcccctgatttcccactccacacgctatatttgtgtgtgtgtctttaattcctctagagctgctgggttagggtctccacgatcaagctggtctcagcaagagtgagaggtcatcagtgagaaaagaggtttgtggccaagaaagtacatgaccaatgaaagagagttaacagaaatggaagggggaaaaagaaaggtaactagaataaaaactactagtttaaagagaatggaatataattaggaaaaagcaaagtaaatttgtccagaagaataaaacaaagcataggatcctttgaggaaagaacacaaggcaagaaagcaaattgctagtcatgaaggactacacaaagtggttatgttttactctatccaataaaacatgattaataagaaaccaatcaattacattattccaacagtattctaaataacattccagacagttccacttgtggaaactacagagcaaatttacttgacttggtcttctgctgtaaacaaccagaaaactagataaaatacatgaaataactggcctcacacaacaaacaaaaaccatgcataacagcaatgactgaaagaagcaaaataaagaacaccctatgcttatccagcctttcgtgtgtaggtactttctaaacagaataaggacagggatagaacatagaagccaaagttcaagagacagagacaacaacttgagaggtagaggcaactgaagtgcctaagtgtaccgaagagatagtatttcaccaagaaagaactttagaagtctccactgatgtccccttgaggctttggctaaatactaagttgaaaatgcataaagacaaaattcacaacacaagacacaaccataggggagcttgaagatgaacattctcagagctcatatcaagctgggagacacttaagttcacaccagtcagagtgtagacatcactgaatacaatagtggcattcaatagtgactcttggaaagcagtagactataatggccctagagtaaaaagtattccatactaattctaagaaaattttaaaaactcaacaagatcaagtgtatctataactaatctataattaaattgcctggaaaaacaaaattcaccattcttgaaggaagataacaaaatctagaaagtcaaaaacatgagtcacaatgactcaccaccaaataatttattagacatgcacaaaagcaggaaaataaggcccataaacagaagaaaagtcaatagaaacagatgcagaaatggcatagataacaaaacttggcaggaaaagcttttaaaagagctattataaggctgggcgtggtggctcacgcctgtaatcccaacactttgggaggccgaggagtgtggattacttgaggtcaggatttaggaccagcctaaccaacatggtgaaaccctgtctctactaaaaatacaaaaattagctgggcatggtggtgtgcacctgtaatcccagctagtcgggaggctgcggtgggaggattgcttgagactgggaggcagaggttgcaatgagttgagatagatcgtgccactgcactccagcctgggaaacagagcgagactccttctcaaaaaaaaaaaaaaaaaaaaaaagctactatgtattatatacaagctcaagaatttaaaatgagcagacaaaaaaatctaacaatgaaaaagaatcttaagaaaacttctatagcataaaaaatatatacaaagtgaaaaaactcactgcacagcttaacaaagtcagccaatgaaaagaaataataaaaatttgaatgaaaatcaaatagaaaacagaccaaaaacacagaaaaattactcaaacctaaacctgatctttttaaaagattgataaaatcaataaatcactagttaaactaactgagaatgagaaaaagaacacaaattatgaatctcattaatacaagagattgtaaaagaagaggcataactatatattctacaaacactgaaatgataatagggtaatattttgagttactttatgccaataaattcaacaactgagatgagatggacaaactccttgaaagacactaccaaaaatggtataaaactttgaaaatctgaatagccctatatgtattaaagatactaaactactaagtaaaaattttccaataaatatcattctgaattacaaagagcagttctccttctttgcactaatactgttgcctgtatttcccctgtatcagattacaatatacccgatctgttttatatttttaatttactatttgttcatttaattttatttgagacaaggtctcactctgtcacccaggctggagtgcagtggtgtgatcatggctcactgcagcctcaacatctgggctcaagtcatcctcccacatctgccctcctgggtagctgggaagacaggcatgtgccaccacacctggctaatttttttctattttttgtagagacagggtctcactatgttgcccaggctggtctcaaactcctgggctcaagtgatccttggcctcccaaagtgctgggattacaggcatgagccatggcatctggctgttttgcttttggctgattaccatttagatcagagatggcacggcctccgtaattcacctataggagccattacaaccaatcacaaatctttttcctactaaagcctagatacgctcccacagttcttctcaaacatttcaagcaaccaaggggagctgcatataaagataaaacctattagccacaccttatttatatccttaataataatttcattattcatctcatttttaaatcattatttttcccaaatagctttaggaaaattttccaatcttatgctctccttcattatttaaatcttacacaaaacagtactcttgtataagtgaacattttaaacaaacaaccccactaccttttcctgaaaactggtgctgtccacacaatactaaattcttcctggttaataccttctacactaattttacccaattttcttgcctatcatctctacctgtttaacactgtttagagtttaattgcatgtaattttctaactcattacctgttgctattacacctcagtaaacttctatctcttccacacccaacattctctttcacattaacctaattcctacttccctatcttctaaaatacacatgttcattcccttctccattccaatatttcagcacttttcattctgagggttaaatttcttgagaataaagttttctatgtgcttataatatagatgtcttataaatctatactaaataaatgaaaaatcttattatttgagctgcaatttgacataataaatacaaccagttactaaatatctatgaatgcacctaaaattcccatttcattatttacaaactcttccacagtaaaactagctttaccttcgagcattaaaagattttgtaaaaatcattttttaagattggtaatgctttgattggtaagatcataaatattttctacaagtttttcattgcaaatgtgtagtatttcagatatttcacatgttttttcaagaatatctattttggttaatctgggaatttaagtccctaaataataccattaccaaggtaatgtgtattctgagttccaaacaattaaaatacaagtgaacttttctttgtgtggtaaaatattcataacataaaatttactattgtaaccattcttaaggttaaaattcagtgacattaagtacattcacattattgagcaaacatcaccactatccataaccagaaattttctatcataccaagctgaaactccacacctattaatcaaaagctccaaattccccctcctctagcgcctggtaatctactttctgtcactatgaatttgaccattctaggtacctcatataagtggaatcgcataacatttgtccttttaggtctgctttatttcacttagcctaatgttttctaaaattatccatgacgcaagaagttcaaaatttaattcctttgtaaaactaaataatattccatttcatgtaggtaccacatttttttatccattcatccactgatggacatgttggttgtttccaccttttggatattgtgaataatgctgctacaaacactggtgtaccaatatccatttgatactctgctttcaattcttttgggtatataaccagaaatacaatagctggatcatgtggtaattctgtttaatttttgaagaaccactataccatttttcacagcagttcaacaattttaaattcctaccagccatgcagaagtgttctaatttgtccatatccttgccaacactgtttttttaataaatagcctttctaatgggtatgaaatggtaactcattgtggttttgatttgcatttgtctaaggactggtaatatagagcatattttcatattctaattggccacctgtatattttctttggagaatgtttattcaacatttttgcccattttttaattgggttgtttgggagtttttctgttgagttttgggagttctttatgtattctggatattaaccccttatcagacatatgatttagaaatattttcccattctgtggatttccttttcactctcttgacagcgtcctttgatgcacaaaacttttaaattttaatgatgtctaattttttatttttctttcgttacctgtgtttttagtataatatccaagaaatcactgccaaattcaatgtcttgaagcttcttcactatgtttcctttaagagttttacagattgagctcttacattcaggtcttttatcaacacaggtgaacttttaaccatcatcgtaacaggaagtagagtgcaactttgcactaagttaaaattatcagtcccatggtttgttttctccaaattatgaaaagcatttgctcttaagaatcaatatttaactcctactagcatgtaaaaaatagaaagtaatgcagattcaaaataggaaaataagacgctattacttcttacaaagtatgttctctgaccataaataacctagaaatcaacaaaaggaaggtacctgtgaaatcccccaagtaatcagaaattgtaaaacacgtatctaagcaattcacgggtcaaggcagatgtcttaaggggatttacacatatttttaactaaatgaaaatgtaaatacaacatatcaaaatttgtaagatacacctaatgcagtgctaagaggaaaacttacagcattaattacacatattagaaaagaaggtcttaagtcaataaccaaaccttccctcttaagaaactaaaaagataagaagtaatcctagagtaagcagaaggaaagatataattgagacagaaatcaatgatattgaaaacagagtaaaatcaataaaagtagaaactttaaaattgataattttccagccagtccaagcacaaagtacaagaagagctatcccaatggatcccacagatgctaaaaggataataaaggaatactataagcaaatctctgataataacgttgacgaattaaaagaaattgatgatttccttgaaacatacaaactaccaaaattcactgaagtagaaagagacaactggaatagccctatatttttcaggaaagagttgagcagcccttctgctatcttttggggagcctgactgcagagctggccttcagctggcatgtaaaaacttggcctttggggtgttcccatgtaacatggttattttgcctgttttgggcacaaaaccctgacataccagcttaatctaggtcttttgtagaaacactgtgatttattataaagacctgttctctttcttggagtcaagtattttactagttatggctagtcatgcaggtaccatgtgcctacatgaccaacccttaataaaaaaactcttaagtcttaagggggctttctagatagaaacaatgcacatgcattactacaattcactgctggaagaagtgtgttctttgtgcctaccactctcaatagggagaactttggaagcttaaatctagatgcctccagactctactggattctttttccattttttttttttttgtagacatagaaacccaattctaactttcatacaaaaaaggtaagaaaacaagaactagagccaaaaatgttgaaaaagaagaacaaaaagaattcactctaagacattttctgacttattacaaagctacagtcatcaagacagtgtggtaatggagaaatgttagactcaaaaatcagtggaacagaatagaaggtgcagaaataaacccaaagaaatatagtcaattgactgttcacaaggatgcaaagtaattcattggagaaatgacagacttacttgtcaacaaatagtgctagaataacaggacacccatatgcagaaaaaatgaatattgacccatactttacaacttatacaaatgtaattcaaaatgaatcacagacttaaatataaaacagaaaaaaacctatacaaaaaaactacgaatcacttagagaaaaaactgaagaaaatctttgtgacatttgtttatgtacagagttcctagatataataccaaaaccatgatatataaaagaaaaaatgaccaattgaatttcataaaaattaaaagcttttgctctgccaaagatgctgttggaaaaatgaaaagctacatatttccatgggagaaaatatttcaaattacatatgagacaaaggacttctaaaggactggtatccagaatgtataaaaagctctccaaataaaaaaaataagaaaaattatccagtaaataaaaaaggaaaatgctgagcagatacttcaccaaggaaggtttacagatagcaaataagccatcaacatcattagtcactaggaaatgcaaaagaaaatcatagtatgacacatcttcacacctattagaatggctaaatcaaaaaaagagaaaaaactggcaatgcgaagtgccaaagaggatgtggaagaattagaactctcatacattggtcaggcgtggctcttgcctgtaatcccagcactttgggaggccaaggtggatagatcacgaggtcaggagatcgagaccaccctggtcaacatggtgaaacccagtctctactaaaatacaaaagattagctgggcatggtggagcgcacctgtagtcccagctacttgggaggctgaggcaggggaatcacttgaacccaagaggcggaggttgcagtgagctgaaatcacgccactgcactccagcctggtgacagagcaagactccatctcaaaaaaaaaaaaaaagaactctcatacattactgatggcaatgcgaaatacaaaggacactctggaaaaaaatttggcagtttctaacaaaattaagtatatacgtaccatgcaatctgggaattctactcccaggaatttaccacttagaaaccacgtgatatcgtttctaaacttttttagcaacaaaaaaaggagttgaagaatagcagttattctttcccagatataagaatatttcatttaaatagtttcctgactaatattcatatgttaatcttccctcattttctgatttactatttcattcagagatttacttagcattattcttttattttgcttatagtttctctgtattgcattttattgtctatcatgtagataaaactgtaagcaaacattacatgctctaacttaagaaggaaatagtatatctagtcaaatgacatttaactcttctctgtactaaaaaggcaaaattactagtctttttattttagtaaaaattctaaaggaatacaaacaacagacacacaaaaaaaaaaagggaaaggaagacagcacacaaaaaatgttaatagcattttggaagctagaaagcacacccgatgaaatagaaacctaagcccagggggattaactcagcaacaatcaagaagctgtatgccacagaactctgacaaagttcgggacctgaaggcagggatccacggtggcactgacaaccaaaacacattgtaaattgttaaaggaaacagaactccaaatcccttttccaacctcactcaagccatgccactattccttcaccactcctgcaaaacactgaagctttcatctttggggaagttacaccagagaaacgctgtgtttgtgaacaacacatctgtgggggggtgggggccaaggggaaagggttgatgatatatcatactgaaaagaaaaatctacataccaatttatgagaaaacaccctcaaaccttataccagatcccttctgctcagctgcaaaagtatttacaaccaggcttataaaccctagacaaaagactaaaaggttcctgtttggagaaatgttcagtctaagagaaacaaaatctacagttaattctatcactgaggaatcctgcacaaaaaaacagccagatctctacctggtcatcctacaataaaggtctacctcaaatacattttgatgcctcggtcttaagtatgaacaggcatcaaaaatcaccaaagaataaggaaaagcctctgacatgaaagatggtgagcaaaacaaaaaggataaaaaggaaatcagaagcagcagaaaaataaagggagtaaaagaaaacttcatgcaatcatgacaaatatctaaggcagacagaatcttacatctatgaaaagaccccagaggcttttctttcaatgaaaaaaaaatgtaaaagaaacattaaggcaataaaaaaataaaacaataaaaaataaaacaaagacaataaaaaaagctcttacaaattaaaattttgactagaagaataaaaaactgttaaaattttccagataaagttgagaataatctcctagaaagtaaaacaaaaaagtaacaaatggaaaacaggatagaaaagaaagctgaaggaccacttcaagaaaaccaatagctgaataacagcaattccggaaagctgaaagatggaaaaacagaggaaacaggagaaaaaaattatcaaagaaataattcaaaaaaatttccaagaactgaaagataactatatctagcaaattgatggaaaaaacacccatctcacagcacagtatcacaaaatttcagaacacaacagaaaaaaagatcctaaaagcatcaagtaaggggaaaaaagggtttatagaaaagctcatggatcagaagggcataagactgcctttttttttttcttttgagacagagtcttgctcagtcacccaggctggaatacagtagtgctatcatagttcactgcagctttgaactcctgggctcaagcaagtagctgggactacacatgagtactaccacaccagctatttttattttttcatttttagtagagacagggttctcgctaagttgctcaggctggtctcaaactcctgggcccaagcaatcctccttcctcagcctcccagagtgctgggattacaggtgttagccaccgttcccagccaggacttctcaacagcaacaatacgagctagaaaagagcagaacaaagacttcaaatttttaagggaaaatgatttgcaatataaaacctattgtcaaataatatgaagtttatatacaaatgatcagagatgtatgtgtatgtatgtgttcccaatcattattctcggctttagaatttatgttatgtatattctttcaacaatagttaacatctaaattatgtttctctaaaaccaattagtctcttctttaaacttattctaaatgactaagaagagaagctgcacacacacacacacacacacacacacacacacacacagtgttcgatgccagcagaaagccaaagtaagactgaaaatttgctgtaattcccaggcacaggtgagtataaagaaatttatagctgtcaatttccatctgaacagcaatctagtcacagaattcttaagtcctaataaagagtaaagtaaaaattggaaaatttaaatgaaaagataggtataacagaaaaaaagaaggtattttcaagtagaaaaagacatgcttaaataaaacacctctctgatatctacagaactgaataatttctcaaaaaaattccagtgctagtttcattctaccataaacaaaggccagtgctagtttcattttaccataaacgaaaaccagagtaattgagtgaattactccttgcctgatgataaatgtcagtatttcttccactaggctagatggtctccaaaggtttagatatgaactgttcatagtataaaagaacagggtcccaagataagaaaggtcatcgataagaaaaaaagaaaaaaaacattatctcaaatattcaatttcaataaatcatgtttaaataaagaaaaggtcttataaatggggtgagggagtggaaataagaaaataaccagccgaccagaagatgaagatatggtcaactttagctccatgttccaaattaaaacaagaatggatgagaaaatactgcaaatgtttattgattctcaactatgttctacatataatattatagacatctcatttagctctcatcaacaacaaacatattagtctcatttgtagaaagagaactgtgctgaaaatggttaagcagtttgtccaaggtcacagttcatgagagagaggtaaactgacttaattctccagctgaagtcactctaatccaaaaatgagtaatgcacaatttaaaaatgaaatgttatacttttgcttcaatatgtttctgatgctgtgaaaccaatattatttctattaatgaaataatatgatgaaacaacacagattcagggaaaatagatatttgccaattgtctgtatgctgccctttagctcagttccattgaataattcactcgtttcctatgatgtaacaagcactgttctggcgctgcagttctgtccaatagaatttcacatccaggaatggcacagtagacacctaaacatgtaaatttgaaagggttaagagttctaaggtaaaatacaaacaggcacctgaaaaaaaaaaaggatgctgtcagaaaacatctatcagaagaggtgattcatgtgcaggttcttgaagtttattcattcattaaaagaatattttctacaagcctgttatatgccagtcatatttagtggtagagcaacaagacaaatgttagtgagtagggtcagggctgtgatgaataaaagaaaattagaaataatgtatcagaacacaagaaaaaacccaagaaaaaagcattcctatggattattcctgggaggactggattcaaaaactaacaagcattaatggagactaaaaatacaatatgtgagcctaaccatcttcagtgagttattcatagagggctatgagaggatgacttaatactaaccttaccaaaaagtagttacctagcatgacatcgaagctagaaaaaaaacaaaaaaaagactcatgtgtgacatgacatagatttttaaactcctgaataaaaataagtactataaacatataagtttattatttcaaataataaactaaaaatttcttataaaaaacaaagaattaaagaatttctctcaatatacaaagatttcttataactcagtagggaaatacaaatatctcaacacttttacatgggtaaagaatagcagataatttacaaagaattagtctgcctgaagtaagggcagagagctaggcatcaaaaacctatttttgtagacaacaatgatctgataactatctaattatcaagcactactgggcattttgaagtgccctccgaagaaaacagtgtaactgagcacaatttttaaattgtaattgatccacttctccatttaccccattccatctctagctcagaatcaaaacaaattataagctgggcccagtggctcatggctgtaatccaagaactttgggaggctgaagtgggaggatcacttgatcccagtagctcgagaccagcctgagcaacctaagcagaaccttgtctctacataaaacttaaaaaatcaactaagcgtggtcacacgtgcctagagtcctagctacttgagaggctggagcaggagaatcacttgagtccaaaagcttcaggttacagtgagctatgactgtgctactacacccgaggcaacagaccaagaccctgtctctaaaataaataaataaaatgttaagtactggaggaaaaaatacacacgtacacatatacgcatatatatatatatatatatatatacacacacacagtacatatatagaaccaaaagttatgtggaagcaccagaacaaaaatacatacatatatacacacgtacacatgcacagacacacacacattcatatctatacctgtatcattactgatatgtgaagcaataggcaccgaacaacaaacaaattcttttgaaatgtacctcatatgtttatattttatatctttaaatgagtattactacatttataatcagcaatgggacccactctatttggcaactgggataaaagtctggggcagatagttactagcattttagagatatttctactttaatcagaattgaaataggaacccaagttgtattaaaccaacaaagggagacttcgaccatgaaacactgacaaacacaggatagaaacagcagaaattagtaaactttagaggaggcacacaatttaaaagccatttccttttctcttgtactaatacatgattaaccacctactattagcaagctcaaatctgtgctcagcaatttaatacaaaggacactaaaatttaaaacagtctatgtcctcaaagaagtgttaatcagtaatgagataaaaactaaaactaaacacacacacacattagtatacagaaaggtcaaagattggcaaagattctaagtgcagaagttcagaaaaagtgacagttttattgttctgataaggaataaataaaattacagaagagagctgtagtatcaggtaaaatgccttccattgcaagaaacagaaaacgctgaatcacatgccttatttttatcacataagtaatcccaaagcagagcggaccaaggcctttccaactctaaaaaattccttcctctgctccccattatccaagtttcacttacccatggtttaagttacctacagtcaactgcagtctcaaaacattaaacagaaaattccagaaataaacaattcataagttttcaattgtgtgccattcggagcagcataatgaaatctcatgccaacctgctgcattcccctctggaatgaattctccatttgtccagcagatctacactatataggctatctacccattaatcactcagcagctatatagtttatcagatcaatttgctgtactgcaccacttgtgggcaaataatccttatattacttaataacggccccaaagcataagagtagtgatgctggcatattgctatgattgtactattttattagttgctgctaatctcatactatgcctaattaattaaactttatcaaaggtatatctgtatgggaaaaaacactatatatatagagagagagagtttggtagtatttgagatttcaggcatgcactaagggtcttggaatatattccccggataatgggggactatgatattgtcttctttctgactagctcctctaagggctataattaatttttaccatatttatcattatttaagtgcttgctctgcaccaagtattattcaaagaactttatgttcattaatttatttcattcttaacaacaacctataataggtttttttttttttttttttcagtcaggttctcgctctctctcacccaggctggaatgcggtggcaaaatcatagctcaatgaagctttgaattcctgtactcaagcactcctgccacctcagcttcccaagtacctgggactataggcaggcatcaccatgcccagcaatgtttttttaatttttgtagaaatggggtctcactatgttgccccagttagtcttgaactcctggcctcaggtgatcctcccgcatcaccctcccaaagtggttggactaaaagcatgacccatcaaacccagactaggtagatactattattggcaccatgtttcaacagctttattgagacataattcacaaaccataaattcactcattcaatggcttttaatatattcgcagatatgtgcaactatcaccacagtcaatttgaggacatttttatcacacagaaaaaataaaactagtggccgggcatggtggctcatgcctataatcccagcactttgggaggccgaggcgggaagatcacgaggtcaggagatcgagaccatcctggctaacacggtgaaaccccgtctctactaaagatacaaaaaattaaccgggcgtggttgcgggtgcctgtagttccagctactcaggaggctgaggcaagagaatggtgtgaacccgggaggcggggcttccagtgagccgagtttgcaccactgcactccagcctgggcgacagtgcaagactctgtctcaaaaaataaataaataaaaataaaactagtatcctttagctgtcattctgtcatggtctgttcagcctgctatagcaaaatgccatagacagtaatttataaacaacagaaatttatttctcaccattctggagactgggaagtcctaaaccaagacaccagtacattcattgatctggtgagggcctattccccatgaatgatgatttctctgtttcctcacatggaggaaggggtaaaggctccctcaagcctcttttataagggtattaatctcatcgatgagggcagagccctcattacctaatcacctcctaaaagccccatctcttcataccacaacaggaatgagatttcaacatgaattctggaaggacacaaacatcctgactacagcactctccaccccccaccctccctccactagtcttcctgaacctccaccaccaccactctaaggaaccacaaatctgctttctgttggtataaatttcccaattatagacttttatagtagtaaaataatatagtgactggcttttttcatttaccatagtgttttcaagcttcattcatgttttggcatatgtcagtacttccgtcctttttgtgcctgaataataatctgttatgtggatataccacattttgcttatccactcacgcactgatgaacatttgggatgtttcaaccttttggctattatgaataatgttgctataaacattcaagtacaagtttctgtgctgacatatgtcttcagttttcttgagtgcatacccagatgtagaattgctaggtcatgtcgtaattcgacgtttaatggtttgaggaactactagtttgtttcccaaagcagctgtaccattttacattcttactagcagtgtatgagggttccaatttttccacatcctcaccaacacttgttgctatctgactttttgatcctatcctagcgagtgtgaagtggtatctcattaaggttttgatttgcacttccctaatgattaatgactataatggctttttccaaacgactaatgttccatttgaatatgagccccatttttaccataagaaaaactaaggtacagagatattaaataaattatccaaggtcacaaacctactaagggaaatgctgagattttcacccaggcaccctggctccatgcccagaattttactatactccagcagcatttctaggcatttcattcaatgcaagaaggatagacatttccagagagtctgttttatcagtgagaaaacattctcagaagccattcaaactttttaaatgtcatacatagactaggtttgggtcacatgacccttcttaaaccaattactgataagaagaatacagtcatcgttgtttcagtctgttttgtgctactataacagattaccacagactgggtaatttataataaaaatttattgtctcacagttctggaagctaggaagtccaagatctggtgagggccttcttgctgcggcatcccataggtggaaggtgaaagggcaagagagaacaagagggagccaaactcacccttttataatgtcacagtcctacccatgagtgtgaagccctgatggcctcatcacctcttaacctttttcccatgtgacctgagaatactcactggaggcgattgtggctgcagcatttaccctgagatgactttgccacaaaatacctcatttttattatttttgcattggtctaatatattgactttggaaacaaaaaacatcattctatttacagcattctgtttttaatagtgatatttccatttacgaaacataataattctcgatcacggaaaacctcaaatcccagaaaacgtagcattcctaggcatgatgttaacatcgttcttgaataattgttagccaaagattcatttattgaatccaatttttctgaaatagatgattctgacgaatcagacaattctgatattagttctgtttagacacaactccaagaagagtttttatattttattttcacattgaaaatcagattttcttcagcctcaaagaacatgtttatgtaaaattaaatgagcgttgtcagcaaactgcacttttctaaatgggaaaagggttaaaagtccattttcttcattacaatggcaattaaatttcaacatgagttttaaaggggaaaaacattcaaaccatagcaaccataattggctgagattattcaagatttccaagcaaaatcagggctcttcgagaaaggtaaatcttgatcagtcaaatcaatagtatctgcaacaggtataaacaaacaaaactttgttttcactttttacaccatctcagaaataagaaaagttaccagatttaaagagttatcattcagcttccattgcgctagtgttatttgcataagtatgagtaaatggataattacaagtcagtcagtaaaagacttcacaacaaaggaagcaaccatttcaaaaaagcaaacaaacaaaaatttgcactaggttgaaatctgtctatggaaaactaagccttcactataggagcaaagcattaagtaaaaaaatttatttgcacgtttcctaatctttgaaaacttgagttatgtggaatttaaagctgaaaaacagcaattaatcattaataaaaaacatgattttaagttacaaggcttcaaagtatcccttccaataaaatgtcacttatataacaaaaatttttgttcattttaaagttttttgaggcttagataagcttgtcttaaaaatgtaaagtttaatttaaaataatttcaagtactatgttactctaacaactgtactaccaaccagatttcatcaatcatattttaaccatagtattagttgataatagacaaattttttcggtactttttataattttatacttgtaaattagtgtgtatgctccaaaaatgatgcagtacactttagcatttgcttgttgggaagagatgagaaaataagatgcgtttatcagatcttccaattgcgcaccagaaatactttcaaagtacctatgttgtaatttcatttttaaaaaattcttttcaattgggggggagggtgaataagtaattacaaagaatggctgcctttagatagaggtttatcatgtaattataataatgatcatttaaaaggatccaaaatgtctccactagtttaaagggctaggcagagttatttttaaaatcaaacgtatgtgctttttctgtttatgtctttggaaagaacattctgtataatgaaaaacatgaccaaatttttcacagtacatcactataaaaccctgtaattgacttttggggttggtttactctatatctatttttgacctcgtagaaaacagcaatgatgtggtgaaaggcccaaaatttaagtctcattgcaggataagactccatcctgattagtatagaagtatcatatttgtgctgggaaatgtgcccattctagtagagaaaactttagtgcataggaaccacctcttttctaatcaagccatgtaaaaactagtaactctggtgtctagtctgggccttggatggaatgtggatgttgtttacaccgatcccctccattaaaggcagcataatgttggtcttcaaaactgatgttggaaatgacaggttcattgcagttaatctgatggaaagtaacaatgtatgtcacaggtaaattataaattaacctttaaacatataaattatcattagatagttctttttctcttgtgttaacacagattaaataaagaacttaatctccttctaaaagctttgaattccgttactaaggaacaaactaatatgttattcctaacaaaaagcactgttcttcatcgaagtctaaaatacctctgaatgggtactcctgctttcaccagtaaaatttacatactaccaagtaaaataaacttatgttacatggtataaaaatcagccctgtaacacctaccacagatttatctcctgtgagttgactcaatcattccttcttttcagtaaataaactacattctacgcagggaactgcaggaaagtttttcagaggccaagtcaaagaatatgtttcacatggaaacttccaaattgacagcctgcccatttttggtaggtattaaagggtcctcagcactttatgaattagttgtggtttacctaaataatcatggccaaagctgccaccgtcactgcattcaatttattcctatcaaaaaaaatcaatgtacctttaaaaaaattaacacattttctaaaattcaggctaaataacagctttctagcagcattgctgattgaatgataatcataataaatcatttttaaaacaagtatattaaaattagtccatttttattagtctctcataacatagattatcttttaatctctacattttaacaagtaaaataatgaattaacattaactacacaagattatttaacagcttccaccaacttcttgaggaacagttatacaaagatgtttgaagaatatcctctttatgaaaaataaaaagctcctgaaaatccttacacgaattgcctatataaaagatcatctctgaacaatgaaggaacttcttaccaagctaacaagataggcaaataaaataaggtaaacaagtatgtgacagcctgagctatattagaagtcaccaagacgaaaatcactgaaagacttttgacccagctgcgtcaggtgtcctggtccaattccctgcaataaattcctcatctaaacagatgaaactgcccacagtatactacttgcacaccaccagataggccagctgatgtttataactgaaaataaagccaagaattagaagtatattttaaaataatttttttaaaaccctaccaatcaaaaccaatcaaaatttgccctggaacaggcaaattcacagccaaatcctactagacatacaaagaagagctagtaccaatcctagtgaaattattccaaaaaaaccaaaaatcaagtgggaactcctccttcaatcattctgtgactccagcatcattctgataccaaaacctgccagagacacaacaaaaaaagaaaacttcagatcaatatccctgatgaacagagatgcacaaattgtcaacaaaataccagcaaactgaatccagaggcacatcaaaaagctaactgacaatgataaagtagcctttattcttgtgatgcaaggttgggtcaacatacgcaaatcgataaatgtgattcaccacacaaaaagaattaacaaaatcagaaaaaaaaaacacatgatcatctccatagatgtagaaaaggctgtcaataaaattcaacatcccttcatgttaaaaactctcaccaatggcatcaaaggaacatacctcaaatagtaagaatcatctatggcaaacccatagccatcatcatactggacaggcaaaagctggaagcattctccttgagaactggaagaagacaaagatgccaccactctcaccacatctagtcaacatagtactgaaagtcctagccagagcaatcaaggaaagagaagaaacaaaaggcattcaaataaaaacaaaggaagtcaacctatctctcttcaaaaatgatatcactctatacctagaaaatctcagattctgctaaaaggctcctagaactggtaaacagggtcagtaaagtttcagaatacaaaatcaacataaaaaatcagaagcatttctatataccaataatgcccaagctgaaagccaaataaaaaatgcaatcccacctacaatacccacaaatagcatcaaatacccaggaatacagcaaaccaaggaggtaaaagatctctacaagaattacaaaacactgctgaaagaaatcagcgatgacataaacaaatggaaatatagtccatgcttgtggatagcaagaatcaatattgttaaaatggccatactgcacaaggcaatttacagattcaatgctattcctatcaaaccaccaatctcactcttcacagaattttttaaactattctaaaattcttatggaaccaaaaaagagcctagacagccaaagcaattctaagcaaaaagaaaagcatattactggcacaaaaacagatacacagaccaacagaacagaatagagaacccagaaataaacccaagcacctacaaccacctgatcttcaacaaagtcaacaataacaagtaatggggaaaggactccccattcaatgaacagtatatgataactggcttaccatatgcagaagattgaacctggaccccttcctttcaccacatacaaaaatcaactcaagatggattaaagacttagatgtaagacctaaaactacaaaaactctagaagaaaacctagcgtacctatctggacatcaaccttagcacagtttatggccaagtcccctaaagcaattgcaacagaaacaaaaattgacaagtggaatctaattaaacttctgcacagcagaagaaattatctgtagagcaaacaatgtctcctacaaaatgggagaaaatattggcaaactatgcatccgacaaaggtctaatatacagaatctaggaggaacttaatatgtgaaatacaaccccattaaaaagtgggcaaaagacatgaacaggagcttcttaaaagacaacatacaaacagccaacaaatatatgagaaaatgctcaacatcactaattattagataaatgtaaatcaaaaccacaataagataccatctcacaacagtcagaatcgttgttattaaaaagtcaaaaaataatagatgtaggtgaggttgcagaaaaaaagaaagcttacacactgctggtgggaatgtaagttcagccactgtggaaagcagtttggagatttctcgaagaagttaaaacagaaccaccatttgacccagcaatcccactactggatatatacccaagggaaaataaatcattccaccagatagacactggcacacatatgttcagcacagcagggttcataactgcaaagacatggaatcaacctagatgcccatcaagagtggcctggataaagaaaatgtggtacatacacaccatggaataccacacagcaataaaaagaacgaattatgtcctttgcagaaatacggatgcagctgaaggccattgttctaagcaaattaacaaaggaacagtgaaccaaataccatatgttctcatctaaaagtgggagctaaacattaggcagacatggatataaagatggcaacaacagaaggtggaaacttctagagggtgggtgagggagttgggtatgggttgaaaaactacatattgagtactacgtttactacctgggtgatgagataattcgtacaccaaacctcagtaacatgcaatttacccacgtaacaaacctgaacatgcacccctgaatctaaaataaaattggaggaaaaaggctatcatttgaaaagctacagaaatgaacaaatgtaaaaaacggacttgctgcatgatgataaagggaatgccattcttgtatccctacagtctcaaatccaacaaaagaaacaaacatagtcccttctcaccccccaaaaatgtgctttttcttgccataaaatcgtaaccatcacacaaaggcaccttggtgatttcataacattgtatattatagtccattttctattaaaaataccactaaagtaaatttttaggaaaattatgttacctgatcagtaacttgtacttaaacatcgattatgtacatcatttgaataccttccagaggatcgattctccaacataaaattgaaagaaaaccagatccaattaaataagcaaattcaatttacagaaaaaaattacttgtttcattaagtcaaacattgtggtggtacaccagagaagtagaaatctattagctatgaattaattaatgaaaaagaaatgaaaacacttattttttaaaaaatttacataagcattataaaacagaaatgacaaagtgcatttaaaaaactgattggatcttgaaatctgtattttttagaaacacccagaataagatttcagaagaagtatttttatatacatttttaattgttgtggtgtaaaaattgttgtgggtaaaagttcaccagccagtcatttttctttcattttctaacttcctcaagaaaactggctgggcacggtggctcacgcctgtaatcctagcactttgagaggctgaggcaggtggatcacttgagatcaggagttcaagaccagcctggccaacatggtgaaacaatgtctctacttagagtacaaaaattagccaggcatggtggtgcacacctgtagtcattaagatttaatgaacattggttataaggttcctgttgtttaacttaataaacaaagcacaacagttcatcagctataccaaccctaaactgtctagccctgcacttcttgtgaggcaggataaaataaataaaacatcacttacttaagtcactatttgttatgttttcattacaacaagtctaatatgagcctaactcttataatatttgctaccaagaaaggaagggagggaaagaaagagaaaagaaagaagggaggaaggaaggagaggaaagagacaaatgaagacaagtagggagacgagcaaaatttagaaaacatgagaactagtttaaagaaaagagaaactatttttaagtgagagaaggcaaaacatatccgaacaaatgtaaaaaggataaacatctattaaaggaaaaaaatcactttaatgagattaatttgaactgaaatttcccctatgaagtattggagtgagaagacaacagctctagttacaatgaattttccttgatatacacacaattatttcaaatccagtgcatttcctcaagaaaatcttaattattcagattaaagcaatatttttggaaatgaatgaaatacatacaatagaaaagacctctcaataggacacctaatattatcagtgtattttaaatgatcctcaattttaataaaaccgtactaaacataattgaaaatttttcttaggtaagaccttatgtcctttccacatactttcaattctactttgttatatcacaaaagaaaccttgtatatttcattcttagtttttctaagttgttgacagatggagaatgtttaactgaactttgtcctgtcaaacagaatcaactactaattgttttggctaatgatatttagcatgagtctagtccggctaggtcttaaataactttcaaaagttttttaaccttcgtcacttcctgggatatacatcttagcaatcacaaccttgagctaagccaagaaaagactgcacattgagcaacactggtgatatatttaaatacattaaggttaaaatctagtacttttgaaaaatccttaaatatataaggcacaccaaagtagggtttttacttttacctttagaaataaatctgcagaaaaagtactaacagtattacatggccaagaaaaaatatcacgtaaaattagtgtgttccctgcagcattccaacaaaaattatgccatttggatagaggtactgaatatattatgcaagcaagaatgttatgtttgaccaattaatctccttaaagtagttaaaaagatcacactataacaataaaatagatgtttgagaagataaaatatatcaaaatgtatctaccaaaaagtgatcaaaaagaaactcattcatatcttttgcccaaatataagtcacctttcacagaattaatgttcagaaacagttgcctcacattagaatcctaacaaagattctcatattacacagtaccaccacgattttttatttttaatcaaaaagtaacatttgagaaaaatacactagcctgaattgacctcaatcagttggaagcttatagagttatagcttgaaaacttataaacgtaacctgacaattttttttttaagaaagagaaaagccacaaggaaattcaaaatggatttagccgttattcccgggagaattactttacaattccaaatgctagatgttactgtaaaaattttttttaaaaatctagaaacttcaaaagaaataaaatacttacaacatggacatcataaataatgagtgcttaggacttggtaaaaatttctaatgatttcgtcaaagtgatacttaacctcaaacaaccaagaagaaataaaaatcatataccatggaaaactcagttgatatcttaaaaaatatttctaggattgatgaatacacttaagtcaaatgcatgtaacaatatgaaaagactcaagaaatttaaatagaaaaatagtatatttaaattaacatttatatgatttgaatgtatattaaattattaaatattatgaatagacatttgatgacatctatatccctaataattttcacattcaactaagtaaacaactttttaaaatcttctcatctgataaacagaaatctgccttatattcagagacactatattcagtcatatataaaaactctgaggcataaaatgaaaaatattttttcacatatttacagaggtagccattaaggaacatcttctttacaaattatgttggcatattcaataaatgagtacagcttaagcattcctaacctgaacatccagaatgctccaaaatccaaaagtttttgagcaccagcatggtatctacaaggggaaaattccacaactgacctcatgtgacaggttacagtttacatagtcaaaactgttcagcaaacaaaattattaaaattatggtataaatttaccttcagcctataagtataaggtatatacgaaacataaatgaatttcatgtttagacttgggtcccatcctcaaggtatctcattatatatacacaagtattccaaaatatgaaaaacaaactcaaaatccaaaatacttctggtcccaagtattttggatatgagatactcaacctgtattattgaaaaggctgaccatgccacacatatctccgattttaatttatataacggatttagagaatacgcattttaagacctaaaattcatgccctaattaaggagttaacaaggacatctaaaatcccttacttcttcaatctattccttttatagagtaaaaaggaaaatatttaattctctctcccatattcatacataaaaatatgcacacatttctgcacatgcatacaagtgcaatgtttttattgcaagccttaaaatgatcccaatgttgtctgccagggcagtaaactgaaagttattgaattaaaaaatatatttgaaaatagttgagatattaagaaattattttaaaaacttggctaatattcaatttcttagtgttattcttcagtgcctaatacctatctcctttgaactctcacactacgatagattacaatatacaccatctacatccaatatattgcacttagcagagttacttctctgcctcttgactttaaattggccaatgataaataggcagtagtgacaaaatgtgccagttaagagcctaggccttacaaggacttaagaggccctctggagacaccaccatcaccaaaagaaaaagaaaaaaagcatgacctaggttgccccctaatccaaaagtaaagatgaaagtcatggggagtagcaccaacccagcctacccacacatctgcaatgcgaggcagagctgccagctcacatacaaataattgttgccactgagctacccattatttgctatgcaacaatagtaaaaagagttataggtacattattctcattgacattaaggttgaaacatcaacagtatacaacaatataaaattagttctctttccatagaatgaaaggccttgatattcaaagttaaaaaacaaatgaaatcattaaggtaaacacatcaatggaaacaattagttccttcttttatctggaatacatatatgcaatcatagtcctgctgctatgacatgacagactcagagacccaaataatttatatcttgtaattacaattcacacttttagaaattaaaaaggggtgcgtgtggaactctgaaattaatggcaaatcctccaaaacataaaaatgccatcaaacttgaatgtcaaatatttttccacagcttagcacctagatacatgatttacagatctgcctaaatagagtaaaaacaacaacaaaaaacatgattctccataaaagcacaacagaaaatccttaaaatattttttaatgaacgattcggataaattggagatcatttaaaatacaatctccaaaacataatcaggacattcttatatacatcaactgacatgaatttttattctcactgtaagcaattatacaagtgtatagtatacctacttgtaaaaagggtctaaagtaaactacagcagaggcacacagaaaacaaaaaccataactattcaacaaaactaaatgttagataactaagaagaatgtgtacacatagaaaacaaaaaccataactattcaacaaaactaaatgttagataactaagaagaatgtgtgatagtttctgaaagaaacttatttcagataacctgacaaattgaatatggatttttactctgaacttcatcctagtcaaaattattaaagatttaatgaatatattggttaaaatgttcctactgcttaacctaataaaatgaagcacaacaattcatcaggaaaatgtaacttttttcctgtcttcaaaaagatggtgtcatgcagagctttatgaaagagagacatgaacattataactgaaggtattgttctggaaagtcaatcacctagaaagccaaataagtaaagcttgggtatatcatactccaatcaccacagctagtgaaaagaaagaaatttgagcagcacatactaaaatatgtttcagagaaggataacggcaaaacatggtaacaggtatcgtcaaatcaaatggatactgaatgaactaaatttgggaaacccttagttgaacaaaattaaatagtttccttactgtaggactatttggagcctttaatatggtacctacactgttaagtacaaataataccacattcctcatttgtttaacaccattttatcaagaagcatctgaaggaaagccttatttagaacatattttagaaaacgctaaagaaacaattacttcctcagactataccattttaatcatcaaaattattagtactgttgtctcaccatgacaactacaatttgagagtctactaagctctgagtattaggcacgcactttatctctacttaaacagaatcatttgtaaatctctcaaagtattatcccctcaaccgacatttgaatggttaggaaagacaattccctctacagagatcccttccacagtctgacaggtaaacaactagtcaatcttcaagcttcacaatatctttaagctattgcacttaccacgttatcaatttaattgtttgctttatacacttgcctcccatatgagacagatgtttaaagcgcaagggttattgatcatttaacaattttattgagatataactcacataccataaaatccatccactgaaattataccattcaacagtttttagtatattcatagttgtgcaaccatcaacacaatctaatttcagaacattttcatcactccaaaaacaaaccctgtcctttaacagtcattcctctatcctgaccctactcactccctgctcccagccctaggcaaccacggatctatcctgtttctatagatttgcctattctagatattacaaataagtgaaatcatgcaatacgtggtatttatgactggcttcttcaacataatgtttttaagttcatatgaagggacttcatatgacaagttaatggaaaatgtaattgaaagataaaaataaaagaatataaaccttatgttcaacataagctccatcaaggtcaagacacttgtaaatgatgataccagccacttattactctatccctaaagaactgagagtcctgggaatttagccatgtcagtgcagtctttttttatacactattaactatattaaaaaaaaaagtggttgacagatatggtttggctgtgtccccacctaagtctcatctttaattcccaggtgttgtgggaggcacccagtgggaggtgactgaatcatggggggaggactttcctatgctgttctcgcggtagtacataagtctcacgagatctgacggtttgataaggggaaacctgttttgcttagctctcattctctcttagcctgcagccaaccatgtagcacgggacttgctcctccttgccttctgccataattgtgagggttcctcagccacgtggaactgtaagtctaattaaacctctttcttttgtaaattgcccagtctggagtatgtccttatcagcagtgtgaaaatggactaatacagtaaactggtaccaccagagtggggcactgctgaaaagatacctgaaaatgtgaaagcaactttggaactgagtaacaggcagaggctggaacaatttggagggctcagaaagacaggaaaatgtaggaaagcttggaactccctagagacttgttaaatggctttggccaaaatactgataatgatatgaacaatgaactccaggctgaagtggtctcagatggagatggggaactttatgggaactgaagcaaaggtgactcttatgtttcagcaaagagattagtggcatcttgcccctgccctagaaatttgtggaactttgaacttgagagagataatttagggtatctgacagaagatatttctaagcagcaaagcattcaagaggtgacctgggtgctgttaaaggcattccattttaaaagggaaatagagcataaaagtttggaaaatgtgcagcctgacaatgcgactgaaaagaaaatcccattttctggggagaaattcaagccagctgcagaaatttgcataagtaacaaggagctacatgttaatccccaagataatgagcaaaatgtctccagggaatgtcagaggccttcacggaatcccctgccattacagttccagaggcctaggaggaaaaaatggtttcctgggccaggcccagggtccccgcggtgtgtgcagtctagggacttggtgtcctacgtgccaggtgctccagacatgactaaaagaggccaaggtatagctcgggctgtggctttagagggtggaagccccaagtcttggcagcttccacgtggtgttgagcctgtgggtgcacagaagtcaagaactgaagcctgtgagcctccacctagatttcagaggatgcatggtaatgcctggatacccacgctgaagtttgcagtaggggcagggccctcatggagaacctttgctcaggcaatgtgaaaggaaaatgtgtggttggagcctccacacagagtacctactgcggcactccttggtggagctgtgagaagagggccaccatcctctagaccccagtatgacagatgcatggacaccttgcattgtccatctggaaaacctgcagacactcaattccaccccatgaaagcagctgggagggaggctgtaccctgcaaacagaggggcaaagctgcccaagaccatgggaacccacctcttgcatcagtgtgacctggatgtgagacatggggtcaaaggaaatcattttggagcattaagatttgatggccccactggatttcagacttgcacagggcctgtagcccctttgttttggccaatttctcccatttggaatggctgtatttacccaatgatgtactcccattgtatctaggaagtaacaaacttgcttttgatttgacaggctcataggcagaaaggacttgccttgtctcagatgagacttgggactgtggacttttgagttaatgctgaaatgagttaagactttgggagactgtcgggaaggcatgtttggttttgaaatgtgaggacatgagatttgggaggggctagggatgaaatgatatggtttggctgtgtccccacccaaacctcatcttgaattcccacaggttgtgggagggacaagtgggaggtgactgaatcatgggggcaggtttttcccatgctgttcttgtgatagtgagtaagtgtcacgagatctgatggtttgataaaggaaacccgtttaacttggctctcattgtttctttgcctgctgccataattgtgaggcttccccggccatgtggaactgttagtccaattaaacctctgtcttttgtaaattgtccagtctcggatatatctttatcaacagcgtgaaaatgggctaatacattgacctttaaagacagtttaagattagtaaagaaaaagaagtcagaagaagctgaatcaggactgtaaggtggatgcctaatgatatctcatggaaactctcacaaaattgctcttgattggaggaaagacaggagtaccgtcctggtggagaaggattctagctttaccaggcatttttttttctgctaaagctttggctgactttctcaaaacactctaataataagatgttatcattctttggccctccagaaagtcaacaagcaaaacgcctcaagcatccccaaaaaaactgttgccatgacttctgctcttgaccagtctgcttttgctttgcctggaccacttttacctcttggtagccatggtttttattgttctttgtctttaggatcatactagtaaatacacatttcaactcctgttacaattctttgaagaaatgctttgagatcttgagcccatttgtttgaaatttccactgaaagctctgttcttgtctgcagctgatctgggtgcagcaaccttggcacccatcgggtggaaagtttgctcaactttaatttttcagtcagaattgtataaggtgaaccaattgagatatctatggtattggccagtttctgctgttgtcaatcctcttcgataaggctacaaacaagatacattttttccttgaaaattgatgtggatggtccgctgctgtgggtttcacagcatcgcctcatcccttcatgaaatgagacgttcatttgtaaactgctgatctcttggggcactgtcgtcctcatatacttcttgtgaagcatcagtgatttcaccattctaccacccaagcttccccataaatttgatattagttcttgcttcaacttgggcagaattcatgttgctcttttcaaatggatgtcttatccatcttagtccctcaaactagatcctgtcatacatgttataacaagttagtaagagtttattttgttgtttaaaaaaaatgtgaaacccaggcatagtatttcataattcacattttccacaaacttttaaaagaccccttgtatatcagtaattaattcctttttattatcaaataacaatatttaattgtatgactcctccacatttgctatccattcatcaggtaacaaatatttgggtcatttttattttttgactattagaaataatgctgctacaaacatcatgtacaaattttgtgtggacttatattttcatttctcttcattctgcttcactaggagtgaatctgctcgatcacgtgggaaatctgtattcatttaacctctagaaaaactgctaaaaatgttttccaaactagccacaccatagcacattcccatcaacattgtaaggtttcaatctctccacatcatcacatttgttatctttttgatcatagctatcctagtgggtgtgaagtagtcatcattgttgttttgatttgccaatagctaatgacattgagcatcttttcatgtgtttatttggccatttgtaaatcttctttggagaaaagtctattcagatcctttgcccattttttaattgtaatgtctttttaattgttgacttgtaagaggttcttcacagatacaagtaacttacaaatttgtgattttcagaaattttctcccattgagtgaactgtgcttttatcgtcttgaaagtgtccttaaaatacaaaaacttttaattacaatgatgtccaatttaccttttttcctttgttagcttgttatatctaagaatgctttgccaaactcaaggtcattgtgttatatctaagagtgttttgccaaactcaaggtcatgaacatttactcctatatttctaaacattttatagtttgagctcttatatttagatctatgatccactttaatatctatgtacggcatgaagaagaggtccaaattatttcatgttgttccagcaccattccttgaaatagctattctttcccttttgaattatttcagaacctttatcaaaaatcagttgattagctgggaactgcagctcatgcctgtaatcgcagcactctgggaggctgaggcaggtggatggcttgagcccaggagtttgagaccagtctgggcaacacggtgaaaccctgtctgtattaaaaatatttttaaaatttgccaggtgtggtgttgtatgcctgtactcccagctactttggaggctgaggtgggagcatcacctgagcccaggaggtcgagactgcagtgagccaaacatgcactgtggcctgggtgacagagcaaaaccctgtttcaaaaaaagaaagaaaaggtgttggacattgtcaagtattaatttttgtatgtatctattgagttgatgctttgatttttttctttttttctattaatgaggcatattatattaattgatttttggatgctgaaccaactttgcattcctgagataaatttccctgaaacttggtatatatgttttatatgctgctattattttgttgagaatttttgtacctatattcataagcgatagtagtgtacagctttcttttcttgcaattactgttttttatatcacagtaatattaacatcacaaaataaactgggagatgaaaaagtagtgggcttggtgactgggaacatgagggaggattctaagatgaaggcaatcttctatttcttggtctgcttacttgtttcatgactatgttcagtttttcaatattcattcatctataatattcttataatctctgttatttttgagatgtatgttttactttaccatttttttagaaaaagaaaaaatcattatgacatatttctaaatttgttcttaaaagtgttctttttaaaattatctgttacacattgtgtaaaattattgtcagtattcatctaaagtatcacgtcttgaaagacaggaaaagaatgaagaactgtcacagatttgaagagactaagaagatagaatatttaaatgtaatgtgaaatgacagactgattcctggaacaggaaaattccactggaggaaaaactggtgaaatttaaataaggcctgtaatttagttaatagtatgataaaacatagcatttcctagttctcatatttatactttggttaggtaagttgttaatattaggggaagttgggtgaagagaatacttaaattctccactctattgttgcaactttttagaatgacataaattatttaaaaataaaaaggttttaaaaatattaccttgtgactgaataatacatttatctagctcaatattcaataggttaaaaaattaaaaaagaaacacacactgaaaagtctccctcctattattgtctactaactatctagttcccttactgaagaacaaccagtattatcttttttctattcccttccagagattattttttctaatgtaccataagaaaatacatacctgtcaggtatgtatattattttcccccagaaacagcttttcataaaacaattccagtcgcagaatttatgctaacaacgcactaaaatattctgctatttactgcattactgtttattttaccaaaaatgtcaacatacataaacataaaagcctaaaaagtttactaaaaacagtgtttgaataaacacactctgcagacatataaatagaataatatagcacaactaaatggagtttatatattagtaccatttaacatttcaaaattaatgtaaaaaactacacagcttttcaaaattataatatgaaaatagaaacctctcctataaaaacttatacaatataatcaaatactatataaagaaaaaagttatgcactaaaatagttattgttcatttgcttttgttgctttagggtctgtgagatagattacaataatggccccaattcttcacccctccccatatctgtatctttttccatgtggttttgcaatttttgcaattcttttcatttaaagagtcagcgtatatttcccactcattgaaccctagctgattttctgatttactctggccaatagattaaagtgatggcacaccagctacaagattaggctttaaaatgtattgcattttttggtctttattacatctctcccattatgaggagaacacacctgctacttgatgagagagtaaaaccaagtcaaacagttcctccaattaaggccatccaaaatcagcagagctgcctagctgaccatcatacacacatgaccaatgaggacttaactgttgcatgccacagagactttgaactgctttgtgatattgcattactgtagcaatagataactgatacaagatacttaactatatactacttaggacactggtcaccagaaactaccttttaattacaatacttccaaagataaaacacatttctattttctataagcttttcttatgattttatattacataaaactccttatccaatgtaaactcaatatattaaaccatttaatctaatgtaacattacttaataatcacttattcttgctttgtgatgcttatactaaattcttaaatgcaactgaattcattttgggactctccattttattccactaatgtcaaattattattattagttaagataaattctaatacttcatagaaatacttttctctattagaagtgtccaaattatatatagctatttttatgttactgcataaaatattacagttatttttcctttacaaagaaaaggaggtttagattagaattattatctaggattagcacttctaatatgtctggaatcctcaggctacaataaacgtacaggtttatatggaatatatcccagaagaaaagagaattttttttgtaccagtgaaaatagatgacaatcagtgggatggatacaatctttatctctactagccataaactttccaccacaaatggatctggagggccacagaccctccaaaactgtagacatatggtgaagcaacaggcaggcattcaagtaggtgggaattattacatgactctgaataaagcattaccctatagggactcagaagaatacaatttttggtgtaactccatattctctgtgtcaggatttacacacacgcaattccaaacatgacttggatctccgattagaagtgatagactggataaagaaaatgtggcacataaggaaaattacctccttatgacaactagctaattaactagcttacaaagccactaacagtagcttacaaaatcacagctgttactttttcaaacaactaaatgttgatttcattttaaatgtcatttcaaaagaattaatgatttcctcaaagcactacaatttatacagcatggaatactatgcagccataaaaaaggatgtgttcatgtcctttgcagggacatggatgaagctggaaaccctcattctcagcaaactaacacaggaacagaaaaccaaacactacatgttctcacgcataagtgggagttgaacaataacacatggacacagcgaggggaacataacacaatggggcctgtcggcagtgggtggggtcgggggagggttgggaggctatgggagggatagcattagaagaaatacctaatgtagatgacgagttgatgggtgcagcaaaccaccatggcacatgtatacctaaataacaaacctgcacattctgcacatgtatcccagaactaaaagtataatttaaaaaaaaagaaaatatactttaatgatattcaagtctacacaggtctttttccaactatggtacaaaacaaaaatcctataatgaacatgttaagtataaactgttgcctttcaaagttccatcattatcctattccacaaaagcattagcaactatgaaaataagtgggtgggaatgtgtaatccaaaaatatttgggcaaagaaa

SEQ ID NO: 105 - DNA, 3740 bp, Homo sapiens
atgtgcgggatgtaaaaaatactcactctttctagacaaactcttactaaaacacaggcaaagggaataatcgattgagcctgttgaaggagatgccaccactgggtgttggtgtttaagagaagtgaccctaagatttctgtagtctgtttgtttaaagataaaccacaataataggagacctttctttcagaaacttgcaggccgggtgtggtggctcatgcctgtaatcccagcactttgggaggccgacgcaggaggatcacttgaggtcaggagaccagcctggccaacatggtgaaactccgtctcaactaaaaatacaaaaattagccaggtgtagtggcgggtaactgtaatcccagctacttggaaggctgcagcaggagaatcgcttgaacccgggaggcggaggttgcattgaacccgagctcacgccactgcattccagcctgggtgacagagcaagactccatataaaaaaaataaaataaaaaaggccaggcatggtggctcatgcctgtaatcccaacattttgggaggctgagggggtgcagatcacttgaggtcaggagttcaagaccagcccgaccaacatggtgaaaccccatctctactaaaatacaaaaattagctgggcgtggtggtgcatgcctgtaatgccagctactcgggtggctgaggctggagactcgcttcaacctgggaggtggaagttgcagtgagcgaaatcacaccactgcactccagcctgggcaacaacagagcaagactccatctccaaaaaacaaacaaacaaacaaaaaacttccagtcttgtaatatcccacgtccacccttttctaagtacaggatactcctgagatttaacttataatcacattttatctccttaagtctaccattataaacttttaaaaaaggataccaaaattagtgtaacaggatttactcatttcagttacacaattccaaactttcccctgcaggaaaaccagtatttacatttgttatattttcatcactagatggctaagaggaaatgctagtgattaaaacacagaaatctgtttcatgtaactttttattaaaaatagtttttatattggacacatgtttacagataccattttaagaagacctaaggcatacaaatgtgggcttttggcttgcttcactgaatgaagataaagatataaaaacccagatctgcctgagggtagtcgtttaaagacagccgctaacatggaattctcacaattgttcttttgagggatattttaagccttgttctcttatcgtcgtaggtaagcacttgtaccatgaaaaccgtaacctgtacttcaagaaaacattcacatttctgctacaagaaaaggttctgatgatttaaatgtttaagacttatggcagctcttcagaaagaaaaaggaagtcttcataagatacagagatagggaggctgaggcgggtggattgtgaggtcaggagtttaagaccagcctggccaagatggtgaaaccccgtctctactgaaaatacaaaaattagcctggcatggtgacgggcacctgtaatcccagctactcaggctgaggcagagaattgcttgaacccaggtggcggatgttgcaataagccgaaatcgtgcaactacactccagcctgggcaacagagcgagactcaaacaaacaaacaaaaagtaactaggaaagtgttttacatgtgggcttattttaagaagaaatttactaaaagctgagagatgggtctcgataaaatttgatgattcaaagaaagtggatgggaactttactgatcttagtttaaaatatcctgagtcacctgccttatgaggtggaaggtctttctttcttactatatgtacacctttaattgaaaaggtgagaaaagctccatactgtgatgctatgatttccccaaggcttaccttctataagtagtcactgataaagtgccattgacccgcatttgtttagaattatttcattaaaattggggtatgatctagcagtttataataaatatttatggataattttattggcttttaaaagatactgtaaaattgacatatctcaaaatggagttaatttatatttacaacaaaccaaacacaaacatcaattatggaattacagggtcacattttaattcctgaattttacagtttagcattaatatcaccacatgtatacaaatggtgtaaaacaagtacagtggtattttttaatacaaaataaacatctgttttatggaaaaaactatacttcatatctacacagacagctcatcttttccaaacaatagccaaaattaaaattaactacaaaatctccaaaacaggggaaactgctttagattaaacgattccaggaaaaatggacccgtaacacattacaagggtgatctaaagattgtggctggaattactgttaaagtttttttttcccaatgcattaaattgtattttggggagatttttctcacttcggcatgatctcagatcatagatgagcaaactaacattaaaatatttacagttaacttgttgctctaaaaataaaacttaactgtttgcctcaatttatttttaaaattcacttacgtatatggaatgtgcttttactcttcttaaaaaagcagctttcatatcacacccttgtttacagaaaagctacatgtgctgcatgctgactttgacacttaagtagcttcttggatcaaaatggcttctagatactaaatgccacttaattcagcactattcttggttggtctgtataagtaacactttaaaacttgcagctctggaaagacagaactttactaacaaagtagaaagtgatttcaaagtatcttccacaaaagattgtactggtaggcggttgacaacattctgttcgatctactttcaaatttctagagaaaatcattttggaatactactgtactgattcttggccttcgttgtctctaaaagtgctgattttaacattatcttaaaactgtccagtttgaattgagcttgttttcatcaatatacatattgaaaattcctggtgtagaaaactcaacatgtgctgaatacggggtgtacttcccttcaactacctaaaaggctgaacttttgttaaatcttaaagaaatggtcccaacagcttaacttcatttttttaatgatagttgaatgtgttttccataaaaatttcttttaaaaagaggcaactgattaaaacaacaacatggccagcaccattatacaagtaatgttattgagtttacaactgaagttctgtaaaattgtttctagatcgacaccccgaggagcaaccctgcattattatatcaaccttttcccctcccctaaaccgtccccaaacctgtgacttttccttgctgagaagctgtctcccaggttctggttactaatgtttgttttgacagcctaaaaggcaaaccccttaattactagcaagcaatcaagttcctgggaagcctgatttttattagaactaaactctcttagctgatatactgtcttttgctactccttgtatattttataagttcaattgagaaagctttctgattcagattttcagctcactgaacagttgcagcattgtaagaccacatgttgagggtcccctaataaatattttatgagccaagacgaggtcttttcctgggggacgattcttcttcttcatcttc

SEQ ID NO: 106 - DNA, 130334 bp, Homo sapiens
atgacactcctcttcagaatatattcaatgatggaattccatgccagaaaattgctgtttatcaattattataacagtttctgttataaagacttaaaatttcaatggataccatctgttgattttaaaatccacactgctataaattagtcatcataatataatggtcaagtatcatatcacaatttactattgtctggtagtgttcttgaaacttaacttgttctctttgttcctctttgaagctttttttttcttttttcttttttttttttttttttttgagacagatctcgctcttttgcccaggacgagagttaagtggcatgatctcagctcacctgcaacctcgccccctgggttcaagagattcttctgcccgccaccatgcccatctaatttttgtatttttaatagagacagagtttcaccatgttggccaggctggtcttgaactcctgacttcaggtgatctgcccgcctcggcctcccaaagtgctgggattacaggcgtaagccaccatgcccggcctcttataagctttttagtaactgagagaagtggaaaaatcatggtgtccacattgcatgtggtcactacttgacctggcactttatatctgacagacactgtgtggagtgagctattaccagcaatctgttcatgttaccctccagtaggcacagcacataggatatgttccaactaggccataggtctcctcaagagctaaacactacatatggcatttgttgaatcattttactgtccacaagacagagatatatttatcaggggcctcattcacctggaaaatctctgagcttcttacctataggtggtgattaaatgggtaaacaagctgtttttcctagtcccaaattcacccgattataattaaggaaattcattttggttgcaacattcactgctatagcatattggcggcttttttttaaatcaatgttagcctacatttgcttataaacatcttcaggtttccattttagtggtatcgcttgaggaaaaaatccagaaaattctgatgccagctattctacatggttccctctactgaaaaatataaagtggatcaaaggttatatactactaaatcttaatgcatagaaagcttgaatatttcttgtttttcataacatccaatttaacacacataagccaaagatcccaagtatagaaaggcaggaaaaagagaacaggaagggcagagggggctgtggcaactacagttttgggcagtttggtaacaccccttcttctgctgctgctttaataaggtataactgacaaatttgaattgtatatatttaaggtgtacaactcgatgttttgatacatatgtgcattgtggaataatcatcacaatcaagctaattaatcatcacctgacatagttatgtttttgtgtgtgtacgtgataagaacacttcagataaaatatatggaatgctttgcacattttcatgacatccttgtgcaagggccttgctaattgtctctgcattgtttctattttatttatttatttcagacaaggtctcactttgtcacctaggctggagtgaagcagtgcaatcttggcttacggcaacctcttcctcctgggttcaagtgattcttctgcctcagtctcccgagtagctgagatcacaggcgcacaccaccatgcctagctaatttttgtatttttagtagaaacagggtttcgccatgttggccaggctggtctcaaactcctggcctcaggtgatctacctgcctcagcctcccaaagtgctgtgattacagttgtgagccacgacacctggcctgttccaattttagtatatgagcttccaaagtcagcaccttatccttcttctcacaacagtactcaccaacccacaaaacataaggccagcaacccagatttagaccgaacctcaacttcctggccagaggaattatccaaggattattattagggcaggtgacacaagttgagaaaatccaagttcttccccagcaggtactcgaggggccctttggctctggggtcacggagctagaggaagtgaagccagaggggcttgcacgcctcatgaaaaggcctagcagaaatagaagtgaatgaggccaaaacccagagaaacagacctgtgaagatatatacacaaagcagagggacagagaaaaagagagaatgagaagacctttcaatgtccttgagtccctgggttcagagtagctacggtcagggccttccctattctccccaggaacatgaaccactaaatattgctctttgcttaaattattttgagtaggatttctgctccttgactaatagtaaggcatattactttatctatttctgagtaatggcaactatttttaaaatcaatcttactcccacacctaggaggaaaaaaatactgtcagatataaaattaggtttaaacattattagctaaaggtgtctgagattttgtctggaattcgctggtaaaaatgctattttgaggtgaatgtgtataaattaatccataccctagggacaattatttaacattgttaacacccaggtcaggagtctacacctgaggcaggggtgattaactagacatctaaaggccttaatcagttggccaccctccaaaggaggcaggtgtagaactttagatatctcactttctgaacctgcaccacaagcgatgttgcattttttcatagtgaaatgagcagtattcaagatatactgccagatgactagcagcctttttttttttttccttgagatggagtcttgctctgtcacccaggctggagtgcagtggtgcgatctcggctcactgcaacctccacctcctgggttcaagcgattccctgaatggacaaattggcttaggtcaagtcttaagggtgagagaagctgctgaatgacttcttatgacttagattctcaaacactccctgggttttcatccagtctagtgtcctactcttccttctagattcacccttctatgagctcttcttggttctaatccagtttagttcctgggtattagaggccatatttgcttgcagcccacctctggttttagacttaggccaactcacacccacatttgaatgccgcatagctctatccctcacctatactcctaggcctatttcattttgcttaaagaaagtgtttatttctcatttgcatgtggaaagtctttattattgtacatatcacttgcaacaatctgtccaaaattagagtatcttgtacttttacatagacagaatgacagaattttttaaaaagagtgaaagcacattccatgtacataagtgaatttttaaaaagtctttaattcaaaataacatttcaccgtgtaatttcttaagtttcagccataggtatgtgttcttgaagtagagaccttttttttttgagacagagttttgctcttgttgcacaggctggagtgcaatggcgtgatctcagctcactgcaacttctgccttccgggttcaagcgattctcctgcctcagcctcccaactaactgggattacaggcatgccctatcatgcccagctaattttttgtatttttagtagagacaggggttcaccatgttggccaggctggtctcgaactccagaattcaggtgatccacccaccttggcctccctaagtactgggattacaggagtgaggcatcgtgcccagctgagacttttttttttaagaggcgagctagtttattgatacagtagttcctgtctaattcttaggcactcaatttaagagattgaaaagaatgaaaagatagttccagccccatcaggaaaactgtatttgggttcttctcactataaaagggtatttttagcttcatttttattattggcctgaagaaaaaatacacaaggaaccaacacggaattaaactaagctgcccccaaaggaatggagaagaggatttgattttagcagagacctgtgtctcacttacaaacaatgtgtggatgaaaaaatgcctacatggggtatgtagccaccggtgcagtggctcacacctgtaatcccaacactttgggaggccgaggtgggtggatcacaaggtcaggagatcgagaccagcctatccaacatggtgaaacactgtgtctactaaaaaatacaaaaattagccaggcatggcagtgggcgcctataatcctagctacttaggggactgagacgagagaattgcttgaaccggggaggcagaggttgtagtgagctgagatcaccccactgcactccagcctgagcaacagagcaagactccgtctcaaaaaaacaaaaaatgaaatgcctacatgggatcccaaggtgagtggacgctaggtgttgtggcttgggagcactgggagagttgctcaaacttggcatggagagagtggaaccacctgctttcaaatgaccatgaagtggcaacaagtcctgaagaccagggtccttccctgaatgttctggagtgtgtaatcttccctttcaccattccatcattactccaagattgtggtaatatttattgcacatctgtgttacggagtatgttcacacctataacaagtaaatatacaattttttaaatctagattaagctatttacaatatatctaaatcaacaatgactacttgaggatattctctttaaatactattcattacagaaggctgagtctacgtgaggcagatgtgtgctttgcctacatcagtgtttcctaagcagcctgcttggtgctagctcacagatattgactgccctgggtcctggggacagttggttgtcttgggtgattatcttcagctgtaagcagcctcttcctcttgccccagtgaaaccgcctttgcaaaattatgactgagacagtgaaagaggtccaacttaaacgactccatcttgcctccaacctccaagctgtgcttgttcattcctgggtataggctgaattaactttgggaggaacttagtttatcatttaaaacaatgataatagcagccctttcccaggacaaacttccttcttgcccagggattggactactaacattagccacaaaattaaaaattatggtttaggagtcacctagctggaggctacaagactctgaccctccctaaactgctcctaagatcagtgcttgaggtgttttgcagactccacccttcatgcatctaccagcactacccagatggagaaactggccatttgatcttgtgacccccacccaggaactgagtcagcgcaagaagacagggacgcccccacgatttcacgtatgacccaaccaatcagcactccccaactcactgcccctcccctcccaccaaattgtcttgaaaaactttgatccccaaatgttccgggagactgatttgagtagtagtaaaactccagtctcctgctcagccggctctgcattaattattctttctgtatcgtgattcctcggtctcgagaaatgggctctgtctaggcagtggagtaaggtgaacccactgggcggttacaaattaggtaaagtgaacccactgggcggttacaccagtgtgctatacaactactgtattgtcatttctgtgtgtgccatttgtgttggaagcactggttcatgtatctgtaacagtttagtgcaagaggcaaaatgttcctttagctgcatctcttctactgacaaaataaatgtaaaaggtaactgtctgcattcaagaaatcctttatcagatgtaagcagagagccagagttaaagcaagattcagcctaggagacacagagacttggtagtttctggatagctcttctattcagaagtaaaggtgttagatacatttttggaaacagttttattctagttctacaatcatagaaaagtggagactaatggctgaacagaagtaaaattcgaaacagcagaaatgaaatgtcagaattgagttcaaccattctttcctcccagggaggtcaaacctaccatagagtatctgattcacgcagggattctatctgaagttcaagttctttcacccattcatctgaagtgtcccaattcaagagggtcaggttttctgtactttctgtttccctgcaattcgtgagtcagcagtaccagggcagtgaatttttttttttttttcactctggctgcacattgaaagtacttagagaatttttccccctaaaaatctgtgcctgggtcttaccctaaaccagtgattctcaaatgtggttcccagatcagcagcctcagcattgcctggtaacttactagaaatgtgtatgttgatccccacccctgctctactgaatcagaaattctgaggttggtgcccagtaaccaggtgattttgatgcaacctaaatttaagaacacttgacctagacaaattaaatcagaatctctaaaatgaagcctgagaaaatgatcatttcaaatgattctaatgtacagccagagttaagaccattgccttggacaagaggaaagccctaggaactcaacagaatttctggtctgtcaggtctccatttttcacatcagaccaggctccctacttcctgatgcaggtccctttccaggtaagattatcagtaactctttcagcagaatttggagttcactcctgagtttatttctggccttgggtagatttcatgcgttacatccttgcctaaactcattactcacttgtaaacacctgtggaagtgaacagccaggtctcacagcatttgttctctaaagcatcttgtaagaaatgagagatgcattacaaaaggaaagtagaagaaatgagggctctcacgttttagagcacaagttctcaatcttggctgtatattagaatcaccttttaaaaactcctattacagaccacataccagaccaattaaatataatattatgggatagggtccagaaatcaatattttttgaagctcccgaggtgactaaaattggctgagaattgcactctagcaggagaaacttgactaaaatgtcagtcttgagcaagagatagggagactgacaggaggaagaaaagcttctcagtgccaacaaggaattggtattcacaggcacacattcgtccagtaacctttttaaaaaatactttcttctctaaccttaacacagaactagatgggcccctttcatacactcttaggttgcatgagagagggagggaaagataaggaatagatgaagcaagtctaatgaacccttgaaaattgttcatcttgatgataagtatgtaggagtgaatcatgctatttacttaacttttgtgtatatttgaaaatttctacggtaaaataattttcaactaaactttttcagaagtggggacattattaccagcttacagaaatagaaaggattataatgatactatgaaaaattgtactccaacacattggataactttaacttgtagcttgaaagtagggtaaataggggtccattccaagatggccaaataggaacagctctggtctgcagctcccagcgtgattgacgcagaagatgggtgatttctacatttccaactgaggtacctggttcatctcattgggactggttggacagtgggtgcagcccacagagagcgagttgaagcagggcagggcatcgcctcacccgggaagtgccagggatcaggggatttccctttcctagctaaggaaagccatgacagactgtacctggaaaatcgggactttgccacccaaatactgtgcttttccaccagtcttggcaaacggcacaccaggaaattatatcccgcgcatggctcagtgggtcccatgcccacagagccttgctcactgctagcacagcagtctgagatcaaactgtgaggcggcagcctggctcggggaggggcgtccaccattgctgaggtttgagtagggaaacaaagtggacaggaagcttaaactgggtggagctcaccgcagctcaacgaggcctgcctgtctttgtagactccacctctggggtcaaggcatagctgaaaaaaaggcagcagaaacttctgcagacttaaacatccctgtctgacagctctgaagatggcactgtttctctcagcatggtatttgagctctgagaacggacagactgcctcctcaagtgggtacctgacctccgtgtagcctaactgggagacacctcccagtagcagccaactgacacctcatacagccgggtgtccctctgagacgaagcttctagaggaaggatcagacagcaatgtatttgctgttctgcagcctccgctggtgatacccaggcaaaaagggtctggagtggacctccagcaaactccaacagacctgcagctgagggacctgactgttagaaggaaaactaacaaacagaaaggaatagcatcaacatcaaccaaagacatccacaccaaaaccccatctgtagtcaccatcatcaaagaccaaaggtagataaaaccacaaagatggggagaaaccagagcagaaaagctgaaaattctaaaaaccagagcgcctcttctcctccaaaggatcgcaattccttgccagcaacggaacaaagcgggacagagaatgactttgttaagttgacagaagtaggcttcagaaggtcagtaataacaaacttctccgagctaaaagaggatgttcgaacccattgcaaggaagctaaaaacctggaaaaaagatcagacgaatggctaactagaataaacagcatggagaagaccttaaatgacctgatggagctgaaaaccatggcataagaactacgtgacgcatgcacaagcttcagtagccaattcgatcaagtggaagaaagggtatcagtgattgaagatcaaattaatgaagtgaagcaagaagagaagtttagagaaaaaagcaaaaataaatgaacaaagcctccaagaaatatgggactatgtgaaaagaccaaatctgcgtttgattggtgtacctgaaagtgacagggagaatggaaccaagttggaaaacactcttcaggatattgtccaggagaacttccccagcctacaaggcaggccaacattcaaattcacgaaatacagagaacaccacaaagatactcctcgagaacagcaacctcaggacacataattgtcagattcgccaaggttgaaatgaaggaaaaaatgtcaagggcagccagagagaaaggtcgggttacccacaaagggaagcccatcagactaacagcggatctctcggcagaaactctacaagccagaagagagtggagtccaacgttcaacaatctcaaagaaaagaattttcaactcagaatttcatatccagccaaactaagcttcataagtgaaggagaaataaaatcctttacagacaagcaaatgctgagagattttgtcaccaccaggcctgccctacaagagctcctgaaggaagcactaaacatggaaaggaaaattggtaccagcctctgcaaaaacatgccaaattataaagaccatcaatgctaggaagaaactgcatcaacgaacgagcaaaataaccagctaacgtcataatgacaggatcaaattcacacataacaatgttaaccttaaatgtaaatgggctaaatgccccaattaaaagacacagactggcaaattggataaagaatcaagacccatcaccgtgctgtattcaggagacccatctcatgtgcagagacacacatagactcaaaataaagggatggaggaagatctaccaagcaaatggaaagcaaaaaaaaaagcaagggttgcaatcctagtctctgatgaaacagacttgaaaccaacaaagatcaaaagagacaaagaaggccattacataatggtaaagggatcaattcaacaagaagagctaactttcctaaacatatatgcacccaatacaggagcacccagattcataaagcaagtcctgagtgacctacagagagacttagactcccacacaataataatgggagactttaacacctcactgttaatattagacagatgaacaggacagaaagttaacaaggatatccaggacttgaactcagctctgcaccaagtggacctaatagacatctacagaactctccacccaaaatcaacagaatatacattcttctcagcaccacatctaacttattttaaaactgaccacataattggaagtaaagcactcctcatcaaatataaaggaacagaaatcacaacaaactgtcactcagaccacagtgcaatcaaattagaactcaggattaagaaactcactcaaaactacacaactacatggaaactgaacaacctgctcctgaatgactactgggtacataacgaaatgaaggcagaaataaagatgttgtgtgaaaccaataagaataaagacacaaagtaccagaatctctgggacacatttaaagcggtgtgtagagggaaatttgtagcactaaatgcccataagagaaagccggcaagatctaaaattgacaccctaacatcacaattaaaagaactagagaagcaagagcaaacacattcaaaagctagcagaaggcaagaaataactaagatcagagcagaactgaaggggatagagacacaaaaaacccttcaaaaaattaatgaatccaggagctgattttttgaaaagatcaacaaaattgatagactgctagcaagactaataaagaagaaaagagagaagaatcaaatggacgcaataaaaaattataaaggggatatcaccaccgatcccacagaaatacaaactaccatcagagaatactataaatacttctacgcaaataaactagaaaatctagaagaaatagataaattcctcaacacatacaccctcccaagactaaaccaggaagaagctgaatccctgaatagaccaataacaggctctgaaattaggcaataattaatagcctaccaaccaaaaaaagtccaggaacagacggattcacagccgaattctaccagaggtacaaagaggagctggtaccattccttctgaaactactctaatcaacagaaaaagagggaatcctccctaactcattttatgaggccagcatcatcctgataccaaagcctggcagagacacaacaaaaaaaacagaattttagaccaatatccctgatgaacatcgatgcaaaaatcctcaataaaatacgggcaaaccgaatccagcagtacatcaaaaagcttatccaccaagatcaagtgggctttatccctgggatgcaaggctggttcaacatacgcaaatcaataaatgtaatccagcatataaacagaaccaaagacaaaaaccacaggattatctcaatagatgcagaaaaggccttcgacaaaattcaacagcccttcatgctaaaaactctaaataaactaggtattgatgggacgtatctcaaaataataagagctatttatgaccaacccacagccaatatcatactgaatggacgaaaactggaagcattccctttgaaaaccagcacaagacagggatgccctctctcaccactcctattcaatatagtgttggaagttctggccagggcaatcaggcaagagaaggaaataaagggtattcaattaggaaaagaggaagtcaaatcatccctgtttgcagatgacatgattgtgtatctagaaaaccccactgtctcagcccaaaatctccttaagctgataagcaacttcagcaaagtctcaggatacaaaatcaatgtgcaaaaaatcacaagcattcctatacaccaataacagacagacagccaactcatgagtgaaccctcattcacaattgcttcaaagagaataaaacacctaggaatccaacttacaagggatgtgaaggacctcttcaaggagaactacaaaccactgctcaatgaaataaaagaggacacaaacaaatggaagaacattccatgctcacggataggaagaatcaatgtcatgaaaatgtccatactgcccaaggtaatttatagattcaatgccattcccatcaagctaccaatgactttcttcacaaaattggaaaaaaactactttaaagttcatatggaaccaaaaaagagcccacattgccaagacactcctaagtaaaaagaacaaagctggaggcatcatgctacctgacttcgaactatactacaaggctgcagtaaccaaaacagcatggtactggtaccaaaacagaggtatagaccagtggaacagaacagagccctcagaaataacaccacacatctacaaccatctgctctttgacaaacctgacaaaaacaagaaatggggaaaggattccatttttaataaatggtgctgggaaaactggctagccatatgtagaaagctgagactggatcctttccttacgccttatacaaaaattaattcaagatggattaaagacttaaatgttagatttaaaaccataaaaaccctagaagaaaatctaggcaataccattcaggacataggcatgggcaaggacttcatgactaaaacaccaaaagcaatggtaacaaaagccaaaattgacaaatgggatctagttaaactaaagagcttctgcacagcaaatgaaccatcaaagtgaacaggcaacctacagaatgggagaaaatttttgcaatctactcatctgacaaagggctaatatccagaatctacaaagaatgtaaacaaatttacaagaaaaaaatcaaacaaccccatcaaaaagtgggcaaaggatatgaacagacacttctcaaaagaagatatttatgcagccaacagacacatgaaaaaatgctcatcatcactgatcatcagagaaatgcaaatcaaaaccgcaatgagataccacctcacaccagttagaatggcaatcattaaaaagtcaggaaacaacaggtgctggagaggatgtggagaaataggaacgcttttacactgttggtgggactgcaaactagttcaaccattgtggaagacagtgtggcgattcctcaaggatctagaactagaaataccatttgacccagccatcccattactgggtatatacccaaaggattataaatcatgctactataaagacacatgcacacgtatgtttattgctgccctattcacaatagcaaagacttggaaccaagccaaatgtccatcaatgatagactggattaagaaaatgtggcacatatgcaccatggaatactatgcagccatacataaaaaaggatgagttcatgtcctttgtagggatacggatgaagctggaaaccatcattctgagcaaactactgcaaggacagaaaaccaaacaccacatgttctcactcataggtgggaattgaacaatgagaacacttggacacagggcagggaacatcacacaacagggcctggcgtggggtgggggtatgagggagggatagcagtaggagaaatacctaatgtaaattactagttaatgggtgcagcaaaccaacatggcacatgtatacatatgtaacaaacctgcatattgtgcacatgtaccctagaacttaaaagtataataaaataaataaacaaataattaaaaaaaaaaagaaaatagggcaaataggccagacgtgatggctcatgcctgtaatcccaacactttggaaggccaaggccggtggatcacctgaggtcaggagtttgagaccagcctggccaacatggtgaagccctgtctctactaaaaatacagaacattagccaggtgtggtggcggattcctgtaattccaactactctggaggctgaagcaggagaattgcttgagcctgggagacagaggttgcagtgagctgagattgcaccattacactccagcttgggcaataagagtgaaattccatctcagaaaaaaagaaaaaaaaaagaaaaaaaagaaagaagggcaaataattttttttaaaaagcagattggataagctacaggaaatggataaattcctagagacatgcagactgccaaaattagctcaagaaggaacagaaaatctaaatagacctaacagaaggagattgaatcggtaattctcaaattcttccaaaaaaatagaagaagagggaacacctaacaactcattctatgaggcaagcattacttgatataaaagacagataataacatcacaagaaaactacaaatcaatatcgcttctgattttggatgcaaaaatccccccattaaaaaaacagatgctcaactgacaatggggttacatctgatgaatccatcatatattgaaaatatcataagttgaaaatatatctaatacacctaacctactaaacatcataccttagcctagcctaccttaaacatatttagtatacttacattagcctacagttgggcacagttaccaggcaatccagtacattgtagagcatcagttgtttacccttgtgattatgtggctgatcaggagttgtagcttgctcccattgcccagaatcacaagagtatcctaccacatatcactagcccagtgatatggtttggctctgtgtccccacccaaatctcatcttgaattgtaatccccacatattgaaggaggggcctggtgggaagtgattgaatcatgggggcagacttccctcttgctgtgcccacaagatctggttgtttgaaagtgtgtagcacttcacccctttgtggtatctctctcctgccctgccatggtaagaagtgcttgctttccttttgcctctcgccatgattgtaagcttcctgaggcctcctggccatgcttcctatattgcctgtggaactgtgagtcaattaaacctcttttctttataaattacccagtctcaggtggttctttgtagcagtataagagcagactaatacacccaggaaaagatcaaattttgaatttgaagtatatggtttctactgaatgcatatcgctttggcaccattgtagagttgcaaaattataaattgagccatcataacttggggaccatctgtactagaaaatcaaatccagcacatattaaaaggattacatgtcatgaccaaccaaatgggatttaatcccaggaaagcaagggttgttcagtataagaaaattagtcattgtaatatactgtattagtagaatgaaatgggacaaaacatacaatcacctcaattgatgcagaaaaggtatctgacaaaattcaacacccttttacaataaaacacttaaactacaaatagaagagaactttctcaacatgcaaaagggcttatatgaaaaacccacagctaacatcatactcaatggttaaagacagaaaacttttccccttatatcaggaacaagacaaagatgtctgatcttgccacttctattcaatattgtgctgaaagtcctagccagagaaatcatgtaacgggccgggtgcggtggctcacaactgtaatcccagcactttgggaggctgaggtgggtggatcacctgaggtcaggagttcaagaccagcctggccaacatggtgaaaccttgtctctactaaaaatacaaaaattagctgggcatggtagtgcgtgcctatagtcccagctactcggaaggctgaggcaagagaatagcttggacccaggaggtggaggttgcagtgagccaagatcactccattgcactccagcctgggtaagaaagtcagactccatctcagaaaaaaaaaaaaaaaaaaaaaaaaaagaaatcatgtaagaaaaaggaggggtaaaacatccaaacaagaaaggaatgagtaaagctatctctatttgcaggtgatgtgatcgtatatatagaaaatgtcatgaaatccaccaaagaaaccctcagagctaataaacaaatttaacaaagtaataggatacaagatcagcatgcagaaaccagttatatttctgtgcactagcaatgaaccatctgtaaaggaaattaagaaagcaatcccatttatagtagcaccaaaagaataaaatacttaggaatacatttaaccaaagaggagcagaactaatatgctgaaagctgtagaacactgctgaaaataattaaagaagaccaaaataaattgaaagaattcacatatttatggtttggaagacttgatcttgtaaagatgacactgttccccaaagtgatctacagattcagagcaattcctgtcaaaatccaaaacctttgctgcagaaatggaaaaagtctatcctcaaatgcatatgtgatctcaaggcaccccaaatgtcaaaacaatcttgggaaaggaagacaaaattggaggacccacacttcacaatttcttttttcctttttctttttttttttttttgcaacagagtcttgctctgtcattcaggctaaagtgcaacggcgcaatcacagctcactgcaccctccgcctccagggttcaagcgattctcctgcctcagcctctcaagtaactgggattacaggcgcccatgaccacacccagctactttttgcatttttagtagatacggggtttcgccatcttggtcaggctggtctcaaactcctgacctcaggtgatccacccacctcggcctcccaaagtgctgggattacaggcatgagtgactgtgcccggcctcacaatttcaaaactcactacaaagctacagtaatcagggccgcgtgtggtggctcacgcctgtaatctcagcactttgggaggccaaagtgggtggatcacaaggtcaggagttagagaccaacctggccaacatggtgaaatcccatctctactaaaaatacaaacattggtggcgtgcacctgtaatcctagttactcgggaggctaaggaggagaatcgctggaacccaggaggcagaggttgcagtgagctgggattgtgccactgcactccagcctgagcgacagagcaagactccatttcaaaaaacaacaacaatgacaacaaaagctacagtaatcaaaacactgtggtactggcataagagagacatatggatcagtggaatagaattgagcatccagaaataaaccatacatctatggccaattgattttcatcaagggtgctaaaacaattcagtgagggagaaaacagtcttttcaataagtagggctggaagaattggatactcacatgcaaaagaataatcttggactattactgcataccatctataaaaattaactcaagatggacaaaagacctaaatgtaagaactatgaaagtaggaaaatgtaaaatataaaactctcagccagacacggtggtttcacgcctgtaatcccagcactttgggaggccgaagtgggtggatcacctgaggtccggagttccagaccagcctggcaaacatggtgaaacctcatgtctactaaaaatacaaaaattagccaggtgtggtggcaggcacctgtaatctcagctactcaggaggctgaggcaggagaatcgcttgaacctgggaggtggaggttgtggtgagccaaggcaccattgcactccagcctaggcaacaagagccaaactccatctcaaaaaaaaaaaaaaaaaaaaaaaaaaaaaaatatatatatatatatatatatatatatatatatatatatatatatatatatgatgaactctcagaagaaaacacaggcaaacatcttcttggccttggatttggcagtcttaggtatgacaccaaaaagcaacaaaagaaaagaataagtaaatagagcttcattaaaattaaaaatttgtgtatcaaaggacactatcaagagagtaaaaaggggccaagcagggtggctcaggcctgtaatgggaggccattacaggagagggaggccaaggcaggagaatcacctgagctcaggagttcaagaacagcctgggcaacatagtgagatcttgtgtctaccaaaaataaaaaataataaaaaattagcaggcgtgtaacctgcatctgtagttccagcgactcaaaggctaaggtgggaggactgcttgaacctgggagatggaggctgcagtgagctatgatcacacaactgcactccagcctgggcaagagagtaagaccctgtctcaaaataaaataaaatagaataagagagaaagtaaaaagaaaacccacagagagggaaatatatttgtaaattatacctctgataagtatctagtatccagaatatgtacagaactcctacagctgaacgattaaaagacaaagagctccatttgaaaatgggcaaagcgggctgggagcagtggctcatgccctgcactttgggaggctgaagtgggaggatctcttgaggccaggggttcaagaacagcctgggcaaaatagcaagaccctgtctctacaaaataaaaattaaaaatttagctggccatggtggtgcatgcctgtcatcccagctacttgggagcctggggcaagaaggtctcttaagctcaggatgcagtgagccatgatcatggcactgcacttcctcctggacaataaagtgagaccaccctccatctcttaaaaaaaatgggcaaaggacttgaatgcacatttctccaaaaaagatatacaaatagccaacaagcacatgaaaggatgctcaatattattagtcattaggaaatcagaaccatgatgagatacaacttcaaactcaccagattggccataattttttaagtagaaaatcagcattgatgaggaggtagagaatttggaaccctcatatgttgctgataaaaatgcaaaatggcacagccactgtgcaagacagttttgtggttccttaaaaagttaaatatagaattaccacatgacccagccattccatttctagggatatatttgaaaggattgaaaacagttattcaagcaaatacttgtacacaaatgctcatagcagaaatctccacaatagccaaaaggtgtaaacaactaaaatgttcatcaattgataaatagttaagcaaaatgtggtataatcacacaatggaatattatttggccataaaaagaatgaagtactgagtcatgctacaacacggatgaaccttgaaagcattaagttaggtgaaagcaaccagacacaaaaggtcacatattgtatgatttcatttatatgaaatatccagaacaggtaaattatcagaggctgtgggtagaggaggaagggggaatgactactaatgagtacgtgattttttcccgggggagagtggccggagggtgatgaaaatgttttggagttagatggaggtgatggttgcacgacgctgtgcatgtactaaacgccactgaattgtacacttagttaatgattaattttatgttatgtgaatttcatcccaattttttttaaaaaaggaaagaacattcaagcaaatacaaatcagttaaggaatgtaaaagtagtctgcaaaaattaagattttgtatgatgactgtagcttagcagttgtttgtgagcatatgttgtcctccttttgggggatttccagacagaggactatgcaaggaaatatggctcctattatttaagtgaaagcatgaataggaatattctgttttgtaaagataatgtgaaaacatttgtatcaaaagactgatagagccaagctatatgaagtaaataaaggctctaatgtcatgagaacctcgagagtgctataagcaaacttctgaaggaataaaatggaagaagaaattatgtcttcaggagaaagtccaaactaactaggacagcaatatgaagtgaattttggctatacagcttctttcttttcttttttctttttcttttcttttttttcttttcttttttttgagacagagagtctcactgtgttgcccaggctggagtgcagtggcacgatctcagctcactgcagcctctgtctcccaggttcaagcgattttcctgcctcagcctcctgagtagctgggattacaggttcttgccaccaagcccaactaatttttgtatttttagtagagatggggtttcaccatgttggccaggctggtcttgaactcctgacctcagatgatccgcccgccttggtctcccaaagtgttgggattacaggcatgagccactgcgcccggccctatatagcttatttcttcaattcttcataataaccctaaaggtataaattattatacccatctatggcaaagattactagtccctttctctaccatatccattttctctttcatagagataaaaagttttagctgagaacatagctgcccaaaataaaaatatcccccagactcccttgcagctaggtgtagttttatacagttggccatgtgactgggttggccagaatttagtcacatggccaactgtataaaactagaagcatcatatggaaacttctgggaaacttctgaggagaaaactgatttatgccttgttccttcttccctctttttccttccctccttcttgaaggatataatgtgtctccagaggcaccaacctggaccataagatgacttctatattaggaatagaagtcaagcatggcagatcaaaaagataggagccagagcccaaaactatggagccccatatttctctcagatgatttaatcctggactcttacttgaaagagaaatgcattctatcctgtttaaaccaatcctatctggagttttctttcttgtaggtaaatcaaatcctaatggatacattattttgcagacgacaaaaccgaaaggataagtaaagcgcacaagatgacacaccagaaactcacaaagccgggattcaaatccagttccataattccagtggtcatgctattccatctttgctgattcttcttttaggattctccagggtctggttgtggcctacattttcagattcttcttttgctgctcatttataccctacgttttgccttttcgaaagatttgggccagtgcttccttgggctcagctactcatgttacctccaataatacagatctttcagttgggttgtttttattgcagtctccaacatcatagaaattacatgctggcatataacgcttgggttgagaaatgatctgaggggcatgaaccacgatgcatttaaaattgcttttccctttgttctttatcctcgtcctcaaaacaaaatggtacaattcagtcctgtcccccactttaggctaaactgataagagcattagttggtatttattcactcaataaatatttattgaacatagttatagaatctgtcagtcattatgtgagaagcccagggtacaatggaacctactctcaaggcatttacatgtaagtgtgcaacttggattctagtgggcatcagatgtcagcttccacattgtgttttctaaattcttttttttttaaagagataatgtcttgctatgttgtccaggctaaagtgcagtggctatcaacaggcgtgttcatgatgcaccagcctggaacttctgggctcaagcaatcctcctacctcagcctctcaagtagctgggactacagactcatgccaccacacctggctacattgtctttttcttttcaatgacgtttcatgagcccttgtgtacatagaccctttcatttgtcctctcatttacctacaaatcacacctggatatatatgaatttgcaccagctatacagatctttgctttgcgattccagatacagaaaggcaggatttacatagagaagaggggagaggactattgacctcatactcacctagtgactggttcccagttgttcaagtcagaaatttaaggatcatctagactcagcctccatatccaattcatcactaaatcttctcatttctatctcttaatcagtctcaaattcatcttctcctctccgtttttattgtcattgttttagttcaggtgaatattgttcctgttttacatgtgtacaataatctctgtattgttagtatgctaaggctgccgtaacaaaataccacaggctgagtggcttcaacaacagaaatttattttctcactgttctagcagttagaagtcccatatcacagttctggcagatttggtttctggtgaggtcttttttactggcttatagacagttgccttcttgttatgtattcacatgttctcttctctgtgtatgcaggaagagagagatcactggtgtctcttctgtctcttcctcttcttataaggacgccaatcctattgtattaggtccccatccttatgacctcatataaccttaattaccttcctaaaagccctatttccaaatatattggggttagggcttcaacacatgaatgaggggcaggatcggggcaaagggacacaattcagtccataacaacctctacactacattctgagtgatctttccaagacacaaagctgatcatgtcaccgctttgcttttaattctttacagttctgggtctcttcgggttctttgggtgggaaaacaactaattcagatcaccttaagggggtttcaggaacttatagaaccaaaggggaggctgaagagccaggcttagaatgaggtagttcctgaggtttcagtaacagggattcctgcactgtcttggttgggtacttacgctgccatgagtggactctctctggttctctccttatattatactgctcaagatacagtctctggttgcactgaatgtacttcatgcactgaactgtacacttcaaactgttaaaatggcaattttttggccaggcgtggtggctcatgcctgtaatctcagcattttgggaggccaaggtgggtggatcacctgaggtcaggaattcgagaccagcttggcattttttttttttttttgaggcagagtctcactttgtcacccaggctggagtgtagtggcacaatctcggctcactgggacctctgcctcgcaagttcaagtgattcttctgcctcagcctcccgagtagctgggactacaggcgcctgccaccatgcccagctaattgttgtatttttagtagaggcagcgtttcaccatgttggccaggctggtctcaaactcctgaccttaaatgatccagccacctgggcctcccaaagtgctgggatgatagacgtgagccactgcacccggtaaaatggcaaattttacgttacatatttttgtaccacaatttttagaaagttaacagtggccttcatgtagccaaatgcttaaaatgttctggaaggcgattttacagtgatgaaatataaatatagctttttatcgctagggattagatgacacatggaatacatgaagttaaataaatgtgatcaagctaaataaaattgatatatttgtgtttgactttggaggtaacaaagaaagacaaatagagaaagatagaagatgatcagaccttgacatttcttccttctttcaatagacacctctttctttcaggctttgtcattttcagtactaagcactaaaaggacttttgtaaatcattatttccagtacatggcaatattttcatcaaactaagttacttcaatggcttatgttaataatattggaaaaaatcttcttggatattatacctaagatttgcttccaaaaactctgtggagcggaggaaatggagaagtttacagatgaagtagattgaccatgaattgatcatttttcagaatgggtttggttcatgcagattcattatactatttcctctacttttgtgtatgtgtgaattctccacaataaaaaggtgttttaaatcctaaaaaaacaaaaatctctgaaacagagagtgtagtgagtgtagtttaggtcacatgcttaccccttgactatgtcagagggtgaaggaagaagcctctagggactcctttggtttctgtagtaggagagcatttgtatttatcatcctgacaatgagacacaatgggggtgaggtaattctcccaaaagacattggggtgcaattaggaagagggatggaggctgggtgtccatataatgacaactatccacttctgtgcatgacagatggggcactttatcaactttcctccctcatctcttatctcctccactacagcctgcactccagccgggccagcaaccttgtgcctttctgtgccctgctcttgactgtgttggtgccctgatgaaagtctactcatcctgcagactcaattcagacatcatctccttcgactttgtaagcagaaggtggtagattttggatggctcttgactcttcatctcacagtgtatttacagtagtggtcctgcatcaaaatcagctgacaaactggttaaaacacatattgctgggcccaacccttagagtttctgtttcagtaggtcttgggtggggacctgaaaatttgcatttttaagttcccagatgatgctgatgctgctggtccagggactgcattttatgaacctctgctttggaacattggtgtccaaatctgactacgtaccagcctcaaatgtagaatgttaaaagtatataacttcctggattggctgtaggcttgaagaatcagatactctgggagtgggatccaggaacctgcattttgaaatagattcccagctgttatttctgcagtggtcctgacaatattttggatagttactggggaccacagcatctgagggcactgatcagtcagaccacctccccccaccctttaggcaaagtgacagagaggctggtgtatttcttcctaacaggatggaagcagccctgaagaaaatgatgctttcttactggttaaaggattatagtgggccaggcacagtggctcatgcctgtaatcccagcactttgggagtctgaggtgggaggataacttgagcccaggagttcacgaccagcctgggcaacaaggtgagactctgtctctacaaataataaaaaaatgaggtaggtgtggtggctcacgcctatagctacttgtgaggctgaggtgggaggatcacttaagccagagtggtcaggctgcagtgaaccatgatcgtaccactgtactccagcctgggcagtatagtaagaccctgccctgtctcaaaaaagaattacagtgaagattaatataatctcacacaaatattcagaaagtaccattgttagtactttaaaatttttaattgaaatcagatgtcaatttctacctcttaaatgagcaaagcattgaaataatttaataggttagagatagtgggttgaaatgcatactctcatttattactattggcattataaactgatacgctgtcttcgaaaagcaatttggcaacctacatcaagatccagaaaatgggccaagatccagaaaataggccaggtgcagtagctcatggctgtaatcccagaactttgagaggccaaggtaggagaatcacttgaggccaggagttcaagaccagcctgggtaacatagcaagaccctatctctacaaaaaataaaaaattagcccatgtggtggtgtgtgcctgtagtcccaactacatgggaggctgaggtgggaagttcccttcagcccaggagattgaagttgcagtgtgctataatggtgccactgcactccaggctgggtgagagagcaagactctcttttatatatatatatatattatatatatatataatatatatatatggccgggcgaggtggctgacgtgtataatcccagcactttggaaggccaaggcgggaagatcacgaggtcaggagatcgagaccattctggccaacatggtgaaaccccgtctctactaaaaaatacaaaaattagctgggcaaggtggcacgggcctgtaatcccagctacttgggaggctgaggcaggagagtcgcttgaacccgggaggcagaggttgtggtgagccgagattgtgccactgcacaccaacctcgatgacagagcaagactccatctcaaaacaaaacaaaacaaaaagtatatatacctttttttaatttaaattttaaaaacagaaaatatttttatttaattttgtaatcttgatataatgactttttttttttaattttttcagacagagtctcgctctgttgcccaggctggagtgccatggtatgattacactggtgggattacaatggtgggattacaggcgtgtgccagcatgcccagctaatttttgtgtttttagtagagaccgggtttcaccatgttctccaggctggtctcgaactcctgacctcaggcaatccgcctgcctcagcctcccaaaggaattacaggcgtgagccaccatgcccgtcaatttaacaaactttgcttcagtaatgtcacttctgggtattaatccaaagaaaataatccataatatattaaaatacacaaatgaatacatattacagtattattgtaatagtaaaacactataagcagtttgaatgtctaaaaatagggtattgatgaagtaaatacatatacttgatggacttttataaggaaatttaaatactggttgtttattcattcatacaaaaaaaaatatttgccaagatgtccccaaagggttaatttgcacttttcccagcattatatttgcatcttcaataataatggacattatcgtcttttaaaatagctgtcaatggtattttgtgctgtttcatgtattacttttatagtggaaacatgctattaataaaattatattttctaaaagattatgtcagttagggagagatgcatatcaagtgctagggctgaatatcagtgtttttatttcttttagttcctgtaattgtatgcagcttaaattttgaactggtctaattcaggataacttttgcatctgaaaagaactattcattgaaggcctgatggtgtcttacttgttttcctcttactgaaccctatatatttgtttgattcctttaatttttattgcccatgaagaacaaatttctcatatgtatattatacttgtattcatcgaaataaggaatcatatctaaaatatatcaggagcctttaaaatattctaatatttaggcctattaactgtatatctgaaaataaatagtagggctctaaagcaaaatggttttaacattttaaaattatccaaatagtagaggaaatataagaaaattatatttataaggtggttaagaaaatgggaagatataataacattaaatggaaaaattatgattgtactatgtaaaataaattcattattatactgtgtaaaataaatgtactatgatcataactatgaaaaaataagcatttaaaatactacaaaaattctaaaatgctagcctggttctacttgaagcatgagagaattcaattatttttttctttatacttagatgtattttccaaatttcttctatagtgagcatgtagtgcttttatatttagaaaaatgaaaatatataaagactatttcagttgaaatggacagaaatacaactctagttcaagccaaaaagagagagaaattgaagggagtagggagagagaaagagaattatttcctggatgaatttggcttcaggcccagatggaaattaatcgtcaggtctctctctttccccctcccccaatatctcagctccgcttcctctgtgtggtgacctcattttcttccattttccaggctgccagacaagtaggttgcccacagctctaggcttacatcatctgctttaggaatcccagtggaaagagactgctctctcccaatgtctctatatcaattccagacaagaattcttagaggtgctgcttggcccacatgtccacccctaaactaatcacagtctctggggaatagagtattaagattgggcaggcttgtgacatatgcccacatctgtcccagagaagaagatatggcactggaagagagaaatggcatcatggccagacaaattaagaaagatactggggactgggagtagtgactcacacctgcaatctcagcactttgggaggtcaagacttgaggattgcttgaggccaggagttcaagaccagcctgataaatatagtgagatcatgtctcttaaaaaaaaaaaaagaggccaggcgaggtggcttacatctaacaatcccagtattttgggaggccgagacaggcgggtcacctgaggtcagaagttcgaggtcaacctggccaacatggtgaaaccccatctctactaaaaatacgaaaattagccagtgtggcatatgcctgtagtaacagctacttgggaggttgaggcaggaaaattgcctgaacccaggaggcagagattgcagtgagccaagatcgcgccactaccctcccgcctgggtgacagagtgagaagccgactcaaaaaaaaaaaaaaaaaaacacacagaaagcagtgactgaaagtctaggaactgtgggccatggtcctgcaatgcaaatgtcatctaaatttgctttcctggcagtgaaataagttcttgctgccctgggtctgtacatgtgaggaacaagtctccctcacctatcttattccagaactgcacatcttccaccaccaacttcttgttggcctgattatggagactgggtattgtcttaggctttgaacaattataggcttgtttccaaggtggggttttcaggccatacaagtcccttcagacctcagctgactttttgccaattttatacaaggggattccatagcctaggcactaataccagaaatcttaccatgcctttgcagtttctgccttttaacacatctctgctttgcccatcctgtaggctttcaaagtgcccatcctatagtaccccataatgactaacctgcgtctgctgtatctcagtggatagtgttttgccacaggtatgaattttaattatggttggcagggaataacacagttgcttgagagagagggatgagggaaacaggattccctgaattgtaggctcttaccaagtccctagtgcatttcctgcctctctcctttgtgttagtttcaggttggaggacacagttcagctttttcaagtcagcaggaataatcattgtttgacccccagtggttctggattgctggctgaaggcagaacaggacttcccacgtgctgttgcatttctgctttcagacaagtgagcttggattcaaacttgtcccttcctcctagcttagcagggcttcctcttagtatctccatgtttgcatcatcctgtctggcagtgtgttcacagaaatggggcactgtgtttgactgagcctgggtcatgtgcccatttttgagggggtggaatttattggagaaagagagaaagagtgggaatacattctgaagtagactacaagctatagtctaacccttcccttcccttcccttcccttcccttcccttcccttcccttcccttcccttcccttcccttcccttcccttccccttccctcccctcccctcccctcccctcccctcccctcccctcccctcccctcccctcccctcccctcccttcccttcccttcccttcccttccttctacaggtatgaaaaatctataatctttttaaatatttttatttatttatttcttattatttttttgagacggagtcttaccctgtcacccaggttggagtacaatggcatgatcttggctcactgcaacctccgcctcctgggttcaagtgattgtcctgccccagcctcctgagtagctgggattacaggcacgcaccaccacgcccagctcatttttttgtatctttagtagagacggggtttcaccctggccaagctagtctcgaactagccttctatagtgagcatgtagtgcaagtgagtcaccgtgcctggcctgtaatttttttttttttttgagatagagttttgttcctgttgcccacactggaatgcaatggcatgatctcgactcactgcaacctctgcctcctgggttcaagtgattctcctgcctcagcctaccgagttgctgtgattacaggcatgcgccaccacgcccggctaattttatatttttagtagagatgaggtttctccatgttggtcaggctggtctcaaactcctgacctcaggtgatctcctgcctcggactcccaaagtgctgggattacagatgtaagccaccagcctataatctttaaagaaaaaataattagtgttttacataaaagtatttatttatttgtttatttatttattgagacagggtcttgctctgtcacccaggctggagtgcagtggtgcaagctcagctcactgcaacctccacctcccaggctcaagccatccccccacctcagcctcacagtcctggctgcgagtggctgggactacaagcacgtgcagctaatttttgtattttttgtagagacgcggtctctccatcttgcacaggctgatttcaaacttctgggctcaagagagccccttgcctcggcctcccaaagtgctggggttacaaacatgagccactgcgccccgccataaaaatctttaaagctaaaactgtaaatacatgagtagaaaagattcttaggatcatatcttaatcttcaaaaattacaagggccgggcgcggtggctcatgcctgtaatcccagcactttgggaggctgaggcgggcggatcacgaggtcaggagatcgagaccttcctggctaacacggtgaaaccccgtctctactaaaaaaaaaaaaaaaaatacaaaaaatttagccgggcgtggtggcgggcgcctgtagtcccagctactcaggaggctgaggcaggagaatggcgtgaacccgggagggggagcttgcagtgagccgagactgcgccactgcactccagccatggcaacagagcgagactccatctcaaaaaaaaaaaaaaaaaaaaaaaattacaaggggaggctgggcacagtggctcacggctgtaatcccagcactttggaaggctgaggcgggcagatcacttgagttcaggagttcaagaccagcatggccaatatagtgaaactgcatctctaccagaaaatacaaaaattagccaggtaatggcaggtgcctgtagtcccagctactcaggaggctgagacaggagaatcgcttgaacctggaaggcaaaggttgcagtgagccaagatcatgtcactgcactccagcctgggtgacagaattggaccctgtctaaaaaaaggaaagttacaaggtgatctcaaataaaatgagaaagagtcggagccagagaaaaaggaacacagcagaagactttgtcaccctatcttcacaccatcagaaatgcaagagccaatcctgtaaatattcatcaacttccttagcttttctttcaacaacagcttccaaatgtttaacacgtagagtctaaatttcaaaagtacttttagaatgtggcttgctcagtgctatatccatcattttcatttacatatatgttttgttttcataacaatatgtttgatgttttgttttgttttgagacagagtctcgctctgtcactcaggctggagtgtaatggcgtgatctttgctcactgtaacctcagcctcccaggttcaagcgattctcatgcctcagcctcccaagcagctgggattacagacgtacaccaccatgcccagctaatttttgtattttcagtacagatggaatttcaccatgttggccaggctggtctccaactcccgacctcaagcaatccgcctgcctcagcctcccaaagtgttgggattacaggcgtgagtcatgccaggccaatatctacttttaacctaaaaaacctcatttttagttttatagtatcagcagatttcctccccagtcaagagctttctgccagctttgaacttcctcacccagagatgcttttgcatcttggttctctgtcttgtttttcctcatggccccatgttcgatccagatccctgttgcagtgagcctagcccacttattcatggagatagactggaaaatataacttcaacatgctgttaaatttttttgagtttttaaaaataaacgttttacttcagaacaattttagatttacagaaagttgtaaagatagtacagaccgtctctgcatatcttccatccagtgtcccctaatgttaatatcttacctagccagaatatatttgtgaaaaccaggaaattaacattggtacattactattaactaaactccagactatatgatttcaccagttttccactaatttttttttaattccaggatcctttccaagatagcacattgtatttagtgagctaaattttgaaacaaattattttttcaagttgttccctgttaagctatgacaattatgaagagtatggcattttaatatttaagataaactattcattagcaaaaacaacacaagttgtcaagatgccacttgttctgtgattataagctcctcggggaagagcctctattatttgtttggcacattctagctatatatagtttcgtacattctctgtaggatgtagttttcacagcagtaagagttgagagaagtataagaagtttaaagtattttaacttttagtggacaacaagctcattctttctaatgtaattagcagagttagaattttgttcttatgtcatgctataaaagatagtgtgaatatatagcttattaatacattacaagtctaatcgaattattgcagtctgagccacagaaactgcaaaagaccacagaaagagattctttttcaaccatcttctccagggggaaaaggacacttgccaacaaaaccccaaatctctctctaggagtaatatttggagcaatttgggggaaagtaaaagttattattctttgcaattttaaataaagacattttcagactggtagaagctatcttatattcaaggctcttttaaagaatctacatataactttcattttaagagaccagtattttaggcattaaaacaaaagagctataaagaattctacttgaagtcaattcaaggacttaattcaatccaagagaaatacagagcttagctgagtatatattccaatctagttcctgccacagttaggaggtatcttcaggagctatcatcaattataggatgacatgcaaaattcttgtagaaagcatgtgctcactctctcccagaaaaaaaaatgacttacctattttgtaaaatccaaagaaggcaaagacagaggaagaatgcaacaaggagcaacaaagtattttgccaagcattagaatataaagaagacaaatgaagatattatatatttaactcttcatttggcaatttattttctggaggaataagaaatatagtaatttacctaattaataaaaagagaaaataaaatatttacatagcatcttattacattctaatcacttgctcatgtataatatcttgaaatggtaactggcgactatattttaggcacagctaccatgggtgctggcacaaagtaagcaaggtctcattgtcctctgaaggcttttcgaatatcacttcccctgggaagctctttgattattcccagctccactatgagggtagtatctgctgtctgtcctgtatgttcctaacatactcaaccaattaatttttaagtaattaatttctatgatagcacttatcacattgtcacctctatagggacactattttatgcaactttttatcttcataaaaagtaaagctggccatggtggtgtgcacctgtagtcccagctatcccagagactgaggcaggggattacttgagcccaggggtttgagtccagcctgggcaacatagcaagaccctgtctcttaacaaacaaacaaaaagtaagtgacagtgttatcggctgaattatgttcccctgccccacctatatttgaaatcataacccccagtacctcagaatatgactgtatttggagatggaagagtcttgaaagaggtgattcagttaaaatgagatggttagggtacatcagttaggatacaactgatgtccttataaagaagaggaaatatggacacaaagagagtagccagtagatacgaatacagaggaaagaccatgtgaggtcacagtgagaaggtggccaactgcaagccaagaagactgagaagaaacaaaccctgctgacaccttgatcttcgacttctaggctccagaactgtgagaaaataaatttctgttgtttaaggcatctagtctgtggtgttttgttatggcaaccccagtaaaccaatacagacagtcacaggtaaatgacaaatagaaagtgttttaaaaatgagagctattatgtgtaattggcagttactctgtgtatacatcttgtatatagattatttatgcacatcattagcaagctttaggaatttatgtctctgcattcatgcttcccttatgattgtctttaagttccatgaccgtctctatgtctgttagggagttgagtgaattattgtttttcaagctttgcattcaagacattttgagagaattcttaaccattacaaagacttctatcatacataaaattgattccctgaggtaaatcattgtgtcctacaattcagttgtatgaatgtttcattcaggtaaggggcacagaaaattatcaggattcaaattaattcagaaggaaaatagctctggatttttcataaatttgtattaacttttttcagaattcatttagatttttcataagataatgtgagaaaataatgtaagagttttgataattttttacataaaatggggaaaattaaattaaaaatgaaaacgtttaagttattgctgttaggtaaaataataaataaataaataatttcaggtcttacctgtatgattcatggagtcatagccaaaaatgtaacggattgcatcattctttgctctcaatactgcaagggcttcccctgttcaccttgtctcgagggctctgaatgatctggctccaggctacctgctctgactttattttctaccttttcccccttttctctctgggcgttagccacaaggtctccttcaggatcctgaaatacactaattccatctggctttttctgagtcacatgacttctcctttctctttattccaagctctatttaatgcacctgatcaggtcttccctaatcatccagataaacagcatctctgtcattctctttctccttacctattgttttcttcttttttcagagcatctcttaatacctgggcattatatctttgtttatctgtttattgtctctctcttcctactccattttcagctccccaaggacaagagctttgttaataaatactattggatgaatatctgtagcatcacacactgaagtctgacataacagcttttcatagtccttaatgatataataaatattggaatgcagcaaataatgatgaagagatgtatccaattatacactgattacattatgttgtcccagaaatctctatatttgtcattgtgctctgtgtgtttgacccctttgaaggtgtcttctgctcagaactttcacccagtgtctcacaactgcccctggtcctcagaaataaatctttggtaaaagcaacactgtttaatagaaataaaatacgtgccacatatgtactttaaaattatctagtaatagtaacactaatagtaattaaaatgaaatgtagttctacaaaaataataaaattgtgtgtaatggaaaaaaattaacattgcttcagttttaaaatttaaatcaataaaaattaaataaaataaaaaattcagttcctcagtgacatttcaagtgctccatagccatatgtggctgggggcttctgtgtggagtagtatgggatataaagcacctgatgctgcctccaaggcatacctgattggagcagcagcagcctgatccaatcagattcctctccccaggattttgaattttgaactgagatacagagagaccagagaagtttggcgctgagtcatgcttgtggcagaattccaagggaaggttcatgagcagctgttgccagggtccccagagcttccttagcttccgctcttcatggttggttgttcagttctttggattctgtgagagagcctaatatatttccaataaattattttctcccttgagccacctcaagctggtttctgttacttgcaatgatactaatttaaataaataaataaatcttagcaacaacgttttcttaaaaggagatacataaaataacgtaattaggcagatgtgtatgcaaaactgctttgactactttagaaaatcttaattgtccacagtgttatcgactgtcaacaaaatggaacacagtgtagataattcaagagtaaactgatacaaaaagagcatttatttggtcttgaaacgcatttgtgtgaattggggttggggatgggggcagagcaaaaacaagatacagctttctaattgttttacagagaatttaatcagcacgaattctccaagaatgacactgatcacacagcaggtgcttgataaatgcatgttgattaattgatttagaatacaccagctgtcggtgaaagaatgtgatccacaatcaaaccatttgacagaagaaagccaggatggcttttaaaattagtaacaacatagaaatctacatgcaaataattcagagatggtggtgctgtctttggttcccttcctagatgagaacaagataaatcatactctgctttgggaagaaggtattcagtgtttaaggctgtaaacagaggaacacattctccagtcatttgtttctagcagtatgtatgtatccgggaggccttctgattgcagataccaagttgtgggaaggagaaaggcagtgggaagcatatgtgatcataagtgatctcccctgatcctggtgagctttgaattttcctcctcttaaatttcataaggttgaaaaagagaagtaaaaaagacttttggaaagccaggcttaaatgggtggaggggaatctaatcaagcctctagaacttctactggtttatagaaagtatcagataaagaatgcacacagggacgcaatcagccaaatctaggaaggggaaaattctacaggacaaatgacctggttttttcaatagataataaattctagaattattttgtaaataacatgattgcattggacgacagtgccccctggtagaatactgttttaggctgggatccctagatacaaattctgggtggggagttgaaagcagaagtttactgcagcaataccactgtgaggaagtaaggaaggtgggactggacactgaagaaagtgaccacaagggcaggtgcggtggcttacacctgtaatcctagcactttgggaggctgaggtggtaggatcacctgaggtcaggagttagagaccatcctggccaacatggtgaaaccacatctctactaaaaatacaaaattagctgggcatggtggctcatgcatgtaatcccagctacttgggaggctgaggcaggagaatcacttgaacccaggaggcagaggttacagtgagccgagattgagccattgcactccagcctgggtgacaaaagcgaaactccatctcaaaaaaaaaaaaaaggaaagtgaccccagtgaggtttcagctatggcctcagttatcctgtggagaattatggagtggggatggcccttcaggattgtctcaaagtgaggcaaggggtccaggctatgtattcctaccctcagccagtcatttgacataggccacccctggtaagggtataactttaggagaggcagttcattgcagccaagaggtgtaccccacagaaaacaataatatccactacaataatataaaacaattaaatcctgcaagtaggtcgggtgtggtggctcatgcctgtgtagtcctagcactttgggaggccgtggcgggctgatcgcttgagcacaggagttcgagaccagactgggtaggcaacatgtcaaaaccctgtctgtattaaaaatagaaaaaaatgagctggccgtggtggtacatagctgtgatcccagctactcaggaggccgaggtgggaggatttcttgagcctgggaggctgaggctacagtgagctatgatcataccactgcactccagcctgggtgacagaggaagaccctgtctcaaaaagaaaaaaataatatatcctgagattagtgacacttcgctattattcaaaccataatttgcataataatggaattttatttatagaattctaaaatatcattactataaaaggtctggcattttatatcaattatcttccgttgttctatattttgacatagagaaataaagaattgtgttatactaacttgttaaactttaattataccaccatttctggaaccctaggtgggggcactttctttgcttggttctcaggctgccatacttgtttcttcctacttcactggccacttcttcctcatcttctccaatgactgctccccatgtctggccctgaattttggagtggtttagtaggcttagttctcagacctttttttttttttttaaatctactttcatttttaaaatgttctcatccagtcttggctttatgtatcatgtataccttcatgagtcacagatatttatcatatccatgaaatccaggctggtgtatccaaatgcttactcaatgtctctacttgagtatctatacacatcttaaacttaacatgttccaaccaaacccattattttttcccaaattttttgaaatctcccacagagatttcaaaatctctgcaaataatagttgcacactctaattgatcaagccaaaaatcttgaactcactcttgagtaatttaaagaaaatttcagacattatgtcaagtcactcgcagatatggcattttgcatctgtaactgataagaacttttatttttcacataaatagcatacgtaccaaaattaatgtaattaatatcatctaatacctggtttgtattcaaatattactaattcttttctttttcttttcttttcttttttttttttttggagacggagtctccctctgtcacccaggctggagtgcagtggtgcgatctcggctcactgcaacctctgcctccaggttcaagtgattcttgcgcctcagcctcccaagtagctggaattacaggcacacaccatcacatccagctaatttttgtatttttagtagagatggggtttcactatgtcggccacactggtctcaaactcctgacctcaggtaatccgcctgccttggcctcccaaagcactgggattacaggtgggagccaccatgcccaatccaaatattactaattctttccaagatgccattttacagttgttttgttcaaactaagactgaattataagggataaagtctataaactaatataaaatatgtcagatggttattaatactgcagagtagagaggtaaagtaaaaaggactatttggttggctgtttaacccagagtgttcaggaaagtcctctatgagaaagtgacatttaaacagaaatgggaataaagtgtttcaaggagaacataatcaactgtgtcaaatactgcaaatgggttacatgtaagaggatgactgaggcttgatctttggatatgacaacaggaaggtcactgggtaccttgactaaaactgcttttgtggaatggtcgaggtaaatgcctgattgaaatgaggtcaggagagaatagaaggagatgaagtggaaacggtaaatatagacaagttttttcagataaggggagaaatatagaagaaacaataaatatagacaagtttttttcacataaggggagacgacaagtgggacattggctagaagggatgtggaaaaatggatagtttttttttctaaaagggaatattacagcatgtttcatactagtaggaatgattcagtagtaagaaaacattgatggtgcaggagagagaataattcctggagagagggccttgagaatgtgaaagagggccgggcacagtggctcatgcctgtaatcccagcactttgggaggctgaggcaggcagatcacctgaggtcagaaattcgaaaccaacctggccaacatggcaaaaccctgtctctactaaaaacacaaaaattagccgggcatggtggcacacgcctgtgatcccagctactcacttgggaagctggggcaggagaatcgcttgaacccaggaggcagaggttgcagtgagccaagatcgcactccagcctgcactccagcctgggcaacagagcaagaccctgtctcaaaaataaataaataaataaataaaataaaatgtgaaagaggatggaattcagagcacaactgcagagtgtgtctttcgataggaggatggacagtgtatctacagtaacaggagagaaagcagaatatgtgggcactgatgctggtagctatggaaattttctcagtgaagtaggaagcaaagtcatcagcagagggatcagcagatgatggagagttgaagagggaaaaggaatgaaatagccctctagaagagttggagagtaaatgggctagggaatgtatgggaatctattaaaactcatttgaaggtggagctatgaatttgcagtatcttctgcatggttggttgtttttctccagtcacatttaactgctgggtgtgacataggaagagagctggatttaactgggcctggagtttggccataaagcacagtgaaggcaaagagaggaaagatatttaagagtgtatgcaaaaataactataatgatggaccatgaaatacaagctggagaagtagaaaagagtgaacttaacagggagtgatgggcagtgaaaaggcggtaatggcctataggtttcaggagtggaaaaattgtgggagtcaaggaacagtgagagtgagctggaaaaatagaaggtgctggtagatttaaggcaaaaatatatagtctaaaattaagagaattgagaaaatacgcagtcatatgaactgatagtggtaatgtaaatcagtatcaccttttttgtgtggtagcatcatggcaatatctaaaattgccatgttacggagcatggtggctcacgcctgtaatcctaggactttgggaggccaaggtgggcagatcacctgaggtcaggagttcgagaccagcgtggccaacatggtgaaaccccatctctagtaaaaatacaaaaaattagcttggtgtggtggcgggtgccaataatgggattgctgggtcaaatggtatttctggttctagatcctcgaggaattgccacactgtcttccacaatggttgaactaatttacattcccaccaacagtgtaaaagtattcccatttctccacagccttgccagcatctgttgtttcttgaatttttaataatcgccattctggccaggtgcggtggctcacgcctgtaatcccagcactttgggaagccgaggtgggcggatcacctgaggtcaggaggtcaaggccagcctcgccaacatggtgaaaccccatctctactaaaaatacaaaaattagccaggcgtggtggcaagcgcctataatcccagctacttgggaggctgaggcaggagaatgacttgagcccaggaggcggagtttgcagtgagccaagatcgcaccattgcactccagcctgggtgactaagcgagactgtctcaaaaaaataaataaataaaaataaaagaataattgccattcttactggtgtgagatggtatctcattgtggttttgatttgcatttctctagtgatcagtgatgttgagctttttttcgtatgtttcttggccgcataaatgtctgcttttgagaagtgtctgttcatatcctttgcccactttttaaaggggtggttttttttttcttgtaaatttaaaactctgtaatcttaaacttgaatagtcttttagagtacctgtagactccctgtggagaggagaataaaatcctagtatctaatttttctatcaataatatttacatagttacaatgtgtcaatgattgttagtggttttcagtttttttttttttttgagatggagtctcgctgtgtcagccaggctggagtgcagtggcgcaatctcaactcactgcaagctccgcctcccgggttcacaccattctcctgcctcagcctcccaagtagctgggactacaggtgcccgccaccacgcccggctaattttttgtatttttagtagagaaggggtttcaccgtattagccaggattgtctcgatctcctgaccttgtgatccgcccacctcggcctcccaaagtgctgggattacaggcgtgcgccaccacgcccggcctcaatttttagcagtagcctaaaagcaaaacagagaaaacttaaatgtggttatgtcaacctttgtaatgtgaaaataacagtataagcacagatagcaggaggaagagggagaacatgaaaagatgggaattaatctcatctactacagtgtttaccagtaaatcaagaaatagtagtaaaggcccattgtttagaattaaagaagtaaccatcaaaaagccttggtaggaaggtctgatggcagatacttgtagtcccaactacttggaaggctgaagcaggaggattgcttcagtccaggagttcaaggctgcagtgagctatgatggtgcctgtgaatggccactgcactccaacctgggcaatacagcaagactccgtctgtttgaaaaacaaaaaacaaaacaaacaaacaaacaaaaaaacgagaacaagaaagccatgaaatagcaacagttaaaagtggtttcctctgagaagttcaattaggggtgggagagggtggggcagtagaacaccttttttatttttcattataagccctattacattattgttttttttccatgtatgtaattattgtgataaaatgttttaagataagaacattttaataaagaaaggggaattacttacaattcattatgcctggagtttaaattttatcagttttcacagaagttcctgggtgggattggttattagaagatctatgggcatgaacagcagaggagggaggaagagggagagggtaatgggtatattcaaatataaaatttggttgtcagaagtaattttcagtatggtacaatgtatatttatcatatttttaatccaactgtgtcctagcaactagggccttgggccaaatccctaaggagagacagccattactttagaaagagtgaaatccctggattctctaaaagtgagatgtacaaagcaacactgttctgtagaggtctggaggtgacagggaacactgctgttgtcctaacagactagggcttcagtctggatatgtaccaagaagaatcctgggcaccagggcactccttgcagaagcacatgtaattaattttgagggaaagacaaggctttgcattgctgtgggtataggtgaaactagaaaaatactgtccccttaatgttgttataatctatagtagccacagcctggtgtggcctataaaaacatgataagcactgttgattttatagcaaaatgcttttaggaagataagcagcattataccatgattaaagatacatttacaaatgaacacataaatgctataatggtaaatctcaaatataatccaacaacagagttttgatttgacagagatgcaaggataaacctttccggttgcagcattatgggggataacatgggatagagtatgttatttttccctattatttgctgtcctccctataaaaggattatgtttacccattttcattaacgttaaccttatgacttgctttgcctatggaatgtatgcagaagtgatgtatgccccacatctaagcagaagctttaaaagacatctggtggttcagacgtgaggtctgcgtgtgctgcatcgtggttgctcctggaataaagatcctagaacagagctataaccacagtgtgtatagtggatgagtaattaacctttgttattgtcaagccactgtgattttgttttctttttgttgttgttgttccgcaacataacctactgaaagctaactattacatagcataagcttaaaacactttcgctaccaactctcagaaaagctagttccattaccattatagcaaacataattataaatgcataaactcccaagaaagtaagggaaatatccaggaccactaaacgaaggggatactgaaacaaagtgtaagttgttaaaatgatgctgcagctataaatagtaataagaaacaaagagaaatgcaataaatgaacctttaaaaatctataaaagaaaacggataattttttttttttgagacagagtctcactctgttgcccaggctggagtgcaatggcatgatctcagctcactgcaaactccacatcccagattcaagcgattctcctgcttcagcctcccgagtagctgggattacagttgggtgccaccatgcctagctaaattttgtatttttagtagagatggggtttcaccatgttgggcaggctggactcgaactcctgacctcaagtgatctacccaccttggcctcccaaatgctgggattacaggtgtgagccaccacgcttggctagaaaatgggtaatttcttaaaggcaagtgagaagaagggaaatattaaaaacaaaagcagaaataaattgagtaatagaaaacagaacataaaatacatgtagccaatgactatatctatttgtttaaaaatggtttctagagcattccatctccctgctgtggtcccactctcttacaattaggcttgatttccaaactgtcatgggtttgatattcaccaagagaaagcaaatacatatttggcacattaataatatttaacaacaatgaattatggttacatatagaaataatttatgttctgaacaaatgtttatgcttctgtaaaaaataaaatggaaaatattctgtatcagacactacatcttcaccatagacttgtcacgatctaggtcagtgttttcatttgagaatagaaacctactggtaaatcataaaatcagtttaatggttataatttacattaaaaaatagaaaaggtgctccctttggcagcacatatactaaaattggaatgacacagcaaagattagcatggcccctgtaagaaaaaaatagaaaagagtagaatttgaaaatatcattgtgcagtgcatgtaggtaagtactgtttcatgaaatattagtctcatttctataatatgtgtgtgtcctaggttgagattaaaatgtatattttactgtaggtggagaagggaaaaaaaaagtttgaaagttgctgactttgccccctgtgatcaagtgatgctcaaaatatttcacaactggtaatgcttagtcatagcccagtcagaatgaaagctggctgcgatattggaatcctgctatgccaggggttactccttttatgctagactgagggtcctaagggaagggtcaggatggccgaggcactagggggagttggtgcagtgactttatgggtgtatcagttttctattgctgcagtaacaaattacaacaaacttagtggtttaaaataacattaatttattatcttacggttctttaagtcagaagtcaggcacaggtctcactgatctaaaatgaaggtgttgacatggctgtattacttttcaggtgcgctgaagaagaataggtttccttgccttgttcagcttctagaatttgcccacattctttgattcatggtccatttcctctgtcttcaaagccagcaacattgcatctccctctgatccttttcccatagtcacatcactccctctgactgcagctgggaaaggtcctccactttgaaggatccttgtaattagattgggcccacctggataatccagagtactctctccatttcaatatccttaaccttaaccccatttgcaaagtcccttttgccatgtaaaggaacattttcacagattccagaggattagggaatgggcatttttggaggccacgattctgcatatcacaatgggtatggaaaagtttcattatctgaacaatcagcacaaccacacctgtgcatcctgccacagtggaactgaaaacaggtcacctgtgaaatcacccatttggagtctccattgcagcattccatgaatgtgtcttgaatgtttgccctatcccttctaagaggagagaggggaaagtttacgcttcacaaatataactcaatccattgctttcacatctccagtattttcctagaaggtttaactgtgaaatgggttgactacctcggacctaggagaactgagagagaattgtgcacaaacgtaagaaaagtatataacagaaatattcttccttttatcacaagtgaaaaatgtaaatatatagatgagcttattttaatacctatatcaatattaatttccattggtaatattaggcgttttatgatgacagcaagtgacagcttttaaaaaataaaaaggttccagaaagccatcccaacttttataattctaagctgtttcataattctggaaaaagtctctggaatagcatttcagaatagtatctcacaaaatatacttatagatgtaggatgtctgtgcacatacacatatgccctggaaaggagaaaagcttattttaaaaactagtgttttaagtgtataagatcttttaaaattaaatgtgctctactatacagtagaattttcaaaacaatctttgaaatgatctatgcatgtttaccattagtgcaatccttctgctcagcactgctctttgaatgctttttatgctaactaacaaaataggaattaactcattttcgaatcatttaattccggccacaaaacctcagtgaactctaacgaagcactttatcaatcagagtgagggtggaggaaataaaaagaagctttaaaaaattccacatcaggtatcaaatgatggtaatgtgagccttttacaaatgcttgtggatctgcctgagtggtatatgaaaaggaagttaatcttgggacataactctattatgctgttttactccgttgtctaaagacattgaaggatgctaatttaatctagcttttgtatttttggtgacttgctcttcttccattataaaggcgactttacagataattagtaagctagatttttttttttcttatgaatctcattggctcttgccacttagacaaaaggaaaggtttcagttgttgctcctctacccccatcctcaattttgaagacaaaatgctttctaattggaaaaaatggagtctttttcaaaatccatgctgcctttcatcatttttccttttctcatccatccttaactacctatcttggtcttgtgttactgccatctttttttaaaaaaaattttaatttttgtgggcacatagtaggtgtattattgccatcctaataaacctcaacagtaagatttcccaagaaatgattgggaagtgattaatgttttatatttgttcagtcattcagaatttcctatcaaatgtaactgattaaaaattatttaacattattttaattaatttttttttgagatggagtcttgctctgttgcccaggctggggtgcagtggcgcaatctcggctcactgcaacctctgctccctgggtttgagcaattctcctgcctcagtctccctagtagctggaattacaggcatgggctaccacgcccagctaatttttgtacttttagtagagaccatattagccaggctggtctcgaactcctggccttaagtgatctgcccgcctcagcctcccaaagtgctggaattataggcatgagccaccatgcccagcctgattgatattattgtgccagttacatttcttggctcaatgtcacattccctttctgcactctgttttataactgcagggcctggaagcctgtatactccatttcccagaatcctttaccgactggcttctagtcaaatttggccaatgagagttactggtgagaggaaagacgccattctgatctggcaccagtggtggaggtgtctcagtggccaattcggcactggccacatagggcctcttctgtgaaggtagagaattggcactggccacaccgtaacctccagcagcaaatgcagctagagggctccagcctaagagtggtagcagctctctcatctctgggcagccttcgttcctttctcccccagcctttccaatgcctttgcaaccgtttcccagaattaaatccctttgtgtttgaatgatgtacagtgttttttgttttcctgattgggactgactggctgattatagaccaaagtattcagaagctttgggaaaccaaggtgtttataagtcaaaatagtgtaatgcttttctggaaaccagtcttccctccaaactgttatcaggcaaattttatgcagttcttagtcctaaacacttgaggctccacccaaatgcaatggatcatggagtttgcttcctgtttcaggggtgcacatggcatagccagtgtgtggtttgggcaccctggaaagtggctatgggcaacggtggacatccttggcttttgggcagtacgaatagctaggttcacccgctgttcagggatacgtgactgaggtctcaggctctgctggttccttgaaaagtcgttgagaatatttagcgacttgcaagtgaggaaggaaattggtcaggcaatagaagttttaggcacctaactgaaggtggagtggtggcgtaggcgctctcctacccaggtcgtcatctatttgacaactgtgtccagtaggagtatttctggcttttgtttcacaaaccagggacttggatgggagaccccaaagggaatagtgtccattagggttagatttcctctgggtggttaaggctacgttggggagggtgcctgtggctgccaaaatttctgggctcctcaaattcttttctccaggaccagaagatgcatttgtcttggtctttacttaatgtctctctttctcaaatctgtttttgcttatcattgtaccctctgggcatagcaaagtgctacatgtattcattcattgaattattcattcattcaattaatattaaatgcctaatttattccccaaacatcaacataccaataacctcttcaaaagtttcagaatttgggtggggcacagtggctcatgcctgtaatcccagcactttggaggacaaggtaggaggattgcttgagccctggagttcaagaccagcctgggcaacatagtgagaccccatctctaaaacaataattaaaaatatataaaaatttttaaaagtttcagaagtttatgtcaattcatattgaacactcttacagtgacttcctgtaacaaaatctctatacacccttgaatctctgtgtacatatacatacagaaattatgtctttcttaatggattatgtatttcttaattgatctgtaaatcaattaagagattcataaattactatttcttaatgatttacagattttctggaatgttttcctactgttcttctaactctgcaggcaagagccctttgtctatatgtgataaccccagtgctcacaactccagtgagtttcaaactttaatgaacatagcataaaaagtaggtataactctttattttttatttttattttttatttccataggtttttggggaacaggtggtgtttggttacatgaataagttttttagtagtgacttctgagattttggtgcacccatcacctaagcactatgccactgtactcggtttgcagtcttttcctcaccaccctcgaccatttcccctgagcccccaaagtccaaaagtcggtataacttttgatcaaccaaatggacaataaacaaactttccattttttgggagactaaaaagcttagtaaaatgtttggaaataaggtaatacacataaataaggaaaaaacataaataaaatatatacagtacatataaaatattcatgtataaattaaatgccattcacaggtaccaaaaatactcagtttgaaataagtaattaaaaaggaatcctaatttacaatagcagcagatgtgaataagttaatgaactttgagggaaaatatattaccaatatgaagaaaaccagaagattcttctgaaaagtataaagtacaagaaaagcaatatgatatttttagaagactactattttaataatgtcgttctcccaccaatgaattaatatgcatagagcaaaatcccaataaaaaataatttgggagaacttgacaaaataattctgaaatttatcaaaaagaataaacagataagaatagctaatatccccagctatcataaaaaatgatctaacattacattaactttttttttttgagacagagtctcactttgtcacccaggctggagtgcagtggcacattcagggctcactgcagccttgaactccccagctcaggtgatcctcccatctcagccacctgagtagctgggagtacaggcatgtacctacaggcacatgccaccaggcccagctaatgttttgtattttttgtagagacatggtattgccctgtttcccaggctggtctcaaattcctggagtcaagcgatcctcccgccttggtctcccaaagtactgagattacaggcatgagtcactacccctggctacattaatttaaaaaatacatacaaaaataacaaggattatctcatgttttatattattttttgtgttcacattattattttaacaaaatatttttctatgaaaaatgcaagcagaaattttatattataaattataaattggtaaggttcagatgccatgagtagcatagtaaaaataaataaataaataaataaataaataaataaataaataaataaataaataaaaagaggagcattaaggtagtaagattttattttatcaagaattgggaccaggcacggtggctcatgcttgtaatcccagcactttgggaggccgaggtgggcggatcatttgaggtcaggagttagagatgagcctggccaacatggcaaaaccctgtctctactaaaaatacaaaaaattagctgggtgtggtagtgcatgcctgtaatcctagctacttgggaggctgaggcaggagaatcgcttgaacccaggagaaggagactgcagtgggctgagatcacaccactgcactctagcctgggcaacagagcaagacactgtctcaaaaaaaaaaaaatcttagtaggcaattttctccatgatagaaaaatatattttaaaacttgagtttgaactgttacatattcagctagtacaatatttcaatgttttcaatagctggattgcactcacatataatttcatttaaaattagcttagcttttggttttttatatttaggcagccaccattattcctaaatacttaagataatgacttaaatgatgaattcatttattaaatgatgaagtttcagcatcaaatgaatggttggtccaacctctctaaaagtggtactttgagatctgttaatcaaaagataattcattgaaataattcctttatcctattaggtcatttgaaaccaaaatccttctttttttttttttttttttttgagacaggctcttgctctgttgcctggagtggaaagcagtgacgccatcatggctcactgcgctcattgcagccttgaacttctgagctcaggccttccttcctcctcagcctcatatggagctgggactacaggtgtatgccaccactccaagcacatttttaaataattttttttgtagagacgagcggtggtgggggctgagggagggctgacttgctatgttacccaggctggtctcaaactcctggtctcaagccatcctcctgccctcctgcctcagcctcccaaagtgttgggattgcatgcatgagccaccatgcctggcctgtaaggctttttaaaatttgtatttttccctacttgggagctaacaagttaccagaatgtgttttaaatatacatttatactcctatagaaatacaagaagcaacatatgcaggattgttacaatagtataaacaccaaatcttaaagtttcagtaataatggatatggttgtggatactacatgtaaaactggtgtttactgaagtgcatagtttcagtgagtttttaaaaaagtgtaattatggtaatggattaggacaatggattcatctttgaaaagtagttcaatgatatgggtgtaatttcagtactaaagtgttgattcaattcttacagttctcattaaaattttttttgtaaaccttttttttttttcttttttgagacaagttctcactctatcgcccaggctggagtgcagtggctcaatcttggctcactgcaccctccaccacctgggttcaagtgattctcctgcctcagcctcccaagtagctgggagtataggtgcatgccaccacgctcagctaatttttgtatttttttgtagaggcagggtttccccgtgttgcccaggagggtcccaaactcttgggctcaagtgatctgcccacctcggcttcccaaagtgctgggattacaggcttgatccactgcacccgaccgccaaaggcattttttaaaatcacaagacagccaggactaaatgattaactaatatgtccctggatgctcaacaaaacaagaatacaatttaaagattagacacaagaacccataaatagttgtaaaccattccttagattctagagtgaaggagataactagtcataagaatgagatcttcagggaacctgtggagatggatataactggcactctcccaaagtgctgggatgcccggcctggtaaactcttttgttttctctctctttttttttgagactgagtctcgctctatcgccatgctggagtccagtggcatgatctcggctcactgcaacctccgcctcctgggttcaagcgattctcctgcttacccaagaccattttttgatataattatccataatttatacatggcaaaatgttcatgtccattatttaaaccaaatcacctattaaaaaaatagcaaaaattcagtaggattagatgcaaaaagtacagacagagctaaaagaatgttaacaaagggaaacaacagcaacaaaatgccaaaggtggaaaaaacagatccttctcagaatggcaaaataaggacgctcagataggaagtaagtgtcaaaccaaattgttaagatgccagtataaataattttggagacatgagcagagactgatactgattctcaactgtcaaaatattagaaatgaaaattatgtatgcatagtaaggacatgtttagtggtgaaacattctaagtttttaatgtactcatactgagtaaatttcatactttgaagctgcactgtccaatatggtagctactagccacgtgtgactacttaaattcaaattaattaaaattaaataggcctggacagtgcctcacacctataatcccagcaatctgagaggccgaggtgggcggattacctgaggtcaggagttcgagactagcctggacaacatggtgaaaccctgtctctattaaaaatacaaaaattagccggccgtggtggcgcacgcctgtaatcccagctactcaggaggctgaggtaggagaatcgcttgaacccagaaggcagaggttgcagtgagctgagactgtgccattgcaccccagcctggaaaacagagcaagaccccatttcaaaataaataaataaattaaattaaattaaaagaaaattcagtttctcagttgtacaagccatatttcaagctctcaagagccacactggacacagagcacactggacatgcagaaatagaacattttcattagggtagaaagttctgttgatgctgtcatggagtatgaccagttgtgagtgaaagggtcataattaagctttatcaatattacttacctggaagtttatcacaactactttttaattatccatgctatgagttacttctattttttttctttttctttatttacacacccttgctggcttgaaaagttacttttagaggcaagatatacaactagataaaacaagggtcaaattctttactgcctttttcttccaaggaagacttccttggaattttattatctataagctagtaagaaatgtaatggcttattgtggctattatcttccagcacctaagaaatgcaatagcttcttgtgaaaagtaaatatgcagcaacttttgacttggtataacatttcagatgctgaataactaggcatcattttattctttctgtgactgagcagaacagctgaggaaaataaaggattttgtctgctttatataatagtataacccatagcacacccagacagaaataatcttttatgatgagtttggtaggcacttctttaacatgtaggggtagaaaaaaaataacctctattaacagttaagggttttgaattataaaatgtctctactgtgatacaaacatttatttattttccacttttaaattttaaaaacagcattcttttcagaaatgccttaggaatatataaataatactgacatggataaaaatcattatatatttttctggaacaaaagagaaaataattgtatattatctagttctcttatgagctaaacatagctctgacactataattcaataaagatgtgatacaccaaaaaattttagtaagacaaatcctactataaatattagatataaaatagttaaaatgccagcaaacagttcaaaaatacattaaaaccttaacctgggctgggcaaggtggcttatgtctgtaatcccagcactttgggaggccaaagtgggagaattgcttgagcacaggacttcaagaccaccctgggtaacacagtgagacccccatctctataaaaactttttttttctttgtttcgagacaaagagtcttgctctgttgcccaggctgggtgaaaaaaaaattaaaataagcataatgaagagtatttcttacaatttttttttttgagatgaagttttgctcttgtcacccaggctggaatgcagtggcatgatcttggctcactgtatccctcgcctcccaggttcaaatgatcctcctgcctcagcctcctgagtagctgggattacaggcttgcaccaccacacctagctaatttttttatttttagtagatatgggatttcaccatgttggccaggcttgtcttgaactcctgacctcaggtgatccgcctgctcagcttcccaaagtgctgggattacaggcgtgagccaccatgcccagcctttcttaaaaattttaaaaagtcagttatacctggtaaagatgtattcttttgtcttttttttttttttttgagacagagtctccctttgacacccaggctggagtgccctggtgcaatcacagatcactgcagcctccacctcctgggctcaagggatccacctacctcagcctccccagtaactggggccacagatgcacaccacacatggctaattttatttgtatgttctgtagggacaggatctcaaaatgtttcccaggctggtatgaaactcctgggctgaagcaatcctcccaccttggcctcccaaagtgctgggattatagggtgtgagccactgtgcctggcctaaagattcattctttatcatcattattaaacatttcacattgtttatcatctttagtgactgtaataaaatacgaaacagaaaaaagagaaacagtggaagggcaaaaacaaaaaatatatattttttagaatatatgattgcatagcaagaaaattaaaaagaatcacctcataactactataattaataaaagaacacagatattggccaggcacggtggctcatgcctgtaatcctagcactttgggaggctgaggcgggcggatcacgaggtcaggagatcgagatcaccctggctaacacggtgaaaaccatcttggctaacatggtgaaaccccgtctctactaaaaaatacaaaaaattagccgggcgtggtggcgggtgcctgtagtcccagatactcgggaggctgagacaggagaatggcatgaacctgcgaggcggagtttgcagtgagccgagatcatgccactgcactccagcctgtgagacagagcgagattctgtctaaaaaaaaaaaaaaaaaaaagatattaaatgttaatgctgctaaaatcagtatatttctgtaaaatcatcaaaacccaattagaatgtatgtaaaataaactcacccaagcaaaatgagtgatatgcatgatctttataaggaaaactacaatgctgattgagagatacaaatgaagacttaaatggggaaaacaccatattcttcaacaggaaaaataaatatcataaggacctttttttttcaaactgtcttacagatttgatgcaattgtaattaaaacataatttttggatgccataaaagaatgattagaaattcatgagaaaacatattttatctgataataaaatacattactctcagataattaaatatattactatcagataattaaatgcattactacggtttaaaacaatgcctctgattaatctcccctcctctccaatattaatgggagagcaagctccctaagacctctgggtcacactgaagcaggatcttggttgatgttgatttcctttccttttttcccttttttcccgtggtctgccctctggtgatctaaatcagcacctacgttttcactgcagcaagacagttcacaacttgttatggaaagccaaggaattaggagtgagtgcctgggtcaaaagggcattaaatgacatcttccaatcctacttcctatataaaataatatgacgtcttggtttggcaaaaaacgctgacaatttttaaagcatgatgtttcttttctgtatgcttgcaaatttccataatgaaaagttaaaaatagaaacaacaaaaaattattgctcccacaaatatgtgaccaatatataaaagaatcctcagtcacattaacaattaaacaaaggcaaattaaaacaagtaaaaattttttttcattccagaccaaaaagaacattgaaacgctaataccttttagcgctaaagaggatatgggaaaataagcagccaatcttttggggagggtattactgctatcttttggagggcaattaagtaataccaatggaaaattttattgttccaaaaacatttcatatccttacacccagaattccacttttatcttatgaaaacacccagggaagaatgcaaaaatatatgtacatgaatgtttattgtaccattgtttatgagagcgaaacattgggaatgagtatgaataagtacttattaaataagttaagatacatcatacaatggaacacatgcatcttttatttatttatttatttatttattattttttagagacaagatctcactctgtcacccaggccggagtgtactggcgcagtcagggctcactgcagccttgacctcccaggctcaagcaaacatcccaccttagcctcccgagtagctgggactacaagcaggagccaacaagcccaacaaattattgttttttttgtagagatggtggttccaccatgttgccaggctggtcttgaactcctgggcttgagagatctgcctgccttggcctcccaaaatgctgggattacaggcatgagctacggcatctggcccatgcatccttttaaaagaaaatctctttttatcaacacagaaagatatccttggaaaattaagtaatgaaacaactcgtataaatgagaatggccacattttggttaaagaagataataatatacgttaatatgttcatttaaaaaaatgtggaggccaataaccaaacaattacaatggttttctttagatagtaagaaaaatgggagactttcactttcttcattgtgtagttctgtaatgtttgattttttcaaggcacatatattattgttaagctcaatgtcctgggttccaaatatgaatcttgaagttatcatcatcattttccccagaatattctaaaagggactagagtaaataggacactcattgatttccttacttgtctgacaaggataaagcccaagctagtggcctccacagtgggtgcacaagatgatccattgatgctcagagaaaaagtatgcgaacatcaacatacatattttaatctcatcctttgttaatttccattgtcaacttttgtttttaaatcatacattatataattatttatattcataaatgtatattacatgtatatcatttgtacataaatatatactcatatattacggggagtgttcaaacatttttttattgatggagtatctgatcaaaagagtttagagtccattaatttaggtcaaagctgcctttaagagaacttgaattagagctaaggtagacataaacattttccataagttagttgtcctccccaaagtcactaatacagtacttaaaaggaaaaaaatcaggaaaataggtgagaaaacacaatggaagacacatgaaagagtcaactcagtaagtaataaaaggtagaagagaagaaagtaaaacggacagaatgattatttacctatacacaaatcaaataataaaacaatggggaaaaccttaatgaataaagaaagggaagtcaaaatgcaggaatagtcccacaaaacatttagagatgaagaaaccacattctatcctgaaaaaaaagcaaattgtcaaacagttggaatttagaatgtaacacatctgtagttctatgttttcagcctaatgcttcaagcatagtatgcactcaatgagtaaagaaagaaaggattttaggttatagcattttacaccaaattaatgtgtttagctgcaatttgaaagcttaatgtgtttttgttatttctctattttaaattgagctgctgaatattttatagattatgagaaacagaaaacaaaaaaattgaaaaaacaatggcaattttgtgatgttacatttgcaaatgcaatgaaaaaggtaacaactcattgggagaatttcaaaatatgacaggtaattatttatttgccaacccatggaaacctcctctattcctttgccgttatatgagccaaataatcaaataagaatatttgcaatgaacttataatttagaacttctaaaatttctagagccagaataaaggcaattaacaggattaaagcagtgacctttttcctgctcttgaaagctgaattcattagtgacgttctatacggtctataaattattttttaaaataacacttccattgtgtgggtatttttaagcctattgctaatagttactttaagccctctgatctagaatgtaagcatgttttgttagtgttaaaacaaaatgaaatcctgttttgcagtagttacaactttaccatctctcccaggggcagcaaagataaatagattatttttaggcaaatgtaaggcactatattcttagattatcattcagatattcatcaaatattcaatgagggtttctcagtgccaaacattgtgttggagttggagatccactcgtgaaattaatgagtcagcctcctccagaattcacaatagtctttccttgattaattttgcaatatccaaactatctgagatatatctgtgcatgtgtatggatgtgtagactcatgaatataaaacactactataaaaaagataactacttaacatttaaccatgattattgtaggaggtgcaatacttaactcttaaaaaaagtaagtagaagtatctttaaaagccgcataatgtgtgattcaacaattctacttttaggaattcatcttcacaaaatgataaaggttagtggcaaatatttaattacaagggtgctcatagtagaattattattattgttgttattattattattttaagacagggtctcactctgttgcccaggctggagtacagtggtgtaatcagagctcactgcagcctccaactcctgaattcaagcaatcttcccatctcagcctcctgagtagctgagactacaggtgcttgccaccattcctggataatttttttttttcttttgcagaggcagggtctcgctatgtttcccaggcatatttttttaaaaagtgcaagaaacatcttagatcaatgcaggattgcttacataaattatgatcacacaatgggaaactaggtaatattaaaaaggattatgtagaagtgttttcaatgatgtggaaaaaattccatgatatatcagaaagtgaaaattagaagtttccttgttgcttaggtgtctagtacagaaaacaagtcctgactgtgctctgagcctgggcaagacacttgacctcacagactcagttcttccatctgttaatgtgtggaatttgtgttaccctcaaattcatatgctgaagtgatagtccacagtgcctcagaatgcgatatttggagataaggtttttaaagaggtaattaagttaaaatgaggttattagggggccttaatccaatatgactgatatgcttataagaaacggagattagtacataggctgtataggggtaagaccaggtatagacacagggagaagacagccatctgcaagccaagacgagaagcctcaaaggaaaccaaccctgccaataacttgatcagagacatagacttcagaactttcagaaaataaatgtctgccgctcaagccacccagtctgtggtaatttgttatagcagtcctagcaaactaatacaccatttaaaagagggagaaaatcttaatatcatctttatttagctcacaagtttgctgtaagtcaaatagatgtaatctctttgtaaactgtaaagtactatataaatgtgaataattgttattcacaaggtccttgaaaatgcagtcatgttgttacgatttgaattttatattcctttagtagggcagacactcagtatcagtacaggggatggggagaagcaagagatttcctagggctgcagcaaaaaacacaaatgatttgtcattgaaagaagaggcaaaataaaatgaatagttccttgcattcatgctgcaaatttttaagcaaaccgatacctaaactacatacaataacaatatctaatatgtattaagcatttactaagtacctagcataatcccaagtacttttaatatgtgttctcagccaggcgcggtggctcacgcctgtaatcctagcctttatcaaccccatggtaaaagtgcttggtgtgtgtatgtgtgtcatgtactgtgtatatatatttatttatgtgtgtgcatctattttagttttgttacatgtatcttttttttttttttttggagacagggtctcactctgttgcccagggtggagtacagaggtgcaatatcggctcactgcaacctctgtctccaggttcaagcgattttcctgcctcagcctcccaattagctgagtacaggcgcccatcaccacgccaagctaatttttagtagagacgaggttttgccatgttgggcaggctagtctcaaactcctgacctcaagtgatccactcaccttggcctctcaaagtgctgggattacaggcatgagccaccgcacccggcctgttatacatatctttaacattaaaatttgttcctatgtggtaagaacagtaaaaggagtaataaaattgccaaaataagttgtgattttccaagagatgactgtgctttgcattactgtgaaacactgaaaacactgctaaatgacctatgcgtaacacacacccatgctatcttcttactcttgccccagtacatccatatgcattgctctaacagtgtgcaagctgttcttctgagtttattttatgataagcgtattgaatacattatctcaaatctgtgtaagcatcctgcttataagaatctcaagcaatgaataaaaagaaaagccttatgttttaaggagaaaatgaaataataaaatattttgaaacaaatgagagaacttgcaggcctgaaggaatccacattgcccatttagatttagagatttagaaacaaggctaagaaaataaaagaaaggaaaactcttacatcatagttatctgcttccagtggaattgagaagcatttggaagagactgaagacaaagaaagactctaatgctgaacaatgagtgtggatgaggccgggcgtggtggctcatgcctgtaatcccagcgctttgggaggccgaggtaggcagatcacttgaggtcaggagtttgagaccagcctagcccggccaacatagtgaaaccctgcccgtactaaaaatacaaaaattagccaggcttggtggcgggtgcctgtaatcccagctccttggaaggctgaggcaggagaatcgcttgaacccgggaggtggaggttgcagtgagcgaagatgtcaccactgcactccagcgtgggtgacagagcgagactctgtctcgagaaaaaaaaagggctgtggggggggctatcattttaacctagtagattggcaaagactattttttaaaaatatttaaaatagggagcccgaggcgggcagatcacgagctcaggagatcgagaccatcctggctactaacatggtgaaaccccgtctgtaccgaaaatacaaaaaattacccgggcgtggtggcgggcgcctgtggtcccgcctactcgggaggctgaggcaggagaatggtgcgaacccgggaggcggagcttgcagtgacccgagattgcgccactgcactccagcctgggcgacagagcgagactccgtctcaaaaaaaaaaataataataataattaaaataattagttcagtaattttcccatgagaatttgttcgagggaaataatgagactagggttcaaaaacatatgtgcaagtatattcattacacaattgtttacgggtttaaaaaattcaagtaatttaatgtagcagttgaggtttggtcaaattaaccaagatatatattctttcatttagcaattctgctggaatctatcccttggaatagtaaataaaaccaacagttctcaggatgcaacatttataacagcagtttgtggaagcaaaaaatggcaaatccacagcacggaggaggaaaaagaaaaaaattgcacatggccaggcacggtgcctcacgcctgtaatcctaactctttgggaggccgaggcaggcggaacacctgaggtcaggagttcgaggccagcctggccaacatggcgaaaccctgtccctactaaaactacaaaaattagctgggtgtggtggcacatgcctgtaatcccagctactctggaggctgaggcacaggagaatctcttgaacccagaaggctaaggttgcagtgagctgaggtcacgccactgcactccagcctgggcgacagagcgagactctgtctaaaaaaaaaaaaaaaaaaaaggcacataatgatcatcttcatgcattcaggtaagatactgtgtgcacattcacaaaataaaaatagactaaaggatggtttatggaatactatgcagttgcaaagaaagcacaaatttatatttttaaaagataaagatataagaaaaaaattcataactgtacatataatcctatttatgtaaaaaatatatatatatatatggttgtctgaagatattttgggactccaaacaccttcacaatgaccactgaagaccccattccacaatggactccacctaaatgctgagttggagttataataagatttggttaccaaggcatttatttaagtgagtattaactttgctcttgcccttgaaaagctcctaattctagttatctttatccaagcgtaagagattaaagacccgcctgaagatacagatgcaaactgaccgtaagacaatcagcgagtctcacacagctcggctttgtattttcagacaaccctttaattacaaacgcctctgggccaatggtctgaaaatggttgggactgaggtgctggggatacaatgatgaactgcagccgctgaagccctgtcaggtggagacccggttacctcagaccctcactgagccttttcttttttcttttctttcttcctgtttttcttttgagacgcagtctcccaggctgcagtgcagtggctcactgcaacctcggcttcccgggttcaagcgattctcctgcctcagcctcccgagtacctgggattacaggcggcgccaccacgccaggctaatttttgtatttttggtagagacgaggtttcaccatgttggccaagctggtctcgacctcctgacctcaggtgatccgcaagcctcggcctcccaaagtgctggaattacaggcgtgagccaccgcgcccgtctactgcgcgttttctaaaccttggctcctacgcatttatcagaagagagagcgcaatctgtctatgacttccagccaatagctacacttcttttctcagccctcgtccactgttcttttttaaccaatcagaaacgtttttcaaacgtttgccctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaaggtaaaaaccagagcccgaaccgacaatccttttctcctctctcacaccagcggcgggcagggggttggtaaccacaagccatctctcgtctccccgaccccctgtctccacccctgtcgcaaggtctcgttcccctcaccaccttctccacccgcgtcatcaggtttagagctggttgtgtgggaggaattcctttcaccctgccaatgtgttccttcgcagacctgaaaacggggaccgagactccccttctctggggccgaagcgcacgtccgaagaacattagacttgaatcgtaaattcggtctctcaccctgtcccgaacgtttctgccctcggcaggtggactgtttggctgggcttcttcaacagctttgccagacttgagaggagaagcgtcggtttacctgagttccttatgatccctagcatttcgcccggtgtagtcagcttaggaaatgagaaatgatttcactccaaaccaacagttaactgcaaaggagggcatgtgataactccaggaagcccagagccggtgattttggtggcctgtgttccccttggtgagctctctactcttcgctataccaaaaattggcgaggtggggcaggaccattcttggaacaaatgaggcgtatagatatggcataatattccccgtgaaggacaggcatctccgggttctgagcagttcttcaggcttggagttctgcattcagttcgtggagactatttgcagcccattcgcagaaaaggaaccagaaaccacgtcatataaatgagtgcccaagcgttattgtggttgtttaatcgggcaagactttgagggtagtagtattcatcaattatttgaacatctgctttgtgttgtaaggttgagtagaatagagctagggtcagttggtacaagctacagggaaacaaatttcagtgaaggaagtgtttcatgatagaatgtatccaagatgagttagccagcctcagaaggtaatgagcttcccggctccagcagtgtttgaatggatctgatagcgacttaatagggttagagggattcagctattcagctatcaaatggtcggttatcctggatgaccttttaagacttctttaaattccaagatatcatgaatctggtaaagatgaaattcagtttgaccactgaatcttttcattacattttcattgctataatcaatattcaaatcgtagttattaaagtgttatttttacaggtaattttttaacaatgttcaaaaacaaaataacttgtatttgtactccttttttttttttttttttgggagacagagtgtcgctctgttgcccaggctggagtgcagtggcgtgatcttggctcactgcattgttttatacatatgatcattcagtaaacacttgttttgattttatttaacttcattatttatctgtggtaacaaaaattgcctggtcactttcagtaacatttacatcagcaaaattccagtacaataaaataatatggaacctattgtaaaaggatttaaccattaacaataatattacattaaaagttatgaagaaattattgcctcatattgattgaaatgtgtttttgtcttaaatatgaggtagtattcattttaaatattttctcaagtaggcaaaaaagcttgtttacaattaatagtatatatgtgtgtgtgtgtgtgtgtgtgtgtgtatatttttttttcttttttttttttgagatggagtctcactctgccgcccaggctggagtgcagtggtgcaatcttggctcactgcaacctccgcctcctgggttcaagcaattctcttgcctcagcctcccgagtagctgggtctacaggcgcgcacaaccacgcctggctgatttttgtatttttagtagagatgggatttcaccacatcagccaggctggtctcgaactcctgatcgtaggtgatccacccaccttggcctccgaaagtgctgggattacaggcatgagccacagtgctcggccaatagtatatatttttagatatattcatttatatatttttaaaagataaaccctaagaattcaaagctgaagagctaggttgacagttctatttggaaggagtggatttttaaatttgcattaataaaatgatttggtttttacactatgtaatattttcttttaaatttagtttttgatgatgaagaagaaagcaaattgacctatacagagattcatcaggaatacaaagaactagtgagtattttttttcactgatttttaaaagtaattaggctaatactacttatagcttttctaaatgaagaaaaatatttttacattaaaaatccttaattttacaaaaatccaatctaccttaacaatagtgccagttatatctgtctccacaggtgctctgaatatctcatttggatgacttatctcctctactctaaggaatggttttacaactctttatgggttcttgcatgtattctttatatcttattcttattttgttgacgcatccagggacatattaattattcacttcgtcatggttgtcatgtgatttttttattttttatttttgagacagggtcttgctctgtcacccaggctggagtgcagtggcactatcacagcctattgcagcctcaacctccccaggctcaagcgatcctcccatctcagccacctgagtagctgggactacaggtgtgcaccaccatgccctgctaatttttttgtattttgtagagatggcgtttctctgtgtttcccaggctggtgtggaactccagagctcaagtgatccacctgcctgggcctcccaaagtgttgggtttacaggtgtgagccactgcccagcctgtcttgtgattttaaaaaatgcctctggcagtggggctcagtggctcacacctataatcccagcactttggaggccaaggcaggtggattgcttcagccaaggagttcgagaccagcctgggcaacatggtgaaactccatctttataaaaattacaaaaattaatcagtcatgatggcatgtgcctgtagtcccagttgcttgggaggctgaagtgggaggatgatctcttgagcccagaaggtcaaggctgcagtgagccattactgtgccactgtactccagtctggacaacagagtaagactctgtctcaaaaaaaaaaaaaagaaagaaagaaagaaaaggccaggcgtggtggctcatgcctataatcccagcactttgggaggccagggcaggcggatcacctgaggtcaggaattcgagaccagcctgaccaacatggtgcaacgccatctctaccaaaaaaaaaaaaaaaaattagtcgggcattgtggcaggcgcctctagtcccagctactcaggaagctgaggcaggagaattgcttgagcctgggaggcagaggttgcagtgagccgagatcgtaccactgcactccagcctgggtgacagagtgagactccatctcaaaaaagaaagaaaagaaaagaagaaaaaaaaatgcctctgggtagcagaagagttgtaccacattgaacttcataatcctgacttcaactatttctattagaagaaatacaatttcatgtgattttcagcaaaaatattaacttttaatttgtgttttggtgaaagacaatgtcactgtcatgtaatatgtagattaatatttgcaaaaaattcgatgatacttttctaaactaaatacttaatatgcaaactgtcatgtagaatttttctatgtaattataaaagttaaactttgtttttttaggttgaaaagctgttagaaggttacctcaaagaaattggaattaatgaagatcaatttcaagaagcatgcacttctcctcttgcaaagacccatacatcacaggtttttgctttgtgttattctgctaacatacagttttaacaaatgcccagggttaaacactcacttaaatttgaatgtttgattgacaaagtgtaatattttagacattgtgagaggtagaaagataattcatcacatatgagttctttttgagagcaaccctgaaaaatgataatttgaggcattaatgaactgatgcaactcaaagtgacctttctaaactcagaactagaataagatcacagggtttatacaaactactgttttatttacatagatctccaataattctgcagttgctccttttataattttagcagatccacagtcagtagttcctgctgctgcttccttctcttggaactacttgtattatcttactggttgtgtagtgctaggctgaagtagtaatacatatgttataaactaatgtttgtttttgttgtttttttgatatggggtctcactctattgctcaggctggagtttagtgtgattgcagctcattataggctcaacatccctgggctcaggtaatcctcccatctcaactttcctggtagctgggactacaggtgccgcaccagcacacatggctaatttttttttttttttttttttttttgtagagacagggtcttgctgtgttgtccaggctggtcttgaatgctgggctcaagggatttgcccatcttggcctcccaaagtgctaggattacaggcatgagccaccacgcccagcctgtaaactaatgtttattgagggcttgtgctaattgatattttgggcacttgacatgttttatctcatttaatcttcctgacacctcttaagaaactgctactatataacttccatttagaaatgaggaaaccaggcccggagtagtggctcacgcctgtaatcccagtactttgggaggccgaggcgggcagatcacctgaggtcgggagttcgagaccagcctgaccaacatggagaaaccccgtctctactaaacatacaaaattagctgggcatggtggcacatgcctgtaatcccagctacttgggaggctgaggcaggagaatcccttgaacccgggaggcggaggttgtggtgagccaagatcgcgccattgcactccagcctgggcaacaagaacaaaactgtctaaaaaaaaaaaacaaaaaagaaatgaggaaaccaaagcacagatatattaagcaaatagtccaaagtccacagctaaataagtagtagagccagtatccccagcccaggcaagccaactgagtgcccttgctcagagggtgaggattgggatatgttgctactacccaagtagccttttgctcaaaaactgaaggccaggaagtggctcatgcctataatcccagcactttgggagaccaagacaggaggattgcttgaagccaggggttcgaaaccagcctggacaacatagtgagaccccatctttaaaaaaaatataaaagttagcttgttgtaggttgtggtggtgttctccccagagtacctactcaggatgctgaagtaggagcatcacttgagcctaggaggttgaagctgcagtaagacaagatcatgccactgtactccagcctgggcaacagattaggacccaaccccaaaaaacaaaacattggctttggcatctcatcttctactaaataaactgtaatttcttagcaagatatggtaagaattgtttaagatgagactccagattgtatttttagccatgatcccttgctatagttctccaatacattatgttctactgccattccaggtaacttgctctcttttttttttcttttgagatagagtttcgctcttgttgctcaggctggagtgcaatggcacaatctcggctcactgcaacctccgtctcctaggttcaagtgattctcctgcctcagcctcccaagtagctgggattacaggctcccaccaccatgcccggctaagtttttgtatttttagtagaggcagggtttcactatgttggccaagctggaacacctgacctcaggcgatccacccgcctcggcctcccaaagtgctgggattacaggcgtgagccaccacgccctgctgccccttgctcttataagcatctgtacacctacctttgctcatgctgtcccttaacctggaatgtatggtcccctccccagaccactccatcattcctttcataatgcggagaaatcctcattatcagggcctggttgaaatgctacttgttatagcagctttgctgcttattctaaagtcagaccagaattcaatctacttaactaggccaattgtaaattgatatttttgttactctgccttgaattatagtttcctacaagtctatttgccctactaaattgtaagtcctttgagctgtgtttagtatatttgcattccctgctggtagaacagagatgaaaacttagttgctagtacatagttctcaataaatgtttattaatttaaattgtcttgttatgatggcctagaagaggttgccttgactactttttaatccagcacttcctcttttgcacaacttttcatttgatgatcacctttaattctaggaatagaaaaccttttttgtttgtttgtttttgtttttgagacagagtctttctctgccaccctggctggactgcagtcgctcagtcatagttctatgcaacctctaactcctgggttcaagtgaatctcctgcctcagcctcctgagtagctaggactataggtgtgcaccattatgcctggctaatttttcagttgttttgtagagagggggtcatgctgtgttgtccaggctggtcttgaggtcctggcatcaagcaatcctcctgcctcaccctcccaaagctctggggttacaggtgtgagccactacattttggctgggtgtgatagctcatacctgtaatcccaatgctttgggaggctgaggcaggaggattactttaggccagggtctcaataccagcctaggccacaatgcaagaccccatctctacaaaaaataaaaatacaagaattagctgggcatggtgacacgctgctgtagtcctagctacttgggaagctgaagtgggaggattgcttgagcccaagaatttgaggctgcagtgagctatgactgtaccactgtattccagcctgggctgcagagtgagaccctgtctctaaaataataataataataaaataatttaaatgttattggtatgcccacattaatgtgaaaaaatctggcaatttccaagaagacataacaatctttaatatgtatgtacctaataacaaagcaacaaaatgtgtgaggcagaaacggaactgcaaggagaaatggatgaatacatgattatagttggagacttcaacaccctctgtcagtattggacagatccagtagttagaaaatcagtaaagacatagttgaactaaacagcaccttcaggccaggcacggtggctcatgcctgtaatcccagaactttgggaggccgaggtgggtggatcacttgaggtcaggagttcgagaccagcctggccaacgtggtgaaacccgtctctactaaaaatacaaaaattagccgggtgtggtagtgggcacctgtaatcccagctactcaggaggctgaggcaagagaatcgcttgaacctgggaggtggaggttgcggtgagctgagatcgcgccactgcactccagcctgggtgacagaacaagactgcatttcaaaataaataaataaataaataaataaacaaacaacagcaccttcagtcaactgaatttatttgacatacaccacttcatccaataatcaaaaatacacattcttctcaagatcacacagaatgttcgtcaagacagactacattatgggccataaaacataccttaacaaatttaaaagaagagagatcatacagtgtctgctctcagaccacaacataattaaactggaaataaataacaaaagataattggaaaaaaacaaaatacttggagattaaacaacacactctaaaaaacacatgtgggccaggcatggtggctcatgcctataattccagcactttgggaggccaaggtgggcagattgcttgagctcaggagtttgagacaagcctgggcaacatggtgaaactccaactctataaaatacaaaaaaattagcagggtgatgtggtacacaccttccgccatgttggccaggctggtctcaaactgctgacctcaggtaatctgcccacctcagcctcccaaagtgctgggattacaggcataagccactgcgcctggccacaatttttgttttatagaattataaggaattatataattatatataaaatatgtaatcatagaataatcataaagtattatattttatagaattataaacaaatgcccctctttattgctgatcatctttcttgttctgaggtctactttatctgaaactaaattaagctactccagctttctttttttttaaacaactttattgagatataatttgcatatcacaatactgatccttttgaaaaatttttttttttttgagacggagtcttgctctgtcacccaggctggagtgcagaggtgcgatcttggctcactgcaacctctgtctcctggttcaaatgattctccggtctcagcctcctgagtagctgggactacaggtatgcaccaccgcacctggctaatttttttatttttttagtagagatggggtttcaccatgttggctaggctaatcttgaactcctgacctcaagtgttctgcctgcctcagccgcccaaagtattgggtttacaggtgtgagccaccgtgcccggctgagaaccctgttttaaaggctattaagataaattttaaaattgtccttttgggacatctaatcataaataacaatgtagcattcttgaattaatctactgttttgcagtagaaatggttcgaatgtatgggtaatagttttaaaacttgaatcttcatttcacttgagacttctttccacaggccattttgcaacctgtgttggcagcagaagattttactatctttaaagcaatgatggtccagaaaaacattgaaatgcagctgcaagccattcgaataattcaagagagaaatggtaaaatgttgaagttagaaatctaagtactaaatgcatttttttttacagttttgactattctaatatggtcttaaatgtagctgtctcatgtacatttatttcaagtttgaaagacttcagctgacttgagattttagagtatatggctgggtgcagtggctcacgcctgtaatcacagcactttgggaggctgaggcgggcagaccatgaggtcaggagatcgagaccatcccagctaacacagtgaaaccccgtctctactaaaaatacaaaaaaattagctgggcgtggtggcgggcacctgtagtcccagctacttgggaggctgaggcaggagaatggcgtgaacccgggaggtggagcttgcagtgagctgagatcgcgccactgcactccagcctgggtgacagagtgagaccctgtctcaaaaaaaaaaaaagagtataaacttcctgatttgtatttgacatctcaaagaaaggagaccagaattcaatgatactttggatttcacagagttcaattttctgcccagccattatgtttatgaagttgagtatttttgaatggtcatagttgtggttactgttgagaggtgtccatcctttttctggcttaagattgttaggacctttgtaggaagcagtggttctttttttttttttttttgagacggagtctcgctctgttgctcaggctggagtgcagtggcatgatctcggcttactgcatgctctgccttgcgggtttacaccattctcctgcctcagccttctgagtagctgggactacaggcacctgccaccactccgggctaattttttgtatttttagtagagatggggtttcaccatgttagccaggatggtctcgatctcctgacctcgtgatccgcccgccttggcctcccaacgtggccggaagcagtggttcttaagctttagcaagcattggaaatggttggagggcttgctgaagcacatatggctgcctcccagtttctgatttaataggtctggggtaccgataatttgcatttttaacaatgatatggtttggctgtgtccccacccaaatctcatcttgaattcccacgtgttgtgggagggacccagtgggaggtaattgaattttgggggcaggtgttccccatgctgttcttgtgatagtgaataagtctcatgagatctgatggttttgggaaaggggagtcttcctgcacaagctctctctttgcctgctgtcatccatgtaagacgtgattgctcctgtttgtcttccgccatgattgtgaggcttccccagccatgtggaaatgtaagtccgattaaacctctttcctgtgtaaattgcccagtctcgggtatgtctttatcagcagcatgaaaatggactaacacaaacaagttcccaggtgatgctgaagctgctagtcctgggaccacaccaacacccactgttctagggcactgggcagagacagataagcttgtaccagcatcatgtggaagacaaaatggaactcaaagccctattaaccctggttggctttatctttcccctgaccctgtgcttaagttcactttctctctagctcttcctgctcttgttcccttcttgtgtacctgaactacatttaacatcctgactcaaaacagccgagtttctaaccatgctacttgttattgtaccatttcctttctaacccagattatcatctctgtttcaaatttcttgctgtggtaacctcaccttaatttctatgtcttcgttagctcaatagattgccatgatatttttttaccacggcccataacctctttaatggcttggcagcaggacctttcctttgattgtttcttgaagatatgagatctatagttcagttgtatcgttggctcttaagggcctggaacatgcaacaatagggcttccgttgttgcatggcaaacatgagaattttgcatggcccttactggggagtttcctcctcatttgactgatgtgagtagagactcttagagccagccaccatcataatcatctactagaatcccaagatgctttccccagcagctaatagcgctgttgtctgtgggtagggggaaaacaccaccctaaccctgaagaatccatgacatagtgctattactttgatgtgaataagtctggaaaatagtctctttctactgtggtttgctctataaaatccttgcctctgaattttcctgaaaactatgctttattctgacttacgggttagacaattttagtaagtatgttagtaaacaaatttttttaggggatcaggaaaagaaatagtgaacttgacaatggcattctttagttttcagtttggaatttaattggaaactcatttagattttaataaaaagggaataaatatatatcttgtatcatgtggatgccttaggctgtcagtaacagaacactccagtgaagaaaagatctcccagaacaagaagtccagaggaagggagagaaggaagacaggttcgggattggttaatttagtggctcactgatctaatcaaggaccccgacactttgcatctttatactctgccattctcagaatcttctctcatgattgtactctggctgtattgaatgcagactcaacagtgtcttatgaagaaatggaatatttcctcctgtacatctctttttgttagcaagacaacaatttcatggaaaccctccagtttttccctcaggtcctattgattaggattggggtcacttgcctttcttaaaccatctggcaaggggaatgagaccattatgattggcttgaaccaattaggagtcactctcctgggattggggagggccctgcctctaagtagttagctgcctgataattctgcaaaagctggcttctattagcaagggaggaggaggggaatgatgtagaataatgactattgtcaggccacagcatggggcattttacttacatttaaacataaggtaatacttagtttctgctacagaatttctaatacatgtacttaagagttttgctggctgggaacagtggctcatgcctgtggtcccagtgctttcagaggctgaggcaggaggatcgcttaagcccagcctcagacttctgtttgaggctgcagtgagctatgatagtaccactgcgtgccagcctgggcaacagagcaagaccctgtctcaaaattaaaaaaaaaaaaagaaaaagaaaagaaagaatgttgcctgactaagatccaggggtgaataccttagattaatgttgattatactcaaaactgcagactatttgaaaatagttcttaatgatgagaaaaagtcaaaggctctctggattcttttttatctttttggtgccttattaaagaatttagagaaattgcaaatgagagtattattttgatggtttttaagtacttcatactgttgtgttattcttagtactttcagttttcctcaggaagattattaggagaataataattttatatcttttgactgagcaaaaatgcacttaagattaatggattagttagatgtcagttttctgattgtgatattgtactactatagttttgtaagatgttaccacttggggaagctgggtaaagagtatatagcagatttctgcattatttcttacaattgcacttacctcaaaataaaacatttaatttaaaaaaatgtatataaacatcaggaggattagagtaataaagctacttaagagtagacccaaaatcctacagtcatatgtggataaagaaatggaaggtaaaaattaagaagcattctgctaatgttgtggaatgtaataattacagatgcaaacagaacaattattaccagtccacctgcttcgcaggaagataaaagtaataaagtaaattaaaccaatattttaagttactttttattttcttgggctcaagttgctacttccctggtttataattattagaccaacatctgaatagaagcttcaagggcagagatcgttttattcatctttgtatccccccaaagtgcttaacaccatggttttattacacatagtaagcagcgcccttttcaataacatctgttataatataaatgaagacttttaatgctatttcaattagcaaaattatattttgttttgtgactcttctcatttaagggacacctttgagagcagtttcattattaagcctaactcaatgatttccgtagtatattcttagacactatatgattatggaagagaaaaacatattaacaaatttttgttgccatacattgttatttttaattgccaataaaataattactaagagatatttgtagttaaaagtgtggggtttttggtggggcttattctgtaaaataggaaaaggcttaaaagatgatagttaaaaatggccgggaatggtggctcacgtctgtaatcccggcactttggtaggccgaggggggcagatgacttgaggtcaggagtttgagaccagcctgccgacatggtgaaaccccatctctactaaaaattagctgggtgtggtggtgggcagctgtaatcccagctactctggaggctgaggcaggagaatcgcttgaagctgggaggcagaggttgcagtgagcccagatcgtgccactgcactccagcctgggcgacagaaagagactctgtctcaaaaaaaaaaaaaaatatatatatatataaaataaaagatgatagttaaaaagataatagcttaggatgttacagtgatagatctgaaggtaacttgtacttaaggaacgagaacagtgagaaatatatgtttttaatggagttgatactatttcatgtggtctttggttttgaacaggtgtattacctgactgcttaaccgatggctctgatgtggtcagtgaccttgaacacgaagagatgaaaatcctgagggaagttcttaggtaccattctttaattgttttttaaatgaatcattattaatattatatgatctgtacatatgctttttgcccaacaaatatgaactaataaaattgctaaattctctactgaaaaccatcaaaatgatctatcaatttatgactgtggatatatttcttagtgacagaaaaagttattttcaggtaacttataccagatcagtccaaatgaaagggtctttttacacccgcatcataggaataggaaagtagccaccaatgggaaaaagttgcagtagacctagcctgatctctggagagaggtataatgacttgagctaaacagcttactccttggcttctggatctcactatggaggtggcatattctaggtgtcacatggtaggaggctgggcatccagattccacagattgaatagctgacttggtgatagtaaccttcaagggagggatgacagaggcgtctatcccagatgagtatcttgccggtctccttgtttccccagttaaatgattctcagccaaatgcctggcaaagagtgtgcagaccactaatggggtccacacagaactaagaaatggtaatggacatttctttttcttttgggcctgttgtgccctgacctttatgggaattttggaaggaaggggcagtagtagctcctaatttttaaatctcctgtgagaatatattagatttagggcaaaaggatgcctataatcacagtgtcacttgcagactgtggccttggcctttggggtcacttcttctccaactatactaccacacatgaccatcttctagcatcctacagttccccccacttaggtactttgtcccacctccaaagcagaagagaggatcagaggatgggcctgatgggaaactatggcaggagctccaggatgcagtgcttaatttcgggggtttgagtgattatggagagggtagcagatatgcagttgaactcaaccctttcttgccacatccctccttggatggcaggggcaaatgggagcctgagacaacacagaatgctttgagtttacaggtttgagatgtaagggtgtttggttcagaggactggtaaagttttgatttggactggttgtgttggttgattggtggcctgaaaactggtcagcactgtatttttagattttattttccaagagcttttgaggggatatactactgtgtaagtaatagaacttagttatgaacatgtataacagttgaccttggttactttcgaaaagcactgtctcagtgaacagtttacaaaagttgatgggctttggcacagtggtatcacaagtgcttgatgatagctcagatgccattggaacaatgacattttatcaagaggggtataatggctcttatcaagaggggtgtaattgatcactctaaagagggtgattgaagtccttattaatgggatttgccattcaaatttgggttcaggatttcaaatctgttgatctttattcagctagggttcattcagagttctagaagaaatgggtagacctgtattttgtgttactaactgtattatgctgtatgcctatgtatgtctttcccagttgactgtaagccactttagagcaaggcttgattatcttccatctttgtgtctaatgtgccttttattgtaagcttaggttagcatgttgcttagttgaatatttgttctttgaccaaaaaaggaaatttatctttttatcttatttttgtatatttcagaaaatcaaaagaggaatatgaccaggaagaagaaaggaagaggaaaaaacaggtgcctacagaacatataacagaagtattttattgctgttatctcttattaagtttacacctagatcttactattaaaatttatacttatgtggaactacataattttaagtacaatgtaaatattgaccaataatattaatatatcaataattctatgtatgtcgtgcattactgctggccaccatattatatagtactatatatacttaactgtatatagtacaaacaccacatagtactaattaatcttacaggacatgcatataagcaagagtagtcattttttttggcaagtttaagcatttgtttttaactttttatacttttttctccttctttatttttgtcctggtaactcacagaacaacattttttttttttttttgagattgagtctcattctgtcacccaggctggagtgcagtggtgtgatcttggctcactgcaacctctgcctccggggttcaagcgattctcctgcctcagcctccagagtagctgggattacaagcgtgcgccatcacgcctggctaatttttgtatttttagtagagacggggtttcaccacgttgatcaggctggtcttaaactcctgacctcgtgatctgcccgcctcggcctcccaaagtgctgggattacaggtgtgagccaccatgcccggccagaacaaccttttatactcttttatttatttatttttttggagacagtctcactctgacacctgggctggagtgcagtggcgcaatctcggctcactgcaacctctgcttcccaggttcaagtgattctcctgcctcagcctcccaagtaggtgggattacaggcgtgtaccaccacgcccagctaattttttgtattttcagtagagacagggtttcaccatgttggccaagctgctcttgaactcctgacctcatgtgatccacctgcctgccactgtgcctggccaactttttatacttcttaatatataaagtatatactttttttttgagactgagtcttgttgtattgcccaggctagagtgcagtggcgtgatcttggctcactgcaacctctgcctcccaggctcaagcgattctcgtgcctcagcctccccagtagctgggattataggtgcctgccaccactcttggctaatttttgtacttttagtagacagggtttcaccatgttggccagaccggtctcgaactcctgacctcaggtgatctgctggccttggcctcccaaaatgttgggattacagacatgagccactgtgcccggccaaaagtatatactttcttataagagtgtatactttatactttcttttaaagaggccagacgtggtggctcactcctgtaatcccagcactttgagaggctgaggtgggtggatcacttgaggccaggaattcgagaccagcaacatggcaaaaccccatctctactaaaaatgcaacaattagccgagcgtggtagtgcacacctgtaatcccagctactcaggtggctcaggcatgagaatcatttaaatccaggagccggaggttgcagtgagtcaggatcacactactgcactccagtctgggtgacagagtgagactctgtctcaaaagaaaaaaaaaagaaaactataatatctttggatcctttaggtagtgaattagttaaaatgaatctaaattgtgtgttttttaaaaaattgtattatggaatcctgaagttatcagaggctaaaacagaagagcccacagtgcattccagtgaagctgcaataatgaataattcccaaggggatggtgaacattttgcacacccaccctcaggtaaggttgaggtgtactgaactttctctaataatatgaatacataaacaccatatagaatgtgccactttctcatacttatttaacttcaaaagccctgggagggagtattgaatgtctttggtatttaacgttctttgtgaatttggttaaagaggttgcagacgagatactgacctgaaagagagcgtatagtcctcaagtttccgtgtaaagcctggaacccagagtagagagcaaaactccttgagggagtaactagcctttgtgcatgactgcagcttacaagagaggttcacataacatttggtattctcttccatgcttacagttgtatggtatttgttagtgagaagctgaacttggaaagataatattaaatttcttttccaatgaattaagtacagctagaaaataagaggtagccattttgtccagatatttggtcagaaatcatatctttgaaatcaaaatttataggaatccttgtaggaaatactagtggatgaccttttcaacatgtggcaaatctattctcaatatgaactgattttctatataagaaaacaagtaattctgaaacagaaattatggtcatgaattcagttcattttattatggattcctatggttttaaataaatgtccttttctcaattaaaaaaatatactctgtgaggtagatattataatccttgtttttcttttatcttttttttttttttttgagtcagagttttgctgttgttgcccaggctagagtgcaatggtgtgatctcggctcaccataacctccacttcctgggttcaagtgattctcctgccttagcctcctgagtagctgggattacaggcaggcaccaccacgcccagctaattttatatatttagtagagatggggtttctacatgttggtcaggctggtctcgaactcccaaccttaggtgatctgcttgccttggcctcccaaagtgctgggattacaggcatgagccactgtgcctggctactcttatcttttttaaaaaaattatttttgttgagtcgggtgttgctgtgttgcccaggctgggtctcaaactcctggcctcaagtgatcctcctgcctcagcctcccaaagcactaggattataggcatgagccactgtacccatcccttcttttttttttttttaaagaaattcaaggaagctgagcgacttgtccaagatcaccgaactcttcaatggtgaaattatgacttaccttggtcttctgacactaaatatattcttctaaaccttagtttagaagaacttctataattgagattagtgtgatgtttacccattaattttttaatgtaagttggagaacacctttctttaatatgcctaatttaagctgttttaggttcacagtaaaattgagcagaaggtacagagatttcccccatatagtccctgccctagtacatgcctagcctctcccattatcgaccccctcaaaagtagtacatttgttacgttggtgaaccttccttgacacaacattaccaaccaaagagcatagtttacattagggttcactcttgctattgtatattctgtggattttgacaaatgtatgatgacatgcattcaccattatagtatcatgtagtatacagtttcattgccctaaaaattctttgtgctctgcctattcatccttcccacctcctagcccatggcaaccactgatcttttactgtttccacagttttgccttttctagaatgtcatatagttgaaatcatacagtagtacgtagccttttcagattggcttctttcacttagtaataatccatttaagatttctccatgtcttgtcatggctttgtagctcatttctttttagtgctgaataatattccattgtctggatgtgccacggtttgtttattcatttatctgctgaagaaaatcttggttgcttccaagttttgacaattatgaataaagctgctataaacatcagtgtgcaggtttttgtttggacatagctttcagctcctttgggtaaataccaatgagcatgattgttatatcttacagtaagagtatgtttagttttgtaagaaagtgccaaactgtgttctaaagcggctataccattttgcatttccatagcagtgaatgagcgttcttgttgcatccttgccagcatttggtgttgtcagtgttctggatttggagtattctagtaggtgtgtagtggtatctcattgttgttttatttgcatttccctgatgacatgatgtggagcatcttttcatatgcttgtcatctatgtatcttctttggtgatgagtctgttaaggtttttgacccattatatttgttgggttgtttgttttctttttgttaattgggttcattttcttattgttgaattttaagtgttctttgtatattttgaataacagtcctttatcagatgtgtcttctgaaaatattttcttccagtctgtggcttgtcttctcatcctcttgatactgtcttttacatagcagaaattttaatgaagttcagcttattaattatgtctttcatagggtgtgcctttggtgttgtatcaaaaaagtcatcaccatacccaaggtcacctaaatttcctcctatgttatcttctaggatttttatagttttacattttacatttaggtctgtgatctattttgaattattttttgtgaagggtgtaaagtttgtgtctagattcatattttttctttcagatgtccattttcctttcctcaccgtattgcctttgctcctttgtcaaagataaattgattatatttatgtgagtttatttctgggctctctattatgttctgttgatctatttctccattcttttgcaaataccacactctcttgattactgtagtttgaagtctccaagttgggtagtgtcagtcctccaattttgttcttcaatattgtgttggctattctgggtgttttgcctctccatataaatgttagaatctgtttgtcagtatccacaaaataacttgctgaaattttgattgatattgtattgaatctgtagatcatgttgggaagaactgacatcttgacattgagttttcctgtccataaacatggaataggccgggcatggtggctcatgcctgtaatcctagcattttgggaggccaaggcgggaaaactgttcgagctcaggagttcaaaaccagcctgggcaatttggcgaaaccctgtctttacaaaaaaaatacaaaaattagccaggcatggtggtgcacgcctgtagtcccagcctctagggaggctgaggcaggagaattgcttgagcccacgaggtggatgttgcagtgagttgagattgcatcactgcactccagcctaggtgatagagtgagaccctgtctcaaaaaaataaaataaaaaaataaaaaaaaggccaggagtagtggctcacacctgtcatcccagcaatttgggaggccgaggtggtggatcacttgaggtcaggagtttgcgaccagtgtggccaacatggtgaaactccatctctacaaaaaatacaaaaaattagctgggcatcgtggcaagttcctgtaatgctagctactcgggaggctgaggcaggagaatcgcttgaacccgggaggaagaggttgcagtgagccaagatcgtgccattgcactccagcctgggcaacaagagcgaaacttcatctcaaaataaaataaaataaaaaccatggaatatttctccatttatttagttctttgatttctttcattagaattttgtagttttcctcatatagatcttgtgcatattttgttatattttatatctaagtatttcatttttaggggtgctgtgctaatgtaaatggtatttttaattttaaattccatttattcattactggtataaaggaaagtgataaactgttattaatttgtatcctgtaaccttgctatataattattcatttcagtttttctgtcaattgttttgcattttctacatagatgatcatgtgttctgcaaataaagacatttttatttattccttcccaatcagtgtaccttttatttccttttcttgtcctagtggattaggtaggacttctagtatgatgttgaatcagaaaggtgagagaggggacatttttgccttgtttctgatcttagtgagaaaccttctaatttctcaccattaagtattgtgttaagttttagagtttttcgtactctttatgaagttgaggaagttcctctctattcctagtttactgagagcacccattaattttaaggagttagattcttatttgacagaaaaacaggagtatattgaatcagaagcagatctgtgaagttaccttgcttctttgtaccaagtcaaaccatttcttttttatatatatgctacagattgtaaggagaaatagcctcattttaatgatatatatgaaagctcctgctttaggtttgtctgtgctctagtttgctgacccaaattaactttgttttatatacacctaagtacatacactatttaaatcttgtgtctaacataaattgaataaatttgctttgtctgctttcttatctaagtgaagctatagaaaacttgatctcaaaccacatataattcagttgtacacattaatggtacaccataaatggtagatctcaaaagtaatgatttcaatttttaaaataatttttttcaaatgcgcatatctgatatttcagagaatcacttcgtacaaagtgatggaagcccagtatgaagacctgagtttggaagaatcatgaagttgtttgagcttctgctttgtccttttgcctgtctttccctcattcctgccagcaatggatagtgtcttttctcagattgatgcagatttgccagagatgagatgatctttctttaggttttctggctttctgatcttcccttcctagaaattagagaagctaagtatttggcttcaagtactttcctttctaggcctgagaatatacgtatgttcataattaacaaacccaaggcaagaactgtccagagaaagaacatgagtggaatataaatgcttatatgtatgggttcccccctcctcaggaattatttgaactgtcccttctccagttctgtgagtccactgagggctaagcctacctctgctaacgtcactctcagtaataacagcggtgttttacctctatctttatttctgttagttatgtagctccctgtctaggttggtttggagtgctggttacagcttatcttttccatggagatttcccttattgtccaagggtctggagagcttttcttccttcaacctctctggcactgtagtcagtctggtcactgctagaggagtggtctgttgtcaagtttcttgcacagacaaaattctgttttctgttttagtatgtatgctggcaaggtattttttttttttaactggcaggatcaaccaggtgtggcaaaaattttaatcatttagacatgtgtgccatgttttcccatcatgcttttagatcttagcatcattttaatgtctttgcttgtctcagtgtgctttctttcatagcccatgtatttacactgaaaatgttttatctttttaaaaacaatcaccttataataaaaaatggctcagaggagcaattagaatgttaactctctctcttggttggcacagtcaccaaatggctggaaagtatttagtgctcatgtttatatgtgcttccaagttctgcttgctttagaaatctttacattttcataatgcactggcaggtttatagttatcttcaatacataattataaacaaaaattattgacattactggcatgcactcttgcaatacaaaaaattatagttttacattaattgttctgaaagtatagggtgactttttacatgcaagcaaaagtttggaaaccaattacattgtagtaagggattagtatactgtttatttggattatgtggcaatcttatattatagtgtagttctaatctttagacaaggattttagctttttgtagctatagtactgtacaaacagcagaagcatggtacttgttgagaagtaggtgagaaactgtagttccaagctccttaaggatagagacatgatgtttactgttcttacccagtggctggcacagtataggcactgaatatatgttgactgaatgactatgaggaaaaacaagtattattaacattagctcatttcggtaaacctagcctaacacttaaaatatttctcataatattctaattgctcttattgtctacttattgccagaagttaaaatgcattttgctaatcagtcaatagaacctttgggaagaaaagtggaaaggtctgaaacttcctccctcccacaaaaagacctgaagattcctggcttagagcatgcgagcattgaaggaccaatagcagtaagtaaacgacatcacttaagaactataagcaaaatgacaaggtactgggaaatcaaacttcgaattgaatcactcagtgggcatctgtgctacttactaaatggatttgaatttagatagctccttttcttacttgacccagaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggtatggctagccttaatatgtcaagatttacaaatctggtggtggaactatcaaaatcagaatatgtgcaagaaagcctctaataaattttgcttgcagacccattcatattaatcacctcctagtgcagtagctgctaagtcttttctaggaagtgaaattgttgtgataaggattttttgaggcagaaaatagcggtgtcattatacatttttttcttatgctgtttctttacttgcccttctctgagtatgtcagggttggtggtctgtttcacctgggcattctgaaatgttttatcatagagcagcatcagtaccacctttatcatagagcacatcagccaccacttcccagaggggttctccaagaagagactttacgaagaagagatttaggaaacctagtctatgtctgtctctccctccgtcccacaagaaggtgcccccgatttttgttcatttgaggcagtatgttgggaattttagacaaattaccctatttcatactgtagccaattttttctttttttttcaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacacttttgtaaatccaaatatcttaaacactttaggtaaaggacagtagggaaggcagctactcatactgattagtttaatacaaattcctggatgttttcccttggaaagagggtatagaaggaaactagttgatagtatgttcattcattcaaactcggttacctactgtttgtgccaggcattgtgctaagcactaaggatacaggagtcaactagattgacagggtcactgccttcatggggctagtggagagggcccaaagacgaaactgttagaaaggcaaagtgtagtgtcctatgagcagggctggctaagcctctttaagctgaatggaaggttaattacacaaagaataggtaaggaacagttcaggttctgcagcaggaaataaagcatatactgaaaaactggagtatatatatgagtggagacggttagcatatgaaattggagacaggtgggggactgacagtgcagagtcttacagggaatgtgaggatttaatttttttaaaaattattttagagacaggatcttgctctgctgcccaggctggcgtgcagttgcacaatcccagctctggattttaaattttgtaataccagcagtgtcaagtcattgaaaaattttaatgcaggggccaggcacggtggctgacactgtaatcccagcactttgggaggccgaggtggacagattgcttgagcccaggagtttgagatcagcctgggcaacatggcaaaaccctgtatctactaaaaatacaaaaaattagctaggcatggtggcatatacctgtagtcccagttacctgggaggctgaggtgctaggatcaccagagccccggaggtcaaggctgcagtgagctatgatcacagcactccactccagcctggatgacacagtgagaccgtctcaaaaaaaaggaaaaaaaaaattaaagcagggaagttaaatgatcaaaattttcatttttattgctgtatgaggtagagtagttgtgggtgtaccatgtatgagacagtccaatcaagggtagagataacttgggcagtggtaaggtagattttacatttatcatttacacttatacgaggcaggagcaaataggacttggaaaatagatgtgcgggatgtaaaaaatactcactctttctagacaaactcttactaaaacacaggcaaagggaataatcgattgagcctgttgaaggagatgccaccactgggtgttggtgtttaagagaagtgaccctaagatttctgtagtctgtttgtttaaagataaaccacaataataggagacctttctttcagaaacttgcaggccgggtgtggtggctcatgcctgtaatcccagcactttgggaggccgacgcaggaggatcacttgaggtcaggagaccagcctggccaacatggtgaaactccgtctcaactaaaaatacaaaaattagccaggtgtagtggcgggtaactgtaatcccagctacttggaaggctgcagcaggagaatcgcttgaacccgggaggcggaggttgcattgaacccgagctcacgccactgcattccagcctgggtgacagagcaagactccatataaaaaaaataaaataaaaaaggccaggcatggtggctcatgcctgtaatcccaacattttgggaggctgagggggtgcagatcacttgaggtcaggagttcaagaccagcccgaccaacatggtgaaaccccatctctactaaaatacaaaaattagctgggcgtggtggtgcatgcctgtaatgccagctactcgggtggctgaggctggagactcgcttcaacctgggaggtggaagttgcagtgagcgaaatcacaccactgcactccagcctgggcaacaacagagcaagactccatctccaaaaaacaaacaaacaaacaaaaaacttccagtcttgtaatatcccacgtccacccttttctaagtacaggatactcctgagatttaacttataatcacattttatctccttaagtctaccattataaacttttaaaaaaggataccaaaattagtgtaacaggatttactcatttcagttacacaattccaaactttcccctgcaggaaaaccagtatttacatttgttatattttcatcactagatggctaagaggaaatgctagtgattaaaacacagaaatctgtttcatgtaactttttattaaaaatagtttttatattggacacatgtttacagataccattttaagaagacctaaggcatacaaatgtgggcttttggcttgcttcactgaatgaagataaagatataaaaacccagatctgcctgagggtagtcgtttaaagacagccgctaacatggaattctcacaattgttcttttgagggatattttaagccttgttctcttatcgtcgtaggtaagcacttgtaccatgaaaaccgtaacctgtacttcaagaaaacattcacatttctgctacaagaaaaggttctgatgatttaaatgtttaagacttatggcagctcttcagaaagaaaaaggaagtcttcataagatacagagatagggaggctgaggcgggtggattgtgaggtcaggagtttaagaccagcctggccaagatggtgaaaccccgtctctactgaaaatacaaaaattagcctggcatggtgacgggcacctgtaatcccagctactcaggctgaggcagagaattgcttgaacccaggtggcggatgttgcaataagccgaaatcgtgcaactacactccagcctgggcaacagagcgagactcaaacaaacaaacaaaaagtaactaggaaagtgttttacatgtgggcttattttaagaagaaatttactaaaagctgagagatgggtctcgataaaatttgatgattcaaagaaagtggatgggaactttactgatcttagtttaaaatatcctgagtcacctgccttatgaggtggaaggtctttctttcttactatatgtacacctttaattgaaaaggtgagaaaagctccatactgtgatgctatgatttccccaaggcttaccttctataagtagtcactgataaagtgccattgacccgcatttgtttagaattatttcattaaaattggggtatgatctagcagtttataataaatatttatggataattttattggcttttaaaagatactgtaaaattgacatatctcaaaatggagttaatttatatttacaacaaaccaaacacaaacatcaattatggaattacagggtcacattttaattcctgaattttacagtttagcattaatatcaccacatgtatacaaatggtgtaaaacaagtacagtggtattttttaatacaaaataaacatctgttttatggaaaaaactatacttcatatctacacagacagctcatcttttccaaacaatagccaaaattaaaattaactacaaaatctccaaaacaggggaaactgctttagattaaacgattccaggaaaaatggacccgtaacacattacaagggtgatctaaagattgtggctggaattactgttaaagtttttttttcccaatgcattaaattgtattttggggagatttttctcacttcggcatgatctcagatcatagatgagcaaactaacattaaaatatttacagttaacttgttgctctaaaaataaaacttaactgtttgcctcaatttatttttaaaattcacttacgtatatggaatgtgcttttactcttcttaaaaaagcagctttcatatcacacccttgtttacagaaaagctacatgtgctgcatgctgactttgacacttaagtagcttcttggatcaaaatggcttctagatactaaatgccacttaattcagcactattcttggttggtctgtataagtaacactttaaaacttgcagctctggaaagacagaactttactaacaaagtagaaagtgatttcaaagtatcttccacaaaagattgtactggtaggcggttgacaacattctgttcgatctactttcaaatttctagagaaaatcattttggaatactactgtactgattcttggccttcgttgtctctaaaagtgctgattttaacattatcttaaaactgtccagtttgaattgagcttgttttcatcaatatacatattgaaaattcctggtgtagaaaactcaacatgtgctgaatacggggtgtacttcccttcaactacctaaaaggctgaacttttgttaaatcttaaagaaatggtcccaacagcttaacttcatttttttaatgatagttgaatgtgttttccataaaaatttcttttaaaaagaggcaactgattaaaacaacaacatggccagcaccattatacaagtaatgttattgagtttacaactgaagttctgtaaaattgtttctagatcgacaccccgaggagcaaccctgcattattatatcaaccttttcccctcccctaaaccgtccccaaacctgtgacttttccttgctgagaagctgtctcccaggttctggttactaatgtttgttttgacagcctaaaaggcaaaccccttaattactagcaagcaatcaagttcctgggaagcctgatttttattagaactaaactctcttagctgatatactgtcttttgctactccttgtatattttataagttcaattgagaaagctttctgattcagattttcagctcactgaacagttgcagcattgtaagaccacatgttgagggtcccctaataaatattttatgagccaagacgaggtcttttcctgggggacgattcttcttcttcatcttcctcttcatcatctggataatccactaagccaaccaaacttccctattgaagaatttaaaaattttttctttaaacatatataacaaaaaagagcttttagtacaaatacaatcacttgtaaaaatatcagaaatcgtttttctaaatcatatcagaaattaacatttgaatttgataaaggaactgcttgaaattatgaacgtttgagtagtaattggtagcacttgcagtaacccttaacttttctatctggttcttggattattaatgatacttcaaaactcaattctgcaaaattttactgtgggaaaatgtctacttttccaaacagtagggataacaattaataacatttggaagctggaaaggacattggagatgaactggttcatttctctaatttcattaccacaagaaagccccttgtagtctttgttcatcttgtgtatatttcatcactaagtacacattattttcattgtgcttttgaagtacagcttaaatggctggagataaacacatgaaatgattcctataaaataataagtaaaacatttagggctagctcgctgaccaaaagaacaataaggatgaggtaattcgtggtcttggcctttgatgagtaacagacctctgtgaaaatcctagaaaaactctgggtactctccagaaaattacacatccacagggtttcattcattttgagccaatcccatgaaaacttatgtcctataggttaagagggctactgtaaacactgtatttagttcaaacccttcagacctctaggagataaaacaaatacaactgaagtaactcatacttcatacctgaagtactgaggtatcgggttttaccagaatgtaaccaaatcagtataatattaaccaaccaaaaaaaggcctctgggcagctagaaacagttatcagaaagacttatatacctgtctgagaatctgtttctcaacttaatcacacacacatcttaagtctggatatgcaagaagcaatatggctaaattgttaaaaataggctaactgtaggtctgatgtcaaattctaatgacaccacgttttatgtaaaaaaaaacaaaaacaaaaacaaaactttggggctgggcttatgcctgtaatcccagcactttgggagatcgaggcggatgggtcacctgagagataatgagttcaaaaccagcctggccaacatagcaaaaccctatctctaccaaaaatacaaaaattagcctggcgtgatggcaggcacctgtagtcccagctactcgggaggctgagggacgagcatctcttgaacccaggaggtggagattgcaccactgcactctagcctgggcaacagagcaagactccatctcaaaacaaaaagaaaaacaaaaaaaaacacaaaaccttgggcaagtggtttaatacctctgcctcagtttgtctgtaaaattggtatagtagtatttaggcctcagtgaactattttgaaatttaaattgatggccaggcgcagtggctcatgcctgtaatcctagcattttgggaggccaaggtaggtggatcacctgaggtcaggagttggagtccagcctgaccaacatggtgaaaccccatctctactaaaaataaaaaaattagccaggagtggtggcgcatgcctgtaatcccagctgcttcagaggctgaggcaggagaattgcttgaacccgggaggcagaggctgcagtgagccaagattgcaccactgcactccagcctgggcaacaagagcaagactccatctcaaaaataaataaataaataaataaatagataaccaaacatctaaagcacttcagcacagtgcttcgtatgtagttagtgttcaataagtgctattagctgctattactactatcatttttctattattttgtttctaagccaaacaaattggaagagaggaaaaacaagaaataattctggtataaaaaggcaccaatctgataatcaaaaagatgacagcaaagttacaaagttttaattatgcttagtattacatatcataacgtacaaacatttgtattccaaatggttaacacttaattgtttctgcccaagattaataaattgtctgaaaaactcacttatacaatttgagttttacttatattatctctgcaaactaacatacatttaaaacatgtttacaataaaaataataaaaatgcaaaatatgaaatgttggaagtaaaaaggcctgtaatctagagatgcactttgtgaagctgattccatacttttaatatgtatctagaaatgtactgttttaaaatagcagattgaaattatatttactcttttacaatcatgttcatataaaaaaaagctttcgatgtcagtacataaagttccatttcattgttttaaacccttgcattccatggtatgaatatatatatattttttaagagtcttgctctgtcgcctgagctagagtacagttgtgtgatctcagttcactgcaacctctgtctccagggtgcaagcgattcctgtgcctcagccacccaagtagcttgggctacatgcatgcaccaccatgcctggctaacttttgtatttttagtagagatggggtttcaccatgttggccaggctggccttgaactcctggcctcaagtgatctgcccacctcagactcccaaagccgagccaccatgctcggcttcatcatatactttaattcctgaatttctggttggacatttgggttgtttttgcagggtatttaggtaagaaatttaaaaagtgaataccagcaaagaaaacaggagaagagagaacagcagtttagagttgccaaggcatttttggaaaagagaaatcagaggcaaggcaagtcatacaacaggaagaagccaagaactaagtatttgcagagggatacagaaacgagaaactgatttgtcttaagaaaaccccagaaagaagctaggcagtaaaggcaccaaaatattggggaaagcagggaaaacagtttaattatagtaaaacagacaactgggtcattgattctacacctctgacagccaggagatttctgttcctccaccatcaccaactacagagaattctacatagaaaatgactctataaagaataaattctatagagaatgtaatgaactttacagagcaaaggaccatatacttcatgactttaggcaaagtaaagggcatgggtaaggccaggctgaaaatgaaagaataaatttaaattttgtatactgagcagacacgcctaccccacaataagctttgctatgtaggcactcagaacactaacaaccattcttatacttacaaggtgtaagagactagctttgtctgtaaaaattagatggcttcacaggagtatggggggaactacaaacaactaacacctcccgaaaaaagcagggcactactctctaagtccataccataaagtcaagtttttaaagtgtataattttcacacaccataaactcaccatttcagagcatataattcagtggttttagtatattcacaagttacgtaatcaccaccaattccagaacatttccaccatttcacccaccaaaaaaagtccccataaacagtcctcattcccccaccaccccccacaccacccagctcttggcaaccactaacctactttgtttctgcggatttgcttattctggacagttcatataaatggaatcatacaatatgtggtcttttgtgactggtttacttcaattaccacaatgttttcaaagttaatctatgcttagcatatcaggacttcattcttttttatggccaaataatatccactgtatgaatatgctacattttgtgtatccattcatcagctgagagacatttgggttattcttactttttggctattatgaaaaatactgctattaacattcatatacaagttttacagtggacacatgttttcaattttcttacaatatatacctaggaaatgaggtagctgggtcatatggtaactctgggtcatatggtactctgactttttggggaaccgccagactgtactccaaagctgctacaccattttatttttatatatttattttttgagacattgtcttagagactcgaaagtgcagtgatgtgatctcggcttattgcaacctctgcccgctgggctcaagtgatactcccacctcagcctcccgaatagctgggaccacaggcatgtgccaccatgtccagctaatttttgtagacggggttttgccattttgcccaggctggtctcgagctcctgggctcaagcgatgctcctgcctcggcctcccaaaatgctgggattacaggcataagcctatgcaccaggcctgttgtgctattttatattctcactagcaatgggtgtcacaatttacattcttaccaacacttgtttttgtgcatcttttttattatagctatcctagaggatgtgaaatgctatcatattgtgattttgacttgcatttcccttactaatgatgctaaacatctttccacatgtttatatgggccacttgtgtatcttctttgcagaaatgtctgttaaaatcctttgtccattttaaaacggggttgtcatgctgaggtgtaagagttctttatatattctggataccagttacttatcagatatatcatttacaaatatttcctcccattttgtggattgtcttttcaatttatggtagtatcctttggagtacaaaatttttgaattttgaatgagtccaatttattatttttcttttgtcacttgagctatttgtgtcatatctaagaaatcactgcctaaatccaaggtcatagatatttatgcctttttttaaaaaagagttttagacttttaacttttacatttggatcttttcatccattttgagaggagttttggatatgatgtgagatagggatctaacttcattcttctgcatgtggatatccagttgtaacatttattgaaaagggtattgtggccgggcgcggtggctcacgcctgtaatcccaacactttgggaggccgaggcaggcagatcacgaggtcaggagatcgagaacatcctggctaacacagtgaaatcccatctctactaaaaatacaaaaaattagccaggcgtggtggtgggcacctgtagtcccagctactcaggaggctgaggtaggaaaatggtgtgaacctgggaggcggagcttgcagtgagccaagattgcgccaccgcactccagcctgggcaacagaacaagactccgtctaaaaaaaaaaaaaaaaaaagaaagaaagaaaaagagtattctttcccccatcaaattgtcttggcactcttattaaaatctgccttatttttttttatgaaaggaaatcctaagatcaccacttgagtaaagtttccaatatgaaagaaaggatcaaaataaatgacaacaataacctatgaaaaagccctttgggaggccgaggtgggtgaatcacttaagatcaggagttcctgacgagcctggccaacatggtgaaaccccatctctactgaaaatacaaaaattagccaggcatggtgtcgcacacctgtaatcctagaacattataataaatgcacattctatacagaaatacacacgtatatgaaatgatatatgcaagtggtcacatattgcagcaatgattttaactacaaaaagctgcaaacaactttaatgcccatcacattgataggggctaattataaattgttatatccatacttttaagttctatgcaggaaatctctaatgtcctgatatgaagagctcaccaagataaatttgctacacaaagaagcaaaataacaggtttctctactgtgaatctgtgacgtgtttattttagtatccacaaatggcttctcattctgattttatatttttcctcatagaaaatatacgttttacagttacacaactaaagaagtattttgtgtctttatgacatttatatcataaaaacaaatgttttaattcattagtagctaatgtctagccagccttcaactatagcaattaacactgttagtgaaactggctaaaccaaagggcaattggtgataaagaatctgtcaccacttaggaatgtgggcatggtttgttaagaaggttgagagcaaattaaagtggtgcttaacttctgtcaactcctgtcttgcttaatttcaaaattctgtgtctacagtgatagagcaactgtttcccaagaacactgtttttatccctatctctaaaaaggatgtataacagatgtattctgtaatctgctgttactgtcaagaagagtgaaaaaggtgttggtgcttgcatttaattttgctcattcataagtaaattatctgaaaggataataaaaactcagagaaatataacagaaaatataacaggaaaacaaaatgaatagtaggatataaaagtaggatagaaaaggtatgcagtattgacatattattagaaatagaagacacagctaaaagagttcaaaggtatctttgtggaggggaacagagggactgatttttttctaatataaacttgccttttggtaatatttgacttttgaaagtacatgcatgtattactttgatttaaaaaaaaaaaaagaaaaaaaagaaaagctaatatatactgagaaggtgtcaagcagtgttctcagcattttacatttgttaaataatttaatcttcccaacaagcttataaagtaggtactaccttacccctttttaaaacaagaaagtcggccgggcatggtggctaacacctgttaatcctaacactgtgggaagctgagcaggactgcttgagaccagcagtctgagaccagcctgggcaacatggcaaaaacccatctctaccaaaaatagaaaaattagccaggcatagtggcatgcgccagcactcccagctactcgggaggctgaggtgggaggatcagttgagcccaggaggtggcggaggcagtgagctgtgatcacaccactgcactccaggctgggtgacagagtgagactctgtaacaacaacgacgacgacgacgacgaagcaggaaggcagggagcttaaggcccagagagattaaataacttatacaaggtgatacagctacaaagaggcagagccaaggtttgaacccaaacaatacaaccctatggcaaatattcttttttgagcagggtctcattctcttgtttaggctggagtgcagtggcaagatcatggctcactgaagcctccacctctcaggctcaaaccattctcctgcctgactcttgagtagctgggaccacaggtgtgtgccaccacacccagctaattttttaatactttttgtagagatggggtctcaccttgttgcccagactggtcttggactcctgcgctcaagcgatcctcctgccttggcctcccacagtgctaggatactgtgcccagcccaaacattcttaatgtagtgtcacaatattactctaaattgtcccatcataaagttgaaaactaattttaaaattttccagttgaaaaacataaaatatgtttcaaataccgaataccatgaaaatgctattgtcaagagcctatctcactatactactgaatgaaaattctacatttttgtaaaataaactcagacttatattttgtgttccaaacaagatgcattcctttaattaggtatgtactaccacggtgtttctgcttgtctttctacctttatacaatagttgtcccctatttatgcctttttattttaagccactcctttttggggaaaaaggatgatttcatataacatatgaacaagaaaaatgtttcatataaaatttaaacttgtttataaaaaaagtaaccaagggaaatacatttgttataagaacaacagaaagtctaatatccttaactaaagattcatcgacaataatataatccaatttgcagagaagagcagattcaaaaggctaatatttagccttactactaatagagtatacacgattggaaatgagatattatatactgtctcccctacctaactggcaaatactaaaaataattatagcactggcaaagctgcaattggccacgcacactcatacacagtttatggtaacataaactggcatagactttatgaagatgaatttgaccgtatgtgtgaagacgttctactactaaactatccaagaaaataatttaaaatgcagtaacactaagtagtcagtgaaatattagaatcaacttaagtgctccaaaatagaatgggggacagggaggaaggatgcttacatttattatcataagcctaaataaaatgaaattctctttgagaggccgaggtgggcggaacatgaggtcaagagatcgagaccatcctggccaacatggtgaaacctcgtctctactaaaaatacaaaaattagctgggtgtggtggcacgcgcctgtagtcccagctacttgggagactgaggcaggagaactgcttgaacccgggaggcggaggttgcagtgagctgagatcactccactgcactccagcctggcgacagagtgagactctgtctcaaaaaataaaataaaataaaataaaattctacaatcaacattttggtaacagaaaaattctaaacaattcattgaaattgttttgattatccaaatttttttcagtaaacatgaaaaaatctcacagacgggaaaagcaaagtttgtgtgtaatgctgtttcacctaccttggtggctgttactgacgtaggcaagtttgtggttttggaagaggatccattagaagttgctggtggtatctgagccactacagatttactgtttgttccattagcagcactggcagagtgggagaaagtaaatttgaagccaccaggagatgtccttttgggaaggttttccttgtcttcactttcttttgctaaagcaaaagtaaaattttgaacgtatatcaataaatactgctaagtcaaaacatctaaaaacagcagtaattaaaaaacttataaaacattgctgcccgggcatggtggctcacgcctgtaatcccaacactttgggaggctgaggcaggcagatcacccaaggccggagttcaagaccagcctgaccaacatggagaaaccccgtctctgctaaaaatacaaaattagccgggtgtggtggcgcatgtctataatcttagctacttgggaggctgaggcaggagaatcacttgaacctgggaggcagaggttgtggtgagccgagatcgcaccactgcactccagcctgggcaacaagagcgaaactccgtctcaaaaaaaaccaaaaaaacaaaaaaaaataacaccaaaattaattgcctttgtttcctaagaacttttgaaaaagaacatgatgtgtacagtgatgatatggtctggctctgtgtccccacccaaatcgcaaatcaaattgtaatccccacatgtcaggggagggacctggtgagaggtgactggatcatgggggtggatttcgcccttgctgttcttgtgatagtgagttctcacgagatctggttgttccaaagggtggcacttccccccttgctctctctctcctgctgccatgtaacacatgccttgtttcccattcaccttccgccacaagtttcctgaggcctccccagctatgtggaattttaagtcaattatacctcttttcttcataaattacagtctcaggtagttctttagagcagtgtgaaaacgaactatacagaaaattggtaacaggaatgtggtactgctataaagatacctgaaaatggcagggcgcagtggctcacgcctgtaatcccagcactttgggtggctgaggagggtggatcacttgaggtcaggagttcaagatcagcctggccaacatgatgaaacctattctctattaaaaatacaaaaattagctgggggtggtggtgcacacctataatcccagctgctctggtggctgaggcaggagaattgcttgaaccctggaggcagaggatgcagtgagctgagattgtgccactgcccaccagcatggatgacagaataagactccatctcaaaaaaaaagatacctgaaaatgtggaagcgactttggaactgggtaatagacagaggttggaacaatttggagggcttagaaaaagacaggaagatatgggaaagtctggaacttcctaaagacttgttgactggttttgaccaaaatgctaacagtgatatggacaatgaagtccaggctgaggaggtctcagatggaggtgaggaacttattcggaactggagtaaaggtcatacttggtatgctttagcaaagagactggcggcattttgcccctgccctagagatctgtggaacttgaacttgagagagatgatttaggatatctggtggaagaaatttctaagcagcaaagcattcaagtggtggcctgggctgggcacagtggctcatgcctgtaacaccagcactttgggaggctgagacaagcggatcacgaagtcaggagttggagaccagcctggccaacagggtgaaaccctgtctctactaaaaatacaaaaattagctgggcgtggtggcacacacctatagtcccagctacttgggaggctgaggcaggacaatcagttgaacctgggaggcagaggttgcagtgagctgagatcatgccactgcattccagcctgggcaacagagagagactccatctcagaaaaaaaaaaaaaaaaaaaaaaaaaaaaaaaaagaggccttctggcggtttctaaaagcgtatgctcatatgcatgaagaaagagatggtctgaaattagaatttatatttaaaagggagcagagcataaagtttggaaaacttgcagcctgaccatgcagtagaaaagaaaaccccattttctggggagaaattcaagctggctgcagaaatctgaataagtaacaaggagccaaatgttaattcacaggcccagaggcctaggagggaaaaatggttttgtgagctgggcccagggccctgctgctctgtgcagtcttgggacaccctgcatcccaggtgctgcagctccagccatggcgaaaaggagccaaggtacagcttgggccatggctttagagcgtgcaagccccaactcttggtggcttccatgtgacacggggcctgtggggtagaggcaagaactgaggtttggtaacctctgattctcaaaccacctagatttcagaagacatatagaaatgcctggatatctaggcagaaatctgctgcaggggcagagctcttatgaagaacctctactagggcagtgcggaagggaaatgtgaggttggagcccccacatagagtccccactgggatactgcctagtggagccatgagaagagggccaccatcctccagaccccagaacagtagatctaccaacagcttgcaccatgcacctggaaaagccacaggcactcaactctagcccatgaaagcagccatgggggctgtacctggcaaagccataggggcgaagccagccatggccctgggagcctacctgttgtatcagcatgccctggatgtgaaacatggagtcaaaggagattattttggagctttaagatttaaagactgccctgctgggctttgcacttgcccagggcctgtagcccctttgttttggccaatttcttccatttggaatgggagcatttacccaatgtctgtacccccgttgtatcttggaggtaactaacttgttttttattttataggatcacaggcagaagggatttactttgtctcatatgagactttggacttggacttttgagttaatgctggaatgagttatgggggactgttgggaaggcatgattggttttgaaatgtaaaaaggacatgaaattagggagggaccggggtggaatgatatggtttggctcttgtccccacccaaatctcattgtgaattgtaatccccaggtgttggaggagatgactgaatcatggaggcagaaaacccccttgctatttttgtgatagtgagttctcacgagatctggttgtttcaaagtgtgtggcacctcggccgggcttggtggctcatgcctgtaatcccagcactttgggaggccaaagtgggtgaatcatctgagaccaggagttcaagaccagcctggccaacatggtgaaaccccatctctattaaaaatataaaaattagctgggtgtggtggtacatgcctgtaatcccaactacttgagaggctgaggcaggagaattgcttgagcccaggaggcagaggttgcagtgagccgagatcacgccactgcactccagcctgggcaatgagaaggagactccatctcaaaaagcaaacaaacaaacaaaagtgcatggcacctcctccttcacactctctgtctcccgctccaccatggttaagatatgcttgctttcctttcgccttcgaccatgactgtaaggttctcgaagcctttcagccatgtttcctgttaagcctacagaactgtgagttaatcaaacctcttttcttcataaactacccagtcttaggtagttctttttaacagtataaaacgaactaatacaagtggtaagtctttattagctagaatcttagaaatctcagtattagaaaggaccttacggatcataacaaaattagccattctatgctagaactctacattgtggtatctagcacatacatctaaaatctcattagctgtctgactcttccttttattgtctccctgtagcttccactcactgactctacacttctttactcatggtaaaaacctagtaatttctctcacaagtcaatattccaaatgcctaaagacaatgatcaagtccgtaagtcctaaatattccaggttcctttttctgtttgtgttatgacataggtgtccaatcccttttaacatctggttattatttttatatatgattcttaacagcatctcactcaacactggatacagaacttcaaatatggctgtactgcctcttttgacaatagtcagggcagtacctgtaatgagtaaaggcagaagaatttgtctagcaaaggtaccgatttcttaggatattttaataagctttttgctccgccacgctgaggcaaataaaacttatcaaactaatgagttgaaaatgagtacgaacaatagtttcaaagaaaatgtaataaatgaaattaattttctgagaattgtctttagaaaatgtcacattcaaaatcacaaacttacataataaatccaagaaaggcttttatcttctaagacataaattttttcttttgtttttgagataaggtctttctctgttattaagctggagtgcagcggcagctcatggctcactgcagcttcgacctcctgggctcaagtgatcctccagcctcagccttcctagtagctgggactccaggtaagtgccactgtgcccatttaatttttgtgtttttttgtagagacagggttttaccatgttacccagggtggtttggaactcctgggctcaaatgatccacctgcctcagtctcccaaagtgctgggattacagacgtgagccgccatgcccagcaaggtataaattttaattaaatatttaaatgatatactcagggcagtattccaaaaaatggtaattcctcaggccacagaagtaaaatggttagttcttttgaaagatatattactagcaagatcttcattttataaaacaagttaagcacatctgaaagccaggggaagttttactttttcacttctcttgttagtatatctttatgtaacttttgtaattttaaaatttcaaagagcaaagttacttgtttgagctcagtttatcagctgtaaaagacacaggcaaagtactctagaaggtttctatgaagctatatggtctctgttattactgagaatttcagtatagaaataaagccaagactattcacagaaagaaaagtataagtagataattcaatttctaactagcaaattaacagcattacaaaatagcaagtttgaagagaaacattttaaacatgaaaagaattcccagacagatttggaaaaagtacataattttaaaagaacacagtttggtataaaatttttgtctttcttgctttgtaaactataaacaaaccttcacaaagcaacaaaataatttctgcactaaataagagggtacactgtgcaaaaattccgaattttaataccttttttagtctccataaacttttcataattatctggaaaatcatcttctggcttaggtttttccactggtgccacaactgcttttccttcctcttcttcatcttcattaaaccacatttcttcatcctcttccaaggcttttgcatctctgcgaaatctgttactacgcaatatagatggtacactgtaagaaatatatcacaaatattgagtaatgatttaaagttcatcatcagattgaactgaaggaaaaatatgtataaccaagatgaactgaagtaattttaactgactataatttatatcaaaataatctctgtaatgatagaagatgtagccagagaacactccaaaatattttaggatgttgtaaattaaactaaatattcttcgtaagttacaacatggagtagtaattcaacatataaatgatatggggtaggggggacgccttaccctcctattcaactctatgctatccagtgatggaaagaaaattcctcagtaaatttcacatggaaaatctgaactacaaacaattttggacacagttttgtaggctataaaagcagtatacttaaacaatacctgttcagtttctgattttgtctgtctttttcttgctcatatttagtcttcaatcctttgaatgtctgaacatattcaatcgattcaagtgctttataaaagttttcaactatatgggcagtaagagacttgatatcttcctgtataagcacaaaatttacatttaaaatataatacaatgcttgttagaagaaaaactttaaaattttgttttgtagttctaaagctgatcaaaaaaggtttttcaaaatcaccttccaaaatgtaatgtcctggtttctttacacatgagtcaggactgcacagaaaacttgaaaaaaaaggagaagcaatttactggagtccttttataggactataaagagcattcgaaaagtaaatagatttattttacatcttctattttttgtatatatatatatatatatagcagtttacaatttaaaaagcacttttacataaaatttcatttgatcttcacaacaattctatgagataggttttattattcccattttagagaaaaaccaaaattgaggctctaagagaggctggatggtttgatccagagcacacggctggttagagggcagatgttaaaattacattttcaaaatactcacggtgatggataccccaaatacccggacttgatcattacacattctatgcatgtaaaaaataaatacatgtaccaaatacatctgtataatattatgtattaataaaagaaaaacatatttttcaacaaacaggtcttatttaatgacttcctgtttaactgctatcaaaatgggatatggttgtggtggttttctttctggtacatttgttaagttttcaaatgagcctaactctgccacatatatcatataggagctggcaaaggcttgatgacaaagagatctctctcaagcctttcccacatcagaggctggctttcacacacacagaagaagaaaaaacaacagaggacacgtgttacctaaataataagaagcaaagacttctctgactatattatacacacagatctgataaactatctggaattctacttgtctattcctatagtcttccaatagtataatatctgtgaaataaactaattgatagtaataacttctaaattctaaaccatcactgcaaatgcatgcatgcccagtaggcttattttaaaaaaaaaaattaaagttgtgattgaggactttacagataacactacatagtaagaaacacacaggtcatttcttgaaaagatacaccataatttggttgcattatggattttaagtcttaaaactagttctcctgtacttctcaattgaaaaaaaatacgcaaatcagaaattagaaacctaggtaatggctctatgttatatgtgaaacgaaaaaatacattaagttttggggcacaaggtacacaaatcgaccactcgaacttattttcacaaaaacaattccatcatgggcatagggacagggttgtaaactctaccatttgctttatctgtatctcaccaaaattttaaaggagaataatataaagtaaataaaatataaagctttgatttattgcagcagtacaatgggaactagtgagctagttaaccatgttccttcttttaccaggttaaagacttctatcctcttcatccttttaaaaatcatatacttggcaattgaccacttttagaaaaacaatccagtcagccaaataatcttcatatgagaatagcatgttatcagcaaaaatctgacttgtaagaaataaaactagataatgaatttctagcttggactttgatttttcaaattatttccagccaggtgcagtggctcacacctgtaatccaacactttgggaggctgaggtgggagaactggttgagcctaggcgtttgagaccagcctgggcaacaaagggagaccccatacataaaaaaaaattaccattagccaggcactttagtgcatgcctgtagttccaattactcaggaggctgacgtgggaggatctgcttgagcccaggaggtcgaggctgcagtgaactgtgattacattattgtactccagcttgggcaacagcatgagaccttgtctcaaacaaaacaaaacaaaaaataaaacccaaattctttccaactatgtggccatttcctcagtggaatgatttcggtgtgtttaagtacaggtgaagtaaatttgttgtactggttctacagttatctgttgcattcctgttattcacatagactgccctccagattgtttatgacaaatcttctgttgcctaaaactaagctgggacaaagcttcaagttctgactggtcctgattgtgctactatccaaaaggatgttcttgaataggtcacttaataactttgggtgtcttaatttcctgatctataaaatacggtaattggagtagtccatctaacttcctgatctctttaacttaaaattctaggattccatcctaccttttatgcatgttgtattaatgtctaccaaatgatttttttttttgagacaagagtcttgctctgtcacccaggctggaatgaagtgatgcaatcttggctcactgcaaccccacctcctggatgcaagtggttcttgtgcctcagcttcccaagtggctgggactacaggcgtgtgccatcacactcagctaatttctgtatttttagtagagatggggtttcatcatgttggccaggctggtcacgaactcctgaccttaagtgatcagcctgcccaggtctcccaaagtgctgggattacagacgtaagccaccacgcccaaccccaagtgaattatttttccatctttctattctttttaaatcattacctctacaataaaaatatcaccttttcctaaaagatcacgtgaataaggcatgattgactgaaatgtccacatacaccaaatgagatcatgaaacatttggccaataaaaatggaactgagaaaatcaagtaaatatgggctgaaagactatgctgaatttcacttttatatttcacaattaaaaatattagcgttaaaaaatatcagtgtcaaaagtaaaaaccactaaactataaccatgtggcaaataagaattaaaaagctactgatttttaaaatttctgtttattagaatagattctaagacacatggaatatataatttcaggggtgaaaagggaatgaagtcactttgcttacatgtaattcttttacataaaaaattatttacatataattacatataataacagctgttttatataaacttaccactcttataaattcaaacaactcaataacagctgaattcaacagattataccgagttccattatccagaagtgcatttataactggctcaaaaagatttcccttggtgatgtaacgattataaaattcatctttaagtccaattatccgcctcataaagcgaagggcacctaattaaaaataatatagggaataagttaatgatcttactaaaatcaattattatacaggtgtttttccaccataaagcaatgtatatgctcttctaaaatgaaaagtaaaactgtgtataaagtaaaaagtaaactcctctaaaatgaaaagtaaaactgtctggtaaaactggactttgaggaaaatagagctgcagaggatcgctcaaaacctgtacaactttgtagccagaactaacaacaacaacaacaacaaaaacagtaattggaatctaggagataaactacccaggcaggtagctctgtgacagagatttaaaaatatgcaaaatccatagactgcaaatgctagcagtatttacagcagtgctggtggatgctgagacaacgcagtgaaggcagctcagaatcagtgggggcactgtcattaaggtgggcacaggagtgggcaacccaccatgagctaagattgccttgcctctctgagggagggagctttagaggcaaaagcttgttttcagttttctgaaaatacagctaaagtgtgggcagcaagccacccaggtgccgaggcaagagactgagggcacgagctgttctagtataataaaatatataaaataagaatagttatactagatatagatcttagatatgattatatatgaatatcattaatcattagtttgcagtaattattctttattccaatattataataatcctcgctctacaatcataacctaggaaaaaccaggccatgcagagataggagctgagggtacatactgagaagtgaccaaaagaccggacagggccaccagagggctccttggtctagcggtaacaccagcgtctgggaagatgcccgttgccaagcagaccatggtctagcggtagcgttagtgtcaaggaaaaacacctgctacttagcagaccgggaaagggagtcaccctttccctgggggagtttagagaagactctactcctccacctcttgtgaagggcctgacattagtcaggcccacctgcagttatccagaggcctaattgtttccctgtgatgctgtgcttcaggggtcacgctcctagtccacctttatgttccatcctgtacacctggctctgccttctagaaagcagtagcaaattagtgaaagtactaaaagtctatgataagcagaaataatggtgtaagctatctctctctctttctcctctctctgcctcggctgccaggcagggaggagccccctgtccagtggacacgtgacccatgtggccttacctatcaatggagatggttcacactccttattctgcccctttgtcttgtatccaataaacatcagcgcagcctggcattcggggccactaccggtctccgcgtcttggtggtagtggtcccccgggcccagctgtcttttcttttatctctttgtcttgtgtctttatttctacaatctctcatctctgcacacggggagaaaaacccaccgaccctgtggggctggtccctacactaaagaggctcctgatgccagatgccaatcacataaaggagatctaaaggttttttacttctctgatgaagactatttccactcacactattctacttctccttgccttgaaaaaaacatttgtgctgaggcaggcagatcacgagatcaggagatcgagacaagcctggccaacatggtgaaaccccgtctttactaaaatacaaaaaattagccaggtgtgctggcaggcgcctgtagtcccagctactcgggaggctgcggcaggagaatcacttgaaccctggaggtggaggttgcagtgagctgagatcgtgccactacaccccagcatgggtgacagagtgagactatgtctcaaaaaacaaacaatttgtgaaccaatcctatctccgtattataattacatcattctcttatgtaccaattgcttacaagctattttacctggctaaatatgcactgtggcagatcagaatgtatttgttaaaagtaaaacagagtaatgaataagaagtacaacttgacttcacattttaggacactgaaaagaaatctcctttttaactcgtgactagctaaataaagcttactaaatttagcaatattactgctaaaaatcttatggaacaggaaggactataatttcaatcctttatttttatatgttgatcctttaacttgtatcctttcccctaagtagtttattctacagataccactagtcaaatcttcaaaacacaaggcttctgattttataagtcattttctcattccaaccctctgttcatagatgaaactcattaaacaaagaacttgtgcctgtcacaagaggttctaaacattatctgagaataaaacagaaataggccacataaggtataaatgttaactgtaacaccaaacaagtatggggagacgtgttagacttacaatcttccctctttttgtggcaggataagaaatggtttacttaagatgcaaaagactgaagcactggcaagtttgtgagcaaagaggcacaattctacactgctggtaaatgaactgacatgtacacaaaactacagttacaacagcactgcttataataatagaaatcttgaaacaatataaacatttaaatattggaaattgtggctgggtgcagcggttcacacctgtaatctcagccctttgggaggctgaggagggtggatcatgaggtcaggagtttgagaccagcctggccaacatggtgaaaccccatctctactaaaaatacaaaaaattagccaggtgtggtggcaggcacttgtaatcccagctactcgaaaggctgaggcaggagaatcacttgaaaccgggaagcagaagctgcagtgagctgagactgtgccactacactccagcctgggcaacagagcaagactctgtctcaaaaaaaaaaatggaaatgcattcaattgacatgttcctattaagggaagtattctgcagtcatcgaaaagtactatttaatgagccaaataggaaaatctgtcttaagaacatcaaacattccaaaattaatataaaaatataatgtaattccaatcaaaatgaactggatacaaccagttatcatgaaagaaaaaaatgtctaagaacaaccaagaaaagtatgaaaaacaaaagtgaaggggtctcagtaggtattaaaccttacaagagacactataatgcctggcataatataataaacacaggttttttgtttgtttgtttgtttcttgagacagagtcttgctctgttgcccaggctagagtgcagtgttgcgatttcagctcactgcaacccccgtctcccgggttcaagtgattctcctgcctcagcttcctgagtagctgggattacagacatacaccaccatgcctggctaatttttgtagttttagtagagacagttatattgcccaggctgctctcgaactcctgacctcaggtgatccacccgccttggcctcccaaagtgctgggatttacaggcgtgagccactgcgcctggccaacactggtacttttacatttggtgaaattaaatgactgtccagaaataaaacaaaagtatatatatgttaacttatttaacaaaaatggtatttcaattcagaaggaaagaggaaaggtatggttgccttaataaaggtgctgatactgttggctatgtatctaggaaacactcatttcaaacactctcatttcaaagtatatgtgcaaaaacaaatttcacatgtgttacatacataaatgtaaaaaaggaaataaagatattagaagaaagtgagaatatctgcataatcttaggacataagactttcctaagcaaaacaaaaaacccaaaagtcataaaaggaaaagaaagacatttttgccatcataaggaaattttaaagttatctggaaaacaatactacaaataaaggcaaagacaaaagacaatgaagatggacattttctcctcaaaacatgataaattgttaatatctctaatatacaaaaagctctaagaaaaagataactggcaattcacaacagataaaaatgcaaagtacactaatatatgaaaagatgctgtcagggaaaatgcaaattagaataacaatgagataccacatttttcagtatcagattgataacattttaaaattagtaacactgaatgctgggacaatgtcaaagtgcttcaattttggcggaagtaatctggcagctatatggtaaattaaaacttagagatacattaaaaagtataaaacagataaatattttctcttaccaatcccattattgagaatctatcctatagaaagaaataaatcagtacttaaaagatttatgtactagactatttaccacagtgagatgtggagtggcaagaaagcaaaaacaatcctgtaatttatccactggagaatggcagaagaatctgtggaagagccatactataaaatcttactcagctatctccaggaataaaattagtctatacaatattgattaatctagagtagtattagtgggctgagaaatgtgttggtatgatactgttttgtaaatataaaaaacacaaaaaaatcctctatacatgtgtgaatatgtttattacataaattggtacaggtatgaaaaaaagaaataatgcagacagttaacactggctattttaagtccataaaaataaagattagggagattaacattttctctatacattaaattaaatgtctatatttaaaatataatttttatggtcagaataaaaccacaaagtacttttcatttggagggaggatgtttctttctctgcttgcaggtgaaattatgaaggtgacagtttatagtctgctaaaaatcaacattgatgcaaatatcaggataattataaagagtgactgactactaaatgacagtttgatgaagtagatgtaaaaaaacagcaggactggttctgttagtaaaatgctgtcactgcacatggtaatgtatcacaacaaaagttaggctcattaaatctaaatgtgagcaatatgtgggtgggaaaatcactacaacctagtcctcttgccctttaaataagaacaaaagaataggacttctcacaatcatctcattcatagaatatacactgctaataaataacttcaaatgggtaacttcagttttatctctattaaaaatgttgctccttaaaacattttatacttacacaaggccagaaaagtgtgctttgaattcatcaagaccaagactcttcttagcaagtccttgttcataatatagttttttatgtgatatgtgtgatgttccacacaaaatgtgagtaactctaaaattaaggcaagtagctgtgctgtttgataattatctacaaaagaaagtaatctcatgaaaataaatattgaatatatctaaataaagaataaataaagcttacatcctatatgttataacaaaatctaaactgtatttcctccttttttttttttttttttttgagacaaagtctcactctgtcacccagtttggagtgtggtggtgtgatcatggcacattgcagcttccacctcccaggctcaactgatcctcccacctcagctgccagagtagctggaactacagatgtacgccaccatgctagctaattttttttttcaagtttttgtagagatggggcctcactatgttgtctggactggtctcaaactcctggactcaagcgatgctctcacctgagcctcccaaagtgctgggattacaagtgtaagcccctgcacctggcctatttcctccattttcatatccatttaaaaggctgtagatttttactttttcattaggcagactctccagaagcatattatcagttttacctactagataactaagacttatatttgcataaaatatgaaatacagaaagaaaggcaataaaaatatatgaacatgataataataccttgatggcactgaggagttcttggtaatgtttctgtaataaatgctatattattaatattaataaatctataaaagggcccattgttaaaaaatacttaaaactttttgcctaaagtggctcagtgcaaatttctcaagaaaaattatacgcttttagaaaagacattttaagaaaaggatatttttggctgtttgaatatcaagtaaaaaatattacatcaagattcttttttttttttttgatacagagtcttgctctgtcgcccaggctggagtgcagtggcgcgatcttggctcacagtaagctccatctcctgggttcacgacattctcctgccttagcctcccgagtagatgggactacaggcacccgccaccatgcccagctaatttttttgtatttttagtagagatgaggtttcaccgtgttagccaggatggtctcgatctcctgacctcgtgatccacccgcttcagccacccaaagtgctggcattacaggcgtaagccactgcgcccagcctgattcttaaacatgatttaatataatttcatatacaacttcttttttttttttttttttttgagacggagtctcactctgtagcccagactggagtgcagtggtgcgatctcggctcactgcaagctccgcctcccgggttcacgccattctcctgcctcagcctcccaagtagctgggactacaggcgcccgccacaacgcccggctaatttttttttgtgttttcagtagagatggggtttcaccgtgttagccaggatggtctcgatctcctgacctcatgatccgcccacctcggcctcccaaagtgctgggattacaggcgtgagccaccacgcccggcctatttacaacttttaaaatatcaactcacgatgtccatagagagggacctactgaataaacttgcattttttctttccctgaggctttggttgatacattcatgaaatgattttgaactgcatcctgaacatcaaattttaatttatgtcaagggctcacatggacaatcatgcaccacccatattataagtgctttagacaaagaaatattttcttgttgtttgagacagggtatcactatgtcacccaggctggagggcactggtgcaatttcggctcaatgcagcctcaacctcccagactcaagtgatcctgccacctcagcctccctagtagctgggaccacagggatataccaccatgcccagtatattttttgtagagacgaggtctcactatgttgcccaggctggtctctaactcctgggctcaaccaatcctcctgcctcggcctcccaaagtgctgagattacaggtgtgagccaccacgcttggctagacaaggaaatattaagctgtaaggaaattataaaatcacaggcttacggaatttttaaaaaaatgacatcatctagtacaactattttatttgagattatatacataaatattttggggaactacaatgctattggaaataaattagcattgtaataacagaatgaccatcacatataaatacacaaaataaaattctgatatttcaaggactgtttctactttaaatgcaagtaaagagtttcacttgctccagaccaattgctctaacagccagtaccacagccaaaatttgaactagtccctcatcattaaaaccaattcctggccaggtgcagtggctcatgcctgtaatcccagcactttgggaggccaaggtgggtggatcgcctgaggtcaggagtttgagaccattctggccaacatggtgaaaccccatctctaataaaaatacaaaaaaattagttgggcgtggtggtgcacacctgtgatcccagctacttgggaggctgaggcgggagatggtttgaacccagaaggtggaggttgcagtgagccgaaattgtgccactgcactctagcctgggtgacagagtgagactctgtctcaaacaaacgaaagcaattctttatttctcaattcccaaattttattacaaaatattttttaaccttgaccctcaatgctgtatgtggaaattaagtttaaaaaaacaaaaacaggccgggcgcggtggctcacgcctgtaatcccagcactttgggaggccgaggcgggtggatcacgaggtcaggagatcgagaccaccctggctaacacggtgaaactccgcctctactaaaaatacaaaaaatcgggaggctgaggcagaagaatcgcttgaactcaggaggcggagcttgcagtgagccgagattgtgccactgcactccagcctgggcgacagagtgagactccatctcaaaaaaaataaaaaagaaaaacaatgaactacagtgttaaacaaatgtcttgtcttcatctttataacggggacaagaaattacttgtatctctaaatagtccaatctctaaacagcctccttatttgaaactggctcccctttgagatttgatgaggctggcagaaaaggtatgggacggtaggtgcacacagcacatgtctttattagtatcaagcccatacctactatgcctattctaagtagaaacaactgcttttagactcagattcatgaacaataaccataaagtggtcatgaaaattagttgcaaagtaattggttttagtttactacatttcaaaaataagaactaaatcctcaaatttcagacaatgccttctcataacaacatcagaaaacaagctataaattttcagggaaaaacaacagaattccaactcgttttctatttttaatattggagatagtggaattacaaaagtaaatttcttcttggattttgtttttatgccaaaatatgcttttcttagccttatataagtgcattacacttagagtagaaaaaagtttataatttgcatgtattcataaagtatgaattcatacttaccgggacaaattgtgttgtttttgtttgatccaactatattatctaataaaaaaattaaaaattaaaataaaatacttcagtaataatatcccagatttccctagtactttataatatacaatgcatgtcttcaatcataatctccttttaccctcaaaataaccataaagacttggttgcttcagcaaaattataactatatctgcaatcttttacaaaagtggatgcagatgtggaattattaaaagacaacatagcataaatattctgataaaaagtaagattacaaccagagataaaactgacatatcttcttttaccttctcctattcatcattcaacaattagggtatttctcttcatctcatttttgttttactatttttaattttttaaaataacatttgcatttgattatccattatacatctaatttttaaaaacagaaaatgcaggaatttttaaaactccagaataatgaatgtgtttatgctttaaattaaaaaaaaaactcaattaagtaggccattataaataagttccaatttctaggaatacattctagagcacatcaaggcacatgtgcacagggaaacacaagaatgtaactggagcattatttgtaatagcaaaaagctagaaacaaatgcacattagaggcagaatggctgaattacagcatcctcataagagaggattatgtaggagttaaaaataaataagaactctatttcaatatgaattagatcaatatgaacaggtatcaatacgaatagatctcaaaaataacactggataaaaaatatgcagaataatatgtatgacagacattaaatttatagcaactttgaaaacaagaaaaataataccgtatatacacatcataacaacataagtaaatataggagtgatacactccaaattcagcataccttgagagatggaggaagagggggtagaatgggaatgggaatgtgaaggggtacatatgaaactccaactatatctgtaatgttttaaaaaaaaatctgaaaaaaaatatggcaagttagttttgataaagccaacagggagtatatgagtgtctgttatattattatctatatatttctgtaagctggaagtgttttattaaaatgaacataaaaaatgcattattttcatttatataaatggaaccattctgcaagaaaaccctctgcgatgtgcttttgtacccattcaccttgatattttggggaattattcagttgatacatcaaaattcaattattttaactgctatatagtattccattatatgaaaaaaacatattttattcattttcctaccacaaacaatgcagcaacattcttgtacctgtcatgcatatgcacaaacattccctagagtatatactcagaaatggaactgatagtattacatagggtgtgctcatgtttcaactttattagtttcataaacattctcctaacttccttttaagtgactcttcaggttaacaagtattctcagatagtggctaatgttctattatgccccacatatttctgatttcactaattaagttgtacgcttttcaaagtcctttgcttatgttagtatgtagtatggtcatatggtaacatatgagactgatgaaatctcagagaactgtaatatctacagttaagttgaatatagaaggactcaatttaaaaattgcctccaaattagatacatgcaactataattacctagagggatatactaaaaccaaaggattctgcactcagactccttcaaaaaatttttagattttcactccattttaataaactgaaaacagaaattgcagctgatgaattacgggtgccgattacataagaaagagaatatggaaatgcaattttaaaaatactaaggaaaaagccttgcccctatatattagcacatattggcatatgaatgtgcatttggaggctaagttaaaatatttatactatttgcttctactcattctagatatcgcacaaatttggcgacaatgctttcttttgataagtgtctacatatcaattccttagtgtgtaatactgtttgccacattttcttttttttctgccagtggtctacacgttcagagaaacttccgtagcaacaaactatagaaatggcccccgaaagaatagtcttgccacattttatcattcacttccataaccttaagaaacaagaaaatcataattttatattgcagtttaagtttttcagtcgtaatctccctgtcttataaagtctcaagtaaattgcctgttagtttaatatttatctcatccttctttaaaaacagaaatcacagcagataaataaagagaccctacccttttcacatttgtcttctgaagtattggtcaaaagtggtgctgtgagaacatgcatacaatggttgtagaaaaaatttagaaattcacttttttcggttttctgaaacatagaattttttaaacaatactgttacttatgtaaataaaaacatcttcaagattagcagtacataccttttccagaaccaaaccaaaacaaaaagaattagcagtacagatcatatataagcagatactttaaaatactgtgaaaaaaatcaaacacttggttatacgttgtcaaagaaccaaaaactaactatattcactttaatcttatttctgtggaactgaaaattaagtctacttcatattatgtactaagtaaaaatgaaggcaagataaagatcagagagcatcacaaaatgtttttctgaggaaaattattcaaaataattttttaaaaagatgcctgtgatacgaatatgaaacgcagtgaagaaccaatctattgtacaacatatataataacaacatattactaacaatgtattacacttgcaaactgctaagacagtagattttaagtgttctcaacacaaataaatacttgaggtaaaacagacacaaaataaacaacatgtaagtcagaacagcaagcaccataatcactattgatcccatttgtctctctctctctgcagtgtattgagtttttcccaagaaagtaacaaagaaagaaaattctctcaactttaaaaataacattcaaatgggggtaaaaggcacatttgaatctgttttggaagaataaaaatgtttagaaagaaaaagaaccaattaagcccatgtgatagcaacttaactacctaaaatttggaaccccagatttcaccaattctatctaaattttaaaaaccactgaatcactttatcaagccactggatgaaaagacaaaatttaaatcaacttttaacattttaatattttatactttgaaaatttggaaaataatgtctatggcttttgccactattttttacacaattgggtatacaaacttgtaatgatttaaaaacgatgtatatattctctaaatatgaaggaaattttataaagaaaaatatccctccatattgagagaatgactattaatattctggagtatctaatccttaagtattaaggacttaatccttaaatcttttaaaatgtcttaggtaattaagatcattcagtatatttaaatttttccttttttatggtgataaaatcacgcaacataaaacttgctatttaaaaatgtattggccgggcatggtgactcacacctgtaatcccagcactttgggaggctgaggcgggtggatcacctgaggtcaggggttcaagaccagcctgaccaacatgatgaaaccccatctctactaaaaatacaaaaattagccaggtgtggtggtgtgcgtctgtagtcccagctacttgggaggctgaggcaggagaatcgcttgaacccgagaggcggaggttgcagtgagctgagatcacgccactgcactccagcctggtgacagagcaagactctgtctcaaaaaaataataataattttatcatttttaagtgtacagtttagtagtgttaagtataatcacattgctgtgtattaaattttaagaaattaacacatagaggccaagggccataaatggaattcctaacattttactaagattttgacggattacaattttgtattttaccacaaatgaattgctataagaataccactgctacttaaataccaactggacaaatacttaaaatacttgtttctcaaaatcttattacaaagccacctaaaactgactaggccaaaacatttttatctcagagtaatttcttacattagttgtagccagcatgttctctggatcaattagagtacgaagaagtcccattaactgaacagcgcctcctagctcaggatcagtatcacagatcatttgttcaattaccacattaataagaagaatatcctggtggcaaaacaaaacaaaacaaaacatgtttccattagacctggtttagatctaagacaaaaacaccaactgaaagagcaaagtgagaattatatagagaaaaaacgaagaatggaatagcttatttaaacctctattcctaatgcttttgaaagttctataaaatactacacactagagtgaaaaaaaatcccactccgagaaaaaaaaaagaagaaggaggaaaaaaaacccacaaaagcagagcatgcttcaacttataggaagtggaaaacaaaattctttagcagtagttcttgttcagtagaggttctaacagaatctcattttgggtttcagactcaggcgtaaatttagaggttgactaaacaagcaagatcacatgaccctaagacataaattatctcagcctctaactagtaaatccttcctaacaaaaagaaaaaaaagaaaaaatgaccaaaaataacccagtacacaactcttcatgcaagtgaacactgtgttatataacaatctaatattaaatagatttgttacattagtaacatgctcttggattttatttatttatttattgaaacggagtctcgttctcttgcccaggctggagtgcagtggggcaatctgggctcactgccacctcattacaaaccagtctcctgcctcagcctctttagtagctgggattaaaggcatgagccaccatgcctgactaatttttgtatttttagtagagactgtcctgattctaagctggcatctctattttctgattgggaaatataaagaaaatcagatgttcaaatttgtttcattgattctaaaacagatttcttaaaaattttcacctcttaaaattaagatacattttgtaactgatggcatttgacagccactatcagccaagtggtaatcgtgacaaaattacataaaaatcttctactgacactgtctggtaagatcaagaaaacattagcatctgcatatcttaggtttgatggattcagtaaacgagaggagagcataaatctttaaaatataaggattcttttaaaataacacaaatgttaccatatctaaaaaattaacctaagattttattattaaatgagaaaacacctaacaaaataagtaattcagtaataactatattactcatccagtcaggttctgcaagttttactgaatgtttcaaaggccattaatataaaaatatgtgcaatctgtggcataaaaagatgacattattgctaaatttaccctttctgcttggatagaaacaatgactacagtaaaaaatgttaatatttcctttcatcttaatacatatttaaatattgtaatccatgttgccataaccaaatctgctccataatactttaccaaaaggaaatgtttgaatgctgagcatttattttaaaagggcactaaaatatcaactgccactgaatataaaaataagttactttctgtttccttcctaaaggtcaccaccagcccagtatggaattcagcatgtagaagacttaatttggattttttttggtaattaatttatcttctcttgtggactaaattattttgaggcaacacagttttaaaaatgtaaaattgttagctctcagaaaattcaggaaaatgaaacccctagaaggttgttataagaaaaaaaaacactgagaaaggatcttttcacagtgaaaaaatcaatcactgcttttctaagtcttaggtatcaattaaacaagaaatatttttaattaaaacaggaatcaaagcttgaagagttaagaattctgaaagttaacagtttactaagatcatggtctgagattgattcatggtcattttatgataaatgcctttaatcacacacatcactgaagatggagcaatgggagtgttaatttcaaagttatcttttgtaaagggtggcattaagataaaccaatgagattataaaatgattaataaagtaggcatttctctttaaagtcagaattagcatcatttgacattgcagcattagcccaagttgattctaaaataaaatcactttaaaaaacattgaaaataactaacaaacatagaaagtataaatctaaggacacattaaaagattaaatgcaaaacacataaaacaactataatttcattcagtggtaactgatgcaagcatcaaattaaaattgagaatcaaaaactttccttaacaagtggatcgcacatggtggctcatgcctttaatcccagcactttaggaggccgagatgggtggatcacctgaggtcaggagtttgagaccaccctgaacaacatggtgaaacctcttctctaccaaaaatacacagttagccaggcgtggtggcgcacagaggttacagtgagccgagaatgcgccattgcactccagcctgggcaacaagagtgaacctctgtctcaaaaaaaacaaaaaacaaaaaggaagacaattataattatctcctacttaaaactgaggcatttttaataataaaaaaagagtacttttaattatagctctctgttcattttgtccttaaaatagcttaaggggaaaatttaaatatatcagtagtgggaaaacacaatattggtctcattattaaactgtcttttttttaatgttttttatttccataggtggttggggaacaggtggtgtttggttacatgagtaagttctttgctggtgatttgtgagattttggggcacccatcacccaagcagtatacactgcaccctatttgtagtttttttatccttcacccccttcccaccctttccccaagtccccaaagtccattgtgtcattcttatgcctttgcatcctcatagcttagctctcacttatgagttgagaacatacgatgtttggttttctattcctgagttactgcacttagaaaaatagtctccaatctcacccagtcattattaaactttcattcctacttaaaacatattttttgaacaaataaaagcaactttttagttatcctaggtaagtacctgacctgtagatctcctaaggcttgaaattacatttcattaacacttgaaatttaagaccaatatttacaaatctgattctattataatctatttatctcaatattggtttgaatatctgggtttctttttttctaacaataaacaaaatcagtcgccacatattctaatttggccaaagtcacaacaagtcagaaatctattattttgctcccaagaaagattaagattatgttatgttttttc

SEQ ID NO: 107 - DNA, 112730 bp, Homo sapiens
gcaatgttaggagacatattttttgagaggaccttagacattttcttaggcagattccaagtttaatctgtaaaggaagtcaatctaggtaggctcagttaagaatcattttagtattattcagaacagaaaaaatcccactgccccccatggcaagttttgtatcatagaaatcaacagcttttgtttttcctgatcagttatattagaaaaccttgttccctaggttatatgcacaaaacataattaagaaacacatgtactttgaacctgctgtatgattattattaaataggtcaatttcagtttattggttggtgagtttatttataggtagatagataaatagttttgtttttcaaatttgcggatctgtcttacttacagagtaatgttacttactatttactataagaaaaaaccttgcaaatcgtcttttccaaaagaagaaataaggcacagttggattattttgtgtacacacacgcatctgttttaaattgtgttcatttctgtccctattcctaagctaacagcaccttattttaattactgtagctacctacatatctttattctactattctgctttttcagacttttcttagctgatttttcacatgtcaaattagcagactttcatggaaaagtttcgaattaaatttgtgattgcattcacttcctagaataattttggaagaattgacacatttagtttaatgattcttcctatccaagaacatatatttctctcttttgaggtcttgttttatatcctttattaaatcttcctcaagatcttgcatattactaattagattgatttctcagatatttgtggttattgttgctattatgaatggaattttttttttttctttttcaattgtttgttgctgatatggttgggaactgttgcttttttatgttgctcttgtatttggccatctcgctgatgtacagatgtcatattataataatttgttgatttttctatagttttctaagtaatataattatatcttttgtaaatcatgacagtttcgttacttccttttaagtctttatttcttatatagatctgttatttcttgccttactacattggcttagaccttaaggaaatgtacagtattagaggtgagagcagtaatcacttctattagaaactacagtgagatatccaattttttgtttattaaatgattttatacattttactgaatttctcatgctccatgagatgaaacagcattctcccatacttctggtggaaatgtaaatgaatgcagctctttatatatactcctgtaattttataatctagatagtcttacaaatgtttcatgtcctttgatttagtaatctcacttctaggactatcccttggaaataataaacaatattttagttcaagttgctcattactttatgttacttataataagtatttggaaataaatatctaacagtacagtaatggctttgtaaattatggtatatgatgaaatattgcacaactattaaaataatttgtaatattaataacttagaagtacttatattactaaataagtaaaagaggataatacagaatttttatatagtaaagttgtatcagcatcaaaatacattgaacaaagattaaaacagaacttagatcatcacatcaaaatgataatagtggtaatctatgggtaattactttctggatgatttcatttcctcattcatagttttctatggtgagcatgctttgttcttaaaatcagaagaaaaagaaacttaaagtgtatgtgtttgtaatactaaactatttattttcatcaaaataggtagaaagggagaaatcttagcctattccctaaatggcaagtttagttataatttttttttttttttttttgagacggagtcttgctctgtcgcccaggctggagtgcagtggtgagatctccactcactgcaacctccgcctcccggatccaagtgattctcttgcctcagcctaccaagtagctgggactacaggtgcccgccaccacacccggctaatttttttgtatttttagtagagacaagatttcaccatattggccaggctaggactagttggtctcaaactcctgaccttgtgatccacctacctcggcctcccaaagtgctgcaattacagtcatgagccaccatgctgggcctataattttttagagttaatatttttataatactcttttcaaaaaaaaaacaccttgctgaatgtagatagcaaatgtcataggagaaatctgatacctgagagagtagtacatagtttcagaaccaaggttgagagttatgctctgggatctgcttctaaatgatctgactgccatatcagtgagtcagggaggaagtgtagcagatatccacttgatttggtttcttactgtcttgtcacccatgtgcatgtgtattgtaaactagctgtcatttagcagccctgtgatatactgctggccgagtttcgtaagaaagcttctatgtttgtatagattttagattatcattcgctttatttaagaaacattcattaagtactttcagtgtgtcaggaaccttggtagccaaaggacaaatgacataaaaaccacacagatggcctctttcttgagcagcttttgttggaaataatttatgactaatattatgatggagtgagatggtgtcttactagtaagaccagaaatacttaaattctaattcaaccaattcttgagatcccttagggagctaggtataccaaaattcaagttagaatttgttggcttaggcataggcccctgcctcacaatccagagaactaggttattctatatggaatatgcctttttcctttaccagctaaacctgactttcctttctacgtgttagcttaaattcaagtcgtctcaaattttactactctactaaggcaaaaaactactggtactaaaagaaaatgagcaagaaatgtccaacaagctagatcttgttgaatagttagcaattcagatgtcttactacctaccaacaaactgtccccctccattaccttggcccagtttctatatttggaaaaaaaaaaaaaaaaaaaagcagaacaaaaaaggaataagaaagatggcttggctgctccaagcagccttggaatgttttacctctggtaatgtggaagaaaaataaaagaacggccatcctcagtctgtttcaccataatgtgtagttacaataccaagaaattttgagttattaaaaaaattattttacaaagcagtttcattggtaagaaggattaaagactaaaatctgtaagatgaatagacttttgtcagaccaagggagatggaggtttggggtgggagaatgtgttggattccagctatattattcaaatgctcggagacacagaacattagagaagacaggagttcactgtaggtgatggtgagagtgggcatggagcaggagtgccaagagatgaagttataaaactaagcaggagttagatcatgaagaactttatgtactatgctaagaaatactgaccttattgtgaatgtatggagggcccattggctttttggggagctaggtctgcaatatgaatattagaaggggcaaaactggtgataagggcttgcactagtgtacaagcaataggtatggtgaaaatggagacatttgagatattttgaagaggtagacttaacagggacttatgatcaacatagataatgtatatggtggaaagagaatagctttttgagttggataagtgtgggttcaaatcccagctctgtcacttttccattttaggatcttggatgttttacatacccctgagaaccttagttttctcatcttaattgggacagtaagctgggtgccatggcttgtgcctatagtcccagctacttgggaggctgaggcaggaggatcacttgaggtcaggagtttgagtgtagcgtgggcaacatagtgagacataatctctaaaagaattttaaaaattaactaggtgtggtggcatgcatctgtagtcccaactactcaggaggctgaggcaggaggattgcttgagtccaagagttagaggctacagtaagccatgattgtgccgctgtactctagcctgggcaagagagcaagactccatttattaaaaataaaaatttgggacagtaatatttagcccatagggatgtgaaacaatatatggaaaacatccagtaaagtgccttaccacatagtagatataaaacaatagttgctcttgttgtcagggtgaaggagatagagaggaatcaagaatgacttccaaattttctatttgaatggtgaaaaagagctatattaggaaagtgggctaagctatctggttcttagattgcttgtgaggattcaggtggaagtgttcactggcagttgatagtaagagtatgacacttctgagtggaaggcacagatctgtgagttaatcagcttacacatagcagtaaaagttatgaaagtagatgaggtcccccaagaagagagttagaatgagaagtcagaaccctggagagtggcctaggaagagtagagggtgtattttgtttgattgtttgtttgtttgtttgtttttgagagggactttctctgtcacccaggctgaagttgaagtacagtggtgccatcacggctcactgaagtcttgatccccagggctcaagtgatcctctcacctcagcacctcattctcatgagtagccaggactacaggcacatgccaccatgcctggctaattttttaatttttttaagagatggcatctcactgcgttgcctaggttggtcttgaactcctgggctcaagcagtcctcctgcctcggcctcccaaagtgcggggattacaggtgtgagccactgcacctggctgataaatcttttcagaaagtgacataaatttagatttaagtgctgattttaaaaaattgctaaggccatgcatggtggtgcatgcctgtaatctcagctacttgggagaccaaggcaggagaattgcttgagccctggagttcaagactggtctgaacagcagagtgagacccccatctcttaaaaaaaaagaaaaaaaaaagcaaccaaacaaaaaggagctaacagagaagaaggggtttctgaaatgtaggaagttagctcacagagtcaaaattgaataaggatggagtggcgagtggtgtcaaatgcagcagagcagtcctgtaatggtcactgaaaaaatgcacaatagatttggtcattagaaggaagactgtgaaccaggagctgagtaagtccttgtggtagagtgctttgaatgccagactttggtcggtggaagaatgattaaatgttattgagcacgaaagtgagatgatcagaacactacttttttatttttctggcagcagtgtgaaggatgagaaaggagggaaagctcaatttaggttggtagaggcacagattgaacaagggcttggatcaagatgataatcttgcttggaaacaggttagcgtaagagctgttaggcagtagtgtcttcaaaatttggtcatcactggatgtaatgagtaaagaagtagcctaaaagatgacattttaaggttttcagtgtggataacaaggagaataggggtagcatttactgaaacagggacattagcagaagcaagactggaagatgaaatcattttttatttttaaactttgatttattaagcatatgctattgagtggcactgttattgagttattaggcactgttacggtactagagatacagcagtgaacataataggcaagatccctactttcatggcactttaccttcagaagtgaggtgaagaccaaattataaaaggacaaagtaatttaagacaaataagacaaaactaggtgatgatacagtgatatattgaggggagcttttagatgggatggtcaggaatggcatttctaaagaggagagatttgaactcagaccagaatattacaaaggaatcaactatgcaaagatctgggtgcaaaggcatccccacttagactggagagtatatgcaaagtccctaagaaggaaatgagcttgatttatttgagggccagaagagaggccagtatatcaggtgcagagtgagcaagggagagactaatagagatgagctctgagaagtcaatagaattaaacttaagtggggcctcggaggtcttgctctggagtttggtggcttactgatggcagtggaaataaagcagtatgttgaacttagctgtctgtgaaacatctagatgaagtcaattaacgggcttcaatatacaaactcaaatataatttgcctctgttattcattgaaataactttccaagttgtttaggcattgaacaaagaaatgctcacaatatggaggcttgaggagtgtgtcaaggacatggtcaggggaccagagggatcaggaatctctagcagttcttccccacccctcacccccagacttagctttgacttgaaactcatctagcagttctttaccaaaataaaggtcatcttaaatattattgcgacctttaaagtaatgactgttatataaatgttatgagaaaagtagtcagagaatcacggccaaaaatacctgtgtcttcaggggatgtaaagggtacttaccaacttaaaatacctgcagctccatagggaccatgctgtagattttgtatagtgcttgttcagacagtactctcatttctagaaatgcattttttgcagtaaacaaagtgtgtgtatcactgtgcttcttggtacacaagtagtttgaatagattttgtagccaaggtcatccttaagccatctagttttactgaatacatgttcaaaaacactgaaacaaaataattataccttttgtttatgtattgctttataatttatatagcctttacccctggaaaatcaacttgatcctcaggaacagctctttaaagtagatagggagcagaaattttatggaagtcagtgttactattttagagttgaggaaactgaggatctctgagtgcacagtcataaatttacaactctcacttcacttgcattgctttacttaccacaccatgctaattcaaaggtgtacaaaaatgtaaattttagtagagggtttgtatccttactaaaacagtgacaaaataaattttttaatgtgcatgttagttatgggtgctaccagaaggattaacggtgctgtggatacgcagaggagagtgagattgactttggctgggagagtcagaggtttaattttgtttagaaaatgtgtactgttttcttacttggtactttttattgcctcttcttggttgccccatacatttaaggtactacatgtgcagctttgaaataacctcccccaccctttttttgttttttgttttttgtttttttttttgagacagagtctcactcttgacgcccaggctggagtgcagtggcacaatttcggctcactgaaacctctgcctcccgggttcaagcgattctgctgcctcagcttcccaagtagctgggactacaggtgtgtgctaccacacctggctaattttttgtatttttaatagagatggggtttcaccgtgttagctaggatggtctccatctcctgacctcgtgttccacctgcctcagcctccaaaagtgctgggattacaggcctgagccaccacgcctggcctgaaagaaacccttttattttgtatgcaggaccggtatgtttgtttctgctagcatattttattgttattttgagacagagtctcgctctgtcgcccaggctgcacagtctcagctcactgcaagctctgcctcccaggttcatgccattctccttcctaagcctcctgagtagcgagtagctgggactacaggcgcccgccaccacgcccggctaattttttgtatttttagtagaggctgggtttcaccatgttagccaggatggtctcgatctcctgaccttgtgatctgacatctcagcctcccaaagtgacatattttattcttgtattgccactgaactcagcagagatgaattggtaacagtagctaccatgtaatgagcaattccgtgccagcactctggtagaggatttgtaaatttacttaatacttacatcaactttctgaggtagaaacattctttcataaattggtattttcttttcagtccattcacatacttgttattcccacacctgatggagagaatgtagaactgtgtgaaagaaaagataattataaggcattgtaggccgggcacggtggctcacacctgtaattccagcactttgggaggccaaagcaggtgaatcacctgaggtcaggagtttgagaccagcctggcaaacatggcaaaaccctgtctctactaaaaatacaaaaaaaattagctgggcatggtggcacacgcctgtcatcccagctactagggaggctgaagaagaagaattgcttgaacccaggaggtggaggttgcagtgagccgagatcgtgctactgcactccagcctgggcgacagagcaagactccatctcaaaaaaaaaaaaaaaaaaaaaaagcattgtatttcaggataatgttaagccatgccaatagatttttttattgttgttttattgtgcattatttattatatttttcccaaagtgaagaagccaagctggtatatatactaatctgagtgatgaagtctaagctatataacatgaatgaataaagtaataatatcttaaatgtctttttatgattacagtgacagtatgtagtaatcttgggtggttttgcatttcaaaaaccactttatgtatacactaaaaaaagtcgaatcaataaagagatgtttatttaaactatttaggaatgcaagatgtccataaaacttaatcctttgtttagtgacttttcactcctgtattttcttgttatgataagatatgttgcttaccgtggaaatggtaataaagctttgtgtttatataacatcttttaggatctcaaaatgcttttagactatctcatgtatcctcatagtattttagtgagtaggtaagtggcaagtattatcttcattttacagatggagagagaaattaagccacaaagtgagttaaatgatgtatgtatatagttccgttatctagatacataggcaacctgagccactaaagtaagaatactatattttagaaggattgacatagtataagccattaaccccttagtttttgtactttacacagattgttagaaaaaatttattatgcacatagatttttttttttaatcctttctttaggtgtagaaaacattacaatacttcttttttttcttcctttttaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaaggtaaatgctgtatttttcaactgtgtctatttggaaggcataaaacagcagttaaaaccaagtaattggctgggaatgatggtcactagaacttcattacctttgtagcctagaagttgatatataatattagaaagggaattaagttgggctattttaggaatgaaatttgagcggtcctccgccttgttccttacacttttaaaaaatattttttctttcttccccacccctcccccaccccaacaagatggagtgtcactctgctgcctaggctggagtgcagtggtgcaatctcagctcactgcaatctctgcctcccgggttcaagcgattctcctgcctcagccttccgagtagctgggattaagtacaggtgcccgccaccacacccggctagtttttgtatttttagtagaggcggggtttcaccatgtgggccaggctggtctcgaactcctgacctcaggtgatccacccacctcagccccccaagtgctgggattacaggtgtgagccccctcgcccagcccattttttttctttttcataaaatatttacgtaactttattgatataaaactcattcgtacaccatacagttcacgaatttaaagtgtacaattcagtggtttttaatatattcagagctgtgtagacatgactacaatcaattttagagtgttttcatcatccccagaataaattctgtatcttttttaagcatcacccccttatcccaatccttccatcctagacaactaatttctgtctttatagatttgccttttctggacaattcatataaatggaatcatggtcttttgtgactggtttcttttagcataatgttttcaaggttcaaccatattacagtatgatcaatacttcattcctttttagggacaaataatattccactctatggatatacaatatttttgtttatcctgtcaattgaaggacatttggttttatccacccactggccgttatgaataatactgcagtaaacatttgtgtagaactgtttgtgtgggcatatgttttcatttctcttgtatttatatgaaattacctagaaatggatttttgggtcatattgtaattctatgtttaaccatttgaggaacttaccgactgttttccaaagtggctgtaccatttaacatttccatcaatagggtatgaaggttccagtctctctagatcattgccagtacttgtcattatctgactttatgattaaagctatcctagtgaagtcatatgtcactgcagttttgtttttactgatactaatgatattgagcatcttttcttgttcttattggccatgtttgtatctttggagaaatgtttatttggatcttttgcccattttaaattatattatttatttttcattatggaattgtctctttatatattctacatacaaattccttatcagatatacaatttgaaaatattgtctcctggctgggcgcagtggctcacgcctgtaatcccagcacttcgggaggccaaggcaggtggatcacctgaggtcaggagttcaagaccagcctgaccggcatggagaaaccttgtctcactgaaaatacaaaattagccaagcatggtagcgcatgcttgtaatcccagcaactcgggaggctgagggaggagaattgcttgaacccaggaggcggaggttgcagtgagccgagatcgcgccactgcactccagcctgggtgaaagagcgaaactccatctcaaaaaaaaaaaaagaaagaaaaaagaaaaatattgtctcccattgtgtgaattgtctgtatactttcttgatagtgcctttgcaccaaagttttaattttgaagtctagagttttctattttcctttattgcttctgcttttggtattgtatctaagaattcattgccaaatccgaagtcattaagattcctagttgttttttttttttaagataattttatagtttttactcttacatttaggtctgtgattaatttggggttaatttttacgtatggtgttaggtaagggttcatcaagcaccagttgttgaaaagactgtcctttctccgttgaatgttcttggcacccatgtcaaaaattagttgaccatagaacatggatttatttctggactttcagttgtattccattgatctatatgactatctttatgtcagtaccacactatcttgagtactttggatttgtaataacttttgaaatcgagaaatgtgagtcctgcagctttgttattcttcaaaattgtactgactctttcgggacacttgcaattccatgtgaattttagaatcagtttgtcagtttctataaagaaaccagatggtattctgatggaaattgcattgaatctgtagatcactttggggacggttgccagcttaacaatattacatcttttggtctatgcacatgggaagtatttctggttgtttaatctttaacttctttcatcaatgttttatagttttcagagtatacattttgtacttttgttaaattccaattttatttctgatgctattataagttgaactgttttcttgattgttcaagtatgtagaaatacattttttaatgtattaatcttttatcctgcaacttttgctgaactttttgattagttataacagtttttttgtttgtttgtttgtttgtttgtttagtagagtctttaggatttctgtgtataaggtcatggaatctgtgaacagagatagtttttactttttcctttctactctgcaggagttctgtttctttttcttgcttagtttctctgtctggaacctctggtacaatgttgacagtgtgcttgtattttgttgaggatttttgcatccatattcataagagagatgtctgtggttttctttttgtattgtttttatctgattttggtaatgataatactggcttcatagaatgaattggaaagtattccctccaaactggtattaattctttaaatgttttgtggaatttaccagtgaagctgtctgttcttgggcttttcttatgggtagttttaattacgaattcagtctagttgcttgttgtaggtgtattctgattgattatttgttcttgagtcagttttagtattttggtccgtatttttctaggaatttgtccatctcctctgagttacccaagtaattgccgtagaattgttcatggtattcctttgtaatcctttttgtttctataaggttggtagtgatatctcctctttgatttctgattctaataatttgagtcctactttcttggtcagtctagctaaaagtttgttagttttgtttacttttcccaagaatctcaatatttgacattttttctgaccctaagaaggttcttcacagcctctttgctcacttctttctggcaaactagccaacctgtagttaagcctttatttccagtgaatctcttagtcttctcccaattaactgccttttgaaaccatctctactttttttgagagtacccttaggcttgaacttcttcacattgtcttgcaaatgaagtcaattcctttgggaagagatttggagctctttgttttatggtgtgtttctgacttatggcttttgaaccgggggttgagacagtggctttctttctgagttacaaccctgctttaagagctgagtgcctggttgctggggcagcaatagcctcaggtcttctcaactggcctctcctggcttagaactttgactttatgaactatgaatgggccaggtcaagggcaacctggaccccagtattttcatcatgccacatccaaggtagagtctatgtcccagggctaaggacttggttctgctacacttgcctggaacttagcaacaggcaaccaggggtaagataagaaatgcagacatcttgcccctcctggggccatactcctctgaccgggaggtgggaagagtaggaatcatattcttagctgcaccagtctctaatgttcctgtgtggaaacgggaggaagtagggaaggggagagtcttggttcaaataccacagactcttactgttcttaccaatttctgtgagattttcttgaataaatgtttctttatttgctgttatttgcttttagaaccatttccagagactttaaatggtattttttgctttttttagaattttcactgggaaacagatccatggaactcctcacactgccctgctagaaacgaaactctgcatcttacacttttaactggatttagccatccttttgaaattttagagaagtttcaagtgttttgaaaggcttagagagatttttttcccaagggaagagcccactatgaccaggaacgtgagtccataatagagcataaactctttgagattaacacattttcatagcaatttggtacacagacctgttttattttgtctttaactgaaaattttctgatttgaactacagttatggcatcatgatcaaacctattcagagaagcatcatttaattaccttgattctttttaatttttctataattgtaaacctactatttggcagtgtaattaatgttcggtttttgtttttgctagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggttagttgattttaggacttgtactttttacttatttcttcagtttttacatgaaaattttagtgatagtttagctatcaaattggaaatatgcaaatgaaggagaaggcatttactttagcaattatatggaagatgtttaagatgaacatttttaacctcatttctgagatacattttattctactttttgtaaactttatcagcatatttatgagacaagtggaatttattccatttgtttatattgtaatcttagcatgttgaaatcatacattgtttttcataagtgtttaaataggtgaaaagagagttgaattatcatcttaatggggactttcattagtgtgttttagtttttttttttcttaacaaatccagaaaattcaccaaagtatcaagaataattaaataataaacatctaacaaccctcagtcagaatggtcagttgttaatattatattttctgctttttttcaaatacagcaaagcagttataaagtgaacatcatgtttaccctttcacctttcaaagactgcagctgctataaatctaatgtgtctaagttttacgtacacttttaatactctgacatatatgattaatggatctacataaaaaatgttttgtgtgtgttatgaaatgttacaatgttgcagaattataaatttcacttgttttgagatctgtttgtacatatatgtatatttgcatatatgaatttccttgaactgctatataatattttatcacatgagtctaccacactatattaattcattcccatactgtttgaggttattgctagggtttgtgtgtgctatcacaaacttagttgatgagaacatgtgtgagaagtggaattattggatcatagagaatgtgtatgtttggttttgctaggtaatggctaaagagtctctacagtggctatttaactagcagtgattgatagtttccactttgtgctcaccagtacccagtagtgtcaggccttgaaagtttttttcaatctaaaattgtttcttattttaaaaatttgtgtttttcatggttatccatgagattaagcacctttcatatgtatattagtcatttatggctttgttttttaattctggttctcattttttctttcagaagttttccttatttatatgatttatatgttatacttttccctttcaataaaggactagtgctagtcttttatctttgtcataccttttgtcatatggaagtcttacatttttatttagtcaaatataaatcttttcttttgtcttttgctttttgtttataaatttttcttctgtcccaaggtcataaagtctcaaaaaacaatttcttctaatagctttaaagttttatttttgtaagtttgatcttttattcgctcaagattctttttgttgatggaatgaaatgagaatacaattttatttttctttcatatggaaagccctttcttaaacagcccattctgtctctattgattgtcctcttttacataatgtctcctttaagtgtggttcaatttctggtttctctgttttgaagtttttatctatttgccagttcctacaccaatgctcttactatattaatgactgtggttttatattaagccttgacttctttttgggcaattttccttctttctttatttttttttctttttttgcccagaacacctacccttttcagaatatttagaatttgggactcagtatttcattattgaataaattaatttcaataaattattgaattatactttatactttaaacctgtaccaagatacatgtgggacaaagggagaaataaaactgacatttctaaatcagctgctatattatagtcagatattttgaatatattacttcatttgattctaacaacagcaacaccggcatagaaattagctccattttaagattagaaagtagtatcagaaaagaaaaaattatgaaatctattaaaaatggtaaatataaagttatttaatttgatatacacataaagtagtaatacaaatgagtacagattgagtaccccttgtctgaaatgcttgggactagaaatgttctagatttcggattttttcagattttgcatgtgcacaatgcaatacttcggggattcatttttgtttcatatataccttatacataaagactgaaggtaatcttatacaatatttttaataattttatgtgtgaaagtttgtgttaagtacttatgtgtggaattttctacttgtgggatcgtgtcaacactcaaaaagtttcagattttggagcaatttggattttagatttttgtattagggatgctcaccctgtgttagtatagcgtcgcaatccctgaaaaagttagcattatagtaaagctctgaattttaattttaaaaaagataatttgaaatctttctgtatagtatatacaccattgacgttggcaaatatgattgattaaaagttaattccataccagttgttgatatctgttttagaaaaatactctgctatttaggtctgcatgaaaggatgcagtgtttccatcctggattagcagtgggataaattagggaagccaagaaaattttctactttgtttgatttggaacctcacattatgattgcttcattttgtctaagaaatgatgagttggtaaagtccctctctcttacacatccacacacttgcagatacacaaaacaaatttatttaagaatttatatatacatatacttcaaaaccaaatattatgatttggggcatatctttaaaaaaaagattcacaccattattatctactggattgacaattcataatccaatatactttaagcttactttcagtggttcaaacatcttaaatatatcacacataaaattgtttaattaaaacaggttgacactaaaaaatattaatatcagtatacttaaaattgttacttttaaagatttaacagagtaactcctgtttgttaaatttgtctaaaagaatatgaaaaaatatattttgaaataagtattgattaagcatttaatatgttaagttgaaagccttaaccattcgtagcaacaactatgctttatttgatgtctaaccactactacaaatagaaacttattgacttggctatgaatgaatggagttatttgtattcactgctgaaaatagtgatctgtttgctttttaaaaaaatttgtaaaggttttcaaaacaatatatgcatatggtatttaaaaatgaaatcacagaaaagtttactgtaataaggaggctctttgccccaccccatcctgctttccagagaatatcatagctaactattttaactatttttgcatttttgttctttctaggatgactgtcatgtatctaaatcatatacttaaacactgttatttattgatctatcaatattttatactatctattgagttcttgcatttagaattaaggatttacttcactttgcaccatctgaagacattaagattcttttgaaaaactgtatgcaggccaggcattctctcttaactcaccactctatttccaataaagttagacaatgccttttcttttttcttgtattgtttgactttacctgaaataatctttagttatttcaagtttttaagaacaatgtgaattccagtcacattttccttttttctggagccttccatctttctaatgaacatgaacagtttcttctgtagacctgttccaggggtattatcttgagatttcttcccttctctgttcgttttagatctcatattggttctcaagatctcgtgttttcatttttcttggtctactctcttcgttgctggaaaacgtgctgaaatgcttcctaacgaaaagcttggggaaataaatttgtctaaaggattctttattttctctttctgcttaatttggttgtttggctaatacagtattctagattgaaaattacattctcttaaaacattgtcacagctctattttctttcatctgttttatcaacaagaggtttgttattttttcttgttttttttttctgtaggtgacctgatttcttccctgcagctttatttttattttgaaataattttatacttagagaagagttgcaaagctagcatagagttcgcatatcattcaccaagcttcccttattgtaaacttcttgtataaccacagtaccttatgagaattaagaaattaacattgttgcaatactattaattacactttccaccaatataccttttcttttccaggattcagtctggaataacacactgcatttgtttgtcatgtttccttagtctcctgcaatctgtgacttttcctagtcctttccttgtcttttatcacctggacacatttgaaagtggttttggtatttttagaatgtctgtcacattgggtttgtctaatgttttctaatgattagagtaagattgtgaattgtcatgagaagaatagcacattagtgtctttctcttatcatataagaggaagtatgtaatgtgattatctcattattggtgatgttaaccctgatgtattggttaatgtagggtgtgccacatttcttcactgtaaagttacagtttctctctttccatattgtttgttagaagcaagtcactaagttcagtcgacattcagggggaagagaactaagcttcacctcctgaagggagaagtatcgaagaatttgtggacatatgttaaaaccaccacaataattactattttagaggagtttggggggcttttttacaaataaaatactaaagcttcacttttagcattcctcagtggatcttgcctgcagcagttattactgtgatgtttgaaaggtcattttcaattttccttgttctttgtaccacttatactttcttctccaattatttatgcaatcatttatttacattggtatggtctcatgagtagttcttttgttctttgggttataattcaatactatcattttcttgctcaaattgtttcacctttggccattggaaggtctttcacattagttcctgtgtcttcttgaagtgcccctgttttgtttttaacgctaagggcgccttttaatctgtggtgtgctgctaatttcataatgctgtatctgagaatagatttttatttgttgtgctaatgacttgtactctgggtcacctctctccctctctctctctttctctgtctctctctctctgtctctctgggctcttagtagacatattttggaatctctagggttttttttttttttttggtcttacagtttttctcttatatcttttgtctcattaccattttattttccatgaaattttttaagtttactttcagatatttctattgaattgcattttaatttccaatagtgtattccatcattgttggtgggttttgttttgttttactgcattttgttctcattgtatggatgcaggtgcttgctgaaattatctcagttttttaatctagaattttatgtttcctccaggatgatttttttgtctgtatctttttccagtgttgtaggcgttcctgaattgtccagtgattctttgtttttgttcaagttgatgatgatgatgatgatgatggtggtggtggtggtggtggtggtggtggtggtggtcatggtggtgatttgatgaaatcttaagtgaaagattttgaaaactttatgagctagtggcgttttgttttggtttttttgagacagggtctctgtctgtcaccaggctggagttcactggcacgatcacagctcactgcaacctcctccacctcccaggctcaagtgatcctcacacctcagcctcccgagtagctgggaccacaggtgcatgccaccacacctggctaatttttctattttttgcagagacagatttttctcagtgttgcccaggctggtgttgaactcctgagctcaagcaatccatcctcctcagcctcctggagtgttgggattataggtgtgagccactgcctctgccaagctagtggcttttattttaggtaactgggtggaacactgtgttacactggaagatgcctaattaccaaaatacaataatatgctgtgcaaccatgtttttttaagatacaaatctttaatattaacattttgccccaattttttgatagtagttatagtctatgtatggactttaattttgttttatgttccatgtctccctcccagcagaagacattgactgtcttctagaacatattctcttccttgacaatttattttctagtttgcagacatttgatataatcattgttttgctgatggacttcctttcctttttttttttttttgttattgtagatttaacccttttatgcctttactattattttaatgggtgtctcagtggggagaataaacaaacacatgtaatcatgctgctctcttaaactttaaagggttacatttagccaggtgcagtagtgcacacctatagtcccagctactcaggaggctgaggcgggagaactgcttgtgctaggagttcgaggctatagtgcctatgatcccgtgaatagccactgcactccagcctgggcaatataacaagaccccgtctcttaaaaaaaaaatactgataacttggaaatactataatgatacaactaaatggataatgtctataataacgatgtcatatagatatgcacacttttatgttacatgtgttaatatagtgtactttgtgaatattttattgtagatactttgcctacttactggactgttttatttgccattcataatccacttagaagtaaggcaatctagggatgatttttagcaactagtgttatagggatctttaaccagatctcaaattctttttcaccagctaagaaaaaatccttttcaaaagagcccctaaaaagtcttgtgcaactgcagtataggttctttataatatatgacgacttagtgttttagccaagatacaattttatataaagttaaatgtatttataattgtatcaataattataagcttaagtggaaatgaaacagattctgtaaaattcatttgggaatgaaacttcaatttttttaacaaaataaggaatatttgatcaaaacagatgaaacagaaaactccatcaatttcgttgaagttttctcacagaattttgttgttgttgttgttgctgagaccatgtcacccaggccagaacgcagtgatgtgatcatagctcacggcagccttgacctcctgggctcaagcagtcctcccacctcagctgcctgagtagctgggacttgcaggcctacaccactacacctagctaatttttttttttttttaaaggtgggtttttgctatgttgcccaggctggtctttttttcttttttcttttttttttttttttttttttttgagatggagtctcgctctgtcacccaggctggagtgcagtggcatgatcttggctcactgcaagctccgcctcctgggttcatgccattctcctgcctcagcctcccgagtagctgggactacaggcgcccgccaccacacccggctaattttttgtatttttagtagagatggggtttcactgtgttagccaggatgatctcaatctcctgaccttggatccacccgcctcggcctcccaaagtgctgggattacaggcgtgagccactgtgcccagccccaggctggcgttaaactcctatcctcaagtgatcctcccacctcagcctctcaaagtgctgggattataggtgtgagccacagtgcccagccccagaattttcttatataaatgttttaattagtatgtgaaacatcaaaactgttgccctttgtgtccactgttggccagaatggaccaagttatctacaacttgtctgttccattgactacactaaaaactctggacaagtttacttatttgttttcttaagtatctaaatgaggacaatgaaaagcaaactatagcaggcaattgagaaatgaagtgaaaacttgaatttgaataacagtgtatcatatgtgttcatttcatagagatctttttccctcctttgtctcccaggtttaaccctgcgggcactgcatagcaggtgcaggtagcaaacaatctaagagaaacctcttgtatctaaccagaaaagcaagaaaaggggccttttgctccaaaaccagttccatttgcagattacactgaaatagtagcagcttaggcaccaaaaaatctctagaaaatacccatatctctggctaggggaactagaaaatagagtctgttttccaagaaatctgaggtaaatcaacatcatttttctgtcttgccacttctactctgaaggtggtcccagtcgtggtgtaagtgcagaacattatgggagcccccagtaacttggcttttctagccggaggaactagaaggtgagacaactggaggttggaaaggcataggggaaattttgagagcgatataaaagatgcttcctaattctgtgtgtagatcaaaagaagtcctgggttcaaccttgcactgggctcaaccttgagcattgcatgcacagcacagacacaaagaaccacagcaaaggcctcaagaactaaacatcttaaaaaccaccatccaattcccagcatgtgctgagcagagacaaaaagcataacaaagcctttgaaaagtgaattaatgttggaactgctgctcaaagagggcaagatggaacttttagtctgaacctaaacgggttgagtgcctgctaaaacaaaaacattttccagagaatttttaacagggcctaaagtctctgcaatataatgtccaaaatgtccgggatacagtccaaaattactcaacatactatgagccacgtaaagctgactttttattaagagagaagataacagatgtcaagatgatctagatttcggaattatcagataagacctttaaagcagctcttatagccatgatccatggactaaagataagcgtgactgaaatcaatggaaaggcagaagtttttagcagagaaatctgctataaaaactataaaaaagaactaaatagaaattttagatttagaaaaatacaatattaaaagtaagtttatcagatgctcagtagctaagtggagataatagaggaaagagtcagtgagattgaagatagaccactggaaattataaaatctgaagaattgaaaggaagaagattggggagtcagaaaaaactggattgcagggatctgtgggacaataataaaaggtcttaaatttgtgtcattggtctcccagaaggaaaggaaaaatactgctgtaagacaaaatttgaagaaataatggctgggacttcccatgttaggtataataggttcaggaagttcgttgaatcccaagcagaaactaaaagaaaacaatatcatattgtaatcaatctgctgtaaatcaaagataaaaaatcttgaaagaagccagaagagaaggacacattatataccggggaacaaaaattcaaattatggcggatttcttcttagaaactatggaggacagagaaagaaaagaactatcaactatcaactcaccattttatgtccaaggaaaatatcctcaaaacagtatagtaacaagagcaaagtaaagatacttccaaaggaaaactaagagaatttgctgctatcagatctgcctcaatagaaatgccaaggaagttcttcaaggtaaaattaattataccagagagaaatttgaaattgaataatgaaggaagggcaaaaaataaaaataaatcgtcttttctgttttctcagccacttgccaaaagaaatgctaaatacctgggtaaatagagcagactgtttttcctctgctgaaattctttaacatatgtctatttacagttaaaaaaaattaacattgtcttgtagatagtcattgtatgttgatgtaatacatatggccaatataacagaaagggagggtaaggaagccaatagttaaaaagctgctttgttttactctgataatatagaagttgttatatatattttgaaaagttagatatataccaaccactacagagagggtgggtggagatactcccctaaatgtctcctatatataggactgataattattatagactttaataattttgtaaattaaatgagaatactaaacaacattcaaatataggttgataatctctaattcacagcgctccaaaatctgaaactttttcagcaccagcaggacgctcaaaagaaatagtcattggagtgtgttgtttttcagtttaggatgctcagtcagtatgtattctgcaaatattcaaaaatctgggaaaaaaatccaaaatctgaaacacttataggcccaagcatttcagataagggatacttgactgtcatctgaaaaaaatggagaaaagggaaaatagaagcatgaaaaacagacaatttaaaaacagatgataaaatgatagacttaaaatctaatcaaatcaatcattacactaaatgcaagtggtataaattatactaatccaaagggagatactgtccaatgacattttttaaaaaggatccagctgtatactctggataaagagagtatctgaataacactccactttaaagaatatcccagcagaatgtgtattttattcaagagcacatggaacattcacagaggtagaccatattctggaccatgaaacactccttaacaaatttgaaataagaatcagactggcatggtggctcatgcctgtaatcccagcactttgggaggccaagacaggtggatcacctgagatcaggagtttgagaccagcctggccaacatggtgaaaccccacctctactaaaaatacaaaaattagctaggcatggtggcatgtgcctgtagttccagctaattggaaggctgagacaggagaatttctggaaccctggaggtggaggttgcggtgagctgagattgcaccattgcactccagcctggacgacagagtgagattccatgtgaaaaaaaaaaaaatcatacgaagtatgttctcacatcattaagctagaaatcaaataacaaaaatatctaggaaatccctaaatatctagaaatcaaacaacacatgggccaagaaaaagtttcaagggaaattagaaaatatttccaattaaatgaaaatacaccataaaatttgtgggatgcaggtaaagcagtgcttagaggaaattcgtagcattaaatgcttttactggtaaaaaaagaaaggtcctcagtcaatagtctaaacttccaccttaggaaactacaaaatgaagagccaattaaattcaaaataagaagttgggaaataataaagagtagaaataaaaagaatgctatgcataactctacaacctaaatttgaggacttagataaaatggaacaactccttgaaagatacaagctaccaacactggctcaagaagagatagatagcatgaatgctcctatatctgttaaagaaattggatttgtaattttaaacttttgacaaaagaaaactctgggcccgtatggtttcattgacaaattctaccatttaaggaataaataataccaaattctacaatttctttcagaaaataaggaacacttctcaacttattctatgaggctcacattatcatgataccaaagaaaaaaacttagaccaatatcgtaagtatagttgtcaaaattttcaacaaaatactagcaaatccagcaatatataaaaaggataatgcattgttacgtagtacagtttattccaagaatgaaaagctgtttgaatatttgaaaaagtcaatgtaattcactaataatgacaaaagaaaaaaaatcacatgacagcaaacacacaataaatatttggcaaaattctgcatatatttctgtaaaaattctcagcaaactgagttgaaggaaacatcattaactgggtaaagggcatttgctagaaatctgcagttaacatcattcttaatgatgaaggaccttttgcttccctgtggaatcaggaacaaggtaaagacatctgattttaccattcttattcaccatagtactggaatttctacccagtgcagtaaagcaggaaaatgtcataaaagacatacagattctaatagaagaaataaaactatctttatttgcagacaccaggttgtctgtatagcaaatccgtggtgcctaccaaaaagctttttgaactagtgagtttggcaaggttgccagatacaggataaatgtacaacagtgaattgtatttctacatcctagcagtgaataacgggatataagtagtttataaaaagagtgccatttgtaatatgatgaaaacagtgaaacattttgccataaatctaacaaaatatatgcaagacatgtaagctaaaaactaaaacattgatgaaagaatgcaatgaagaactacattaatgcagagatacacattgtattcaaggattggatggcccaatattgtttccatgtaatttctccccaaacatatctgcagattcagtataatccttctcataattccagcagcatttttatagataacaagctgattctaaaattatatgaaaggcaaagcaattagaatagccaaaacagtttcaaaaataacataattggctgatttacactgcataattttaggtgttcctgtaaagctacactaatcaacactgtgtagttttgaaggacacatggataagtaagacagaatatagagtccagaaattcccctccacacacagggtgcaaaaacagttcagtaaagaaaaagtagcgttttcaataaattgtatagaagaattagccatatgcaaaacctttaacctacatatctcaagtcttttacaaaaactaactccaagtgattcagagacttaaatccaaaacctaaaacaacaaagctttttgaataaaatataggacaaaatctttgcagccttgagataggctacgagtgctttaacacaactccgaaagtgtaatccataaaagaaaaaatcagtaaataggacttgatgaaaactaaaaacttttgctctgtgatggatcctgttaagagaatgaaaactcttaacagatacagatacagactgggagaaagtgtttgaaaatcacatacctgacaaagtgcttttatgctgaacaccttaagaagttttaaactcagtgtaaacaaatttaacagttttttttttttaaatgagcaaaggatttgacacttcaccagagaacatatgtatgtgacggaaaagtgcatgaaaagatgtctgatatcatctattagggaaatggaaaataaaaccataatgcaatactactgtacacctattagaatggctaaaatcaaaagcaagaaccatgagaacatggtaactgcaagtactggtgaggatgcagagcaattggaattctcatatattgctggtgggaatgcaaaatgacacactgcctttggaaactagtttggcattttcttataaacatgcaattaccatatgatctagcaaatctacttctgagtatttacccaagagaagtaagaactgtgttcacacaaaaaaagctgtgagtgtgcatgtgtgtgtgtgtggcagatttatttatttattactcaaaattggaagtaacccaaatgtccttcagctggtgaatggataaaaatatccatacattggagtactactccccaacataaaggaatgaattattaataaacagccacatggatgaaactcagatgcattatgctaagtgaaagatttcagaatcaaaagactgcataatatatgatatcatttatgtgatattctggaaaaatcaaaactataaggacagagaacagatttgtgttttctagggcataagcaaggaggagggagagttcaactacaaagagacactacaaaggaatttttggaagtgatagcaactcttctgtgtgtttattttggtggcgattatgtgactgaatgcatttgtcaaaactcatagaactctataccaaaaaaatgaattttactgtatataaattaaaacataaatgttaaaaaagtggagacaaactcattttgagagactacagtgtaaaaagggagagagatttactattttatattttaagaattcagaacagttttctgttaagcctcatgtgcatgcctcagtatcaggcaaacacttctgttaactctgccaaggataataggatttagagccaaagggactcctgaaaattattttgtgcaaccccatcatttcataaataagtaaactgaaggctcaagaggctaattgtcttccaaggctctaaatgtagttactcttgctgctttctagattttctctttgtctttgtctttcagcagtttgattataatgtgactcgatgtgactctctgcatttaacctactcggagttcattgagcttcttggatatgcagattattatttatttatttttttttcaaattggggaagtttttacctatttttcaaatattctttctttaaacaccttggaactaatgagtctctcagcctgtgctgaaaggttctgtgtgcatgttgcagcttgccttcagcactcagccagtcatttgacatctctgccttagccttcactttctgcttacctagagcctcaggattaggcacagattagttagggccttctcatgctattctgagcaggctcacagcactaaacgtgtgtgaccttctaaacatgtatgaccttctagattcctgtgtatatgtcacaggtttttaaagctcttctgaatctcttagctctcagctagcttttcctttaaagccttttggttagtctattgtttgtcccaattattatcccctgtcttgggcatccatgaagttaaaatacttgcttctaattgttttagacaaacacatgccctgccttacatctgggagaaggcatttctcatggggctacttcacagagtcagattaaatatgacagttttataagtggagtcttcagggaatgattatttgggaattaggctttgaaagagcctcagctgtgttccaccccctctagtggctgccagatggtgccaagaattcaggctgttatttttcaaggctgccacagaggtggggagtggaaaatgagactagtaagttaaaatactacaaagcttgctgttcttacagaaattcagccatttttcttgaataaacacttccatggattgctgcaagccttgattaattgccagaatctgaaatggttgcttttgacagtttttttcccataggtttttgttgcttttatggaagagcaaagttttggaggttcttcaccatggtcagtgacatcatttcttggttttgctcttgccccctctttctttctgaagcatcataaggattagaatgatccttgtgttgatgagttctctttgtgacatgttgaatgatgctgtctgtggcacatccaggaaatgtctaattcacagctgagtttcggaatctggatcttgatgtagtcatctatttatagatgatagttaaaacaaagtggattaaatagcctaaataaagcatttataatgaaataaccaaagagcttctatatttgagttgataattgctacaggaaaaaatgaaaaatcactcattatgcagattggtgtccctataaattcatggtctcaaatctcaaccagtttctcagaactgcctatcaatcttagtcgtctttgtcagttttctcattaacttaattattatctaaacctccttaagtcttcttatatcccttgtcactccccttcaacctcgccttactctcagttttctacttaaagaaaattaaagcatgacttctctcaaattatcatctttccccccttattacaaccagccctccttatatgtggattcctcatcctcagattcagccaactagagattgaaaatttttgaaaaaataaaaactgtaaaaaataatacaaattaaaaataatataacaactatttatattagtcataaaagtaatctagagatgatttaaagtatatgggaggatgtgtgtaggttatatgcaaatactgtatgcaccattttatataagagacttgagcatcaaatgatttggggatctacggggtcctgggaccaatcctagtgtataccaagggcaactatctacttttacccccaggtaaatgatactggaaaatgtagggtactcatgaaaagactttagatattctaggccgcgtaggtaagaaagagtgtaggagggactgatagactgggagtaaggtaggggtgtttcaggaactacatggctctcagtttgaataacttgagtccttacattcaaaaatgattacagttaacccttgaacaacacagaggtgaggcaagtcaaccctcaagcatttgaaaatttgcgtgtaacttttgactcccctaaaacttaactactaatagcctgctgttgactagaagccttaatgatcatagtcaattaacacgtattttgcatgttatatgtataataaaccagattcttaaagtaaactagagaaaagaaatcgttaggccgggtgcggtggctcacgcctgtaatcccagcactatgggaggccgaggcaggcggatcatgaggtcaggagatcgagaccatcctggctaacacggtgaaaccctgtctaaaaaaaaatacaaaaattagctgggcacagtggcggcctgtagtcccagctattcgggaggctgaggcaggagaatggcaggaacctgaggggcagagcttacagtgagccgagatcacgccactgcactccagcctgggcgatggagcaagactctgtctcaaaaaaaaaaaaaaaaaaaactgttaagaaaatcataaggaagaaagaatatatttactattcattatgtggaagtgggttttcataaaggtcttcatctttgtattcaaattacgtaggaatttgaggaggaagagaaaggatcggtcttacggtctctaaatgccacacatttaaaaatgtccctttagtgggttgaattgtttcttccaaaaagatatgtttaaatcctaatcctagtatctgtgaatgtgaccttatttggaaatagggtctttgcagatgaaatgaagttaaaatgaagccatactggattagggtgggccctaaactcaatagctgatgtccttataagaggagaagacacaggggaaaagtccaggcaaagacaaaggcagggattgaagcagtgcagctacaaaccaaggaatgccaaggattgccagcagtcagcagaagctagggtgaggcaagaaaggactcttctctagagtccttggagggagcaaggctgggctgagatcttaattttggacttctggcctccagaactgtgagaaaataaatttatgttgttttaagccacccagtttgtggtattttcttatagaagcccgaggaaactaatatattaccttaatttgctcttgaaattaattttaatttataaatatggaggtatattatcaaatgacaaacttagaaatagcattagtaatttaaaaagtatgtttcatacattgtcatagcttagttttgagagtagcaatttgaaaaacagattataggcagaactctgacagttagataactgactcttgataggtgcttcagatacagaaagcttaaaagatctggtttattccactcatccattccaatctatcattccatttgaaatctcagcaaattttttccaagggaaattactgttaagaatattaaaatagtaagtagtcgaatgtagtttctggaacattgtatttaaatccttttaaaagactacattttcttaatgtgataaagcatggtattctcttagataatctaggcaaaaggagcattttttttcctatactcagtttattaaaaatttcttgggatacattgagattttcatgaagaaatgaaatttgaaatttgttcttgacgtactttggatatttgtaatgaagatgttttacatatcttgagccatatattaggtcagctataatttattgggctttaaattttttataaggttatatcatatgtaactagattagttttctattgctgccacaacaaattaccacaaatttagccgcttaaaataacacacacttattacctcatagtttctctaggtcaggagttcaaggggcctcagctgggtgctctgctcagtttctcacagagccaaaatcaaggctttggcaggactgcattccttactgaagaccctggggagaaacctgcttccaaagtcgtttgaattgtcagctaaattcagttcctttctgttgtagaatgtaggtccttgtttccttgccagctggcagttgggagcctccagtgtttacacttggaggctgcccacactccttctcatactgtccatgtggccccctccagcaacagcagggcacgtttcccctcactattctaatctccctgattctagctaaagaaagctcttcgcttttaagaattcatgtgattacattacgcactactggataattcagaataatatccctatattaagctccataactttagttagatctgcacagtcccttttaccatgttacttaatgtgggaaacacacattcgcctgtctgaacccaaagactgcacttggagacacaaagaacagcaaaagcgagacttttaatggtggtcttgcaagatggggcgtatggtaggcaggcacacccagggcagttacagcagttaatttacctcctagcatgcaaatccctcccctagttcctcataggtcgagtattacagggttacaatcttcccggacatcatccaagtttcattatccccctaataagggtgtaatcttcccttccctgcttaagtttcgatttcccaataatgaaactttcttcgcttttatgggctgaccccttctctacattctgtttgctcattgtgaccttctaggtgcgtgagccgtgcagtttgttacatccgcaggctggttgccagtatatttagatttatcatgccttgaaaatagatcatttaaaacattttctcacaaagtccctcctcttttctgtttacttccttcggtctcattttcatctaaatcctttttgtccttgaattgctctagaagtcttttactttctccataggagattgagtttaattttgtttctaatagtaccaggttattttgctggttaagtcatgggcatttgtttattaatagctgttttaatctctgtgctagtccccccacacaagggttaatacaaaaatcccactgctgttaagacttctgccacaattatgagagatgtaaggattgagggctaccatgtctttccattttccaaaccaatcttctagccaacccataaatgggtcatcaattccagcattttctgccagttcattggctagagttgttggtcttcgtaaagcttttctgatggtcccatctggggcagtattgttgggaatgaaagtacaacatttcccacccagcataacacatacgccccctttttctgctagtatcatgtctagcgcaagcctgttttcccaggccatttggctgatggcatttagctggctagccacccctttgaggatgtcccgagtataatcgatgaatctctgttgattataatagatgtagttaatctagtccacattcttaatagttgaccaccagaagagtgctgacttaaaccgagctgctatttggtttcgggccttaaattcattaggcacccccccccccccggaactcctatagagttaacatatatattgggatcaaaagatacgtcaaatctctccggttttggtagccgtgtgtattttcgggtatcttatggaataccaggatgaagggaatggccaactggactaaagcacaagtcccagtccaattggacggtaacaacttatcatccttttttcccacagtaccaccagacatcagccgtggtgtatggagagctgagtaattgccattgcctgactcaacctgtgatgcttaggatgtgggtacaagttgagagttctcccatgggcttattgaactctgccccctgcctggagaggcaagaggagtagttcatattccctgtagagaatgaggggttctgacctctctccacaatgcgggaaagagcaatgacagactcttacaagtctcattttcccatgcatccttgtctcggtatagagccaacatgcaacacattacttcaggatcagtattccatcctaggggaaatggaaccacccatgcctgaggtcctcccgcagcacatgcatagtagttactcttgttgagggcttgtaccaaaaatgtgacccactcaacccaggcattcacatccccataccctcagtttttaaggtttgctttacatcctttacctcaattatttttagccttttaggatcattatttggtggactaaagtgtttactagggcctgggcttggagtagtaccagacacttggggggttgagtttttgatgagtttgagaataaatcgccctacagggtctttccctgtgatgtctgcccctaacccatataaccaagagtcttccagaactggggccagcccatgttttctttttagatttttctcagagttaactttaagggttccttaggtgacccatgcactttccactggtcttttcccctcctttccagggtctcctttaccagtcccttgactcgagtatagtgagtccacctcatgcagctgttcgcatggctgtctcagtggtcaggagcacttgatagggaccttcccagcttgggtggagcttgtcttctttccaagtcttaatcagcaccaagttaccaggctgaaagtggtgagccatgaactcaagaggtgaagtttgagttagaagtcgttttaacctaagggatgacagggtggagtatatggccactatataatttctttaaaaattgatccttggtttccatagccggaagatctgtagctctgcgcaaatataggagcccatataatgactcgtagaggggcaatcccaagtcttttattggtgcttgttctaatctaaggaatgctattgggggacatttggttcaaggcattttagtttttaagattagtttggtgatatgctttgtgagagtttgagtcattctttctactttccagaggaagggagatgccaaggggtgagataatcccatttaatttgtaaaccttccataattcaccttaacacccttgaggtaaagtggcttccattgtctgaattaatattttccatcagtccaaagctaggtgaatctgttttaatattattttgaccacattcccagcagtggctgttggaaggggaaaggcttctacccagcctgaaaggtaatctaccatcaccagtaaatactttagtcttcctactttgggcatttctgtgaaatctacttgaatgctttgaagtggtcttactccggaggtcttcctgttttctaatcacctttttgtttatcttttgacaagttaacacaatttccacatgcttgtttagcaagggtataaatccctatacacccataattcctaagtattgtatcacacaaagcctggggtccccattgactccatttgtgtaatgtagatactagttttctcattaggggtttacttatttcaggaagtacccatttgccatcttcagtctgagtgacccctgtcctgtctaattcttcctcctcctctctggtaaactggggccttaatactagcttagggatgtttgggagcaggctacatagtctaatttcttcgtccagggaggcttgcttagcagcttcatctgcaagcctgtttcctgtagcttctatagtgttccctttctgatgaccatttacatgaactatggctacctctgctggaaggaggaggctttctaaaacctgtttgaccagttccccaggtaccaattattttcccctgctatttattagaccctgctctgtccagattttttcaaaagtgtgttccaacccattaagcatatttagaatcagtatatatagtgccttctttggctttaaggagctttatggccgggttaagaccatataatttacagatttgggctgaccagccattaggtaatctacctttctcacatagggagtgtttatctccatcagtgacagcattgccatctctcgttcgtcacaactcatccacaaagagccttatcccatcatgtagtggagcttccctaaggtttggtcctactttggtttgttattctatgatatctaagcagttctggtctgatgtctttgatctcctctcctttccataggaaactggctgcatttaggcaaatatttgttgttacaagcaaataattttttttcttaataatatggcttcatattttatgaagaacgtgttcaaactatctcccggcttttggtttaatatattcctgacctggtgtggagcgcttactattagggccccaacaaaggttagctttctactctcctaccagcagggctgtggcagcactgcttgcacgtatttgggccacccctgagagacaggatcgagaagcttggaggcaaaagcaacagattccctcttccctccccaggtttgagtgagcaccccaagggtgatccactgttaccaacagatggaatggtttctctaaagatgagaggaccaggaccggggctgtaatgagggcccgctttagctcttttaccacctgaatttcctttgaggacaattgcaagggattgggttcttcttttagtaacttgatatatagagtctttgtcttttgatcatatgagtcaatccataacctatagtagccagttaaatctaaaaatttttggagttctctttttgtcttaggcaaaggcagacccactattcccagtattctctctgggtttattcttcacatcccttcactaatcaggtgtcctaaatatttaacttctttttctgcaaactgcagtttgttcttagatactcgcaatcccctttctcctaggaaattaagcttgtggtggtttctgatacctcggtcctcctctccccagaaattaaaagattatctatgtattgtaacaactgggttcccctggaaggttgaaattcctccaggactttttctaagatttgaccaaatacgtttggggcttctgtgaaaccttgtggcagcacagtccaggggtactgttgttttctcctagttatagcatcttcccattcaaaggcaaagaggttccctaatcctaaagtctaggggacatgcccagaatgcatcatttggatccaccacattgaaccacttacgttcatagggtatcttactaaagagggtgtagtgtttagtcaccacagggtggtaggtctggacagtttgatttatagcccttagatcttgtagcaatctatacaacccatcaggctctttgggagaattggagtattgtaacatgcagggttttaattgtccatcgttaatcaatccctctattaccagttggagaccttttctcccttcagtggaaatgggatattgttctctgcaaactacttctggttgttttaggttaatctgtaagggtgtgatttttaaccctctgttgccttccctaaccctcacaaggggatttaatttttctttcctcctcctctgtcaggaggcccatcattacttttatttgtccttcctctattcctaatcctaaacccaatctcacaatcaggtctcgacacaggaggttagttcctacttcaggaacaagtgacgcctcaatttgttttgctcctgatgtaattaaaattttcttaaatattggaacctgaaatccctccccttttacccctgatactttcaatttttccttagagagttctgtagcccttggttggtgaattagggaggagtgagctgccccagtatcaaccaaaaatgtcacttctccctcaggtcccaccttcaaatttattaagggttcctggtgggatctactcagaaggtgctcctgcccccgactagtcttcatcaatagtcatgaggggtatcaccttttcttttttccatttaggacatcctctcttcaaatgccctgtctttccacacttgtaacatccactcatagtcttaggaccttttccctgcatttcccttctttctttgtgttgaaatctataattcccttgtctcctaagtgggggatcttgatgtaagtcttttctgactacctcttccacagtggaaaccatgatttttgctttttgtttctgcttctcttcctttctccttacaaagaccctctgagtttgcctcagtaaatcctcagttggtttctctttccatccatcaatcttttgtaattttttggtaatgtcaggccagctcttaattacaaagttaaccttcaaaaggcattgccctactgggtcctctagatctaatccggagcattttctcatctgatctctgagcctatataggaatgcagaaggagtttcctctttttcttgttgaatcgtgaatgtgtcctatgtcctacgagtggactccttgatccctttaattattagttcctggagatcctacatttgggcgcagtccctgggatcattattatcccattcaggattaacatttggaaatttttgtttggctggtgagacttcttgcctgggagggtgttgcctctcccagatggtcatgtccactctcctgatcattcccctttctcttcctatgaataggatattcttgatggacatcatttcagcccaggtgtaagagctgtatcctaggaattggtccagatggtctgctaaaccgagtggatcttctaggagtggtttcatttttttcctgaaattcctaatttcaatacttgcaagaggagcatttacaaagccagtctctccctgtcccatgggaactcccctaagagggaacatgctaggtgcctgctgtgtggaaggaatagggaagttctcaatatccctcttacagtgttcttttcttaaatttggataaggatttagaggagcagttggtttggctccgccatggtgtccaggtctttcctcctctaaccctcctgctgccccttgattttcctgtcccctattttgtgagatgtatggaggggcatggatgatagggtcccagggcttttccctgggtgagggatttttactaggctctttttcttcttctttaagtgggaatatggggctaattccttgatccagcagagagcataacctgtctcttgtgaggttggggttttattattcacatagagaattaaagcttggcacacctaatttttatctgagccaaacttaggccataggactatgctggtaaatgtcagagggagtctctttggctccctctttcccttgtcccctaggcctagaatttctgtttcccatttttggtcagtctgtgtctgagcttttccctgtgttctcagcaccccctactggaggtttcttgcacacccatggaatcacttcatccattctctggccattctttgtccattctcctcacgggagaacggaaccatggattgggactctgcacttgcttcatatctagggtacatctcagtcacacacactcaacctctgaaaatgcccaaccaccaagacagtacttacagtccaattttcctcccttggcttctgcacgaggttgcctggttgctgcagtgcctgcttttctccctgtgtcgcctctgctgcctcctgaataacagtctcaggtttgtctgtggcttctgtggggagccaggatgcccggacagagtgggccacccaaatcgggtgggacacctctgccctctcggctggagtcccactccatgcaggcacagagatcccagacaggcccccaggtttgtgagaaacacagattcacctgtccaaacccaaagaatggacttggagacacaaacaatggaagcgagacttttaatggtggtcttgcaagatggagtgtctggtaggcaggcacacccggggcagttacagcaggtaatttatttcctagcatccaaatctcactgcaacctccaccccgcctggttcaagcgattctcctgcctcagcctcccaagtagctgggattacaggcgtgcatcaccacgcccagctactttttttgtatttttagtagagacagggtttcaccatgttggccaggctggtctcaaactcctgacctcagggtccacccacctcagcctcctaaagtgctgggattacaggtgtgagccaccgcgcccagcctaaatacagtttgtttgtttttttaagtaggccactgcctccacctttgtacagagaaatcccaggttcctcctgtcagaacctagctagaccctggaataagataccaagaccaggcttgccaactgtggcttggcatagagtttgtgtttgacctggggtcagggccttgtctacacactttttttttttttttttttttttgagacaaggccgtgctctgtcatccaggctagagtgcagtggctcactgtagcctcaacatttgcattacatgttgatttatataattaatggatggtgttgcttattatcgattgattgtgaatctggccacgacaaatttattctaattgtttattttctcagattatttatgtaaatagtaataactgtaaataataatctatttcaatttttttcttccagtgattgtacctcagttcattttactgtcttatatgttggcttcgtcagaatgtttcatattatgttgaaaatagtaatgatatatataatagcattcttatcttgttcctgatgtataaagtaatagttcagaagtttctccattaattatatgtaggggtatagcaggtaaaagaaataaatttttattcctggtttgccaagagctcttatcaaaatgtgttaaattttatcacactgtttttatgcttctgttgaccttttttttctctcctttaactttatggaatcttaagtcatacaaagtattttatttttgtgtagtcagatttgtctattctctcttttatagtttctaaataacctgttgtactttttaaagtaccttcaaactctaggttatagaaatattttcctttttttttaatacttggttttaaatctttgtagcatgtatcttggtgtgtggtatgacatggaggtgcatcttctttgtgttacttcagatggatgtttaatacaatattgtattgagtgcagtgctcctgtaagttttaatatttgtttgtaacaataataaggaagactaatggttttttcaaagtttactcaaaagtaaaagcacacacgtaaagaaaaagagaatgtaaagaaaaagagagaatatctgacgtggaccaacttgagcctatagattttttttattggtaagtcaaaagcagggccaagaaaagaaattatccaaattgaattttctcattatattagtctgttttcatgctgctgataaagacatacctagactgggcaatttacaaaagaaagaggtttaattggacttacagttccacatggctggggaggcctcacaatcatggtggagggcaaagaggagcaaatcacatctcgtgtggatggtggcaggcaaagagagaataaggaagacacaaaagcagaaatccctgataaaactatcgtatcttgtgaggcttattctcaagaacagtatggggaacccacccccattattcagttatctcccactgggtccctcccacaacatgtgggaattatgggagcacaattcaagatgagatttggatgaggacacagagccaaaccctatcacttattacccaagttttatcagactgggaaaacaacatttcagtcccttaagtaacaattttagagggaagatctacggctaacagttattcattgtgcacatcaggataaaccagttaaccaaattttgatatgcctcatttattatacacaaaaacaaaaaggcctttttgtttttagttaacattaaactagcttttattccaaaacaaagaagtcggtccagtaaaactatcttatattttgaagaaaacatatttaagaattgctttggacaacagaaactgttatcttatgaaacctaaaaactttattaaattctgaatgtagcatgtgcctgcctcccatttttgccttgtaaagaactcagtatgctattaaattattaacttagtttatttgaaatagttccaagatatttcatgcctccaagattaaaactaaaacccaggttagcagttttgaagaagagtggacatgagccttgaacattatatatatttgttacatctgatagagatattttaaattgtctgctaaaaaccctcttgctttgtagatgggaaaactgagagttccagtggctatttacttgctccagcttttatttccagttcatagcagaagcaggacttaaacttcaggtcttttcgtctcaatcacatggtctttctctttgcattgtgtatttgataacgtttttaaataaaacaaagcattttgcaactagtgaaactgtacaaaaagtcatataatgtgaccagaagggagattattaaaaattataatttcacttaagcaaaatgtgtataacgccatttactgtttttctatgtaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcagactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagggataatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaaccctaggttgaaccacaaaatttcatttaaaatgtttatatttggaaatatttgcatagagtgtaaattgttctgtagtttcatattttgtaaatatgagttatgttgacaatgtgcagaattctttatgctttgatgtggtagccaaagaaagaattacacttttttccaaggccagcagaaaattctcttttaactacattgtaattcttgttttcctctactaaaaattggccagtcccattttatttctagtgctatgtaagaaggtaattaggaattataacacagtaatgtttttatgttacatcaataactgaattttccctaaaaattagcctaatatataatagatatattatgaagcaaaacttttatttttgaaaaggcagaataattttcagtgaagtaagtgactaaagaaaaaaactatattattgtttatgcaagggtcttacaggaaagggtctttttttttttttttttgagatggagtctcgctctcttgcccaggctggagtgcaatggcacgatctcagcttactgcaaccgccgcctcccaggttcaagcgattctcctgtcttagcctcctgagtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaaaaaaaaaaaaatgaaaaaaaaagatgaatccagaaaaaaacctgtttcccatattctagaatttagacaattattctgccagcaaagcctctggggctgtaattgacatttttacagtgctgatttgtataaaatttgttttttgtggatttggaaataaaatcatgtacaagttgttgcctgcaataacaattgcaagtaacctattaaaaattcccttgagtttaacatgtttcatttaattatgtatactataaagcagcaataaattatttgaactatcaacctacttatcatgaacactggagagttaaatgcttctcactggagaacacattggccaccgttcgtaattcctcgtattgagatctggtcaccatttctctgaacataccgccaaagaactccaattcaaattgcatgttaatttgtagccattgctctagacatttatggaaattaaaatttgatttagagacactttttacttaaatattttaagcaatcaatgttaggaaattataggaagacctgaaaacgaaaaacataattaaaatattatttaagctcacagaatcactgagaagcaatataggccacatagatgccacaaagactacaagcagaaactgtcttcctcctgggagagccctgcaaatctcatgaagacctttagtaacataatgaatacattattgtaacaacttcagctaacacatttccagactcacaccagatatagacatagcaaagcgagggtttggcccagggtggcggaggtaggatgttaggcagcaagagaagtacgctggcccactgacagaagactccaaagactctaggttttaggtagtaagcaggggctacaaggtgtttggacagagaaccttgtacagcaaggtcctaaaggcatagttgtgttacaactttgtaaaataatgtgttcataacactgactgaatcaaagaatttatgctactctgtcaaataagacagtaaggaattgtcaaaggatgttttctatccaaagtaaagatacacttcaattacctgaaaaattcgcattagaaagcatcaggatgatatcgtataaaaggggataatgcaggccaggcgaggtggctcacgcctgtaaccccggagctttgggaggctgaggtgggtggatcacgaggtcaggagttcaagaccagcctggccaacatggtgaaaccccatctctactaaaaatacaaaaattagccgggcgtggtggcgtgcgcctgtagtcccagctactcgggaggctgaggcagaattgcttgaacccaggaggtggagtttgcagtgagctgagatcacgccactgcactccagcctcggcaacagagcgagtctcttgtctcaaaaaaaaggataatgcaattagaaaatgtcattgtgtttttcaatttttaatatagtttgcttcttgtacttctagaaatttcagccacatgaaaaagacaataataaagaaaaagggataaatcaccttgaaaattgacaaaagctgttggtgtagtaagttaggaaagctgaagcagtgctaaaagcaatactaatagggtgtggtttacaatgccattggtaatgacaacttgaaaatagaaaaatatacagtattgtttattttttaattaaaagttcagatgcttaatttcaggggtgcagagacttcaagtgtcacagcaaacttgaaatactttattcctttgtgaaactgaataatatattgctatatttactgcctgaacagtaatgtctgcttaatatacacacaaccaacttgtaattcggtagcaggacttttaaggcatgtattttccattcttttaagattggctgattagcataaaccttgggctctgttcctcttagtaacaggtggcaatgaaataatttatttttggatacctgagagtaatgtcaagcagaaatagtggaaggaaggaagagagaaaggaaaggaaaaggagcataaaggcctatttataatgcagtgggttgatctccctggttaatagctaagcaccgtgccaaaagagatcaacggagagtctgaggatttcaggctggattcctggttcagccacttagtaggcacacaaccgtgggcaagttattgaacttttaagcacttatttttttctacttcatagaataaaagagcaatgcttattaatgttaagcattatgaataatacataggtctgttaagatcaaacaagaaaactatattgagtaacacatagttgtgtttaatacgttattattgttaattataagttaacccaaaaggcagacgggtgtcttagtccattcgggctgctataacaagataaactagactaggtagcttataaacaacagaaatttatttctcacttcggagctaggaagtccaaggtcaagattctggcagattcagtgttcatttactggttcatagatggtgacttctagctgtgtcttcacatggtgaaagggacaagacaactttctggggcctcttttgtaatgacgctaatcccattcatgagagctctactgtcatgatctaatcatttttcaaaggttccacctcttaatatcactggtaatattattggtaattgggtttcaacatgaatttttggggggcacaactgctcagaccatagcagggggcatggaatagttcccacctggaccaatgctgaaatgtcttgaaaatgggcaacaatacatcaaaaagttaattctcaaatcccattttaaaaatgaaatttcagtgggaatttccaaattcaaacatatttttctcaaactgtgagctactttgccatactctacctcaaaattttatgacagtctttttccaattctaagaaaaataaaaggtttaaatcttagttactttcttccccccccccccttgagccaaggtctcactctgtcacccaggcacacaccaccatgcccagctggtcctgggctcaagcgatccgcctgcctccacctcccaaagtgctggaattacgagcatgagccactgcgcctggcctaattcctaatttttaaatgttaattacaattactgtttgcctacctcaaagtgataacagacaagcacaccggtgaacaagaagcaaaccaattactgaaaaacagaaacagctgctcatgtgttgttcactaacttttgtgggtttatgtgtggatgattttctatatttaaaagcattctctatatttagaaatatatgtgttaaataaacccaggcatacagggcaaatgtacccctcttttcagctacctaccaaattgcagccaaaaaaagaaaacatggaatgtggagttcaaaagtttcttagacaacttcctctcagacttggttcagaaaaggataataggatgctctacttttactttgctttttagattctttgtgaaataagataggatatagaataaatgtctaaacttataatgccctgcaaggctgaggcatctctgctggctgtagcttcagttgtccagttacagccttcttgcccatttaactcttacctttgcttcagatcctgttcttaactctgagttgctctgctcattcccaagcttacctttgttggagatgctttttccaattaatacatttatggagcacttactgtgtgtcagattcaggcacaagggatgctgtttttcttttctatgctaactctgccttcttgcatcccaacctcagctggatttctggagctccttgagatccatttaccctatgcctaggaatgggcaggccagcagttgcagagatactggagtctattgagaccatatctacggggaggagccgaggctcaggtaatctgaagcaagttaacaggtttcaagtcagggtcagagacttaagaaatcagatgtgggtgttaagatcagacaaaagcaaattatagggaacaggagaaaattaaacgagcagttgtcataaacgccagtttgtctttgaatcatgtctttctaggtggttggcttggttcaaattttgttatttattatcctgctatgaattgtggtttcataaatattttatttatagtagtagtattttttagatgtttagatgtggaaacataataacgttatattttctgctggtaaaattgttccttgcttgtataatgttatgctggaattaaatacatcagtaaatcatggtgctgtgtgaagggcattatggcttccaagtatttggtcaccttaacaagtctgaaaatcactgttgaggaaaataatctaatggcaaagaataagctaactgaaaaaagattccaacccaattcagtaatactgtaaacagttaccactttaatgtattttatgtttttgcagccctttacattagcttattctttgtcaggttcatatatgtacacatgaaatgtatgtgtgtacatgttaggtggagcatcatatatgtttatagtttataaggcagaattaaatttatgttactatggtttggcattatagttgcttattctctgtccttaattatgtggacagacataaaattgttagaaaattaagccctattctgattatcacttacaaccttgtttaaattttcttttcttttcttttttctttttttttttttttttttttgagatggagtctcactctgttgcccaggctggagtgcagtggcatgatctcggctcacggcaacctccgcctcccgagttcaagtgattcttctgccttagcctcccatgtagccgggactacaggcgcctggataatttttgtatttttagtaaagacagggttttaccatattggccaggctggtctagaactcctgacctcccacgtagctgggactacaggcaccctgataatttttgtatttttagtagagacagggttttaccatattggccaggctggtctagaactcctgacctcatgatctgcccgcctcggcctcccaaagtgctgggattacaggtgtgagccaccgtgctcagcctgtattttcgtttctatggagcaagttatgactagaacagagttttgggttctgtagaaaaaaactcatttctccttgttttgctctgcttttcacgatattgtggatgccaatttgtactaaaagtctgtgtaaatatgtccaccaatttgataagtagctggaagtacttttattcttgtgttcaattgtaacacagcacagcattcatcagtcagaagggatgctggacatagtaatggaagaaggtcctagagcaatctccctccctccccttagttgctgggttctggggaggtcatggggtagtagtaggggagtcaggaactagaagtttattgtatggaattgcctccttgtatagaattatgtcaatattttaataaccaaccagtgtggttatactggtgtcccagattaatgtgcaccctgagtaggtgcgtttattctctacccatgcttcagacttccagtatgtggatggaaaaacccaatcccaaaaccattattttagttattaagataataaaaaggcccatgcagttacttaaagattttgctgagaaacatgaaaatcaagggaaaatgcaagtggaaaagtcatttcacttcaggatacttaagactgactcaaaaattcctgtaaaatgtatgtaagatgcagcttcagtggattatgatgcctcaaaccatcttagaaggcaaatcagagaaagggagacgattacagctggtttgtatgtcaacaaatgtgattacttcctaaactgtcttttcagtgatttttcaaaaaaaaatctgttaactgtatttattgaatataagacacaattgattatttcatataccactaaaaaaaaccctgccaattacactataatccattactttaatatcatttaaaagcttttttaaacttataaaagagctgttagacttgttgatatattttatcatatatcattcttctttctacgttagaaatgcaagtgaaatgtattacccaaagtaatctatggattcaatgtaacctctatcaaaacactaacaacattcttcacagaaatagaaaaaaatgctaagatttgtatggaaccacaaaagaccctgaatagccaaagcaatctgaacaaaaagaacaaagctgggaggcatcacactaccagactttgaaatatattacaaagctatagtacccaaaacagaattatactggcctaaaaacagtctaggtagaccaatggaacagaatagagaactcagaaataaatccacgtattcacagccagctgattttcaacaaagtctccaagaacatataaccggaggctgggtgtggtggctcatgcctctaatcccagcactttgagaggctatggtgggaagatcacttgaggccaggagttcaagaacatacaatggggaaaggatagtctcttcaacaaatggtactgggaaaactatccatatgaagaagaataaaactagacccctatctcttaccatatacaaaaatcaactcaaaatggattaaagaattaaaggtaagacccaaaactgaaatcactggaagaaaacatggggaaacacatcaagccattggtctaggcaaagatttttttggataagacctcaaaaacacagttaacaaaagcaaaaataaatggggttatattaaattaaaatgcttctgcacagcaaaggaaaacaacagagtgaagagacaacctaaaaaatgggagaaaatatttgcaagctatccatctggcaagagattcatatccaaaatgtataaggaactcaaccaagagcaaaaaagcaaataacttgattaaaaaatgggcaaaataatctgaattgacatttctcaagagaagacatacaaatggccaacagatacatgaaaaaaatactcaacatcactaatcatcagggaaatgcaagtcaaaatgacaatgagatatcatctcatcccagttaaaatggctattatcaaataaacaaaaaatagcaaatgctgacaaggatgcagaaaaagaaggcctcttatatactgttggtaggaatgcaaattagtacagtcattataaaaaacagtatgtaagttcctcagaaaactaaaaatagaaatagcatttaattcagcaattctactactgagtatatattcgaaggaaaggaaatcagaatgttgaagagatatttgcactcccatgtttattgcagcactgtttacaatagctaagatatggaatcaaccaaagcacccatcaatggacaaatgggtaaagaaaatgtggtgtatatacacaatggaatattatttagctgtaataaaatgatttgtaatttttggcaacatggatgatcctggaggatattatggtaagtgaaataagctaagcacagaaaaacactgcacattctcactcatatgtggaagctaaaaaagttggtctcatagaatagaggttaccagaggctggggaggggtagggagttggcagagggatagagaggttggttaattgatacaaaattaaagttagataagagtaataaattctatagcacagcagcgtggctataattaacaataaattatagtgtattttaaaatacctagaagagaggattttgaatgttctctacacaaataaatggtaaatgtctgaggtgatggatgtgtcaattaccctgatttgatcattacacaatacatacaattatgtgccaatttgaaatacatacatatataaatgaaatagtttcttcacatcagtgactttgtttgtttgtttgtttgtttgtttgtttttgagacagagtttcactctgttgcccagggtggaatgcagtggaatgatctcggctcactgcagccttgaccccctgggctcaagcgatcttcccaccctagcctcctgagtatctgggactataggtgcacaccaccatgcctagctaatttttaatttttttgtaaagacagggtctcaccatgttttccaggctggtctcaaactcctgggttcaagtgatcctcctgcctcagcctctcaaagtgttggggttacagatgtgagccaccatgcctggccagtgataaccttatcatgtttttgcccacgagtggtagttttaaaactatgttcacaaattttttgatattcctctcttcaatagatggagcctaagtcccctccacttgggtgtggcatggacttaatgacttgcttctaatgaatagcataaagtggatgtaacagctgtgatttcaggcactaggtcataaaaagtcactgtggcttccctcttagttctcttagattgtttgcttcagggaggccacacactatgtcatacataatcctatcaagaggcccaatattgctcagatatctgggcaataaccacctaagtgagcttggaagtggtcctccagcccagtcaagtattcagatgactgcagtcccagccaacatttggactacatctcatgagagaccctgaactggcaaacccaactaagctggtcctagattcttgaccaacagaaactaataaatgtttgttgttttaaactgctacattttggggtaatttgttatgcaataatagataactaatataccgtaagtcaacaattttcgaccaataccttctgtgcccttaaaagcataaacgatgcagcatttcttaaaaggagcctccattattatctttgggaattttctctacactaatggtatacattctacaagttttgctggagatatatgggcaataatacctacaacatacctgcctgttggcagaccacaaatgacacatctctctttcaaagatgttaaaatacgggggaaaatgtgcttcatagaatcagtgaaagacgttttaggtcatgtttattatctgccttccgcctccatcaacccctttctctctctaagaacttgatcttgtccatttcaggacaaacctgaggttcgtagagggttagtgtatttacatcctccactttacatgcaccgcacagggcttgtatggttatggggggaaaagccgttggtgtgaactgaaagaatgctttgttaactcaaacatttctcagcccaagaaacctttgctatgagtgtcacaaaggggaataccttctttgtggggtcctgaaattgctgggtaagtggtgatggtggttgttgggaaaggagcttatgatgctggtggaattttgggtcttaaagagggcatattaatctttaaagaattggaaatatttcagttacatgtaatggtctatatcttgcaacaattcattaccagcatattaggtaatgcatacacacacacacacatatatatatatatagagagagagagagagaagcaagaatgcaaacaattagcagtgccacacccaacgggtgcatagtcaaagcaaatataaaataaagacagagatttacctgacctaaccacactgatatcctcctttaatccttctccaataagtaagatatcacgtatggaaaggtttttaaactattaagcactagaccaatgtacactttaattacatacgtgggctgcctcaatgctgagagagtggcagatcctcatttaattcccacctgtgcctgactttgaccactttctctgagctttctcttcatttctgatttcaaggaaaggtgtaaggaacaaaaatagaaataatgatgtttaatacgatttagaagaagttcagaaataattgtgcttataccccctacaacttaactccctttcatgttctttggatgaatttatttaatccctaaatcttcttccttctctggagctaatactcctaaaataaagcttctttcctgttctgattacctggaatttaaatctctttttacagatttatccttccccctttttccttcaggggctctaactctttccctgactggaatttcttgggtcacagaagtccctccctccttaacatctttgtagtgcttctttcaattcaacaaatatatgaacaatagtattgctagagggcctaacttagatgctgcaggggatttaacaaaatgacccagtccctgatagtgtctgccttcaaagggcttaaatatttacaaggaaatctaagaaaactatacagttaggtataatgtagggtaatgtgtattatattggtacagaaaaagaagacaagtactaggtgaggacttcctctcctgagattcttgtggtggttgtttccttccttgatcacttactttatttatttatttatttatttatttatttatttatttatttataagacaggctcttcttctgtcacccaagcaggaatacagtggtgccatcacggctcactgcagccttgacctcctgggctcagttgattttcccacctcagcctccccagtagctgggactacaggtgcatgtcaccatgcctctctaatttttaaaattttttttgtagaaaggggtttttccatgttgctcaggctggtcttgaactcctggggtcaagcaatccacctgcctcagcctcctaaagtgctgagattacaggcctgagccactgtgcctggccttgattgcttgcttttgacagttttagtacaccgcagtttttttctctgtagatattgcaacattgttctttcctataaattaatcagtttttctttactatttttcctcctttaactgttaaattcatgttatagtctacagaaatgcttgttttgtttgtttgtttgtttgtttgtttgttttgacaaagcctagctgtagcccagactggagtgtaatgacacaatctcggctcactgcaatctcttgcctcccacgttcaagtaattctcctgcctcagcctcccaagtagctgggattaagcgtgcacaccaccatgcccagctaatttttttgtatttttagtagagatgggtttcgccatgttggccagtctggtcttgaactcctgacctcaggtgatccacctgccttgtcctctcaaagtgctgggattacaggtgtgagccattatgctcggctgtttttgtttttttaattattctatcaaaaccagcagtggtaagaccatatcactttatttctgctttgaatggtctttaccttatgagttgacttctgcctgtgatctgcatgcatcttctactggtggataatccttctctgcctccacccttgtccatgttatgtatctgatgacccaaatagcagctccctgttatatttgtccttcacctgcttatttctgtctctaaaccagatattaaaattcctcaagtcacatggttttctcaattttacgttgtttttctttttctctttgcaaaatcttaagttgacctcagtcaagggcttctgctagaataaagttcctttaacgtttagtcatacttaaaaaaaaagtaataaagtattcatcatttatgggaaatcatgttagtgtaaagtgatatttccaatgatgttatatatgtagcaggtgcatctgagacaaaaacaccttcatacctcccttggttgactaccaaatgaatgctttttcccctttcctcactaagagaacccagattttcctcaggctcctcctagtggccatattcttagaaggtggctggagataatcttgaacttgagagtgatgatttaggatatctggtggaagaaatttctaagcagcaaagcattcaaaaagtggtctgtttttgaacagcaaaagctgttctaacagctgcttctaacagcatatggtcatatgcattcacaaagagatggtctgaaactggaacttacattttaaagggaaacagcataaaaatttagaaaatttgcaacctgaccatgtggtagaaaagaaaaactcattttctggggaggaattcaagtggctacagaaatttgcataagtaaagaggggccaaatgttaatagccaagagaatggggaaaatgccttgaaacatttcagagaccttcacagtagccccttccatcacaggcctggaggcctaggagggaagaatggttttgcgggctggacccaaggccctgctgccctgtgcaaacttggacacactgctccctgtgtcccagccactccagctccagctgtagctaagagtcccccaggtacacctcaggccgctaccccacagggtgcaataagccttgacagcttccaagtggtgttaagcctgcagatgcacagagggcaagcattcgggcttcagagcctctgtctagatttcagaggatgtatggaaacacctggatgtccaggcagaagtgtgctgtaggggcagagctctcctggagaacttctactagggcagtttggaggggcaatatgtgtgttggagcccccacacagagtctccactgaggtcctgcctagtagagctgtaagaagagggccactgtcctccagatcctggaatggtagatccaccattggcttgcactgtgtgcctagaaaagctgcatgcacttagtgccaccctatgaatgcagcaaaggggtctgtatgctgcagaacaagaggggaggagctttcccaaggccttgggagcccaccacttgtgtcagtattacctggtgtgagacatggagtcaaaggagatgattttggagctttaatatttaatgacagtcctgctgggtttcagacttgcatggggcctgtagcctctttgtttttggccaatttctcttttttggaatgggagcatttagctaatgcctgtatccaaattatattttggaagtaacaactggttttgattttacaagctcacaggtggaagggacttgccttgtttcagataagactttggactgtggacttttaagttaatgctggcatgagttaagactttgggggactattgggaaggcatgattgtattttgaaatgttagaaggacataagatttgagaggggtcaggggcaaaatgatatgctttggatttgtgtccgtgcccaaatctcatatcaaactgtgatccccagtgttggcagaggggcctgatgagaggtgattggaccatgggggcacatgtcccccttgctgttctcatgatagtgagttctcatgagatctggttgtttaaaagtgtgtggcacttccccctgctctctattcttcctgctccagccctgtaggacatgctggcttccccttcaccttccaccacgactgtaagtttcccgaagcctccccagccatgcttcctgtacagcctgcagaactatgaggcaattatacctctgttctttataaatcgcaggtagctctttacagcagtgtgagaatggactaatacattgcccttttcctttctcctcagggcactctttttcctttcagttattcagaaccttcctattcttttaaaattatctgcccatcaaatttgaagagttgtgagattggattattcatccttatagaataataggagactggaaataattatgtattgttatttattagtctggtactgaaagctaagtatgaattcatccttggggtgttcagcatgaatactattttcccaaacaagagattgcatatttaccatacgttagatggtaatttaatctgagttatttaatctgagtgccagctgcctcatatgttaaatggagataataactgtaatatctctagagtcactgtgagaattatgtgagataattcacataatcacacaaacttgtagtcatccccagacccctggccactccttcacagagctcttggcacactatcactctgtctaacactacttctgtaacaatttttagtgctttcaatagccatagagatgattcttccaaagctttaattatgtgacctcttctcttacagtgatcctcaagtccaccctacctcagctactcacccccgtggccttaccctagacctcttcatttccaataaatgtaagtaacggcccccattacattaattcacttctaaccattatattattgctgctacctcctatctttctagctcacttactcaactactcacactttaaaaatctttgaccctacctggtcaagcaatccattcatgtcattgcctttttattgcctctcagtttcttcatgtcttcacttccctccttacccagcttagttattatagtaaaatattaatgagtcacttttatatcccctgaactctcctgccctaatgcctctcaatcaaactatcctggcaaaatccaaaccagtcatggttaaatccagccaacatagctctaataaccatgcagttgaataaggctggaggaaaacatccaaatccatgataattacactcaagtgggcctttattgctgctctgcaaatatactatattccatagtttattcacttttccagtctcctgaacacttcctccctattttgcatccttagttgatgactttgcttttatttcattagacaatagacacaatcagggccagcacagtggcttacaaatcccagcattttgggaggctgaggtggaggatcacttgaggcatgaagctaggagttcaagaccagcctgagtaatagggtaaaaccccatctgtactaataaaagaaaaaaaaagaagttgaaaatagacataagcatctatgtctcccactcccacttttatcaagctacctatatcttactctgcctttcctccttcttctatggatgaaatctgtgtttctaaaggttaatctctatttaagactagactgcatcctcttcttacctactcagagatagcaattccttccttttctctccagcatcagcaacttttccctctctattgaatcgctttcatcagaaaaagaaaatgcagagatatattttcaaaataagaaaatgcctataaaaagaaaacttttgtttctatacctactttctactccatttctctgttccttctagaaagagttttccacatttattctctctaaattttcttcttccactctctcttaaacttattccaaccagacttttgaccctactgctccattgacagacttcttctccaagtcatgaatgacggctccatgtgatgaggtccaacagttgattcaagtcttcatcttacttgacccctcagcatttgcacagttggctactccctttttctggaagtcctttttttccattggcttctagaaatctgctttcacttggttctctttgtacattatatgctttttatttcccactgtacctcagctactcaccgtcatggtcttaccagaggcttcttcatttctgacaattgaaagtaactactccattatttcatttctaatcgatacactctctcactgctaccccctatctttaccagttttcttttcagcgttctttacttgtgcctcctcagcctcagggtttggtctttacacaaccttaggtaacctggtctagtctcataacttcaaatatcatttctgtgctgatgatttccagatttatttatctaggttggacctctttcctgaacctgtactataaatccatttgtcatttcactatctccatgtgaatatttaatagacacctcacacttaacatacccaaagccaatctgttcatttccttcctcaaatctattttattctgcaggtttccttatctcagcttttttgtttttttttaagacagggtctcactctgttgcccaggctggaatacagtgttgtgagtgtggcttcctgcagcctcaacatcctgggctcaagcaattctcctgcttcagccttctaagtagctggaagtacaagcacatggcaccatgctcaggtaatcttttcaaaacttatttttattagagatgggatttcactatgtttcccaggtggttctcaaactcctggcctcaagaaatcctcctgcctcagccccccaaagaactaggattacaggcatgagcactgcacccagcctttcatcacattttaaatctatcccttactttatcagaaaaaaattatattaatccatactcattactttttatatatcttatattcacatcattaacaactccttgtggcttcacttttaaaacatattcagaatctaaccacatctcataacttctctctccctttttaaaaaaatttccaactttaagttcactggtacatgtgtaggatgtgcaggtttgctacataggtaaatgtgtgccatggtgctttgctgcacagatcatcccatcgcccaggtattaagtccagcatccattagctattcttcctgctgctctccctcctcccacaccccaccctctgataggccccagtatgtgtcgttcccctcagtgtgttcacatattcttatcattcagctcccacttgtaagtgaggatgcagtatttggttttctgttcctgcgttagtttgctaaggataacggcatccaactctatccatgtcactgcaaaggacgcaatctcattcctttttatggctgcatagtattccatggtgtatatataccaaattttctttatccagtctattattgataggcatttatgttgattccatgtctttgatattgtgaacagtgctgcaatgaacatacacatgcatatataatagaacaatttatattcccttgggcatttacccagtaataccattgctgggtcaaatggtatttctgcctctaggtctttgaggaattgccacactgtctctcacaatggttgaactaatttactctcccaccaacagtgtaaaagcattcctttttctccacaacctcaccagcatctgttgttttctgactttttaataatagccattctgacttatgtgagatagtatctcattgtggttttgatttgcatttctctaattatcagtaatgtcgaggttttcttcatatgtttgttggctgcctgtatgtcttctttcaagaagtgtctgttcatgtcctttggccactttttaatgggtttttttttcttgtaaatttatttaagttctttatagatgccagatattagacctttgtcagatggatagattgcaaacattttctcccattatgtgggttgtctgtttactctgaggatagtttcttttgctgtgtggaatctctttagtttaattagatttcatgtgtctatttttgcctttgttgcaattgcttttggtgtcttcatcatgaaatctttccctgtgcctatgtcctgaatggtgttgcctagattttcttctgggtttttttttttcataattttgcattttacatttaatctttaatccatgttgagttgatttttgtatatggtgtaaggaaggggtccagtttcaattttctgcatatggctagccagttaattctcccagtaccatttatgaaatagggaatccttttcctattgcttgtttttgacaggtttgtcaaaaatcagctggttgtgtgtggtcttatttctgggttctctattctgttccattggtctttgtgtctgttcccgtaccagtaccgtgctgttttgattactgtagccccatagtatagtttgaagtcaggtagtgtgatacctccagctacgttttgttttttgcttgtttgtttgcttaggattgtcttggatattcaggctcctttttggttccataagaatattaaaatattttgtttccagttctgtgaagaatgtcaacggtagtttaatgggaatagcattgaatctataaattgtttttggtagtatggcctttttcatgatattgattctttccatccataagcatgaaatgcttttccatttgtttgtgtcatctctgatttctttgagcagtggtttgtagttctccttgaagaggtccatcatgtcccttgttagctgtattcctacgtattttattatctttgcagcaagtgtgaatgggagttcattcatggtttggctctcagcttgcctattgttggtgtgtaggaaagctagtgatctttgcacattgattttgtatcctgagaccttgttgaagttgcttatctgcttaagaagcttttgagctgagacaatggggttttctagatattggatcatgtcatctgcaaacaaagatagtttgacttcctcttttcctatttgaataccctttatttctttctcttgcttgattgccctggacaaaacttccaatactatgttgaataggagcagtgagagagggcaatcttgtcctgtgccagttttcaaggggaatgcttccagtttttgctcatttagtatgatattggctgtgggtttgtcataaatggctcttattattttgaggcatgttccttcaatacccagtttactgagcgtttttaacatgaaggggtgttgaattttattgaaggtcttttctacatttattgagataatcatgtgctttttatctttagttctgtttatgtgatgaatcacatttattgatttgcatatgttgaaccagacttgcatcacagggatgaagcctacttgatcatggtggataagtttttgatgtgctgcgggatttggtttgcagtattctgttaaggattttccatcaatgttcatcaaggatattggcctaaagttatctttttttgttgtatttctgacaggttttagtatcaggatgatgctggcctcatagaatgagttagggaggagtccctccttttcaattttttggaataatttcagtaggaatggtaccagctcttctctctacctctgctagaatcaagctttgaatccatctggtcctgagctttttttggttggtaggctatttattactgactcagtttcagaacttattattagtctattatgggagtcaatttcttctttctcctggattttctagtttatatgcatagagatgtttatagtattctctgatggttgtttgtatttctgtgtggtcagtgatgatattccccttatcatttatgattatgtttatctgaatcttctctcttttcttctttattaggctagctagcagtctattttatttattttttttttcaataaaaaaacagcttctggattcactgatttttttgaaggatttttcaggcctctatctccatcagttcagctctgatcttggttatttcttgtcttctgctagctttggggtttgtttgctcttggttctctagttctctttgttgtgatgttaggttgttaagttgagaactttctagctttttgatgtgggcatttagtgctgtaaatttctcttaacactgctttagctgtgtcccagagattctggtacattgtctctttgttctcattggtttcaaagaacttcttgatttctaccttaatttcattattttttacccaagagtcagtcaggagtggattgttcaatttccatgtagttgtgctgttttaagtgaatttcttttttttttttctttttctctctttttttttcagacaaagtcttgctctgttgcccaggctggagtgcagtggcacaatctcagctcactgcaacctccacctcctgggttcaagtgattctcctgcctcagcctcccaagtagatgggattacaggcacgcaccaccatgcctgggtaatttttgtctttttagtacagatgaggtcttgccatgttggccaggctggtctcaaactcctggcgccaagtgatccacctgccttgacctcccaaagtggtgggattacaggcatgagtcaccgccctcggccttgagtgaatttcttaatcttgagttctaattggattgtgctgtggtccgagagactgtttgttatgatttcagtccttttgcatttgctgaggagcgttttacttctgattatgtgatcaattttagagtaagtgccatgtggcaatgacaagaatgtaaattctgttgttttggggtggagcgttctgtagatgtctatcaggtccacttgattgagagctgaggtcaggtcctgaatatgtttgttaattttctgtctcaatgatctgtctaatattgtcagtggggtgttaaagtttcccactattattgtgggagtttgagtctctttgtaggtctataagaacttgctttatgaatctgggtgctcctgtattgggtgcatatatatttaggatagttaggtcttcttattgaattgaattctttaacattatgtaatgcccttctttgtcttttttggtttctgttggtttaaagtctgttttgtcagaaactaggattgaaacccctgcttttctctgctttccacttgcttggtacattttactccatccctttattttgagcctatgtgtgtctttgcatgtgagatgggtctcttgaagacatcatactgatgggtcttgatcctttatctagcttgccattctatgtcttttaattggggcatttagcgcatttacatttaaggttagtattgttatgtgtggatttgatcctgtcgtcatgatgctagctggctattttgcggacttatgtggttgcttcatagtgtcactggtctgtgtacttcagtgtgttttagtcatggctggtaatgctttttcttaccatatttagtgcttcctttaggagctcttgtaagggaggtctggtggtaacaaattccctcagcatttgcttgtctaaaaaggatcttatttctcctttgcttatgaagcttagtttggccacataaaaaaatctgggttggaaatactttcttttaagaatgttgaatattggcccccaatctcttcttgtttgtagggtttctactgagaggtctgctgttagtctgatgggcctccttttgtaggtgacctggcctttctctctggctgcccttaacattttttccttggaaaatttgatgattatgggtcttggggatgatcttgtggagtaccttactggggttctctggatttcctgaatttgaatgttagcctgtcttgctaggttgggaaagttctcctggataaggtcctaacatatgttttccaacttggttttgtgtcctgaattggtgggttcttggtctcgctgacttcaagaatgaagccgcggaccctcgccatgagtgttacagttcttaaaggcggcgtgtccggagtttgttccttctgatgttcggatgtgttcagagtttcttccttctggtgggtttgcggtctcgctggctcaggagtgaagctgtggaccttcgcgatgagtgttacagctctcaaggcggtgcgtctggagttgttcattcctcccagtgggttcatggtctcactggtttcaggagtgaagctgcagaccttcctgctgagtattacagctcataaaggcagtgtagacccaaagagtgagcagcagcaagatttattgcaaagagcgaaagaacaaagcttccacagtgtggaaggggactcaagcgggttgccactgctggctcaggcagcctgcttttattctcttatctggccccacccacatcctgctgactggtccattttacagagagcctattggtctgttttacagagagctgattggtccgtttttacagggtgctgattggtgcatttacaatccctgagctagacacaaaagttctccacgtccccactagattagctagatacagagtgtcgactggtgcatttacaaaccctgagctggacacagggtgctgattggtgtgtttacaaaccttgagctagacacagggtgctgattggcgcattcacagtctctgagctagacacggtgctgattggtgtgtttacaaaccttgagctagatacagaatgctcattggtgtatttacaatcccttagctagacataaagattctccaagtccccactagactcaggagcccagctggtttcacccagtggatcccacaccggggccgcacgtggagctgcctgccagtcccacaccatgtgcctgcactcctcagcccttgggtggtcaatgggactgggcgccgtggagcagggggcggcacttgttggggaggctcgggcggcacaggagcccacagcatggtgggggtaggctcaggcatggcgggctgcaggtcccgagccctgccctgcggggaggcagctaaggtgtggggagaagtcaggcacagcagctgctggcccaggtgctaagcctctcactgcccagggccagccgctctgagtgcggggcctgcagagcccacgcccacccggaacttgtgctggcccgcaagcgctgcatgcagccctggttcccacccgcgcctctctctccacacctccacgcaagctgagggagccggctccggccttggccagcccagaaaggggctcccacagtgcagtggcaggctgaagggctcctcaagcacggccagagtgggcaccaaggctgaggaggcgccaagagcgagcgagggctgtgagggctgccagcacgctgtcacctctcagtttcattctctccatctccttcagggacgccaattagtcatagatttggtctctttatataatcctatatttctgagaggttttgttcattccttttctttttctttttttttttttttttgagacagagtctcgctctgtcgcccaggctggagtgcagtggcgtgatctcggctcactgcaagctcgacgtcctgggttcacgccgtcctcctgcctcggcctcccaagtagctgggactacaggcgcatgctgccacgcccggctaattttttgtatttttagtagagacagggtttcactgtgttagccaggatggtctcgatctcctgaccttgtgatccacccgccttggcctcccaaagtgctgggattacaggcatgagccaccgcgcctggcctgttcgttccttttcattcttttttctctattcttaatctgcctgtcttatttcagaaagatagtcttcaagctctgagattctttcctccacttggtctactctgctattaatacttgtaattgaattgtgaagttcttgtagtgtgtttttcagctctatcaggttggttatgttcctctctaaactggttgttttggctgtcagctcctgcattgctttttgtttgtttgtttgtttgttttgagatggagtcttgctctgtcgcccaggctggagtgcactggcacgatctcggctcaccacaatctccgcctcccaggttcaagcaattctgcctcagcctccagaatagctgggattacaggcatgtgccaccaggcctggataatttttgtatctttagtagagacggggtttcaccatgttggccaggctggtcttgaactcctgacctcatgtcatccgcctgcatcagcctcccaaagtgccaggattacaggcgtgagccaccacgcacagctcctgcattgtttttatcaagattcttagcttctttgcattgggttacaacatgctcctttagctcagcagagttcatttttatatttttacccacattctgatggctacttctatcatttcagccatcttagcctcagcccagttctgagtccttgctggaggagtgttgcagtcatttggatgaaagggggttgttcgagttttcagcatttttgcattgattctttcccatctttgctggcttatctacgtttgatctttcaggttgctgacctttggatggggtttttgtgggttttgttgttgatgatgttttctgtttgtttttcttttaggagtccagccactcttccgtagggctgctgtggtttgctgggggtccactccagaacctagttacctcaactttttccatacttagaggtaccaccagcgaaggctgcaaaacagcaaagatggcagcctgccctttcctctggaaggtccatcccagatgggtactgacctgttgctggcccaaacacacctgtaggaggtggctggagaccccacttgggaagtctcacccagtcaggaggaacaggatcaggggcccacttaaagaagcagtctggctgctttttggtagagcagctgtgctgtgttggggatcccttcagctcctgattggtttgagctctccaagacccataggctggcctggctgagacacacaaacagccaaggtggtagcctgtcctgcactctgggcaatccatcccagggttaaattagaactctgtcggctatagaacatgggtgggggtgccaggaggccccagttggttgcatccttttttcttagctgtatattactccattgtttggatgttagatagtttattgaacccatctcctatggcaggatatttggcttatttccagtgttttgctcttaccattagtgctataatgactaaccttgtgcgtagatttctagaataaagatgctgggtcaaaggacaaatgcgtaggattttttctagaaatcagtgaattctatggggttatatcattttgaatttccagaagtgatgtatgaaagtgcctgtttcctcagccatgccaataatatgatgtcattcttaaaaccagtaagtgaaaaaatagtcttgtactcttgtttgaatttgtatttttcttttgtgagggaagttgagcatcttgctatatgtttaagggacatttgcataattgaacacggttcagcatttcatgttgatatactagtcagcaagttggaaagacaagaggaaatggagaactgggaaattctaagaatatgatacaagcattttatacctcatttactttcacttcacattagctacaaagaaaatttcctagtttcccttttagctaatgtgaagtgaaaagtaaatgaggtatacagtttgggtggacatgagtcccattaaaacttggaacaggggtaaatgtcgtatttccaagagaaggaaaaggtgaatggacactggggacagttagcagtttctgctacatcatcttcttttaaaaaaatctagctattatcacagccctatgtgatttttgtctcatatttcttctttgtcctcatctcttgctattctccctcttactggcattcttgctgtttctccaaaaatcaagcatcctctcttgtgggtctacttgcccttccctctgcctgaagtgttcttccagaacgcatggctcactctcagaattctgctcaaaagtaagcccttccttaaacaccaatggtaattaacatgctctccatacccaaccttttaccctccgttgcttttcttcttagaattgatcatctgtgtcaatcgaggaaaatgacaagtctcaatcattttaggagatttgtttgccaaagttaaggacactctgggagacaagtctatgcctttctccgaagataaatttgagggctccaaatttaaaggggaaagggcgggatattgagaagcacacaggttttcacataaacaaaagggggcagaggaagaatgtgaggaatcgcattttacataagataacaaaatggggtaggggaacaatcagatatgcatttgtgtctggtgggtgattgcacctggaaagacaagctatcaatttgcattgctatggtgaagttttaacagctcacccataatttccctgtgggcaaaatatgggggaggcatgtagcctttcatcttgtagccatcttatttaggaacgaaaagggagaggcagatttgcatgacccagttcccagcttgacttttcccattggctaaacgagtttagagtcccaaaatttaatttcctgtcacatctgacataataaacatattatatctttgcttgcctagtttctcatgtttccccctccacaactaataataaatgtgccaggcgttggcctgtttgtgcttttaacatatttaagctgaattatttctcccaacaactctatgatgtggtgtatcatttactattaccatactatcactacataacaaacctcaccacaactatgtagcttaaaaccaataatcattcattattttcatgcatctgtgggctgactgagagtagattgatcaagactagccttcgctggacttgcctctgagctacaaaagtcgggtccaggctggttccctgcattagcaagctaactagggatgttcttctcaagacagtggcagaggcacaagaaggcaagcctcaccatgcaaagacattccaagcatctgtttgctactacacttgatcttagccaaaagaagcgatgcctctgtttgttatgtctgccaatatcctatggaccaaagcaagtcacatggccagccacaactttaatagcacaaaaaggtataagcatactcttttcatgaaggtggggttgggggagagatatttgctaaaaaatagtctcatctaccattttttttttcctatttctggtgaggaaactcaggcacctagaaaatagaaatggaatgcaaattcagttggtatagctccactctattcagtagaaatctagcctgtatctccaatatgagggtagaaacttaatctgttttgttttctgttatatttcccagcacctagaacagtgcttggcacttagtaggcattcagtaaagatttgttagacaaatgaatgaactcagcacagcacatggcacataattggtacttgatcaatgttagctattattattgagaaaaaatacataaaacttgggaacaaggtaaagccatgttcattcactgtcacattgaaacactgcttcaccggccaatgaaaggattattaattatttagggaaaagtatcttttttggactcattaactactactgatcgaagtctcaaactctgaagttacgtttttatttacagatttttgttcaatacagatgtaatttattttggaaaaacaaattattttttaaaaaacaaaggattattttgccctgtatgacattagtgagtgttgttttgaacctagcaagctgactcatcctgtcttcctccaatgctgctaaatttctttctcgaactgtccttggaacttacatcattttgttgctttcctcatttatgagttaaatcaatctttgacatatcttcatcttatatttcgagttacatagttaactttttggaaattgcactttaaagttagcatcatttaaaaaattttcctgctagatttgaaagtggttattcactttcaatttaattcaactattatttacagaattcccggttttctaggttacagggatgtgaagctggaatataagaggggagagaaggaactggtgattgccagccttgtataccagcaactgggagccccaaagattattatggacaatataaagcagccttgacaggttagaagtcattatcaaagttttccaaggccctgtgttatttcaagattctgatcacataactggaaacttgtcgatggttttcaggggcagttaatatcctgcaaagaaaaaaattgttgaagcctcatcttctggaaatgtctgtcaacattcaggtattaaatggattattgtgggcaacagtccttcagtagcccccatggaaggggtggggattgaagactttagtttgaaataaacaattaacaaaggagacttaaaagtttagttgaggactcctcctcaaaattctggttgctttaataattagaatttccataagagtctcaacgaaagccactaatggaccgcagtgaaatcctatttcagtatcatgaaactgtttttaatctgaagctttttctctttgacctttttactcttgaattaaatgataaatctatagattttcggaacattttggagatcacgaaagggcactgtgcgttctcttactgggtgtactgaagttccagtaagtttcaggttgaggatggcaatcaggaggacttcgaatacttagatcttggattcccacaactaggaaagttgaattgcaggactggctctcttctggtaatatttggacaccttgggaaaggtgaataacagccttcaacttgggccccgaaacttctctgttacttatttttgtaacttagttccttgcccataaaacaaagactgaccagtcagagacttggctttctacggattatgtcaactagtcaaggtaagagattagcacggaccttggcacaagagagcattgcttcatccagagcacttaaccaatgctgggatctccaccaagtgtccagtaggcgaaggagccggagggcagtggagcgagcgcactgggggctcagacccaccccggacacgcggcttctcggccgtgttcgggacctagagcccgagggcctctcccctcggccttggccttggcgtatactgggcggtggcgcggtgcgctcactccgcccccagcgggctggggcggggacaccgtcccccgggaaacgggacgcgctgcttgtcccaggccttcgcttcggcctgcgaggctacagctgtgcgcagtggcgcggctgctaagtagcagcaggtgggagactagggtctgcgctcgcggcgaccgcggaggagggtgggcgcctgcggaggtgtcctcgctcacttcggggggcccagagtctcgggtgaggagccagccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggaggtaagaggcgacgggcaaggggacctgcccatccaacaaaactacccaggggagacagcccagtcgctcccctttggattcccgcggggcgctcactcgggcactttaacaaacttggcttgaagtccccatcctgaggcccgcaggactcctccccacgtgcacccactctgcagttcagcagctgcaggttagtttcctaagtcagcagtttgtatctgaccgagaatcccgcgttgagcctgttcgaccaggataacccaagaacaccagcgctttctttagctgcttgggtgttaggcgccaggtgggctttctgtgccaaaaaacttgcgtttcagttgctcttgggtcactctggagtcacatcctttaaaaaatggggtgtttggcagagcgcatgtaactcgtcacgtattttgattacgtgccaacaacacttcaccccaggcaaaaacattaagtccttaaaaaggaaggcccctgcaatctccgcacacatgggtgtttactgaacatttagagggaacagttccctcctttcttctttttcttccttttctttttgaatttcgatgatttgtccactaaaaggttaacgtatcacctaacgtacagcacttgtatttagtatttttcaagtatgatgagtttggagcaagattcacaatttttaagtagcgcaatgctcagtttaacatgttatgtcgttttatcactaggtgtggtcattgtaatagttgggaaataggatctcagagaagaaagagtaataggaaggctgccttatggtattgtgaattttgaattcttttgttttaggactctcctaattgtaactttaaaaaaaataagtttgtcagtagacaaggcgatagaacacaactctagtattacctaagttaaatagttattataatgttcaatggaatgactcagtagttgtggaaatgttagcatgttttggttatacggttctattctttgatagaaatacaaattaacctcttgggcttgtctttatctcagtttggcttatttccaaaccagagaagagtataaaaaataaccctttaggattgaaacatttctacatgcctacgtgctccttatttgtttttagttataagattttttttttggtgtataatgaactggtataattggcatgcctttaaaaggtgatatttccacaccagtaatgctgtgaaattagcattataaaagaacaaagaaaactgtatactcgctgcatactagggaagagccgtagaaggaccttgtttatagggcaggcaagatgccaggttttgtttcttctgctagcaatacagctacaagttggatatagtaaatcctgcttgttaacaagaaaactacttgaactaattatcttgctcttgttttagattccaagagatgcaaaccataaacttgtttttatttccaagaagattactgaaagcattggagtaaatgacttttctcaagtggttttatttggagagttacctgcgttgtctcttggacatgtatctgctttccttgatgaggtactggtctgtctttaatatttaaagctttcacttatctccatgacatttgaaattatttaggacaactccgataattaaaaaaagaagagctaggaggggaagggaaggggatgggggtggttaaaaaaaaaaaaaaaaaaaaaagcttgtagaagccaggagtctctagccaggtggatggagtcataacatctagactgttcctgaaaggagctcatgcttactgatgctaatattcaacaggtggcaattgcagggatcattctctccctttcttccttccaacacaatagaagcaaataaaaagcaacttgaataggttcttgcaccttagcagcaggttttaagcttcacattcagagtagagacaaatttacactttgaaaatgagtattatcagttcctttttatacttgttagaaactaacagttaaagactaagattcactcatggcagataatgggaaaaggtgatgaaagtgttagaaatggttcttaaactttctttttctcctcttaaaatagagaaatagtcttcaaccaatgttactgacactttaatgtgcataagaactgcctggggattttgtgaaagaggttggttcattcagtctagagtggagcccgaggttctgcatttctaacctgttgctgatgctctttgtttgtggactagctttgaagaacaactgccaaataaccaggttccatggaactagaacctggctctcaaacttcgctgaacattaggatcacctgggggaacttgtaacacaatgccccaggtcacacccataccagttaatttagaacgtcctgaatgggagccaagtagcagcagttgttcaagattcccaggtgattctaatgtacagtgagctttgggagccactgggttagatatctgtctacaaggccaatttctaaatcagacctctgtaatcagtgtagtcctgccaaggccgatatttaaggtaggaaaaatgctgacatatttattgctagttatttaccagtctctcatgatcacacctcttctactttttgagtctcttcttctgtctttttgaagggaggtattttcctgctggactaaccaaagtctctcacccctaactcctgtaccctgcctgggtttcccttcgctcctgttgaatttaattggctttagctgatttcagggaggtgctaggaagacaatcttttaacttcagtaccaggaacaatttttggtatgcagcaggtgctcagattttaattgaactgaatctgatgactttggttcaatatgagaatctagaccactatcaactggaacttggaggggcagggctacactgtgaaattcttgctctactatctgtgtctggcaacagaagatacaagcctttttcaaatttctctactctttctctcagtaccaggatctgcttaatattctgaaaaaggtatgcctgctcctcaacattatgatgtgtttccataccagagtgtattatatatttatacttagccaaagtatataaaatgtcatatggttatttctttatgtatcacgttggcccacatttcaaaagaaacaataattgtgaatgcttaccaagacataaagaaaatgtcatttggttcttctcagtcaatatctgggccccatccttggaaattccaatttaaaaaatctagaggggcctgggcttctgtattttaaaagtgtttcctcagtaattgtattgaatggtttaagaactgtcataaagagaaaccccacagtttgaaaagagaaacagaaggtaagtaaagagatccacagcaaaggcacacttgctcttttatctataggtgtatatgtccttggtgaaccttactttggttcatagagaaagtttatttttcttacaaatgcaaaaactacacaaactgacaactaaaataagacaaaacctcaaattaattgacttactttgtatatatttaataaaatttattgtaattaataagtacatcccaggtctatttgttttaaacgatatttctagagatgctttagctgtttgagttacgaattgctttccagagcatgtggctcagaatttcgtagtgttttatccacagctcatgacacagacattaagttttaaaagaagttggctttgtcatggaataatgtgagaaacacatttatccttccaaacccaaaggatggactcggagacacgcagtacagcagaagcaagacttttaatggcagtcttgcaagatcgggtgtttagtaggcaggcacacccggggcagttacagcaggtaatttacttcctagcatgtaagcccctctcccagttcctcagtggttgagtactatggggttacaatattcctggacattgcctaagtttgcctggacatatgccccttataatgttataccctggcccccttcctcacttaatttttgatttcccaataacgaaactttcttcccttttatgggctgactcctcgtctacattctgttcctttatcatgactttctacatgcatgagccatgaggtttgtcatatcctcaggctggctgccagtacttagatttatcatgccttgaaaattgaccgtataaaatgttttctcacaagttccctcctcttttctatttactttctttggttttatttttatctaaacccttttggttcttgaatcactctaaaagttgtttacttttttccttataggagagcaactttaatttggtctctaatagtagcagattattttgctagtaagttatgcacatttgtttattaatagctatttttgtgctagtccccttacacaggaggaatacgacatcccattgctgttaagactcctgccacaattatgagagatgtaaggattgaacctatcataccttttcattttttaaagcaaccttctacccaacccattaatgggttattaatttcagcattttttgctagtttgttggctagggttgttcttgtaaagcttttgtgatggtgccatctggggcggtattcttgggaatgacaacacttcccacccagcataacacatacaccccctttttctgctagtgtcatgtctagtgcaagcctgttttctcaggctatttggctggtggcatttaactggctagccacccctttgagggcgttcttagtataactgatgaatttttgttgaatataatagatatagttaatttaatccatgtttgtattaatagttgaccaccaaaagagtgctaacttaaacccagagctctttggttttgggccttaaatttattaggcatccccctagggacacctacggagttaacatatatattgggattaaaagaatttgtcaaatatctccaattttggtggccatatgtattttcgggtgtcttaggaaatgccagagtgaaggcaattggactaaagcacaagtcctgatccaactggaaggtaacaggttacagaggttccttttcccacaataccaccagacattagcctggggcacatggaaagctgggtaattgccattgcctgactcactcgtgatgtttaggaagtggatacaagttgagagttctcctatgggcttattgaactctgccccctgcctagagaggcaagaggagtagttcatattccctatggagaatgagggaattgctctgggatctgacctccgcaatgtgggaaagagcaatgacagacttttttttttttttgagacggagttttgctcttattgcccaggctggagtgcaatggcgcaatctcagctcactgcaacctctgcctccccagttcaagcaattctcctacctcagcctcctgggtagctgggattacaggcaccactgtgcctgtctaattttttgtatttttagtagagacagggtttcgccatgttggccaggctggtctcgaactcctgacctcaggtgatacactcaccttggcctcccaaagtcctgggaatacaggcatgagccaccgtacctggccaatgacagacttttataagtcttatttccccatgcatccttgtcccggtatagagccaacacagtgcatttctttaggattggtattccatcctagaggaaacagaaccacctgtgcctgaagttgttccacagcacatgcataacacttactcttgttgagggcttgtactgaaaatttgacccaggcattcatattcccatactctaaggtttgctttaaatcctttaccttaattatttttacccttttacggtcattatttggtgaactaaagcgtttattatggtttggggttggagtagtcccaggcaaatgggggggttgagttttttattagtttgagaacaaattgccctaggggggtttttccctgtggtgtttgcaccaacccatataaccgagatgctacttttggttcttggtttagaagagctggattctcaatggtgatgagtataggattgcgttttaaattctggcagttacttggtggggagcccttggacagatgtaatttattctttaagggtctccaggctggagttacccaccccatgtttactgtccaaccctgcaattgggtagtccaccatatagtatcccagctggggcagggtgatattctactataacctgtatttggttcagggaaaagatatgtatccacttgagagagctgtttctgattttccacattcccacaaggtaaaacctggcaggcattaaatcttatagtttggggtgctaccgtcttggttacattaataagcaacctgattgagtaggggggagtcccctgcccgtttccattttgacctgctctttgtatagtagcccatcccagccatattaacttccaaaatggagccagcccatgttttgttgttagatttttctgggttaacttgaagggttccttaggtgacctgtgcactttacattcgtctttttttctcccttccatttttttttaaaccactcccttgacttgagtatagtgagttcaccccagtttagctgtttgcacagccagctcagtggtcgggagcacttgatagggacctttccagcttaggtggagcttgtcttctttccaagtctggctcagcaccaagttgccaggctggaagtagtgagccgtgaactcaagaggtgaagtttgagtcagaagtccttttaacctaagggatgacagggtggagtatatggccagtatataatgtcttaagaattgatccttggtttccatagtagggagatgtctagctgtgcccaaatataggatctcatataataacttgtagagggataatcccaagtcttttcttggggctgttctaatcctaaggagtgctactgggagacatttggttcaaggcattttaaagattagtttggtgatatacttttggagagtttgattcattctttctacctttccagaggaagggggatgccaaggggtgagataatcccatttaatttgaaaccttccataattccccttaacacccttgaggtaaagtggctcccattgtcaggattaatattttccatgaggccaaatctaggtacaacctgttttaatattattttgaccacattcccagtggtggctatggaaggggaaaggcttccacccagccagaaaggtgatttacgattatcagtaaattctttagtctttctactttgggcatttctgtgaaatctgcttgaatgctttcaaataatcttagtcctggaggtctttctcccatggcctgttttataatcacctttttgtttgtcttttgacaagttacacaacttccacatacttatttagtgagggtataaatccctatacacacccataattcctaagtattgcatcacacagagcctggggtccccgaagactccctttgtataatatagatattagttttctcatggagtttacttatttctctcccatcaagaagtacccatttgccatcttcagtttgacccctatcctgtctaattcttccttcttctctctggtaaactagggccttaatactaccttagggacgtctgggatcaggcttgtcttctaatttcctcgtccagggaggcttgctcagcagcgccatctgcaagcttgtttcctgtaggttctatagtgttccctttttgatgaccatttacatgagctatggttacctctgctggaagcaggaggctttctaaaacctgtttgaccagttccccatgtaccaattcctttccgctgctatttattaggccccactctgtccagatttttccaaaagtgtgtaccaccccacaggcatatttagaatcagtatatacagtgtcttcttgggctttaaggagctttagggcctggttaagaccatataattcacaggtttgggctgaccagctattaggtaatctacctttctcacacaagaagtgtttattcccataaatgacagcatggccattatgtctcttgccatctatcacatgggacgacctatccacaaatagccttatcccatcatgtagtggagcttccctaaggtttggtctaacttttctttggtattctatgatatctaagcagttctggtctgatgtctctctttttctcctctcctttccataggaaaccagctggatttaggcaaatatttgttgttatgagcaaataatttttttaactactatggcttcatattttagagtctgagaatctgttaactatctcctggcttttgacttaatatattcctgacccagtgtgggttgcttactgttagggccccaccaaaggttagctttccactctcctagcagcagggctgtggcagcactgcttgtacacattcgggccacccctgagagacagaatcaagaagcttggaggcaaaagcaacaggttccctcttccctccccaggtttgaatgagcaccccaagggccgcgccctggtccattgtcacatacacatggaatggtttctctaaagaagggagggccaggaccagggctgtaatgaaggcctgctttagctgttttactgcctgaatttcctttgggaccattgcaaggggtcgggtttctcttctagtaacttgagatacagaatctttttttgagcatgagttaatttattacatacagtagccagttaaacctaaaaatttttggagttctctctttgtcttaggcaaaggcagacccactattcccaatattctttccgggtttattcttcgcttccctttactaattaggtgtcctaaatatttaacttctttttctacaaactgcaatttgttcttagagacttgcaatctccattcgtctatgaaattaagtaagcttatggtggtttctgatacctcggccctcttctccccagaaattaaaagattatctgtgtattataacaactgggttcccctggaaggttggaatttctccaggaccttttctaagatttgacgaaatacatttggggcttccatgaaaccttgtggcagcacagtccagcggtaccattattttctcccagttaataggattttcctatttaaagacaaagaggtctctgctcctgaagtctagggacatgcccagaatacatcttttagatccaccacactgaaccacttatgttcatagggtatcttactgaggagggtgtaggggttaggcaccacagggtggtaggtctggacaagttgatacataccccttagatattgcaccaatctgaacgacccattaggctttttgactgagagaattggagtgttgtacgggtgacatgcagggttttaatagtccatttttcattaatccctttattactagctggtgatattttctcccttcagtataaatgggattttttttttttttttttttttttgcaaactacttctcttggttgttttagtttaatttgtaagggtgtgatttttaaccctcccctgttgccttttctaacccaaacaaggtgattaattttctttcctcctcctcttttgggaggcccattattacttttatttgtccttcctttattcctaatcctaaacccaatcccacaatcatgttttgacccaggatgttagtttctgctttaggaacatataagagtgaccagtttgttttggtcccaatctaattaacattttcttgaatatcagaacctgaaatccctccccttttacccgacactatcaatttttccttagagagttctgtaccccttggttggtgacttagggaggagggatccacaccagtatcaaccaaaaatgtcacttcttctccctcgggtcccaccttcagatttattcaggattcctggtgggtgggacctactcagaaggaactccccccacagtcttcatcaacggtcatgaggtggatcaccatttcttttttccatttagggcattcttttttaaaatgccctggctttacatacttgtaacatcccctcatagtcttaggagcttttccatgtatttcacctctttctttgtgtcgaaatctgtcattcgccttgtctccttcaaggaggatcttgatctaacctttttttgattacctcttccacagtggaaccatgagtttcatttttatttatgcttttcttcctctctccctacaaagaccttctgagcctcccttagtaatttcttaattggtttctcattccatccattaatcctttgtaatttttttttaatgtcaggccagctctttcttacaaagttaaccttcaaaaggccttgccctactgggtcctctggatctaatctggagtattttcttaactagtctctgaccctgtgcaggaatgcggaggaagtttcctcttttggtttttgttgaatctccaatgcctttgagaccttttgtgtcccagtagtggactttttgatcctttttattattagttccctgaggttctgcatttgtgtctgttctctgggattttttttttttttttttttttaggggaagtctcactctgttgcgcaagctggagtgcagtggtgcaatcttggctcactgcaacctccacctcccaggtttaagtgattctcctgccgcagcctcctgagtagctgagattacaggtgcgtaccaccatgcccagctaatttttgtattttttagtagagatgaggttttgccatgttggctaggctggtcttgaggccctgacctcaggtgatctacccatctcggcctcccagcatgctgggattataggcatgagccctgcacctggccccttgggatcattattatctcgtttgggattgacatttggaaatttttgttcagctggcaagacgtcttgcccagcaggttgttacctctcccagatggttatggcccctctcctaatcattcccctttcttttcctgtgaaaaggatacttgtgatagatatcatttcagcccaggtataaaaactggattctaggaattggttcagctggtttgctaaacccaggggatgttttagaagtggtttcatttccttcttgaaattcctaacttcagtacttgtaagaggagcatttacaaagccagtctctccctgtctatgggagcttccctaagagggaatatgctagatgtctgctgtgtggaagggatagggaagttctcaatatccctcttacactgttctaattattttctcaaatttggataaggatttaaaggagcaattggttcgactctgccatggtctgcaggtctttcttcctctaaccctcctgctgccccttgattttcctgtcccctattttgtgagacacatggagggggtatggatgatagggggtcccagggcttttcactgggcaggaactttttactaggcttcttttcttctttgaaggggaacatgggggctaattccttgatccagcagagagtgtagcccatctcctcttgtgaggatggggttttatcattcacatagagaattaaagcttggtacacccaatttttatctgagccaaacttaggccacaagaccaaaggcttacgaatggggtctttaggctagataaacagcaacgctttatcatcttttgcctttccttgtccctgattcaagggttgtcactccaaacctcattcttcccaaaggactatctgggggaatgtcagagggagtctctttggctccctctttcctttggcccataggcctagaatttctgtctcccatttttggtcagtctttgtgtccaagcttttccctgtgtactcaacccccaactactggaggtttcttgcacaccccaattgctttgcctgtctctggacatttccctcatgggagaacagaactatggattgggattcgaactccgcacttgcttcatatctatgttatatctcagttacacacacttgacctctgaaaatgcccaaccaccaaggcagtacctatagtccaattttcctcccttggcttgtgcatgacgttgcctggttgccatggtgcctgcttttctccctgtgttgcctccactgcctcctgaataagtcttgggtttgtttatggcctctgcagggatccaggacgcctggatagagtgggccacttaaattttgtgggacgtgtttctgctctcgactggagtccttctctgcacaggcacagagatcccagacgggcccccaagtttgtgagaaacacatttacccatccgaacccaaagaatggacttggagacatgaagaacagtggaagcaagacttttaatggcggtcttgcaagattgggtgtctggtaggcaggcacacccgaggcagctacagcaggtcatttatctcctagcatgcaagttcttcccccatttcctcattagttgagtactatggggttacaattctcacagacggtgcctaagtttcattatcccccttataaggttataccctggtccctttctctgcttaagtttcgattttccaacagtgaaactttcctcccttttaggggctgacccattctctacattctgttcactttttgtgactttctaggtgcatgagctgtgcgatttgtcacatctgcaggctggctgccagtatttagatttactatgcctcaaaaatggaccctttaaaatgttttctcagaatagtaaatagagtgaagtctgaaacagtacccagtacgttagaaatgttgaataactttaattttctttgagcctgacttttagaaaaagctgttgatatcaaggatttaatctagaaaacagtctcccagtaggtaatgcatgttcagcccaacaaatctaaacttttttctttccaatttttatcttagattcaaggggtgcatgtactggtttgttacctgggtaaattgtgcatcatgggagtttggtatacagagagtttgttacccaggtaatcagcatagtatccgataggcagttctttagtcctcaccctccttccaccctccaccctcaagaaggccacagtgtctgttgttcgtttctttgtgcccatgtgtactcaatgtttagctcctagttattaatataagtgagaacatgcatggccaggtgcggtggctcgcacctgtagtcctaccactttgggaggccaatgtgggcagataacttgaggccaggagtttgaaaccagcctgaccaacattgcaaaatctcgtctctactaaaatacgaaaactagctgggcatggtggcacatgcttgtaatcctggctactcgggaggctgaggcaggagaatcgcttgaacccaggagacatggaggatggagtgacccgagatcttgccactgcacttcagcctcagtgacaaagtgagactctgtctcaaaaaaaaaaaaagtgagaacatacagtatttggtttttctgttcctgtgttaatttgcttaaacctaaactcttcagcctgtttgcagagttcttcacaaactacccgtgccgtcctcacagcccaagtattgccatttctctcaggggtactggctctatttccaggatggtcaaactggcagtttcctacaagcaccatactccctgagtccccatgatttttatcagtgttctaatttctggaatgcttgttgtcttactctgttcaggttgctatcacaaaataccacagacttgatggtgtatcaatactggacatttatttctcacagttctggagctggaagttcaaaatcaagccagtagtgaattcgggtatctgaaggctgcttcatggtttgtagacggccccttctagctatgtcttcacatggtggaaggggcgaacaagctccgttggtcctattttatggagacactaatcccattcatgaggactcagccgtcatgacaaatacacctcccaaacactccacctcctaataccatcattttgggggttaggatttcaatatatgaattttcagaggacacatattcacaccataacacctgccttgccctgttctttcatcttaaagattcaaaccaagtaacaacttttctggcaagtctttcttaataccattctctcccagaggcagatatttctcccgtgttttcatatgcatcctggacatacctctaatcatggcagttcttatcttgactgtcatagttccaggatctcacctactgagctcactgagggcagggactatcttgtactaatctctgtattactagcttgacatgtaatgggtgctaagtaggaaaaggtaataataatatttggagacatttgtttgaacaccattcaaaaatgaaagtgaattttcagctttttgtttaactagaagattgtattgtcaaactaaactctaaaaaggtagaataaacattttctgagcattttggctaattcaagttttatagtaaaatgtttataaactggacagattatatatagattatatcagaaaaatgaaaaaatgtttaaaatgagtagatacttgaagggaaagcaagaagagaccaacttcattaatgcagcattctcttattaattacataatatatgccaggctctagaaataggaaaaatactttttcagagttttcacatagtttcattgatgtttcccgtttcatggtagaaggagttctgaataaggtccatgtggctgaataaacatctttctgactacccaaactttaatcctctgggatgccacctagggcttgagaagattaatttacttctagcttccatatgattcagaaagattgttttcattaatgtgcctgccagtgtgctcagtttgcatcatgagggcagtttacctacttgacatagctgcttatttcatgcagtgtttgagttattgggaacctccacaaatgtttgataaatgggtaaatgaatgaacaagcagtatgctaattccactttgacagaatttatgtctaattgattaaatctaaatgggtcactgactttatcctctctttgtagatttgatatcattggatatttatgaaattggacagttttgttgccaattttgtacgacaagaaaatctttgaaggaatgcattgtctgtaaattaatttaactatgtttctctttctctagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagtacgtaacagtacaatatatacaggatattaaagtagagagccaggccagcacggtggctcatgcctataatcccagcaatttggaggctgaggtgggagggttgcttgatcccaggagttcaagactagcctgggcagcatagtgagatctcatctccacaaataaaataaaatggaaagtgagcatacccatttaatatcacacctctagcaaacccattagcaaacagagaattacagctacatcatatttttaaaataagtgcagaaacaccatgtgaattatttccttttaaagtatgcttttaaaaagcaaattatacaaaaagcaaactgtagtaattgccatgccagtaacattattcctttagtaaaatagtttttgaggatataattctttaacagtgttttttgaggttagagatatgtcactgacagaataacgtaaccccacaactcaaatcaagaccataaaaataatggattttcaagaatttatttttaggaaactagtttatggatgcctaaaataactattaaagtctatgtctttggataaaatgattcatctttgaattattttattatcttaatgtttgtaggccaccgtcaaacgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaagtaagtagatagccctagaaattataaattaaattagcaaagtgtcctgagctgcaatgaccaatagttttaaagatttaacacactgtctttgtataatttactggtctgccctcttttcttaatccagagttctgtgtgtgtggtgtgcacttttgacattaatttaaagtaactttgcctttctgagaatattttgacagcatttgagatgattggaaatattgtgctaccttggaagagcagtacttacccagggaagcgttgaagactggaaaatttaattagtcaacttaattgatttgggaaggagtgaggtcttgcttggtagagagacacagctttggaaagactaactttggttcctctgctgggtgcttgccatacaaattacttacttaaggttctaaaagttaagacatccattcacatgtcttttggagattttctgaaacagaaattttatatggaaaaattaatattttacatatataatatattaggttctctagatggatcaactaataggatatatgtatatatgaaagggagttgattaaggagaattgactcacaggatcacaaggtaaaattctacaataggctgtctgtagttgaggagcaagggagccagttgtgaatcagtctgagtcccaaaacctcaaaagtagtgaagccaacagtacagccttcagtctgtggccaaaggcccaagagcccctggcaaaccactggtgtaagtctaagagtccaaaagctgaagaacttggattctgatgttcaagggcaggaagcgtccagcatgggagaaggatgaaggccagaagactcaggaagtctgcttttccatcttctcctgcctgctctattcttgctgctctggcagctgattagatggtgcccacccagattgagggtgagtctgcctctcccagtccattgactcaaaatgttagtctcctttggcaacaccctcacagacacacccaggaacaatactttgcatccttcaatccaatcaagttgacactcaattataactatcacatataataatatatatccaaatttaaaaacctaaatgcaaaataaaatacaaggctaagaaaaaaatgtatttttaaaattattttcaactggaaaccagatataactttgagtgttaaatactgtatcacttgtgagtgaaatggaatttaaatattttattacagaatgcatgtatttagtaatcgagtttatatttattaaagttcttctttttttcctttaacttagcttcaggcacctgttgtcctcaaaatggttaagatcctgacaactaaacaaagcagctattttcctactctgaaggacatttttctggctgtggaaaatggtaagactcttgttcctcagcctggcatcaatatcaccatctgctcatgatccagcccctgcctgctcggccttgatatttacccttccgccatgtttgtggagtgattgctcatggctcttctaatgataaattcatctcaccctttgtactatattctccacccatactaaactacttttagtttatctggtatatagtagtacctgccaaaatggctccagattgaaattttaattagaatgtttgtggaggagtgaggccttcattcggagttaaaaaaaaaaaataagtctggatagaggttttccaatcaacagattgggctatggtgagtctagttattcatcagttcagttctctgagtgtgcttggtaaccagttatttagcttgcaaacactcaaagccatcattgaagttttggtgaagattaaatgtacagagtggagggtttgttgaactttgaatagacaatgcatgcatcttgttacaaaccaggaatcataaaatgatatccagtcgaaagtcttctcaccatccttgtccttccactctctagtttcagccccacccaaagatgacaaccctgctcagttccttgatttctgttcatgtttctttgcacatgtataagcatttagttatggatatacatgatactgtggttttaaataataaaatagataatatggacaagtaactttttttgtttctaatattaaaaagtttattttttcccacgtgacatttggaaagttaggaaatactgaaaattcacttcaaaaatgttttaatacatctttagggttttctgcatgaattctgtttaaaaagagggcataagataaggaggaatatatacagcaggggctctgtaagatctgaattcctgtcccaaccctgcttactgagcattttaaatttgctaagcctctggtttttcattggccaaattggcctattaacaccttccttgaagagttgctatgtggatttagtatttcttaatcttgtcatgatcaacattttgggttagataatttttttgttgtggggggccatcttacatattgtaggatatttagcagtatctctggcctttacctgctggctccatccctgttgtgatgatcataaatgtctccagacatggccaaatgtcccctgggggcaagatttctcctggttgagaatcactgggttaaggatagcatattatacactatgcaaggtactagacatgtagtaagtatgcttcaataaatagaagctgttggcatttttttttctgtgttagcataagatgaaaattttctctggctacagattctgcaggaatgaatcccagggttcctctgagccttatgcatgtgtggcctggagattcaggaagaaaacacttctcaatagaacaagtggctcaaactcatggtcaagttgaaggaagaaagctcttctcaaagacacacttcaggcattgtggagtcaccacacatgctgatcacattttaaggacacttaatatttaagggcacttacctactagatacgattatataattttgacataaacattgataaaaatagtaattttgaaacatgagtacatctgggaaagaaaataattcctgaacattctttttattctcagggctttattgttacatagacagatgaactggttacacagacagattaattggttacacatcaagtgtctgggttcatccttgactcctggtgacaaaattcagcagggttttttttgttcttgacacaagtcttttgggttaacaacaaaaactagaatttacttgactttgttccctactttcataataaaatttgttctcagttcctcaagggtatttgtagccttgggagcaaaatggaatctcatggagatccatttagggtatattaaaaggatcagtgctaagcaagagaaaactttggattcaattaagcagtcattaatgagagttaaatatttaaattttttttcatatctatagcatttttttgtttgatttttttcttcctttttcttttttggagacagggtcttgctctgttgcccaggctggagtgcagtggtatgatcatggctcactgcagcctcgacctcccaggctcaagtgatccttccacctcagcctcctgaggagctgggaccacaggcaactgctaccatgcccagctaatttttaagttttttgtagagatggggtcttgctatctttcccaggctggtttcgaattcctagactcaactaatccttccgaagtgctgggattacaaacatgaaccactgcacctggcccgctgtagcatttaaaaaaaatatttaccatgcttaacatttgttctattgaaataaacttcacataacataaaattaacaattttaaagtatgtaattcattccagttttagtacattcatgatgttgtacaacctcacctctgtcgagtttcaaaatcctttcatcactgtacttaacaattttaagttaaacctttattaatgatataatttttctcaatcattgcatgagttactgtcataggaaactggaatgagagagtaaacaattcaattgtgctcataccaagttcctagaaggaattaacattctagtgatgaagtttgtaatccaagccataaagtgacaacattgcagagaggttttattccgacagtttccacagggttgagtaaatttctttagactccaggggtattttccccttgggttttccatcacaatttatttatgctatgtgggtaactagatcagtgctctcccagatgactcagttacagatggacagcgtataagtcttccaaattgctcgtgtgtagattgtaggataagtaatataaaaggaactatgacaacatttaagtgtggccatgttgttttacgtggctctcttctacatgtaaagtgaatttagaaaaaaaaaaaaaacaaaccagaatcacgttaatggtggttctttgctttcagctcttctcgaagcccaagatgtggaactttacctgagacctctgaggagacacatccagtgtctccaggagacggaattcccacagacacgcatattaatcgctccattatttcataccatctgtctgatctggagtcattccaagttttataacaccccagctcgggttatagttttattgcaagagttttgtaatctcttcattaaccaggtatgaagcatcaaaaaacaggaacaataagaattgttgctgtgaggtaggttttacgagactagtgaagaataatctagtatacagtaagaacaccatctttctttttcttttttcagaaaggacatttttggtaacaaaggccaggtaaccttttaatcctaaatggcaggaagctatgaaaataagtcagacataatcaaaggacaagttgttgcttggttttgtttaacatctgtacctttcttcaaaaggctttaaggcagcttccagcaaaagacagacatgtgtagtaccttctttgtagccttcccttcggttttcacagaaacactggctgataaaagccttttggaaagtgtggtaagttaagagcatctggcaaaaagaaaatcctaaaaaagtagtagaattgtattgaaaaaattctgattcattgctgatcttttaaaatctcttttgtaattgtgtctctattccttactcaacctgcaaaatgttaaaaaaaaaaaaatttaaaaaaaggaccaccttcctctgtgtcctcatcctgtctgtgtgaatgtggattcttccatgttcacagtaccagagggtattacataatttgagaggtaaaagatacttggatgctacataatccagtggttcttatttggaaccacttagtcttaatcttctcaggctgccatagcaaagtactatggattgggtaggttaaacatcagaaatttattttctcacagttctagaggctgaaagtctcagatgagggtgccagcgtgctcagattctggtgggggccctcttcctggcttgctgatggctggctgccttctcactgtgtcctcacttggccatcttcctcttgtaagaccacaggtcctgtcggattaaggccccatctttacaacctcatttaatcacagttacctcctaaagaccctatatccagatacagtcacattgggagttaggctttcaatatttatcaatttgaatggacacaattcagatatttttcaaatgaattaaccaagacttgaaaaatgatgttatttgctcaatttccctgagcagttaggaggaaagccagaccaaagaacaggtctgcagacttgcagcttagaatttttggagtatgaggttgcattgttaatatttttcatctctcttccctctctgattctgaaaagatagagtggtgtgtgggaaaggctttggacctagaccaacctggattgaaatctaattttctcacttaagggaagttcaattactcctcagttcccacatctatcagtggggataatgcctagtccatggctattgcgaggattcaaagataacctaagtgaaatgcccagcgtagtgctcggtgtttaatcgaggctcagtaaatgttagttgccttctgttcttttgcccaaactattgacttacaggctagttgcagctggtggtagcagataacaacaggtcgattccttgctatattttaccatcatctcctctggttttgttcaatatctgttactctgttgggcaaactcagttttgcccttttgttaaacaggttccctgggtcctaatggcgcgggtctctatgtaaaacaccacaatccctgttgcagggccaaaaactacgaccaccacttcccccaaacccctttttagggacctatttctcattttgagaataattgaaactgtttcactgcaaatccttgttaacgtatgaatcacagaggagaccatttgttggcataggtgacttattttaagtcctagttacccgtaagcctgtaaacttctcatccctggcttctagtctttcaacagccagagtctgccaagctcctgataaaataatgtggcttctcttgttccttagttctggcttctatccaaaggtttcattgacccgattcctttgattctatgaacggcagatttcagactttgtggtaaatatgcccaacatgttaggagtcaaaagttaacaattagccaatgtccatagctggttccctgaagcactaaccaccctgccaccaattttactacttttatatagttatttaacaaatattatatagtacttattttgttcaggagcttttccaagccctttacaaaaattcaaaagttacaccctcatagcaacactatgacgtaggtattattagtagcttcattttataatgaaaaaaaaaaaaacactgaagcctaagaagataagtaactctccaacccagcaagtcagtaatagagttctcacccgttataccatgctccatattttaaaataagtttttttaatgtctgaatgtgacctaatacatggtatgctaacgataattgtaaaatattctcattgcataatgttggaacattggaaatggttctggagttttatcactctattattaaagcatttttatttttctgtcctcctaaacttatatatatttatacattttatcatgcatacaattttgtactaacttcttgaaagattattttgttattgctgtatatgtaagttgcttccagcctccttgattgtaaacagtatgcagaaaaaaactatacaaagatcccctcttttgactggaatgattggcttactataaattcctgatgttggtcaaagggtacaatcttttcatggctcttgagcaatatttaatactttcaaattattttctaaaaggttatatcaattacattgttattatcaatgtgtaaaagctttcactatgacctgtcaacttggagcattgccatctttaaaaaaatttggggtcatttattgggtatctagtggtaacatgtttttaaatttgtaccttgcatgatatatgtgtgattacacattttatgttttctataattgtatttcctcttgtcacctacatgttctttgcgttcatgaatttattgataaagtttttgtgaaaattcaagcccttcctatgttacatattagaggtcataagctgacatgctgtcagctcattcggcccaaggatcaatgcagtgtttttattttgtataatatttttaacttaaaattgttaatacttaaattggatagatctcatttaaatgccagcatttcagcctccactgaaaactcagagatcttgctacagtgcttgcaccatccccacaggcgcagccagtgactgtaacttcaaatgccccttaaggtggaacaggtgctgtgtagatgaccatgaccttcactgttcactgtcctttctgatctactttactcagtttcattacatgcttgaccctatgacgggaatgccagtcagagtcggaaactctttgttactttaaaagcaaatgtatttcttttctcttgttttctagcagtgaacattaacatcattatctaggccagacacataaaaggcatcacctgttcaccttgcgtgctagcacaggctttggtagtggggtcttaatgccttgcctttcttctctggtaacctgacactactccatggtccttgtgtgtcattaccactctagacactacgttgtctattccatggcttggtgtatctattgtagatattgtcacctacaagatcctaggtgaggaagagttaaagtctgagtagtcgagtgtggagtggagctgtcaggactgagctaaaataacagtccataaaaacacatgcaaaagaatagagaagcagcagcagggagacgagcctcaaactaacaatatcattggtaaattggttaattgatcattagcttattgataaataagttggtaagcagtgttttagtttataagacctctgaagtgggactagttcatcctaaatctagtggcttttagcttgtttgtgctggtaccattgagtgtgcgatgatagagctggtgtggttaggcgtgctccagactgggtactgtgagaggtagaaaagaatttagagtttatgagctaaaagggattttgaagttcacctaattcatttccctcattttgcagctaaggaaatagatcctctgagacaacttagctagtatcacaaaagtagtttgtggcccctagtagggtcacagccagcccctgcgtcgggtcatgctttttccttcacacgttctgcctccccgtgcaaggagacagactgagtgttttcatttaggacattaagtgccatcttaggaggccttactcaacagtgggctgtatgaacaggaggttctttgtctatgattgtctcatctatgcgaggggccagccaggaagcacaggaataaacattaagcatgacttgtcctagggatgttactttacatacaagtaattaggtaacagggggctgctgaagcagaaagggccactcgagcaaaagatggagtcgtttgccatagatttttcagcatcctaaaaagacacatttactataaagaatacatagagataaaggtatatggaatacaccatatgccacatcaaagtgtcaactcttttaaaattcacattgctgagggattcctggtggttctcttcactgccctgaatgacttgctgttatagcaccctcatgtggaggttaattttctatctaacctgacagggaaataaaagcatagattgggaaggagtctaatcagtaggggttttagacactaaatgaatgatttccttattgccttacaaattcatggcacagagcctatattgcatgtaaaactgttttcattaatgggaaatgaaaggtcatatgcctacatttagggaagaagtgcttccctctgctattttgaactcagggctttcattacattatccattgacatcttgaacaacattctaagcgaccacaaaattgaaggcacacaaattaaacctataatttatatgaggttaagatgcgtcaggaagaggtagcatacaaaagaaccttcagaatgcagaggttcttggtccttgaagaggggaattctgaatgtttataccaaatatgaagagagaagaagttgggagtgtcggttgatcccatgagaatttgaccagtgccacgtggatcttccagtcttttcttttatccttctcctctcttcctttcttttcctctattcaaaactagttcatgtggcacacgtcagccagtttgtatgtcctataatgttacttgagcccccagaagagaagtttgctaacttgaaagaatttccactgttacacactcctaatcagctctttctctttacaagtggtcctgaactaccaggtaaagtgagcatactttaaaaattcatgttctgatagatttccttgtctgcctcgtatattctttagatgagaaaacgattgttcagaatatttgctggcaggcacagtcatgcaaattacatgacagttgtcatataatgaggcttagcaacaatttagtcatttgctagaatgtaaaaatccagaaatagtagggtctcctgtatgtaattctaacttatacaagtatgtcattgaagtccaagtagctgaatttctagaacttgtgctttctttctttcagcattgctggcccaactttagatactggcatttaaaaatgattctttgaaacagagacggttacagggaaaaactgttaaacatagttttgatcattgttccctttcattaaatcctaggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggtattcattttttgattttatttattcatgttgaaggtgggtgcaaaaagccagtagcttttcacatgattcatggaacagtttactttatatcataggtggaggtctcctttctcagtgattctcataaggagctcagcaggccaatgctatgatgatacaagggcattttttaaatctttaatttggattttttaaaagttcatttttgattccattattacattgagtataagtaaatctctttatgtatcagtgactcttagaattgactaatctgagagagagttgtaagtcaggaagcagtaagctcatcctctgtaaataaatccacttttccttttgtatatttaatgcttaaaattggtatttcataccctaaaacccattgcataatttaaattatcacacttttttagtatatgaatatatgctgtactacaaaaatattaaaaccatttgtaaaaataaaacatggaaaagtatgtgctctgtgtaaaagttttcaaataccttaaaaccaaaaattaaacacatacaacctacacattcttacatttatatggtgtctattggcttagtttaaaaaaaaaaaaaaaaagtttaaattgatgacactgccttattttctttgtaaagctctaagaattttgggcattgtcattgataaaggtttgttttattccattcaaaattagagctttatgtcttgagaattctcgtaatcacttaaatgagcctgaatgcctcttctgtctctgaatgtgaaatacctaatgaagggcagcttacatatgccttccttaacagtttcctgggctcgctttcaataaagcagactcactgccgggtatggggtgatgaaaacaggagttttggatattacctggggatctgacttacgtttaggaagatataaaattgggggagttatgtgtctagttatggtaaattagaggttgcttctactgcgagatagtttttgttttcttttttttagagacagggtctcattctgtcaccccggctgaagtgcagtggtgtgaacacagctcactgcagccttgacctcctggatcaagtgatcctcccgcctcagcttctcaagtagctgggactacaggtgcacgccaccatgcctagttaactttttaatgtttcatagagacaggatctttccttgttgcccaggttggtttcaaactcctgggcataagcgatcctcctgcctcggcctcccaaagtgctggtattacaagcgtgagccctgtgcctggccagtgagagttaatttttaataaacatgaaaatgggagagtaattttaaaaattagcaatgactttgtttaattaaatacttatttctgtcatgaaaatatttattttctgtcattttctgtcattgactcattgattttgaacatttgaaaatgttcttgatttgaaactttaaaatattttgctgctcaatgtagtggaaaggtctttactgtgttttttacaaaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggtaatgttgtacctttgcattttcattgcatgggatcctataattttatagctgaaaaggaagataggtcacagtgataatagggaccatccattccaatatctctaggaccaaaagaggttacatgacttgcctgaagtcttgtagctacttagttagtagatcagggatcagaacttaagcttttgcattttcagttcagaatgacggctgataaaactgcagacctcagtctggatttgtatcttgtttgtgtatgctaaacagaaactttccacatgaattcattttgatctgatgtccatgtaactcgtgctttattttagcattttcttgaatcactggatgttttgttttttgattcacctgaacacttgctttcaccccagtcattaagtgtatcatttacatgttggttgtttcttataatttttgttattcttgagagctgattataatttcatatttccaaccacaggaaagggggaacctttctgatttaagctgcttctgtgctctgtcagttccagcatgttagtagccagggagctacctgtgagcatccctgcagttctaggataaaaatagcttcattttagtagtttgccaagaacagcgaagcccaagtccaaaagaatgaagatttagctcttgttcttattattgtatatgtaatgtgagtttattcactattgtttatatttggccaaacaattgattctttgaagtgtacgagtgcagtatgttagctttataaggatgtagttagcaaacttaagccctctgaattatagtcagttttggaaagtggagttaatggtagaaggacactgctgtaataggtgactttttgctaaaccagggcactacactttgtgaaaaagtatgaggaacctaggatcatggtgatgaataatttgagtgagctcatccccaaagccttgtaagatgcctggcacttggaaggcattcaataaatacgtacagaatgggattcttaagagagcctctaggttagcgccgctgaacgagctagtggaggaggagtgtgagactgagcctgcacaagatccttggggacatttggattgcaagagagtcttgattttgttataattacaaaaactggcaagttttcagagtgccagaattagagaatgtggccaggtttaattgacgtcactaccttggccatgccaaaggtcctgattttactcctgtctctgcctaaagcctgcatagtcacaaacatgtaggaatagaaaattcatttactcttgaggtatatatctgcttggtatttgtattttggaagcctattctattttgcagataaggtgggcagggtttacctctgatcttcggtctggttggagacatcataaccttcccctgaagttcccttcatcctcctgtctgattcttgccttagaatctagaagctccttgactttggtcattccctaaaattaaaacatgaattaactaaaagttaacttaatcagcatacttatgttgaaaatgaccattacttttttaaaaaaatgtgttttgcctatcattattactttaaaatattgcatttatcatatatttttgcttaataagctgttcattttggtgctttttagctgagttccttgtactttgacttcatgatgaaatcagttggtagtttttgagacattattttaacaaatgacttccaacctagtgtatgcatatatttgcatgtacatatgaatacatgcccaacctctgcccttcccctcccattgcattcacccccatgttcctgctcctgccccatcccctctgactacaaactagtgcttatataacagggaagtgtgtcagggtcagccattctgccctttggtatatacatggtttaaatatgttccagtaaattaaagaaatgatcactggtaatttgctttttgaaatgctgttgtttatttctcttctcatcaatctcatgcctactaatcaggctttgagcctttattggcgtaccgaaaggtttgctgccgtggtccatttacagaatgtggggattttatcaggtgtgcccataaaaatggttttgggtttctcaattattgaatgttactttaggtgttttctttgacatcttcttaggggactgtttgaaatctagacagttatgggaagagacttgctttcttcattattaatgttgaacagttagtccagcaatattagactcagtaattttgctgtctttctgtggtgtttcttgatgaaatccctcagatacctaagcaaagatggtagctattcttgttgagggtaaccccttggctccacttagtctctgttaatgagagccagttaatatttatggacgaagtactggatgccaggcgttgtgccagagatttcccacattatatacctgcttaattttcactataacccagagagtggtcccgcaggcaaatgacagtttcactaaattacctgagattatagtttccagttggtggaatggaagtttgaatccagaactctcaaccacaagccctgcatacttttgttttccctccctccctccctcccttccttcctttttttttttttttttaagacagagtctcactctgtcgcccaggctggagtgcaatggtgcgatcttagctcactgcaacctctgcctcctggcttcaagtgattcttctgcctcagcctcctgagtagctgggattacaggggcacaccaccacgcccaggtaatttttttgtacttttagtagagatggggtttcgccatgttggccgggttggtctcaaactcccgacctcagatgatccaccctccttggcctcccaaagtgctgaggagattacaggcgtgagccactgcactgggctttttttttttttttttttttttttttgagacagtttcactctgtcacccaagttggagtgcagtggcatgatctcagctcactgcaacctctgcctcccaggttcaagtgattctcctgcctcagccttctgagtagctgggattacaggagtgtgccaccatgcccaactaacttttgtatttttaatagagatggggttttccaccatgttggccaggctggtcttaaactcctggcctcaagtgatccacctgcctcggcctccaaaagtgctgggattacaggcatgagccaccatgcccagcccctgcattcttttcactgcaccaccctgttagtatttatcttgcttgttgcatcctcattgaaatgaaaggaataagttcatctgtgggaactcacctgaggacctatggcctgagatggagtgatccaggttgctgtgtctgcttttctgctgattttcagtgggaagctttattcaggtgccttgttcaccatgatatcagaatctaaaatacattttaaaagtagttatttagttcatctgtactaggttgtattctaattcctagaacgagtctattgttctgctgtcactcactgaactattcttttgctatttatgtagtgttttctcattttaattaaacagatttcatctttattagtcatacacagcattttcatgttttgcctgcctattattcaagattaaatgagttatttagcaaccttccttagtaattcttttggaaaggtaacatctgtaaaaacttagtccctttcttctcaccctatggccttttccctagtcttccatttttcctccccaaaggcatctctattaaaaatttcttatatgatgttccagagatatttggtgcatgcactggcatatacatatatttattcctttgttttctgcttttgcattaatagcatttataccttgcttttatcccttactatattttggcagtcattctgtgtcactacaatagcattgctcatcttaaaacaactgcgcattccatcagatttatatactaaagtttatcttatttattttaaaatgtcatttagtagatatcattgtttaaaattttaatgagaaacttctgcttctggaaagagggagatgtacttttccctactgctcccagtaagtgcaactaaaacactggccgttatacagtagcatggctcacctgtcaccgagactcctctagatcttgttgctgctgagtatcctacctgccagcgatggagattgactctgaggctccaccatggtattatcccttgaggagaccaaacagctgcttggcaggaagttaattacccaagaaggacagcgattcatcttgtacaggattgatacatattccaaggttgtgtcttccttgcctgcctgaaaggcctcagcaagcacggcggccacaaacaacccttgaaaatgtctattgcaggaagcccagaaaggaagcaccaagttggtttaagggactgttcttggggttgtaggggagaggagataaaaggaagccaagatctgagatcccagaagatcttaatactgactcaagactctcttgaaagatgtaaactctgatagagggtatggataatatgtttgatcctttctagggcttaagccaagaccctatcaagcaagtaagtgggagattgtgcttataaacagctcttttgaagtaagacagatgttctccttgcttctcagaatattttaggccaaagcattttgtgggcataaattagcctaatatcagtgtcaatgctgtatttcagcttactcgtgaagacctggtctttgtgctgtaagcaattaagaaagacagaattcttaagtgtatttcaaggaaatgtaaaaacaaagtgttcaatgcacacttatgtatatatattatgatgtttataacaaaagtgtgaaaacacacatgggaaagattgaaacttactttggggtagtggttttctgggcaggcagaaagagaaatgtgtctatgtgtgttactacttatttctgaaataaaataacagtatctgagaaaaacaaaacaaaaaaaacactggccattatatataaaacagacctaagaagactctgaaaggtgaaaagaaaaaggcagagtggctaaggatattgggactcaagaaacaacaacgtgatgatgagttccctggattttcctgttgcctgaagtaatccagacttggagctgaaaacactggcaaccaggaaatgccagtgggcacagaccagaaagaagcccagtaaaagcctgatctctccctagccaaaggctcaagaaggagagagcttaacacaaaagaagatttgtaagccatcaactgtccactctagccaaacaccatggaagaaactgtgtcccacccctccccttgccaggaagagctgagtggggagcctagacttacaccctttctgtctgaaaatgctccaactcccacccttgctggggtgatgtcagagatgaccacatagggagccatgattttcatccctgctggccaggaatgaacttcattctctgtggtgtccggagaccatgtgggaatcctggatttccttcttcacccagcctgatgttggagcaaacctgatggagagtccagactatcaccctgaggccaagtggtaacaaggccacctgcacttgtggcagcagtagagaccacatggggaactggaagtcccaacccagcggtaacaaggagccccgcccacccttggtggatgagtaaatgccgagtggagaacctggacttctgtctctattgtaatgaggctggagcagcatcagagaaagtcagcaaaaacaaaaggtttaaataagagtcagagtcttataacaatatgaaatttcagtagaatatcagttagtataccaagaaccaggaagatctcaactgagtgaaaaaaagacaatcagtagatgccaataccaagataatagagattttggaattacttgaaaaagattttaaagtagtgtattagtccattttcacattgctacaaagaactacctgagactggataatttatgaagaaaagaggtttaattgactcacagttccacagacttaacagaaagcataactgggaggcctcaggaaacttacaatcatgatggaagatgaaggggaagcaaggaccttcttcacatagtgttcagagagagagcaaagggagaagtgccacatacttttaaaccatcagatctcatgaaaactcactgtcatgagaacaacaaagagtaaattcaccctccatgatcccctgtaaaatcaaaaacaagttagttatccaagatacaatgaaggtacacgtattgggtaaatattccccttccaaatgggagaaattggccaaaacaaaggggctacaggccctgtgcaagtgtgaaacccaccaaggcagtcattacatcttaaagctccaaaataatctcctttgactctatgtctcacatctaggacacgctgatataagaggtgggcttccaaggccttaggcagctccacccctgtggctctgcagggtacagcccccacaactgctttcactggctgatgttgagtgcctgcagcttttccaggtgtatggatctaccagctgtcagtggatctcccattctggggtctggaggacagtgaccctcttctcacagctccactaggtagtaccccagtggggactctgtgtgggggctccaaccccacactgccctagcagaggttctccatgagagctgtgctcctgcaactgacttctgcctagacatccaggtgtttccatacattctctgaaatctaggtggaggttctcaaggctcaactcttggcttctgtgtacccacagaaacatgtgccaaacacaactgcctacccaacgtctccactgagatatttcatacacatctcaaaatcacattcagatctaaacccctgcctgtccctccccaaacctactcttgcctgtctctccaactcattaaatggtacatataatgggctacttagtgagaaacctttgagtcatctgtaatcttgctcattttctcacaacaaccatccagttctttcagctatgccttgaaagtatttccaggtgttttctgtgacttggcttattgcacttgcctccaaactgctccctcttccccatcttggctttcttagtttgttctccacacggcagcctgagtgccttttagacactaagtcaaaccatggcttttctctaattacaacccttcaatagcttctcatgatgctaataaaggcaattatgcagttttcagaatacagcaacatttttataatgatttctgaacaatactagcacatcatttattctgtaatatatatttattgagaaacagctatgtcctgggaactccattaaatattggtactgtaattgtgaaagaaaaataaacctggcagttacactcagagattaaaatccaagggagaatgtagacaggcagttatcatatgggtgcccggtgctggagtatgaagagtacagagtgctctgagaacatttacatagggcccctttccagaggaggtgaaatgtaaactgagacctgtaacataaatagaaatgaagcaggtgagaagtgggtgaaggagagagacagaatgtgataaggctttgtggctggatctgagagtgtgaaattgggagagatggcagaatagttaggagcagtaagtggcatccagaccacatagggtcttatgcagtagattatgctaagacctttggacgttatcctaagaaactgacaattccgaattaagattgtgagttaaaggattctaaataagaaagtgacatgataagatttctattttaaaaaagattatttagtcagccattggaggatgaatcagagataggactagaggcgaagagtagttagaaagtgattaacagatacccagatgagcaataatggtgacttggaccaagggcatcctggagatggaggatagtagagagactccagaggtagttagaagagcacttgacagagaagtcaaggaggttgcccaagtttctattagggtgtataaaaagaagagcagctttgtagagaagataacaagttcagatttgtacttgaacaaattaggtatgaattttttgtgggactttccaagggagaggtcccacgtgcagttctaaatttgttttcaggaatgagtgagtgagaagggagggaggtgacagatatcagggagggagactagcatatttttctctccctgagatgtttatttctaaatgttcagttaatgttttgtgaccttaagccgtatgttctctattactatactaagaagagggatgttaggcgtgttaaaacttgttgggaagttgtgtttactttattagccaatgagccttgaataaagagattgcttggctctaattcagaagtggaaacttc

SEQ ID NO: 108 - DNA, 70096 bp, Homo sapiens
cgtgttttaatctcttgaaagaattgcccctgtcatttccgattctaatgaccagtaaatatatttcagtctcaccctaacattaagaaaacttcagctactgtgtagggaaagctaactaggtaacttcttgaggaggttgcttttttttttttttttttttttttgagacggaatctcactttgccgcccaggctggagtgcagtggcatgatcttgcctcactgcaacttccacctcccgggttcaagcaattctcctgcctcagcctcctgagtagctgtgattacagctgcataccaccacgcccggctaatttttgtatttttagtagagatggggtttcaccatgttgaccagactggtcttgaactcctgacctcaggtgatccacctgcctcggcctcccaaagtgctgggattacagacatgagccaccgcgcctggccggaacttgcttcttgaaaacaaatgtggcacactagtatctctgaccacagaaagagaagaagccattgttattcttgttgatgatggcgacagtaatgacatggtaaaagtttcagtgtagtgttttagcccggtttgatatgagtaaatttaaaggcctctttttgggttatatctatgacaccttatttatatgttcatgtttttccaagataagacaaatgaatacttacatggtttttttttgtttttggtttttttgagacagagttttgctcttgtcgcccaggctggagtgcaatgacatgatcttggctcactgcaacctcagcctcccaggttgaagcgattctcctgcctcagcctcccaggtagctgggattacaggcgcccaccaccaagcccagctaacttttgtatttttagtagagacagggtttcatcatgttagccaggctggtctcgaactcctgacctcaggtgatctgttcaccttggcctcccaattccaccttggctggaattacaggtgtgagccactgcacctggccaaatacatatataaattaatacataaatacatacgtatatatacatatatatacacatatatatgatatatatatgatacctttattaccattactctttttacccaaactatcctatctatcaacatcattgtcaagtctttcagtttcctttcttgctattgctctgagatcttccttccttcctctaattttttggaaatccttggtaaatcgcattcttgttaggacagtagaatgaaccctaaagaggaaatacatatgatttggtgataaatattcagccccctcttagaaatatcattctctacgaagcatgttaacatccttagcttcttttctcgtaacttttgggtcaatacgtaaaccaacattatgaaggaattatgataattgactacctaagaatacagtgttgaagaatgcagttaattacttcattaaataattgagtaatttttatcctatatatacacacaagattgtgtaaatagtaggactcaaaaaatctttttgaaactattaagtatctgcaatatgccttatttaatccactatgacagacatatatgttttttaatcatctcttaatttataatttctggctatttatgacattttcaagctatttcccaaagtacatacaaagaggaatttgatttatttaaataggacttatctgccccctaaaataagtatctttattcatgaaagtgaacatttcatgaacaaatatgcttcagcccaattatccttcagcttttttgttcgtttgtttgttttgtttttttggtaaagatcacttcgagaatctcataaaactgtggacactctccccagggaaatacacgttcgaaaatatactgcacattgggccagacacagtgcctcatgcctacaatcccagcactttaggaggctgagaggaggatcacttgagcccaggagttcgaggctgcagtgagctatgatcacaccactgtgcttcagcctgggcaacagagcgagacactgtctcaaaaaataataataagtgttaaaaatatgttgcatataatgataaagattcacagattcccccaaagcctatgcatgaattccctagttaagaacacctgttctggtcttttcatgaacctgtcaattcttttgactgctatctggaaagccacttttattaattgaaggttacttttattagaagggcttttaggaacttcaaggaagaatatttcttttttttttttttttttttttttgagacagagtctcactctatcgcccaggctggagtgcagtggtacgatctcggctcactgcaagctccgcctcccaggttcacgccattctcctgcctcagcctcccgagtagctgggactacaggtgcctgccaccatgcacggctaattttttgagttttttagtagagacggggtttcaccgtgttagccaggatggtcttgatctcctgaccttgtgatctgcccgcctcggcatccgaagtgctgggattacaggcgtgagccaccgcacctggcccaaggaagaatattgcttatttagtggagaggatcctctgaaatattaagactgaacttgatgttaagtagcaaaagcaaagataaccaaagtgattcactaaataatcttctcatcaaacctatcttagccagagccaaccaacaaaataaaaaatgtgcagaaaatctaaaatgttagagtcttttatgaatgctgacctgtcattatgttagaaaacaaaatgcagtttttaatcagattatataattcaagggatttagcctgtgctccctggctctctgtgaatatgttcccattgcccttttatcagttagaatgttgggttggctacttttgaaaaaagttcttataaaataacagtggcttatacaaggtcaaaaagtagtcctgccacatgagagttttacagatagtccattcagaagtcatgtgttaccacaaattgtcatcaatctggctctttatagttcaccatttctagaatgggcttttcacggtcccaggtggctgcaggagttgcagcccccatatccacattcctgacaggaggatggaagaagaaacaaacaagatgacaaaaggaaaaggacggtgtttgctttgttgtgcaagtgcttcctacaagttaacaaacagaaattctcctttcatctcattggtcaaacttagtcacattgcattacctagctgcaagagaggctgggaaaagtgaatttatcttaagcaaccatatgcccagctaaaaattagcaagaagacattttaaggaaggcaatcagcagtctccatcacagatgtcctttcccacatctccttgtattatttggggtgttctgtgttgctgctgtggtccaatcttgttaaagcctgtgtatggatagattgatgaatgctatctctcttgttacccatatgggttaggtaaatgaggaccagttgttcctgttgcctgggtgtccctcacagtggagtaaaatacccaagaggtttagacaagtcaactgtactgctagggtatttttcaaatctaattaaaccttttttttcttttttttgctctgtcacccaggctgaagtgcagcagcacacttatagctcactgcagccttgaactcctgggctcaagtaatcctcctgcctcagcctcctgagtagctgggactacaggtgtatgccactatgcctggctaatttttaaatccatatttttaatctttcccctcaatttagaatttacctccaaactttggcatgtgtattcaaaatgaacagtttgtttaatactagtgctttattatcctgagcattccagaatatttatgtaaatttaatcaagtggctgggacataaagaaccatttcttgtaggataccatctacctacgcctttcagctaaagagcctcttgaggctaggcacggtggctcacgcctgtaatcccagcactttgggaggccgaggcgggcggatcacgaggtcaggagattgagatcatcctggctaaaaaggtgaaaccccatctctactaaaaatacaaaaaattagccaggcgtggtggtgggcgcctgtagtcccagctactcgggaggctgaggcaggagaatggcatgaacccgggaggcagaggttgcaatgagcagagatcgcgctactgcactccagcctgggcaacacagggagactccatctcaaaaaaaaaaaaaaaaaaaaaaaagagcctcttgaggaagatgtagtaaaggagtactcttttggctcccttcacacccagataactatatttttttagagtaagaagatagatttctgtttctgtaaaatttgcaggcagaaacaagtaattgatcattgtgcatataaaattggtaattgtgtacaaatagcactactatgggtatgcagatgcctgttctttgttcacaatggagtctgtattttttaaatatttccttatcacttggtttgcaaaaatacaactggcctgaactgtggaatggtaggtagactcataccttttcttcagaaagcctgattcatatttttttcctgcatcatttatgttatcagaacacaaagaaatggattgacttgtttcttttagcactgaggataaagccaagtcatttatataaagtacagattgaagtaatgtacttagttattatagtaccttgggttttatgtggactatctgtaattcagaaaggtattaagtgatttgttagatcataattccaaagtgaaattttgatacatatattggatctcctagaaatttctcacatttaaaagtaaattttttttatacccttcaaggttaattccagttatacggtttctcttttctgccttcacaagcttgccctttatttgtggaaaagttattttttaatgattgtatatttccaagccccataaatgacctaaaaatggcctagtgatttagagtgacctagtgatttaattggatctgcgctacatgcttcctggccaattctagaaccgtatttggtgggagccctggattctgctaaaagcactgtctaaagaaactgaaaagctctctgatcctgacccacagagaacaaatctggtcttggtttagtatcacaagtcctctggaagactaggtctgaactactcacactggttctacatatacttcatatatggcccaagttgtcagatccatttcaaatgtgaactggctatagtttgcccattttaaaggacaaggcagggaagggcagattttggcctcttcctcccctgttgctcaatgccagctgaaggaatagtcctcaacttcctttccttgcctcacagaactgccaaatctgaacatgggtgaaatatgacttttaagccatagattggacagctatttttcttttaattttatggctgttgggccataaccgtatccatgtagcatgccaggattccattttccatctgcgttcttaaaaaaaaatctcacaggtctaggctgggcacagtgacttgtgactgtaatcccagcactttgagaggccgaggtgggtggatcatgagatcaggagttcgagaccaccctggccaatctggtgaatccccatctctatttaaaaatatatacaaaaattagccgggcatggtggtgcatgcctgtagtcccagctactcgggaggctgaggcagaagaatcgcctgaaccctggaggcggaggttgcagtgagcagagatagcccctctggtgacagagcaagactccatctcaaaaaaacaaaaaacaaataaacaaaaaaaaaacctcacaggtctagacacatgtttcccaattttccatatatcacccagtcatcccaacaatgaattttacttttagttcattggaaggaaataatgtgtcgtggtgattttattagttaaggtacaggctaagctgctgtaagaaagagaatcaaaactatagggattcaaacaagataggagtttttttctcacacatattaggcagctttgttccatgagatcattcatacgcccaagctgatgggtgcccctgccatacctaactcaagttttccagacttgaccaatcatcatcatttctagccatagaaaaggaaagagttcgctgggccccgcggctcgtgcctataatcccagcaccttgggaggccgagcagggtggatcacctgaggacaggagttcaagaccagcctggccaatgtggcaaaaacccatctctattaaaaatacaaaaattagctgggtgtggtggcatgcacctgtaatcgcagctactcaggaggctgaggcaggagaattacttgaacccaggaggcagaggttgcaatgagctgagttggtgccactgcactgcagcctgggtgacagagcaagactccgtctcaaaaaaaaaaaaaaaaagaaagaaagaaaaaaagggaagagtgacaactaagacaagcaatttcattttcagcaaatgacctggaagttatacacaacactttagctgaaattctgttggcaaaaacttggttggatgacacaaatggcttcatgggaggctgggaaacagtcaagggtgtccatgtgcccagagaaccagggaagaatggatagttgtggttaactagcattctcccaaccgtaatagcattctactacagtgatgaaatgaagatgatggctttatgtcatccagattctgcgaagaaaattttgcagaggaaaatgatgtcaagcagtatgacatggttaaaatgaactgtctcattttctagtgaacttagaagcattcagaagcatgactgaagcaaaataaaagtattcctcttaagccaacagactggcaaatgccaaataatctcctgttaagcttctcattggataagtagccatgctgaagactgcctctgtagtatctcactctcaaagttctttacaagattattgaaaacgcagacccttgctcttggaaaccatacagatggataatcaagcatttcttctcttttttcccaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtaagtgctagtggtcaaataacctcttccaaggagtttacaaagctgtcagtctttgggcactatcaaaattgaccataatttctcttttgaagctattattgaaatagctgacactatgtatgtatcttctgccaagtgtgaaaataaaccagatcaaaggttttccagcagtggatgtttgcacttcatgagataggtcaaaccagttctacatcagcagcttagtgtaaaaaaaaacaaaaaatgtccttcattatgttaacaaaaacagtggtttacatgtgcgtatatgccagattcattaggcaggtaatgaagcatttgcacaaatgtaattacatacagcaattctgacagttcataacactgcattaataatcactacaattagttctgatgatggaagcaatttacagcgcgtcacatgtataaataatggtgcatttcctgcatatgtcattattatgtattaaggatgccaccttgttgtgactttctcagtaatgttccccttgatttgaagttaaaggtagatgaatgattttatttcgtagctaaaatgtgttttacagatgggaatgggaatgcctcatcaagaacatttgtgtaagttctcataaacccaatgattggatttcaaaaagcaagaaccattcattcctaaggattttctagcttaatcctcacaagggaaacttttttcattaagttaaatccgttaagactaggatacatgtgtcaaaaccagtcaagtgttgtactctaggccacattttctataaagcgtttttaaaatcacccgtctctgtttctaaatggaaactattgttttatgttccttcagtaatgattgttataacttttttggtcagctttctcaggcttcggtggtgatttgattgctattagaatagatacccttggtacctaacaggcatattttcccaaggaacaaattttaaataagttgtatccaaaataaatggttttaatatggtatttgatgttcagtgttccatatctctcatttttcaatttatagaattaagtaattctgaatactttgagcatattttgaccattctattaaatagtaatatttttgtgttgattcccagcacattttgtctaaactattgcacataaaattataacagttctaggtagaaaaaggaatggaccatttaagacttttattcatgtccttcataactgtcctgtgaggctgcaaccgggaatagaatcgtatttcagctgaatcctatacaccattgaggtggaaatgaaggggaggaagagggaagtggacacacgtgtttctctccagctcttacatcctgagtcttggaaacaccagttgaccaaccgagtcacactgtgtcctgcttttttttcatcctggggctccaggatcagcacagccttaagtttttaacacattctcatgtttctcagtcattttctgcacatcacaaggcgacttatcaggatttgggaattaaattcctatgagcacatgtttggttgtacaaaatggccttttcaagaaagtatatgtaaaaaacaaagaccaggattgagggaaagagaatcaattattgaaaagaacagatctgaggccaggcgtgatggctcatgcctataatcccagcactttgggaggccaagtcgggcggatcgcttgagtccagaagttcgacaccagcctgggtaacatggggaaacccagtctccataaaaaatacaaaagattagctgggcatggtgatgcacgcctgtagttccagctatttaggagactgaggtgagaggatcgcttgaaccctggaagtggaggttgcagtaagctgagatcataccactgcactccagcctgagcaacagagtaaaactctgtctcaaaaacaaaagaggaaagaacaaatccttagctaaataattattgaaaagaacagataattatttaaataattattgaaaagaacagatccctagttaaataaaaattaaaaagagatacatattgaatactgaaatgtgttgcaagcatcgattaaatgtaagcagaaaaagaactaaaagtcagaagcctttgttttccatccatttcagctatttggaaggtagtccatgcagtggttgagagagcatgttgcggtctaggcacccctctcttatttttcattcacctcaacccagcttaaaagacatatttgaggttcatttattcaaattcaaataaacttgtagaaaagtacattggcatagttgaagcaattttacttgttctgttctgtcacatcacgcaacaagcgaaggctataattataattatgtttttacttaaactgttgggaggcagtatactgcccccgaaggtgtaaaggttcctgtctagaaaggcttcatcacacactggcatgttttgcaaacccagaagaagctaaagtatagcaaagagaggcttcaaaccctgctcagccaaataaagagtaggtacagtgatttcttgaataaaacatggtatagtcattagttacaacccttagaacagtcattaggccagtcatgccgtaagacaagccctcagctccatctgtggcaaggggatttgtttgcctggacttttggaaaatactaggattctaaatacaccccaaattcaaattgtgtggatgttgctttcttttcctgaatcagataatacaagctgatataaagcagataataaaaacatgtcatacttcaaaggccctgtgaaccaacatcctttcacaatttttagatgagaatttgaatgtataaactttccctgcaaacatgttctagggatgactcagtttcttttaaaatctgcctaaggctgggcatggcagctcaagcctgtaaatcccagtactttgagaggccaaggaggaaggatggcttgaggccaggaattcgagaccaacctggacaccatagtgagacccccatctctacaaaatttttaaaaaattagcgagatgtagtgtcctgtgcctgtagtcctagttacttgggaggctgaggcgagaggattgctggagccccagaattcaaggttgcaatgagctgtgattgtgccactgcactccagcttaggcaacaaagccagacctcatctcttaaagaaaaaaaatcttcataaacagctcaatgttagtgaattttcactgactatattagaagacactgaaaataattctcccaagaaattctctgcagaaacttagacaatttctgaagcacctttaaatcctcctattgacggaggcttggagggcattgtgttagaggggcacgtgctactggttggctactctgaggcagactctgcacccagcagtgaatatttgtgtggttttctccacaggtcccatgggaagatctccgttatctctttggtgagatcatgtatggaggccacatcacagatgactgggatcgcaaactgtgtcgggtgtatttagaagaattcatgaatccatctctggtaagacatttgtaaattaatttgtaaataaatttcactgagcaaaaaattctggtaagaattttataaactaattatactatgggcaattcttaatgttattgaggatgcttggccttttgggaaatttcttagaaaagcggaatctcgggttccatcccagacctacagaatcagaatctgcattttcacaagtcttccaggtgatctctgtgtgtgctagagagtgcaccagcgtgaggcagcctcacatgcactgactcatcggctctttataaaaaccctatgaggtatgcagagctgacgctgttattcccttttctagaccgagatgctgaaacatggggatttgccccaggccactaggttggcacaggcaagagttttgtgcgtcttttgatagaagtcttttgatttctattccagagtttatttcactaaagtttcttttctgcctgtcatggaagtcctagaaaatagtctacagttggaccagtatcagttactcaattataatatgtgctcaagaaaaatgtggtcaatatgtatgtgaggtgatagatttgttaattagcctgatttaaccattccacgatgtacacgtgtatcaaaacatcacactgtgccccataaatatatataattattatttgtcaatttaaaataaaattaaatctaacaagatagtaaaaaaaaagattatatatatcaaccaagggcaaggtaagaaccttatttggatcttgttccaaatgaactataaaaaaaaaaaaaaaaacacacacatttatgacacaatgggaaattaacattaacatatcatggtaatatagaattcccgttaatattttatgtgtgataataaagtaatatagttatgttttttaaaaagagaaaagatgctccagggtgaacctggaggacattacgttaaatgaaataagtcagacgcagaaggacaaatacatgttctcacacacataaagactcttaaaaagctgatctcctataaatggtgaatagaacagtggttaccagagactggggaaggggagaatggggaatgaatggtcaacagatacaaagttaccatccttagaaaggaagaataagtaagttctcgtgtcctattgcacagtagggtaactgtagtcaacaatacaatattgtatatctaaaaatagctagaagagaggattttgtatgttcccaccccaaagaaatgagaaatatttaagatgatgggcctgctgattgcctgatttgatcattacacaacatatacatgtatcaaaacatcgcattgtaccccatcaatatgtacaattattatgtgtcagttaaaaagacaagtatggtgatttgagaacctcattcttccttctctcgtgaggaagaggtagatcacccctgtaggtggagttttaaaagaccaagcatccttttcccatttctcatcttagtaaccctgtgtctgtgtagaaatggttccagcccggggctgtgttttctggaaaaagtactccatttttgtttctcgtactacagagggtgagcgtggtggctgtagttttctcatgctctctctccctcatggcatccaggttcatggccattcctggttatttcttggaaacgtaaagcacctgtacaccatatcatgtctatttccagttgggcgagacaccaactctgtttaaagcaatgctttgaatagtttgagtgatgtcctatttatagtttctctgaaaatttcacctcagagaagcattatatagatttgatcaccttcctagagttcattttgagaagtaatataatcatatcagtctaatatttagtgtatattagattaaatcactaaaatcatattagtctaatatttagtctattttagactaaaatacaccaggaaaacatagtgtattttagtctaatatagaaaactggggacattcttttgttactacttttaataatgtggaacagtttggagacagtgcaaaaaatgcacaatgttatgtaattgtttcttttgattgtgagtctcatggtctttccttagttctaatgagcaagatttcacatgtcagagagagacttccaatttagcacaattggaagtcactcctcaggaaaggtctgggagcaagttaccatggagatgggaaagctaaacagtgccaggcatgcgacctttacagaggctgatttctccgaatgatggtggagggcaaggggcccgcgaggagctcccctagctctggcctgtggctgaggggagaattactgttgccaaatgcagcagtccattaaccttcacaagcctgaactcccattcaaataattgtaaaataaatataggtgatgaaacctgaaggggcatcagtgatgtgtgtaagccctttagaaatttaggtacctgaccttacatacagatctggcgaggtttccaggattgaaatgcttcattttgcaagctggcatcctcactggagaggtacctcctcaactcaccaaaggaaattaaagcacttaactgacttgctgtcagaggctgcaaatcccagttattttgttctcatgcacgtttctcctgtttatgctgtttatatgattagcaacatgatctaacacttcatctgcaggacatctttttgccacttcccacaagtggttaacatatttggaaattagtgtctttggttgcattggaacatgatcaaaaagcaacccattcatggtgtggggtttaaagttctgctgctcttatccaaagaatcagaatgctttcagtgatatcttgctgttaggaggatcagtgagtttcttgttgaataaatgagtttgctctcagagagagttctccagtgggctttagagggtctctggccaaagtcaagaaagaaaacatcttctcacataaagcatgtatttggcagcgttaattaagaaatacagtaaatcactttcagagaataaggtaccaggtcaccttaaagttatcatataatacaaactattttagtaatatagaataacaagaatctggggtttgaagtaaaaaacaaagacaaaaaacacctgggttcacactgaagtacctctatgtatttgccgtatgatgtaattgaccctctcttagccttggtttcataatctacaaaaccagaatgatcaacttacaggtttgctgtcaggtttaaactttggtacaatgctagaacaatatgcttaataaatgggaaatctttttattataaagtatacattttcattatatatatttaatatttggctatacattaatctgtgataacaatgggaatcctttagtaaatacctgctctgtgccaagggtcattaccacacactttatatgtatgatttcttctcactataatctggaagagtaagtattattccatttaatcaaaaaagaacctcaggcttagagaggtcaagcagctgaaccagaatttaaactcgtaatcagactccaaaggctggtctttctctgcaccatactgccctggctggagtgctgagctgtttgcagcacaggtcaccaaaacaatgactcgtatttgtatgtagatggtgtacaggccaacactgagaacaacacgggcaatacgggagaccagagttctggttctgctactgacttgctgtctggctttgtgcatggcttccctgtgcctcacttcattcatttataaaattaaggtattgcctagaaaatcaccaatgtaccttttcattctcaagacaccatgataattcaatcttgagtaatgtctaaaaatccctaacagcactttggggccatggcatttttgacccagaaggccaagggcaaatgcatttgtttaaattcacaatgaactggagcttcttgtcattaccaacactacttggagaggcagtggagtgggggtcggtttttgttaaataccagaaaggaaaatataaaaaagacaataatctcatggagtccaacatagtgggctggatgctggttctccagtttctaataactgtgcctgcccctgatttcaacaaagatgatttcaattttttttttctttctttttgagacagagccttgttctgtcgcccaggctggagtgcagtggtgtgatctcggctcactgcaacctccaccttccagattcaagtcattctcctgtctcagcctcctgagtagctgggattacaggcatgtgccaccacgctgggctaattttcgtatttttagtagagatggggtttcaccatgttagtcaggctggtcttgaactcctgacctcatgatctgcccacctcggcctcccaaagtgctgggattacaggcatgagccaccatgcctggccgaaaatatcatccaaatttttgattatattttcatgatgtggaggttctttctgcctgagcatgattctatcgattctttttgtttttaaaaaaggttttactaagatataatttgcacactgtaacatttaccaatttaaattatacaactcaaaggtctttagtatattctgcaaccattacaagttttagaacagtttattacccacgccccacccacccaaaaaaaaaaaccctgcagccattagcagtcaggcaccatttgtttcccaccccatattcccctataccccagcccatggcagctactaatctattttctgtctctatagatttgcatgttctgggcatttttaaaaatggactcatacaatatgtagccttctttcacttggcataatgttttcaagcttcagccatgctgtagcatatatcagtactcaattccttttaagtctgaataatgttccattgtatggacatagcacattttgtttatctcatctgtcagtggacatttgggttgtttctccttcttggctattatgaataatgctgctatgaacttttatgtacaaattttgtgtggacatatgttttcaattctttcggatatgtaccttggagtggaattgctgggccaagtgataactctatgtttatcatttgcaagtaccaccaaactgttttttaaatagtggctgcaccattttatcttcccttcagcaatgtatgacagttctgttttctccacatcctcaccaagactgctactgtccacatttttttattttagccattctggtggaggtacagtggtgtcacattacagttttgacttgcatgtccctgaagactaacaatgttgaacatcctttcatgttctcattggccatttgtgtatcttctttggagaaatgtctatttagaattttttattctttgaggcattataacagctttctcagacaaacctcctccaaaggcaagaaagttggccactgtgtagagagctctacaatgatggccccattagcaaaaagcatcttttcataaaaagtcttgagtgggaaaggagaaagtctagattcagcatcaggattcacagggctccttgagtatattaaagtcttgatggttttcttaaagtaaaagggaacacaagtctatgtatggaggacatttctcaggttttgtttgttttttccttctagaaaaagcaagatatactaaaatcaagtctgctgctagggtacgaggaagaccaaaacttacataagagcctgctgtgtgctgagctgtttgcataccttattaaattcttatggccacaaccattaggttgctgttatgagcaatattttactgatgaaaagattgaaatgcagataaattgtcatttcttaaggccaccaacccattaagtgatggaagctgaatcaggctgtctagctgtatacctcaggcccttttgagttggctgttttcttttgccttcgctcattgcctaccatatggaaggcacttgtcacatgtctataaagactgattttctttccaaagagcatgggccatttgcaatcccatcagcagtacatgagcacgcattcaaacaaatgtccccatggcagcttaacctttccaagtggttttggttttggtcagtttctttgcttgaagttctgtttttaactttttgatttattaaggacagattaactgtggcttctgaaatttctttcaatttcctagtaagcacaaacagagaagaccaactacttgttttagggaataatgttcagttgggatatgtggattctaggttttggttttcttattcatattttgcccatatttttattctggctactttatccatcatagactaataataatgagtttaactctcctgtaccattttattttggtcgccctgagccaggtgacatttaaattttcattattcttatatataaacatgaaatgatacaaatgtgaataaataaagccaagccaatggatactggtggtgaaatagtccaacttcttccttcccatattcatcgggtcaagatttccatttctggcaatatgaaggattagataacttgaaaatcctcccggtacaaaataaaaataaaaataaaaatgctgtgtcgaatgttttaaatgcacttggaattcgcagaaagcagtcgagcatccttattaaggacataggctttctaagtaacctggattgcaggtttaagaaggaaagagaaaaccactgttacacacatgattgtgtggaaattcacacttactttgtcctctttagactctgagttccttaataacgaggtcatatggagcttatacttctaaggtttgttgtagtgtactgggtggtgggtacatattactgaatgaattaaagaatattcactttgtctccaagtgatagtgaggggaccacagtgtagcatacacagttacagacaaatcccatttcagaaactgactcagaaaatctaggtagaaaatagctacattcgatgatagtttaaaaataacattcctctgtacatttaagtgcacatacagacaggatttacggtgcaagagactgggagaattaaaacagaggggttaatggtccctggaaactaaagagcaatcagggaaaaataaatctgagattatactgttacttagaaaattgtaagcacttgattgactctgtgtttatggctggtcagagactcaggctcataaattcttttgttacattttgaagttctacattctaatgtttagagggtttgttattgctattcacattgcctttgttcaaaacttccccctaaattgaatgtctaccctcttgccccagccttattgaagtagatgggcacgataaaagcccgctttctccagcctttcactcagtaggtaactgtgtattgagctctcagggtctgtggatcctaaacaacagactttgctgtgagtagctcaaagtcctgggaaggtaggatcggtctgactcttagtatatatggcctatacatggtacttatatacacacacatttttcattaaatgcacatatcattatttataattataaaattcaggtatataaattcacatcatatataaaatgatgtgatgcagtactgtggaaagtatggtgccctggggaagtacaggctacagagtcctactaaaatgagttcagaattatgattaaaatcaaatgtctacctcagcaaattcacatcagagtcttgatttcctctctgggaaatggggatggttgggagaatcaatgaatgggagtgtgttatagggtagcccaggctctgtgatggctcattccttttgtgtgcatgtatcacactgccccatgcacactgcaaactgagtcttcttagggataggattaatgtgtgttccttgggatcttccgcagagatcagtctggtgttgcatatagagcaaaattgttgattataaaacagtttagggagcctgctacccagacagcattgtgctggagccttcttgtcagggtcttctcgaagtgttgaggaagtgaaaatggatgcctacctacatttggaataactgacttttcctttgtggttcaagactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggtagagggtctttccttccttttctttttcattgaagtataacttacttgtactgaagtctactaatcttaattgtgcaaatcaataagtttttacctaggttttactcatacaaccaccacctagatcaaaataacatttccaacactccagaaggatactcatgccccttatcagtcaacatacccctcacctcccccagagataatcagtatctttacctctatcatcacagattagctttacctgattccaaatatatggaatcatacagtgcgcattcatccatgtctaactcctttcattctgcattagatttgtgagattcatccatgttgttcatgtaccaatggttcatttttgttttgaattctatatgaatataaaattcttcattgtactgtgaatggatgtttgggttgtttcttgtttttcacttttatagaaatatcacaaccatgaacattcttctgcagtcaatatgcaaaggtaactcccaaaggcatccattcatactacccatttctctatacccagaagtgggattgccagataacagggtataatgtgtagctttaatagtattcccaatcagttttctccagtggctgtaccagttactttcccaccagcagtgcgtgtgagttccacttgctctatcttttttgtgattttgtaagggtaatgatatctcacagtggttttaattttgcaatcctcaattgaggagtaatattgagcatcttttcacatgcttatggccgtttggatatactgtctacctccactgtaaatgagtttaagatttcaggacctgataaattgccggtcagagtgatgccagctggcaggcatgatgtcagaaccagaggcagtagtctgagaaagcaaggaaagaaggaaagctgcctgaggctaaggacaggcaaagttcctccatcttttctcctttctagatattgactggtttttccagctcggtggagctgtctacatagaattagtatgcatgtctgagtaccatgtgcatactcatacctgtaatatatgtctttcattctttcagagcaacaattacagaagatagaagtttctttgttaaaaatgttgatgtaaattggtctaggaattttaggatgccgtggttgggagggcagcatcatagttcagcagaatttgcttacgcttaaaaggcttatttgggttatgtgacttttattctattttattttttattttttgagacagtttcattctgttgcccaggctggaatgcagtggcaccatcttggctcactgcaacctctaactctcggattcaagcgattttcgtgcctcagccacccaaatagctgggattacagacatgctccaacatgcctggctaatttttatatttttagtagagacagagtttcaccatgttggccaggctggtctcgaactcctgacttcaagcgatctgcccatcctggcctcccaaagtgctgggattacaggcgtgagccactgtgcccagcccctggtttgtgtggcttttaaaaggatctttttaatttagcagattataaaatatggtaccctaataataggcttctacttcctctgatcatatctttacatataaataacatgtagctgatgacagttctatactccctaaatgttaagtgagtaaactgcaaacaactgtagctccttcttgaccagatttggggctccatggaaggggaagtgctggcactggtacagaggcaccaatgaggcagctgagggagttggcactgccatgctgcccacctcctgggagccgtaggcatccttcacatgcatttgcaggcaccttcggaagtcgtatgatatattctgtaacttcaaaaagtagaggatatacacagtcaccatgacgaaaactgaaatagaaaggagctaaatctttgtgttactgatttaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaaggtaagcttaaagtgaggctatagtagacttcagcacattggaagatattcactgtgtggctttttttctccatgcaagggggaattggcattatctcctgctgtggaagcccagcagtttgcattgagttatgacacggtaccagacacttggagcaaactggcttatccttctacttatggcctagcccagtggtaagctaccccatcctcactgccactggccctgagcagcctcggtgctgggttagtgttctgaataatgcttcctaagaactatgcagacggagctttgtgactgttctcaacctgtaaccgtaaaaaattcttccaccaatttcatttgagtttacttggtatattgcatcaaaggcaaaaatagttaaaagacagggtcagagcaagactgaaattctgtcgctcactcattgatacatgatcttagacaaaataacctgtctcttttttaaatctgaaaaatgtagatggcaatagaatcccctgagttgttgttaagagttgaatggccatggaaagcaacttgaatttgcctttgtgtcatcttataactttactttgcaagcctgagattcctctgccttctcatagacaacctttgaaagtttgtaatatggtatgcagtatgcagtaaactagactgggggtataactgcagagatgtgtcacaaagctagggcagaaattcacagattactgaatgtaatctgtgctgatgttacacctaattgctccttggtcttggcaagcaattcaggaagtttcacaaagctgttgattcctggctttttggtgctgagtttctttccccctgctttcctgaatcattattccatgaacctcaactatccctgtaccattcctattattttagtggagactctttacattgtagcatgcacacttttgacttttctttctttttgagacagagtctcactctctcgcccaggctggagtgcagtggcgcgatctcggctcactgcaagctctgcctgccgggttcacgccattctcctgcctcagcctcccgagtagctgggactacaggcgcccgccaccacatccggttaattttttgtatatttagtagagacggggtttcaccgtgttagccaggatggtctcaatctcctgacctcatgatctgcccgcctcagcctcccaaagtgctgggattacaggcatgagccaccgcgcctggcccacacttttgatttttctaacacaatgttagagccttcagcttccctctgaacatcaacctccttctggtctggaattgtagttccaccttattttaagccacattatgtttgttgtgttttgtttgtggtcaatcattatttttgttttaatatactgtactgatttctttgctcatcattgctttttttgtatcttgttctgggcttttctttttttatcagagtataaaatatagagcagggcttggagggtgggggtgtaaatcatcttgtgtttctgaaactgtcctcactgcactctccttcttgattgatagtttacttatacgtagaattataggacacgattatttttccttcagcactttgatgttctaactccatggttttctagctttgattgtagagggtggatctggtcttaaatatttgccattccttcccaagtaaagttttaaaatgtttctctttacccttgatgttcaacaattttactattgtactgaggtatggatttttaaagtactgtcataaatgtgagattccatccatagcttttattctgaaaaagtcttagcacttttttctctgaatatcgtattctcctcatgtctacatttatctgcctgacctcttaacgttttcagtgtgtctttcggctgtatacttgtagacttcatcagttctgggtgatcttcattatatcttcaactgtctccaatctgtttcttaattatttagatgtcattgtccaggttgggcgcagtggctcatgcccagcactttgggagggcaaggcaggaggatcacttgagcccaggagttcgaagccagcctgggcaacataatgagaccctgtctctaaaaaacaataataaaataaataaaataaaaattagccaggtgtggtggcatgcgactgtagtcctagctactcaaggtgtagaggtggtaggattgcttgagcccaagaggtcaagggtgcaatgagccatgatcatgccactgcattctagcctgggtgacagagcaagaccctgtctcaaaaaataaagtatatttcatcgtccataattatcagttccaggttttttatatttttggaagggtgcctagcttagttttataatttcctgttttcgtttttatgactgttattctcttttcctgagaagtttaaacatacttacaagtaagtattttcttcaagacttctctatttcctgggttataaaccttcctgtttgttggatttgctggtggtttttcatgccctatactcttatgtctatacctgaatgacagtttggccagttattaaaatataataacaccctcagttggaggcctttgtagccatcactctcctcttgtcaaatgctgccgtggagatgtcaaaagctagcatacttcttttccctttataaatggcttcatgttttcccctggccatccagggattcttcattgttcatattattctttatattttagtattgattactctctaccaaattttcttggaacatgatgtgcccttgattgtatagattcaaaggtataatttaggaaaactcaaattttctagaattacactttttttttgagagattctcattctgttgcctaggctggagtgcagtgacgtgatcgcagctcactgcaacctctgcctcttgggttcaaccgattctcctgccttcagcctccctagtagctgggattacaggcatgtgccaccatgcccggccaactttgttatttttagtagggatggggtttcaccatgttggccaggctggtctcgaacacctgacctcaagtgatccacctgcctcggcctcccaaagtgctgggattacagatgtgagccaccacgtctggcctcatttcagctttcattttattgctttcactctaaccctttacctctttatttccatttgtttttattattctcccttacgctgtttcacttttgctttcatttctataattttattttctacttcttatttggggtcttcaaacttaatttccttactatttcctacctgatcccttctaagtcatgatcttgtttatatcaacaatcacttgttttagttgttacaaattgtctgcagtgtttatcctcatgatggcaacattttgagagaaatgtcttcctgcctttgcttttctcattcgcctttttcctttgtgtggtgcctatgctgtttcttcttcttatcgtcgagtatgctttttcggatccagctatctggaagaacttaatataggtccgggcacagagattttccttgtggtgacgtaagtttgaccgtgagcattctgagccttttcttcttcacggcccagagtcaggcaagtatctcaggcagacatgttctgccatgtggtttgtcagggtgtttcctcattcacccccacttcctttgcatatctgaagcagacaaggtcctagaaaacttcagtgccagcctttccttctagagaactctggcttttacactgaggctatgctctctactccattctcctggtcccctttaagcagcctctgaaacttacaattcaaggtttcacttctctcttaattttatcgaagaggttcatctgtccctagcctctgtgagccagcttccttataggtcaactgcaaatacttcctaccttgcccaattgtgaggagccgagaagagaacatgtacgtaacagcagcgtttctcaacccaccggcgtgccattcctggctgacttgttttcctaattaacctttttcctccccactttcaggcagctactgcacgtgcttagactgccgtcacgtgctccactgcctccgcacatgctgttccctctgcttatcaatcagatttcccggcaactctggtcttgtaaccaccatcacagccttgccatccctggtcctcagacaccctgtccatacctccaagttggcgcttgtcagtccaagtcatagggtgatgacctttgtatagtcaccacatagcatgaagaggctctaataaaagctgttgcataaatggaaatgagttttccacattcctcagtgtatcttgctctaatgtaaacgctacagtcatcaagtctccaatgggaaacaaactagccctttaaagggacagtgccctgcaaattgtcagggaaggattttaccagctagcagtggtatacttctcctccaccaccaccctgccctaaccgcccacaacagaacatactggaaaatggctattttactgaacagcaagtttttcttcctccctcccataaaccaggttcaatgacctcctcctgcgatgccgagaactcgatacttggacacaagaccttacccttccggctgtcgtgtggctctccggcttcttcaaccctcagtccttcttaactggtaagggctgacgcagtgcagcccctgatgcacacaggaccacagcctaaccagaagccctgctttgtttacctatgatggcgtctccttgccctgctcaccaatcctcaagcagcagccattatagaaaggaccagcagctatagaggaaacagagtcctgggcaggcgagtagcagcaggagggaaaggacctcctatagcagcaagagtagccaagtgaggtggggcacggtgtgctcttattaaacattttctggaaagggccacatagcttctctgctactgtagtgcgaaaaccacagacaatccacaaatggctgtgactattccaataaaactatctacagaaacagcgagcttgtcctgcaggccttagttggccaaccccctgctccagcgcagccatgtgccaatgcccaagaacctaaaacaccctatgggactaaaggatgcctcaatttactggtagctcccgggaaccttacatgcaacacttttatcctattcaatttttgttatatttccaaagcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggtaagacaccccaaggggtaagtggggaaccttttcttactcaggttcagatcagtgtttgtcctctgcttactgtttctcagcatctcctcactcacacagtaaccttatgctagtcattatctcatttcttcctcttaaataatttaagtgctgggatgtgtgtccactgtgaaccaaactgtaatatttggggtgatggctatcacttaaattttgcacatatatctggatgttaatgccactgaataacatcattagacttagactgaatttacattctttttgcttttcaatataatcatttcaaaatctttcttctattgtttaaaaactgtcagtaaatttgctctaatgttttactacaagacttctccaagcctggaagatgctactgcgtagggtgaatctctaagagggggttagactatgcaatattttccaaatttatctggccatgcatttattccacaggacacttagtccctaccaagatgttcctttttcagtttaaagcaagtgccacaagttctggtgtaaaagaataaggtgcgacggggaggaaatgtggtgaactggagatttttaaagggagggcaaactagttcagtgtatgtgaattctcttagaatcccatttcataaaatcagcttacttccacaggaaagtttaaccactacgcatggaagcaaagcggtgcctccgctgcaggcagggtaacctacctttcaaagctcagtccggccagctcagtaaaaataccactgacaagcaaaaatatgacaaaaccagaatgttgaatgtttattgcatcaaacaacttacttgatcattatcattagtagcaagctgccacacaattgcaaccgctgtgtttttgccataggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcactgttcccatgcacattattctaactttttagtaactcacacgtgcattcttttttcaacgctatccttagagtgaaagtcagaaaaaaatactagaaactaactcagggctgagcgtggtggcacacgactgtaatcccagttactcaggaggtaggagaatcacttgaacctaggaggcaaaggttgcagtgagccgaggttgcaccactgcactccctcctgggcaacagaacaagactccatctcaaaaaaaaaaaagtacatcataaaagtacatcatatgtgaacatgcaaaagcaatgcagccggaaagaacggagattttaatttttaacaaacaacaaattaaattattagcccttaaactctttcaaaatataaaagcagcaggccccaggtgagtcctgaaggaagaggctagcactctgtaaggcctccagtgtccagtgtctacaatgttgatggtccccttttgttcagtcaagttttaataaaaataaaactgttctacagttaattgcactttgttcagtgtaaatttccaatgaccaagagcaggttaaacgatgtgtgtggtctattaaactgtggtcactcgtgctaaggcacacttggcctggagtgagttactgtttgggaagccaaagatagatagatcaagtgcaggagctgatcatacaatgttttctctctaacttacttacctgaactttaaccccaccccatttaaactgtgctttttaataactggcagatatttttaacaaagttcagcatacagacaggtctgtgcatacatctatatagattcctctgctctgctgtcttcctgagaaatctttgtaagcatataaacaatctttaacaaaaaatagtaatttctacaaagaatttctgtataaaaacacaactgtaaaaaaatctttcttaggcaccaatggtatgcatgtcttgttggagtactctatggtgaggtggctggttctgtttgttttcctcttaattgtcttctaccagctccttttgtaagctgggaaaaagatgagaagtatttggtaaagtagtacaaatacacaaatggcattctaggcttgagagattccacaatcatctaagagtacaaagccagaacccagatctcctgacactcgaaatcctgacaatttatgcatcaatatccgtataccctctggtgtagtacgccccaagcatgacttgcctcactcccgcattccagaaccacgattcagagtttattaattacataaatgaaacttgtaactcacattctgtcctcttgccctgaactctctctctgcactaggattatggctgcctcttcataatctgtgtctttcccctcagcctgccttgtttgtttgttccttccatttctgtcatacacctcaaggagaaattttggttaaaggcaacgtggagttgagttgaaaaatctagcaaaggagaagattccctaatagggaaaatatcaggcctgagcttttccaatgcaaacagatacagaatggatggtactcgtggtttatataagtaagtaagtcacacgggaaggcaacaactacttgcccagagggtctcctgtgctcagcctcaagatttcaagctgttttgtaagctgctagagacttacttacctctccagatattccttaacattgtcataaccataaaacttggccagatgaatgaggattcctgtggcacagcggccgtcacgcttccgacagtagctgcaattgcagatcccacgacaggggggacacacccaatcctaacagagagatgacagcagacacttcgctcattatctacagggtctggcaagaactgggattcggatccagaatggctcagctggcctctcctccaacctttaatcacatggcatctttcagtctacgtcccagggggctcctcacaaggcaggaaggctgaatcaccccacgtcacatgcaaacactgaaaaatgacaccttttagggctccttgcttaaaaattatggagattttcacaagcatttggccaagcacagggccctgtgcgagcatgcaggtcacaggcccaggatgtcagccctggtttaggagcacaaggtttccaaaatatcaaggtatgaatttcagccctttcaatgtgtgcttattgttgaatgactaacctgagcagcagtttgtttgtctgtcagttgaggaccatatatttaccccatgactgctgcctaagaggtcacactcgggagcaggactgccccaggctcaaggtcgtgcctactcaccatgatactatgtctcattttaccgagggagctgagagaggttatacacctatttcatgggattaaacaaatttatggtaacagagtgagcgacagcttgcacagtgccaggcacacagagagcactctatactgcaatctccacctccctctcagcctggcccaggaaaaacaaaacaaatcagagggaaatcactttgctgaaggacaggtacagggattacttgcataaaactagaggactgtaagcaagttttgctctgacaatggaaaatctaacaacattaattcttctattcactggtcagcttgctctccttccagaaggaatccctatttttcattttccctggagccttaagatacaaatggaagggaaaaaccagagttctggagctccctagttcccagtgagaacccaggaggcccatctttatagcttgcttccttcaccaatacaatttacaacaaatgcaaacactgttcctaccgggtccagcaatgccgatctgacatcctccccatagcggttccgcaggcatggtccacagaactgtcctcgcacaccacagcaaccctggttccgacacactgtcttggtgtcgatggtcttttgtcgacactgatggcacgtgttaccctacagggggaaggcagtgagcaggtgaacacagggatatgctgatgcccaatgaggccagatgccaccatgtgcatttccaagtatatgaagaaatacccccgtctcctcgaatcaagcaggactgttttcctaagaaccacagcattgtctctagaccggggtccccagcccccaggctagaaccagtctgtggcctgtttggaaccgggctgcacagcaggaagtgagcagcggacgggcgagcattaccgcctgagctctgcctcctgtcagatcagcagcagcattagattctcataggagcacaaaccctctattgtgaattgcacatgtgagggatctaggttgtgcaccctttataagaatctaatgcccgatgatctgaggtggaacagtttcatcctgaaaccatccccttcctgccccccaaatccatggaaaaactgtctttcacaaaaccagtccctggtgccaaaaaggttggggaccactgctctagaatgtaaccatcacaggtctgtggccagagaaacatattaggtcagatgaggctgagcagagacccagaaggaatgaaatgatcaggctgtcaggaagagagaccagagaaaagcttgaggcaggggtggcagagcccctgaaaggtgacaggtgactgaggggcaatgagccttgggtggcatcacctcggccccagcctagctctgcagacctggataccttcaatgtgagatctatttttttttaaatattggcaactaaatttaaaacttgacagtgtcccgttacatatccagaaaaacacaaaaaaaatgcagaacgcaaagcctccctctaaatcaccatttagaagaaatttaacccatttcctaccaaagatattctgccaaactttaatttctatggttatattaccccccaaatatacttttttcaatatttagaacataaaactatatgcttaaaccattaacagttacatataaaaatcccttttaaactataccgttcccttcccccagattctacgcatccctaagagagaccgccgtccagatgggaattactgcactaggctgcctcccctttcccaggtacagctgacttttgaccctccaattcagagcctggctctgagcccttggtgagatggcataagccctgatagagtttaaaaacaagtgagatttcaataccaatgccttcgactcccaataagaatgacaattaatgtatactttaccagaactttatcatagattttatctcgaacagttatggcaacattttctaagtcctcttcggtgatatcctccactggccgaaaagaagatatacggtgacgtcgtctgtactcccggcatttcccctgcacaatgaacacaagcagaacatggagatgtgttgagcagttataaaaaaattataaatattttaaactctcaaagatctagcaccattaatgttaaccccgtccctcttctatttccctgcagccatttcatttagttatttactgagctcctgccacctgccaagcttccttctcagcaaggcgatacaatcataaaggaggaactcaaggtttttggttctttgctgtaaactctgtggagaggtgaaccacactgaacagccaaacccacaaatgggtccacagttgctccctccaaactgaaagcgcttgaaacgcctcatgcctaaaacagaaaggcaaggaggaatcactgcacttttctttattgcctgcagcagagattaaagcagggtcctaacaaatgagctgcttctcagctcggcttggataaaagactctctctgtgacctccagcttagaccagggctgcttctcaaagtgtgatctcaggagcaatggcatcacctgggaagcagagagaaatgcaagttctcagctgccgcagacccacggggtcagaaccagccctggggtgacagtgacgtgcgttcacgtttggagggatggtagctcagacaaaaactaattcatgtattagtcagaaaataccccaattgtcttccttcttcggaagctgtaaaactcttccgcaaatttagcggctgagacagtgaagttctctagagcaaacttctcaggaggccgcgcactccgggttgggttcatacgccgcgtgatctgtccctccgagaaggcccgcctcactgtcttcttcctctgaaatcaagagcacagacagagacaactggggactctctcgaataaaagccgtctggtggctgatcaccatatatcagtattggtataattataaggagttctacttacagaagctgaggttggggttcgtactgggaagaaatctggcatcgagttcaattccgccaataactgggcaagctgaagttcagaacaaaagaaagaatcttacaaaaatagggctccaggtttaggtcatccaacacctatctcaagtcttccattttgccaccataagaaacctaacttgaatagtttatataacccacaacagttatacttttaacctcacatgtaaagattgtacctccagacctgagatgctgatgtcatcattcatatgaatgaacactagcctattccttatatataaggacaacacaacactatgaaaacagtcctggaatgatcaagacctggagcatgaggttccgatcccgactcggaggctaatccaaggcggtgtgaccctgggacaattcattttgcacacgtgagtctcaagtttcaggatgttcaaaaaagaaaaagctcaactagattatttcgatggttatttagaactccaaaagtctgattctttaaatagattaatttctcatcaatcaaagtaatctatgaagatattcctacgtgaactaataataccaaataataggcattaatatgccagagaatttaattaggattcgttttagtttatacaattatatgagtgccaccaaaaaaatcataaagaaaatagcttattttaaagatgcagatggatacagtgctgaaaatttcccttagctaagtaaaaatgtttcttaggataaaaataatccgaaagtaggcattccatttttgtaagtaatttatattagacatataagcttgcatatacagtatcactgcatcattctttttttaaaaggaaaagattaaaaaattaccaaaatgctaaaagggataagtggtagaactatttaaaaaaaaactgtagataaacaattatgaagcaaacaatgattctctacaatgatcagattaacagtaattgattatatacagaaaaaccaaatatatgtaacaaagatttcacctggttccattcattgttctaatgaagacaatgtagagtgaattaacactgttgaggttgttttaattcctagacctcttccattccttcagaagtctcagaaccagtgctggtcaccatagaagagtggttctgtggtgaaaagctacctgcccaacctgctccttgcaacttctcagtggacttggtgacatcccacttcccctgctttactctgctgggaacgggctagttgttcagcccctctcatccccaacacaactatatacttagaacttagcttggtcaacagtaagcagcattatggcaccatgtaggggctaaaaatggtgctggggaatctctttctgttcccaaaccagagctgatcatgtaatagttgctctgggttctggaaaagtaaaaggatacacaatacccagagtatattttcttgacagaagccaaagcaacagcagcagctgtaggagcaaagtggttctgggagcccagcaactgctgccagagcctggtgccaactcccaggacgccctccgtgaagcctcaccatggctttgttctccttgatgttcatggtccttttcagcaaagcatctgaactctcctggctctcatcccgagagtcatcctcagactcagaggtagaatcttccctttgtatcacctgtctacagtctttctttctttcaagaattgtttttttctcattctgtaagcgtgcgctagaaaacaactgctcggaagaactgtttttatctggtttgttggccagcttcttggtggggaactgaaaggctactcgaagaccaatactacttcttctagacctgcttcttctaggggtagccttatcttcttcttcatcttcctcttcctcgctcaccaaagatgctttgccatcatcactcaaatctgactccacgacctaataaaataagagcaagaaaaagcacaaagacactgttacagacccacaaaaaagacatgcatttaaaacaactgacagcattatgagaaaaaacatgaaaaatgaaaagcttccccttcatattatgagttccctctgaatttcctttaaatgtgcaagaaattggttgatgaataaaatcagagagcaggcaacctactactgaactgtgcaccatcatacccgcgacagaaatgggttccattcagagcatgagggctgtaagcaaaacactgacagggtgggttcctccaccgtgggacaaccagggagcaccagcaagaggagagacagtcacagaaaaggagagacagcagcatgacagatgtgatcttcagacaggaaaggacgcaacgggggaaaaatgctgactggtctcctctaaatagcaggaaccagactcctgaataacagggcgggagagctgactgcacctcagggcagtgacccaggacaggcagatgacctgccactgcgtcctcagtcaaggggcacctttcccttctctggaaccctcagagccatgaggtgaaaccaggtcacaaagctctacaggttgtagcaaaacaccactcagtcaactcaagaaatcctcacccgacattttcaaattccacatggcagaggtctccagcattcaaacattgctctgttttacaagtgagaacacagtaaatatggaaggcagtaacagggatacatcacctaggtgacagcttggatgtgacgggactcttagcagtggtacagagacaggtttaagtatgtaagatctaggacgtcttctgggcatccttccatgaccagaagctagaaaactttgggaaccattatctgggaattctgaaaatctaccaagaacacggaatggcaccgatacggacccaggatcagttcagggactctgcttcctccccggtgacgaccatcaaccccaaactctcgttggactaaagttagaaataagacacagggagaaaaaaaacgcagataactgccaaccctggtatatccacaccaagccaagtgaggagtaagactatatggcactgatttatctattttttaataccctgaacttcccatattaatagcttcagaattcaaaatggtgtactgcaaaggaacccaatttcaggggacactgtcagggaagaacttcagttttgatccatttatctaccatcctcatcatcgacaggcctctctttaccagatgtggaacagctcactacagaggcctgaaggaaggaaagaacaaatggtacacagcagcccagaatcagacccaagagaagagcacaagtgtagtacatggatgtggttatttcgcatccggccagcagacccctggaaaccaagttacagcaatgtcccattatcaagaaagataggttcgccagttcccacaggggtgggcaggagggtgggctgggaggcaacaatgcttttcttctcactggattctaaaataaaatttgcaagggcctgtgctgaactgtaagctatatcatgatctatgtaactacatcacacagtccatagacttgggggcaggtgggagggaagacttctggggtaattcactttctctcactagaaatgcaaatgcttcgaataaccagacatcacttcactaaagaacagaaaataagtacattgctaactgatgatgcccattagggttttagaagcatcttaatatcgtgctggcaagaagctagggacttgctggccagaactgatggaactgccacacaaacagcttctgcaaagaaagccaaaggagacctggggcctccaggctggcacagctctatgttgctactcatagcaaaaaatcactatcaaacgaagcagcctaccatgcgggcttttatgctctacattctctcctaggacaagtgagggacatggcaggctaggagtcacggcttatttatacctctacacagtctctgccaaaagttagtctttagcagcttctggctgtgaagaggcgtaaactctacgttccatcttcatactgaagaagatagtagcatgtttattttttgcataaatgtatgctatttttagcagaaaacatttctgcacttaaatccgaaggctgtgccttaaagttaccttcaggttcaaacacgagtgggcagtaaactagcctaactgtgcaggataaaacaaacaaataactaacaagtctgttcataggaagtgctgagagtagacttccctccagaatccaggcaggcctgggtcatctttaacactaaaaagcatgacaaatccaaatccacaatgcatggggaacaccaagtttgtaccacagccaaatttttgccaaattaacttcaaaccaaaaactgtcacttcacacacagtaagaaagtatctcaagaaagttgtcatctaagataaacttttagataaaagaggtttaaggaactcttgagataatttttttttttttttttttttttttttttttttttttttttgagatggagtctcgctctgtcacccaggctggagtgcagtggctcaatctcagctcactgcaacctctgcctcccggcttcaagaaatcctcctgcctccgcctcccgagtagcttggattacaggtgcccgccaccacgcccggctaatttttgtattttgaggagagatggggtttcaccatatcggtgaggctggtcttgaactcctgacctcaggtccacccgcctcggcctcccaaagtgctgggattacaggtatgagccaccgtgcctggccaagagagataaattctttgagaaggacaataaaggacgcctgggacacatccccaaaaaccccctaaggcacgaggagaagatgaatggattttctctaagagaataatggactggtggaccagggattagccttccaggagcaatttttttaggttatgttaattgcttgtaagataaatatgtaagaaaaatcttttcacttgtgaagtgactgcttacaagtaaaactctttcagaaacaggattaaaaacgttaccacccacatcccttcctgttgtaattattaccattacttctgggttagtctttccattcagatcactctgcgtaaatcctgcaaaatcctcagtctctgagtcagtgtcctctataaaaattcttcttagctcttctgtgaagtatttggaatgaaagcgcacatcctgctaaattaaagacacacatacatcagagacggaaagtagaatagaggttaccagggaagggtagaatgaggagctactgaacgggtacagagcttctgatggagatgacgaaaatggatggacaacaatgtgaatgtacttaatgcactgaactgtacacatcaaaaacagctgaaatgatatacttcatgttatgtgtattttaccacaaaaaaaaaaaaacactggccgggtacagtggctcaccctgtaatcccagcactttgggagaccgaggcaggcagatcacttgaactcaggagttcaagaccagcctgagcaacatagtgagacctcatctctgcaaaaaatacaaaaattagctgggtctggtggcatgtacctgtagtcccagctacttgggaggctaaggtgggaggattacccaaccctgggaggtcgaggctgcagtgagctgcacaccaatgcactccagcctgcgttgcagccaagatcacaccattgcactccagccgggtgacagagtgagaccctctctcaaaaaaacccgcatacgtacacgtatatattacatatatacacattttctaaagcttacaaaattcagacctacaagacagacaatttttaaaaattgggtgtagtctcaatcagcttctaatgtgactggtaagtgctcatggaattcagcttctcctgccaaagctggcaaccagacacgtctgctttcacatagaaccaaaacacatggaaagaagatatgaggagaaaacctggctccctcccacgtgttggcttccctttccaacagcctttcaaagccggagtctcctccaagtgggtgagcatgcctcccattcaccaacagcgagcttctctgtaggaaaaggctggggcctctctcagcccccaccgcccaccaccagagagcctagacttgctccatgagcagacaccatgggggcctgatggaaagctcattcaaggtcacccccaggaatttctctcgtgcaggaggtgagaggtgaacaaccatggctaggtggcaagtgagcagaaggaaagatgcaatgtgactctttaagaaaaggcattttctaatactttttcttttgaaatagtgcaaagatggaaacccaactctcttaatagtatacttgaaagaaagaggaaataacaaactgcaggccaaagggagacccacgagaccagccccctgcaagcccgccacacctcatcaagactagagtctgtccccagtttcctctgacgtctcttccccccatctctgatatagcaatgaccccttgtaacaccacacttggcggggaatctgtatctaccccactgcgtttccccgcctttaattatatacttctttgagctcatatatctctggggaaagatagatataatagacaagtggaaaaacttacaggggcacacagaaagaaatgcctacatctagcattctgtaagcttaaaaatgtctcctatgaattattatgggtaattggagtgagtttgctcagagctgaattactttgttcctttgttgatagctgtagtgcagctgcttgagaaaaaaaattgcacacacaaaagggaagtttctttaaagtgaaattcaaatcgtgtttaagggagaccagagttagcatacacatactgtgtgcaagttcatgcagcttctctctattggttaaaatggatcatgagcctgtggggtcggggtagagaagcagccagggcttgattattaaggaagaatggtacacagctgctgctaaggaaacccaccatgcacctgaggcctctcagtgcaagaaacatctggctcacagagccttgggccagcccctgcaggctaatttagagtggtatttctgtgtgcaaatttcatcaactacctaaagcccctgcctagggcctgaagggaacagggcaagccttgaagctatgagttcccatcttccagtttttctggctattttgatcctgtgtgctggcctcccagggcaatgggcatcttgggagagattaccatctttgatggtcagtcctgatagagaaaaacaacttaccattgtcctgaactgaggcctgtgctttagtttccttactccaaagtgtgtaagtactgttttccatgtgggtctgtatgatgccaatctccactccacactgctccactgcattctgagttagaaaccctggcactgctgattgctctctggcactggttcattcatcttcaaaatcaatactgggtgctatgctataggccttggtcatctaccatgatcaggaccataagcaaataacacatcagaggagaagctaacataggtggataaacttattttgaagtccatgtgacatggaagaaacagaccagagagcaatggcctgttgaaccagacagccagacaagcaccccatttcaactgcacccagcaaacaacaccccccgtgctcactgtatacagtcaggtggggtgttggatgcttgaaatcagaggaaaggaacaatacatgaggacgaaaagtcagagccagggaagctagaaagcaccattcaagtatgaggtctccccttcttaaggagtttataatctaacagggaggcagacaggtccacgaataaccctggtgagggtcagtgctctaagggatacaaagcaatatggcacacggagggaaagaaaatccagtaagacttcatggaagaagtagcataactggatgtgagccacggtagaggctagaaaaatggtgagagcacagataggcaggaacagcatggaccagtgggcagaaagggcagaacagtggataatgagagtgtcagttcagttcctgtgccctgcagcatagcaggtaggaaagagacccggcggggtaagaggctgagaagtggtggccctggatttggaacatcccagcttggtacttcccagatgtggggccttgggcaagtcattacaccttcctgaacgtcagtttcatcacttgcaaaactgcagcttcccagggaggtctgtggattaaatgcagtatctgtatgaaaagcagttggcacactgtcctccctggggagaacacacctgactacaaaaggagtcatcatagcagcagaagcagctgttctgtttcttaatgcccggtgcctgccaggctctgtgctcggccctttagacatgttctgccttgctcaaatgctcctcaaggtggatccaacaggctctgctctccccaccgcctgactgtgctcagatggagggctaagggaggagctgaccggaggtcaatcctataacagatcctagtaggaagggatgagcattcgggtaagagctacgagggctacggcagctgcagagggaagggaaggatggacaccaggaacacagcagaagtttcatcaactcctggacgggagtcaaggagatggaagaggggagggaaggccaagaacaaaagatggaaatcaagatggggaaagggggaagccagaaagacaaccaagggaaggagaagtgagtttcagatctcccttagcaaccaggaccagtccaactggtagtcagaaaccacctggggctggagagagaagacaagctccacaaaagaatacagtaacagctcaaagcaggacaacagacaagattcactaagtgagaagactgaagacaaacccttagagaacatctgcatttagggacacgaacagggaaaacaagtgacagtaacaaaaagcaggccaggtacagtggctcacgcctctaattccagcactttcggaggccaaggcgggcagatcacctgaggtcgggagtttgagaccagcctggccaatatggcaaaaccccatcactactaaaaaaaaaaaaaaaaaaaaaaaacacacacacacacacaaattagccaggcgtggtggtgggagcctgtaatcccagctactcgggaggctgaggctgggaaaattgcttgaacccgggaggcagaagttgcagtgagccaagatcatgccactgcactccagcctgggtgacacaatgatactccatcttggaaagaaagaaaataataataacaaagagcaaaaggtgtaacagagaggaagaaacccaggtggttagaaggaggtctactggtggggtcaactgctgtggagatgccaaatgagatgaggacgacagagaccagggagcctccagagatctcagaaagcacagctcccaccaggccagaacttacagtggcccacgtaattaagcaggcacttcacttacatataattaactgcttcccttcctggacttgcccagtggaagcaaagtgggtttaatttgctgcctttttggagaggccatggtcaaggcagaatgaggaattttgagtgccacaattaactcagaagaaaatgccactgaagggtagagattttggccattctactactaggacacaatgtgaacctccaggaatctacctgtcagagaactctaacttgtgagtgctagagatcaaagtaattaacgcaagaataaggctctccccagcaattccaagaggacatgccaacagaattgcaccacgggaccacagaggtgtaattgtctccccgtaaccacacaatccctcatgcctcgccgcagcctcgcctctgtgggaagaccctgaacacagcctcgccacaggttacagccccaaggcagccaagaaaatgcacttgatcatgtgaggtccctttatttaaaaaaaaaaaaaaaaaaaaaaaagaattatggtacagggaaggattaacacagcaaagtgaacgaggttctctcaccagttttttaaaacaggaagacacagacataatgtttctaaaataaaatgctagacaatgaactgatatcaccaatctcacaccatgttcaaataaaagaacatccaaaccaagattcaggcctccagatgaacacatctgcttggaaggaatcatccatacctgtttccctgactctagtgagtcaaaactatcgcagctctcctctgacgagagggtttccatgggaacatcatctcggaagccaacaaactcttcatcatcactgggggcgttaaagatgtcagccacttctttagggatctgttttggattcaaaagaggcaggattaaaccaggggttcttgctaatcacttagggacattttctggaggggaggagagatctcatcacttcatccaactgccacggttgcccagaagtccccagtaaccctcagcaaaacactcttcagctaagaactcatggcaaaataaggtgtggggtgggtgggggagataaaacttaaaattctagatatacaccctattttacagagaatgttaaaaccaggccagagagaagacatgtttgatctcttgacaaaaagaaaaattgtttctaagaaccaatgatctcttttttctcctacagtggatgcatctttaaatgtcatctacataaaaaagatgccataaaatatcattaagcacttttcttaatgttcacctacactatttatttttctcttctttgtcataggctgattcagaaagtagaaagttcatacaatgaaataagtagcttttcttcttttctatattgtaagtcaacttaagtagctggggattaattctaacagaattcaaatgctattaggggataattgatcccagagagaacaatgtcagcacacttaatccacaaatatgtatctgctggagttcatttttgtaagttgactattttctcccaattctttgttttaaaaaagttcaaacacacagaaatgtgaaaaaatagtacaaacacctgttgattctttatctagacccattattggtcactgcatttgctttctttctctgtttcaacaaatattaggttgaaccatgggcatttgctgatatttggctgtttttaacttaggaaaatagcaatttaatatgagccaacctaatccatatattcccacacattgattaaagtaatttgcaaacattgtattgattggcccgaatataattcagcacatatctcccacggataaggacattctcccatagaaccacaaaaccataattgtaccgaaaataattaacattaattcaatagtacgatttactgtaactctatattttaatatctgcaactgttctatttgatttttatgacactgttttttgttgtttttcacaacactgactttctttttagatagaccatgacaactgccttgtagaatgtcatgtattctgagcttatctgagtgtttcctcatgattagattcaggttatgtatttttgtcaccattctacataggtgacatgtactcctcaatgcattgcataagggggcacaaaatgtcaagttatcccactattaattagtaatttttaaaaaatttttcattataaaaactttcaaagatatttcaaaagtagatgggaagatattgtaatgagcacacattgatcctccccgtaattatctgcccaaggctaactgtgcttcccctggatcccgacccaactccccttcttctaaattattgtgaggcaactgtagacatagtatcatgtcactctgtatcatcatcaaatgtgcagtctgtattcacagttcttctgcctcattttttaaaaacttagtttatctgcatcatgatccaaataaggttcacactgatcaacatggctcttaaatcccttctcatcactcctttatctcttttctcttgcagtttatttttgaagaagctgggtcacttgactgtggagtctgtccaagtctgaagttttattttttttgcatccccaaggtggtgtttaacagactcatttgggtttacaatttgggagttgaatccggaggctttacttctagttggcttgcttttgccaagactactttttaggaagtgctatgttcttcctttggaaagcacataaggtctggctgtctctttttttagtgatgttgctgtttggtcaataagttaaggtggaatcagcctgatttgttcttcgcttttaaaacaaaacaaaacaaaaaacaataacaacaacaaaaaacaccctttctcctttgtcactaataaggaatatgcagagtgagacttgagattctgtgaatagcctccctgataacatcttgctcaacagtttcagcgtccattgacaattctttttttttatattttttattttaataaagacagggtctatgttacccaggctggtctcaaattccttgcctcaagtgatcctctcacctcagcctcccaaagtgctgggattacaggcatgagccagggcacccttgaatgaattattacattagggactgcaaaagagaaattttcagattttctctctccttcacaaagtagctggcattcttgtataatatagtctttctctcactctcccccttttcttctaccatgtatatccatggatttctaaaaattattattaaatgtgttataatccatactctcataatgctgactgtcccaaatttggccattgggagcttcttggaaagtcatcctctgtctttctgacatggcactaagggtctttcaacacctccttgctttctgacacaagcatggcaagctaaccttgtatgtttcctgtcccagacctcaaatcagccatttctccaaggagccctgaaacctttcactgggaaatggcatttaaaaaccaagctcggagaacacaatgcatctcggttaattaagtatcactgcttgtaggctctttggacagagcaaggatattttaaataggtaaatcacaagttcatggtgacaccctgaattcaaatccaacacggaggcttcttcctctgctccctcatctctccctcatctcacattagcatcgccgttccaccacaaggaaaaccctcgattcccaaaatttttaatatacttatccatgtggtgctctatctacaataaacacaaaatagcgccaaactgacgccaccaatatactaccaacaacaaacagtgcagttcaagatttctttgcagttctttctagccctggaacatagtctcactatacacaggatcttttccttcagctaaccagatgatcattgtacatggttatgcaaaaatgtttcacatgtacttcccatttcatcatgcagtatattaaaaagatgtccttaacagttgagacttaataatttttactgtttcatcagaacattcttatgtgaaactgacattttctttttaaattgagtgcatggaggtgaatgcaatgactactaatacagtttgttgctaccacctggattcatgctaaagatcagcagttttctccactttggcttttgcacaatcagtgcaaatatcaacacagcaaaaagggcaaataatcttagtattattatgacattacattcgccctcatggacccgtgaaagggtctcaggtcctccatctcacactttgaccactgcactagcatatacagagttgtgtattcaaaagctacttagcttcgtggaattctctgtgtgggtgtgttgacttaattttacatttagtcaggttccatttaggaaactggtaatccttaatctatttactttcatccttattttaatgcttcttgattaaaaataattagaaaataatggttcaatcaaaggaagtgtaacataaatacagaaatgggataccccaagttcagtgatgctgaagggttaatacaaacactttcccaccatctaataaaatcactgcaagggacaaacaagaacaacacttacagaagtagagttccactaacaatttttttaccagccacacgtagtgcagcactagcaaagcctaactctgacatcattcttggggaaaatattgaaacttttctcaaggaggtatgttaaacaatgtttgccaccttatcttttcaaagacaccttttgttgttgtttagcactcagaactaatacgcaaggaaaacacccagactagagaaacacagacaatacttatgaaagtgtgcctatgttgtagctacataatagccactgagttcagtccctgcagaggcactaagagggacagtgtgtcaatttcagtctttttcttttggccttctcaccattctacaaaattcaaacagccctgctggcccagaagcttcttttaacataaatggtttaaaggaggaggagcaccccatttatggatttaatggaaatacatacaaggaatggagagggttggtgataggaataaactgcttccagcagcaactgcattagtccctgtgctattgtgttcagccccaccactgctgcgagcctgtgtctgactagctaattcctccttctgcatctttgacttctgcatctgctccagaggtaccattagggggctataattactgattaggaacaaaaggaaagagcacactttcaaaaaaacggtgtgcattcctggggtacgcagggctctgatccttcaaaaggtattaaaagagtttcagatagtcacaagcttcaagatttgccaaaaaaaaaaaaaaaactgtaaaatattcaagtgtcctcaatgcaacgaactgatttgtctaacagatgcaacaaaggcagcaagatttatatgagaaggacctgatagaaaggatacacagggacctcttctaatgaatgaccagttccacaacacagtgatacattaggcccaaggatctgtcactttcctgttccattcagcagcgatccactgggtagctgcatagtctagacaaaaatgcaagacctttttttttttttttcaaagtttgtgttccattctattacaataaagccaatcataagactcaccaaaaagaaaactacaacaagtaactgaaaacaacaaaaatacaaaatttctcaatcaatggatatttacattagttgaacttctgaattaggataactactatctagtgaaccaaaaaaaaaagggaaaattctcatctgaaagtgaaaagaccgtttcattatttataatacttgttaaaaatcgacaacttcatgctattcctttcatgtacagtttctgtttgtctactctgtctttattggaattaacagtgtgaatatcatcaaaagtcatatgggggaccaggattcaattctatgagaacacaggtactagaatggaatccacaggcacctaacatagagcccagcctaaagcagatgatcaacaaacccttgctgaaagcatttacatgcatctgactttgtagccattttcttaagaaaggtgtattttactaggaaaatactaagtcaaaaaggtacactctgtgacattcctacatgaggggaattaaaaattttcacccagaatcctaagacatctttctacaaagcagtcatattcacagctcccctttcagaaaggactgcaggtttcccttataagccatacagattacctgagagcttttctctgaaatacattatgccaactcaacaggctttggggccaagcaggtgggtaacagggcagtaggtcagctgtaggacaatatgggatggtgctgactggtaggctgaacacatatatcagggaaggcaggccactcctccactccagctgatcactgccctgcaggaacaggggtctggtgtgtctgacctccaacattcccagagaacctgagaatctgagtgttggtaagaaacttcccatctacagactggatctcaaacttgttcagggaacatgcacggtggaactcatagggctctgtgggacaccaaggaaactgcaaatgccagaattccaaatattaccaacagtattaatatatctactagtgcctagtagtaatagtagagggcatcaaagtgttaagaagattaagaaaaactttatatcctttcccttattcatggcatcatgattcacaagagccaaaaggtggaagcaatccaagtatccatcgatggataaatggataaacaaaatgtgagacatacatataattgaatattattcaacactaaaaaggaaggaaattatgacacatgccacaacatggatgaactttgaagacgttatgctaaatgataataacccagtctcgataaaaccaagaacggtatgattctacttataacaggtacctagagtggttgaatcctcggagacagcagaatggcacttgccagatgctgaggggagggagaaacgtggagttactgtttaatggatacagattcagctttccaagatggaaagagttttggaatttaaatatgcttaacactactgaaccatacattttaaaatggctaagataggagattttatgttatatgtatcttagcacaatttaaaaagaattcaacgaaaaaagacaagaaagacaatttaagccaggcatggtggttcatacctgtaatcccagcactctgggaggccgaggcaggaagatcacttgaccccaggggtttgagaccagcctaggcaacatggtgagaccccgtctctaccaaaaaagatacaaaaatcagctgggttgtggtggcgtgtgcctgtagtcccagctactcatgaagctaaaatgggaggatcggttgagcccatgagttagaggctgcatgcagtgagctatgatcataccactacactacagtcagggtgtcagtgagaccctgtctctaaaagagaaaaagaaaaaaagaaaaaccggggtagaggggaatttttccttccttaagtgaatgaaatcttccaaactgacagaacaagtccagaccttagcctagttttaatggtaccatcactttaggggcatgtggcttaagaacccaactctctcacctaagggaggttcagatacatcattgtaggtgccaaggcttcagctttagtgtctgaccaaccaggtatctgagcctgtaagcccattagttaactgatagtctggaggacaaagctgtttgcagaaccacacttggctgaaatccagctttgttctatcccagctaagctatactaataaaaataaaccctgctgagttgctgctggcttctcgttgagtaggtgcctttcaggcatacaaagcagtgctctggaggtctccataccattttgacctttgtcagcctgagtctccattaaaattcaatttaaaaaactaataagctataaaaagatcatcaaactgtcagttggtattcaatcaagtatttacctttgaaaatattttaacgtgaagtattgttcatttaaaactttatattgtgaaattaagtataatattttttaaattaaagcttttccataactcaatgatatctaaattcatccttcctggattaaaaaatacaacctcctacccagaaggaacacatttatcagtattagtttttgaagagaaagaaaataagattcactttttaggccaactgatacaagggctgattctgatatactccaagaatattcagtgtacatttcacctagaagcaagctctattttaagatttaaaaagcagacaaaagatatttatgcacactactgcattttccttattaagtgttttgaaagcaattttgatagcaatgacagcagaatttgcaaggtgtactatcttgcatctatgaaaagagatctacacagaggagagcattccttcctctttaacacaccacgaagggcgagaactgttattttcttatgcaaaatcatttctttgaattttttacaaataaatttgttggcccataagaaaagtacataccatgcaccaaccacaagaactaactcaaaatggatcacaaacttgaatataaaactataaaacttttagaagaggagaaaatctttgtgaccttaagttaggcaaagaattcttaagatacaacaccagatacaacacaatacagatctttaaaatgtgtaaagtaaacaatcaaaattaagaacttctgctcttcagaaaacaccgttaagagaatgaaaaggaaagccacacactgggagaaaatatctgcaaatgctgtctctgatttgcacccagaaaatataaagaattctcataattcaataaaaagaaaacaaataaatcagatggtcgacgagttaaatggtaaacaagcacaaaagagaattaaattaacacacacatgcatctgacctctgaatggggaggactttcaccaatcacgtaaaggagaccaaaatggaaaagtagatcactgaccatgtaacagtttaaagcttgctacttaaaagaagaaaattcagaaacaaaaacaaacaaacaaacaaaaaaaggtagggcaaagatctgacaaaaatatgacaaattattaaaattgctaaaaacctcatacaaaatgaaatatataccatggccacacagacaaaatggcaaaacaaagaaaactcactagggaaaacaaaagaggctaaaaacactttaaaagtcctcagcctacctagtaatgaaaagaatggcaagtaaaacaagtattcttttcatctagcaatttagcaacattttgcttccatttttaagggcatgctcaatgatggggaaggtgtgaggagacaaacacttctatacagaactggtatgaggacactgaacccaaggcttcagaaactaagtaccatcatatacatctaaaatagggcagttaatttttaaaaaattaaatacagtgcaatttcaagactgccaggaaaatgtagctaaactcagggtgaaggcgtatatgaattactattagcagttaagagaatcataaaatcaaggattatcaggccaagtgtggtggctcatgcctgcaatcccagtgctgtgggagaccaaggcaggaggatcacttgagcctaggagttcaagactagcctgggcaatacagcaagactccagctctacaaaacataaaaaattagccaggcatagtggcatgtctgtagtcccagctacttgggaggctgaggagggaggattgattgagcccaggagttcaaggctgctattagctatgatcctgccactgtaacagaggaagaccctatctcaaacaattaaagaagaaaaaaaaagatcatcagattgtgatgggatctcatccatcagtttgtgcttcatataatgggagtgacagccagacacagaggcacacacctgtagtcccagctacttagatggcctaggcaggatagcttaagtccaagagttcaagttcagcctgggcaacaaagcaagaccctatctctataagaaataaaaataaagtaaaattagggcaaccacagttagacttactcaaaggcatgtagcttgttagtgtccttacattaaaaacatttccaagcatctaaataagaaaacgatctgtttttctataactatatattaattagtattcagcagttaataaaaaaaatacaaactcatgttaacaccaacagcacaagcaacaattcgaggaaaataataaactggaattcatcaaaattaaaaactgttgtgcatcaaaggacagcaagaaagtgaaaagaaaaatctgcagaatgggagaaatagctacaaatcatgtatctaataaggatctactatctagaatatataaagatttcttacaactcaagaaaaaggcaaacaaccaatcaaaaaataggtgaagaatttgaacagacctttctccaaggaagctatacaaatgacaaacaagtacataaaaatacacacatcagtggtcattaaggaactgcaaaccaaaaataggtaatactggctggatacagtggctcatgcctgtaatccaagcattttggaaggctgaggcaggaggatcacttaagctcagttctagaccagcctgggcaatgtagcaagaccccatctcaaaaaaaaaaatgttttttaattacctaggcatgatggcacatgcctgtagtccctgctacttgggagcctgaggcaaaaggagctcttaagcctgcgagtttgaggctgcagtgagctgtgatcaaggcactgcattttagcctgggtgacagagcaagaccctggctcacaactaataataataacaataataataaagacattgaatagaagccatggggagtggaaaaaagccacacacaggtccaggcaagacagtatgttcagaaaagatctaagatgatcttcagttttcagggtcagaacatacccagccaatcttttaaagatttccctagcacagagtcagtctgcaaagactggaagaggtggccacttctcgaatatttaattctcaacaaaagaacaaagacatataaaaaagaagaaaaacctggcccattcaaagaagcaaaattaattgacagaaactttcccagaggaaaacactggacttactagacagacactggacttactagacaaagaaaactatcctatgctgaaagaacaaaaagcacaaagaactaacgtgaatctggaaaacgagcaaaatgagcctattaacaaagagaaatgaagaaggactccaacagaaattatggagctgaaaaaaatagaatgaccaagttgaaaatttcactagagtggtttaaaaacagatttgaggaggcaggcaaatcagcaaatctgaagataatgcatttgaaaatactgagtcagaggagaaaaaaattagaggagaaaaagttaaaaagaatacagaagagtgaaaacagcctaaactacttctttaggcacaccaatataggaatgatgggagactcagaaagaaaacagagagaaaaagagacaaagattatttgatacgacagtggatgaaaactccccaaactggctgaaaggcatgaattggaatacatcccagaagctcaaggaattccaagtaggacaactcggaagaggtcctttcaaagacaccatataatcaaatattaaaagcctaaagacaatcttgaaagtagtcacatacaagtgacactcaacaagattatcagctgttcagccccagtcaggggtttacagataaaacccccatctccctgggacagagcacctgggaaaggcgtggctgtgggcccagcttaagcagacttaaacgtctctgcctgccagctctaaaggagcagcagatctcccagcacagcgttcaagctctgctaagggacagacttgccttctcaagtgggtccctgactccatgcctcctgactgggagacacttcccagcaggggtcaacagacacctcatacaggagcgatccggctggcatctggtggttgcccctctgggatgaagcttccagaggaagaaaacaggcagcaatcctttgctgttctgcaacctcgcaaacggtctggagcgggcctccagcaaactaactccagcagacctgcagcagaggggcctgactgttagaagaaaaactaacaaacagaaaggaatagcatcaacatcaacaaaaaggacttccactcagaatccccatccgaaggtcaccaacatcaaagaccaaaggtagataaatccacgaagatgaggaaaaaccagcacaaaaaggctgaaaattccaaaaaccagaatgcctcttctcctccaaaggatcacaactccttaccagcaagggaacaaaactggatggagaatgagtttgatgaattgacagaagtacgcttcagaaggtgggtaataaactcctccgagctaaagaagcatgttctaactcaatacaaggaaactaagaaccttgaaaaaaggttagaggaattgctaacgagaataaccaggttagaaaagaacataaatgacctgatggagctgaaaaacacagcacgaaaacttcatgaagcatacacaagtatcaatagccaaatcgatcaagcagaagaaaggatatcagagactgaagatcaacttaatgaaataaagcatgaagagaagattagagaaaaaaagagtgaaaaaggaacaaaaaaagcctccaagaaatatgggactatgtgaaaagaccaaatctacgtttgactggtgtacctcaaagtgacgaggagaatggaaccaaattggaaaacactctgcacgatattatccaggagaacttccccaacctagcaagacaggccaacattcaaactcagaaaatacaaagaataccacaaagatactcctcgagaagagcaaccccaagacacataatcatcagattcagcaagattgaaatgaaggaaaaaaggttaagggcagccagagagaaaggtcaggttaaccacaaagggaagcccatcagactaacagcggatctctaggcagaaaccctacaagccagaagagggtggggtcaatattcaacattcttaatgaaaagaattttcaacccagaatttcatatccagccaaactaagcttcataagtgaaagagaaataaaatcctttacagacaagcaaatgctgagagattttgtcaccaccaggcctgccttataagagttcctgaaggaagcactaaacatggaaacgaaaaactggtatcagctactgcaaaaacataccaaattataaacaccactgacactatgaagaaactgcatcaactaacaggcaaaataaccagctagcatcataataacaggatcaaattcacacataacaatattaatcttaagtgtaaatgggctaaatgccccaattaaaagacacagaccggcaaattggataaagagtcaagacccatcggtgtgctgtattcaggagacccatctcacacccaaagacacacataggctcaaaataaaaggatggaggaatattatccagcaaatggaaagcaaaaaaaaaaaaaaaaaaaaaaaaagcagggattgcaatcctagtctctaataaaacagactttaaaccaatgaagatcaaaacagacaaagaagggcattacataatgctaaagggatcaatccaacaagagcagctaactacactaaatatatatgcacccaatacaggagcacccagatgcataaagcaagttcttagagacctacaaagagacttagactcccacacaataatagtgggagactttaacacgccactgtcactattagatcaaagagacagcaaattaataaggatattcaggacttgaacacagctctggaccaagcagacctaatagacatctacagaactctccaccccaaatcaacagaatatacattcttctcagcaccacatcagacttattctaaaattgaccacataactggaagtaaaacactcctcagcaaatgcaaaagaacggaaatcataacaaacagtctctcagaccaagtgcaatcaaattggaactcaggatgaagaaactcactcaaaaccgcacaactacattgaaactgaacaacctgctcctgaatgactacagggtaactaacgaaatcaagacagaaataaataagttctttgaaaccaatgagaacaaagacaacataccagaatctctgggacacagctaaagcagtgttgagagggaaatttatagcactaaatgcccacaagagaaagcaggaaagatctaaaattgacaccctagcatcacaattaaaagaactagagagtggccgggtgcagtggctctcgcctgtaatcctagcactttgggaggccgaggtgggcagatcacgaggtcaggagttcgagaccagcctggccaagatagtgaaaccctgtctgtactaaaaacacaaaaaaattagctgggcgtggtggcgggtgcctgtaatcccagccacttgggaggctgaggcaaaaagaatcgcttgaacctgggaggcggaggttgcagtgagccaagattacgccattgcactccagccccggcaacagtgcaagactccgtctcaaaaaaaaaaaaaaaaaaaaaaaaaagaactagagacgcaagagccatcaaattcaaaagctagcagaagataagaaataactaagatcacagcagaactgaaggagacagggacatgaaaaacccttcaaaaaaatcaatgaatccaggagttggttttttgaaaagatcaacaaaatagaccgctagccagacaaagaagaaaagagagaagaatcaaatagacacaataaaaaatgataaagggggtatcaccactgatccaacagaaatacaaactaccatcagagaatactataaacagctctacacaaataaactagaaaatctagaagaaatggataaatttctggacacatacaccctcccaagtctaaactaggaagaagtcaaattcctgaagaccaataacaagttctgaaattggggcagtaattaatggcctgccaaccaaaagagtctaggaccagacagatttacagccaaattctaccagaggtacaaagaggagctggtaccattccttctaaaactattccaaacaacagaaaaagagggaatcctccctaactcattttatgagaccagcatcatcctgataccaaaacctggcagagacacaacaaaaaaagaaaatttcagaccagtatccctgatgaacgaagattttcacattggcaataaaatactggcaaaccaaatccagcagcacatcaaaaagcttatccaccaggatcaagttggcttcatccctgggatgcaaggctggttcaatatatgcaaatcaataaacataatccatcacataaacagaaccaatgacaaaaaccacatgattatctcaatatatgcagaaaaggccgtcaataaaattcaacaccgattcctgctaaaaactctcagtaaacgaggtattgatggaacagatctcaaaataataacagctatttatgacaaacccacagccaatatcatactgaatgggcaaaagctggaagcattccctttgaaaaccagcgcaagacaaggatgctctctctcaccactcctattcaacattctgattcttcctatccgtgagcatggaatatttttccattttccattgccagggcaatctggcaagagaaagaaataaaaagtattcaaataggaagagaggaagtccaactgtctctgtttgcagatgacatgactgtatatttagaaaatcccatcgtctcagccccaaaactcctcaagctgataagcaacttcagcaaagtctctggatacaaaattaatgtgcaaaaatcacaagcattcctatataccaataatagagagcaaaatcatgagtgaactctcatttacaattgctacaaagagaataaaatacctaggaatactacttacaagggaagtgaaggatctctttaaggaaactacaaaccactgctcaaggaagtaagagaggaaacaaacaaatggaaaaatattccatgctcatggataggaagaatcagtatcatgaaaatggccatactgcccaaagtaatttatagattcaatgctatccccatcaagataccaatgactttctttacagaattacaaaaatctactttaaatttcatgtggaaccaaaaatgagcctgtatagccaagacaatcctaagcaaaaagaacaaagctagaggcatcatgctacctgatttcaatctatactacaaggctacagtaaccaaaacagcatggtactggtaccaaaacagatatacagaccaatggaacagaacagaggcctcagaaataacaccacacatctacagccatctgatctttgacaaatctgacaaaaacaagcagtggggaaaggattccctatttaataaatggtgctgggaaaactggctagccatatgcagaaaactgaaactggaccccttccttgcaccttgtacaaaaattaactgaatatggattaaagacttaaatgtaaaacctaaaaccataaacaccctagaaaaaaacctaggcaataccattcaggacataggcaggggcaaggacttcatgactaaaacaccaaaagcaatggcaacaaaagccagaattgacaaatgggatctaattaaactaaagagcttctgcacagcaaaagaaactatcatcagagtgaacaggcaacttacagaatggaagaaaatttttgtaatctacccatatgacaaagggctaatatccagaatctacaaggaaattaaacaaatttataagaaaaaaaaaaagaacaacttcatcaaaaagtgggcgaaagatatgatacttctcaaaagaagacatttatactgccaacaaacatatgaaaaaaagctcatcatcactggtcattaaagaaatgcaaatcaaaaccacaatgaaataccatctcgtgccagttagaatggcgaacattaaaaagtcaggaaacaacagatgctggaggggatgtggagaaataggaatgcttttacactgttggtgggagtgtaaattagttcaaccattgcagaagacagtgtggcgattcctcaaggatctagaaccagaaataccatttgacccagcaatccattactgggtttatacccaaaggattataaatcattctactataaagacacatgcacatgtatgtttattgtggcactgttcacgatagcaaagacttggaaccaacccaaatgcccatcaatgatagactggataaagaaaatgtggcacatatacaccatggaatactatgcagccataaaaaaggatgtgttcatgtcctttgcagggacatggatgaagcaggaaaccagctaaattatcagcaaactaacacaagaacagaaaaccaaacaccacatattcttattcatagttggcaggtgaacaatgagaacacatggacatgggaagaggaacatcacacactggggcccgtcggggttgggggactagaggagggatatcattaggagaaataactaatgtagacgacgggttaatgggtgcagcaaaccaccatggcacatgtatacctatgtaacaaacctgcacgttctgcacatgcatcccagaacttaaagtataaaaaaaagaaaaaaaaagattatcagccgttttatcacagaaaccttaaaggtcagaaagcagtaggatgatttatttgtaacatatttaaaatgtagaagggaaaaaaactatcaaacaagaattctccatctggttaaaaaaaaaaaactgcccttcaaaaatgagataaaaattaagacattcccaaataaacaaaagccaagggaattcattactactggcatttgcaacagaaaatgctgaaaggagtacttcacatttacatgaaagtcactacaccgtaactttgtcaaagccatacaaaaatataaggttctcaggtaaaggtaaatacatggacaaatataaaaactagagtattattgtaaatttggcttataactctacttgttattttctaaaggattaaaaatacttacgaatctgttcatggatacacaacacataaagatgtaattcctgatctcaattacataaaatgatggaaaaagagctatataggagtagaatttttgtatgtcgctgaagtgaaattggtatcattcaaaccagattgctataactttagaatgttatatgtaatctccatggtaacacaaaaactatctaagaagaaaaggaaatgaaatgagaagagagtcaaaatgtgccaatactaagcaatcaactaaactcaaaggaaggcaataacagaggaaatgagggacaaaaaagccataggatatacagaaaacctatttcttaaatcacaagattaagtaattccccaccagtaattactttaaatttaaatgtgttaaactccaaatcaaaagaaattgactggcaggaaggattttttcaaaataggatacaactctacactatctacaacagactcactttagatctaaagacaccaataggttaaaagtaaaaggacagaaaaagatactcgatgcaaataataaccaaaagagagatggagtggctatactaatatgagacaaaatagtcaaaaactgttgtgaaagacaaagacattacagattgataaaagagccaattcactagaagatagaacaattataaatatatacacacaccaaacatcaaagatcccaaatatatgaagcaaacactgacagaactgaatgaagaaatagactgttctgcaacaacagatagaaacttcaacaccccactttcaacagtgaacagaacaagacagagcaataaggaaacagaagacttgagcaacattataaaccaactaaaactaatagcactcaacccaacaacagaataaacacttttctcaagtacttacagaaaattttccaggacacactatatgttaggccacaaaacaagtgtgaatatatttttaaatgactgaaataatactatcctttgttacagtagagtgaaactagaaatcagtaacagaaggaaaaatgaaaaattcacaaatatgtggaaattaaataacatattcctaaacaaccatgggtcaaagaagacatcacaagggaaattagaaaatactttgaaacaaatgtaaatgaaaacaaaatttaccaaaatatatgggatgcagcaaaaggcactgctaagaggtaaatttatagctgtaaacacaataaaaatgaagatctccaaccaaaaaacaaaccatacacattaggggaacaggaaatgtatagcacaccaaacccaaagttagcaagaggaaggaaacaaagattaaaacagatatgaatagaatagataatagaataagagaaaaatcaatgaagccaaaagtttattctttgaaaaaaaaaatcaacaaattggcaaatcttaagctacatgactagaaaatatacagagaaaactcaaattactaacgttagtaatgaaattggacattactaccaattttacataaataaaaaggactggccaggcgctgtggctcacgcctgtaatcccaacactttgagaggcagaggtgggtggatcacaaggtcaggagttcaagaccagcctggccaagatggtgaaaccccatctctactaaaaatgcaaaaaaattagccaggcttggtggtgggcgcctgtaatcccagctacttgggaggctgaaacagagaactgcttgaacccaggaggcggaggttgcagtgagccgctactgtgccactacactccagcctgggcgacagagcaagactccgtctcaaaatgaataaataaataaataaataggattttaagagtactataaacaaccgtatgccaacaaattggattatctagatataatggataaatcccgagaaacaaacaacctagctagattaaattatgaagaaacagaagatctgaatatatttgaaataaggattttaagtagtaatcaaaaccctcccaacaaagtaaaccccaggacaagatggcttcatgggtaattctaccaaacatttaaagaagaacaaacaccagtctttctcaaagtcttccaaaaacttgaagaaggaggaacacttgaaactcattctatgtgaccagcattatcctgataccaaagccagagaaagatactagaaaactatacagccatatctcttacgaatactgatacaagaatactcaacaaaatgcaggtaaaacaaattcggcagtgtagcaaaaggattatacaagatcaccaagtggcatttattctaggaatgcaaaatggttcaaacacataaaaatcaattaatgtagtacaccctatgaacagaataaaggggaaaaacaaagatcatctcaactgatgcagaaaaacatctgacaaaattcaacacccttccctcatcagaaaaaaaaaaaatagaaggaaacttaaactcaccaacataaggctatatacgaaaaacccgcaactaacaagatactcaatgatgaatggaagattgaaagcttttcccctaagatcaggagctagacaaatatgcctgcttttaccacttctattcaacgcagtattgggaggtctagccagaccaatcaggcaagaaaaataaataacgcatccaaattggaaaggaagaagcaaaatttatctctgctataagagacgtgattatatatgtagagaacactagagattacacaaaaagtagttagagctaacaattagacattgcaggacacaaaatcaacacaaaaatcaactatgcttctacacactaacaatgaacaattatgaaaattaagaaaacgattccatttacaatggcatcagaataataaagtacttagaaataagtttaaccaaaaaggcgaaaaaagccttgtacactgaaaactacatccccgaaaaaatcaaggaagacaaggaaatggagaaccatcccatgttcatggattggaaggcttaatataaggtgacaatactaactgaagctatgtacagactcaatgtattccttctcaaactctcagtgacttctttcgtaaaaacaaaagtccatcctaaaattaatgtggaatctcaaaggaccctaaatagccaaaacaatcttaaaaaagaagaacagaccaggcgcagtggctcacacctgaaatcctagcactttgggaggctgaggtgggcagactgcctgaactcaggagtttcagaccaccctgggcaacatggtgaaaccccatctctactaaaatacaaaaaaaaattagccaggcatggcagcatgtgcctgtagtcccggctactcgggaggctgaggcaggagaattgcttgaacccaggaggcagaggttacagtgagccgagattgcaccactgcaccctagcctaggtgacagaacaagactccatcccttaaaaaagaaaaaaaaaaaaaagaacagtgttagaggactcacatttcctgacttcaatacttactacaaagctatagtaatcaaaacagtgtggtcttggcataaaggcagacatatatatcaatggaaatgaataaagagcccagatacaaacccttgcatatacagttaactaattttcaacaaggatgccaagaataatggcaaagaacagtattttcaacaaacagtgctgggaaaattggattaggttggacccttaccttaagccatctataaaaactaactcaagatggatcaaagatctaaatataagagctaaaactataaaactcatggaagaaaatacaggggaaaagtttcatgacactgaatttggcaataatttcttggatatggcaacaaaagaaaaataaataaactagacctcaaaattaaaaacttttgtgcaaagggcgctatcaagacagtgaaaaggcaacctatatagaatgagagaaaatatttgcaaataatatctaataagggattaatatccaagatatataaataactcacttaacaactacaaaaacccagttaagaaatgggcaaaggacttgaattaacatttcttcaaagaagaggtacaggtgaccaacgggcacaagaaaaaaattcttaacatcactaatcattggggaaatgcaaaacaaaaccacgatgagataccactttatgcacattagaatggccattaaaaaaaaatccaggaaagaactagggctggcaaagacgtgaagaaattggaacactcgtgcactgcttatgatgatataaaatgacacagccactgtgccaaacagtatagtggtttctgaaaaaattgaatttagtattatcatataacccagcaattctacttttaggaacacacacccagaacaactgaaagcagggactgaagcagatatttgtatgccaatgtttattcattggtatttacaatagccaaaaggtggaaacaaccgacaacataaatagatgagtaaataaagatggtatgtacacataagagtattattcagactttaaaagaaatgacgtcaggcacagtgtcttatgcctctaatcccagcactttgggaggccaagacaggaggattgcttgagcccaggagttcaagaccaacctgggcaacacagagactccatctctaccagaaattttaaaaagaaaaattagccaagcagggtagtacatacctatagtcccagctactcaagaggttgcagtgggaggatcacttgagcccaggaggtcaaggcgcagtgagccacgatagcaccactgcactccagcctgggcaacagagtgagaccctgtctcaaaagagaaataattgaaaaaaaattctgatacatactataacatggataaactttaataacaatgttaagtgaaatgagccagtgacaaaaggacaaataccatatgattccactcatatgagatacctaggatagtcatatcctcagagacagaaactaaaacagaagtaaccaggggctggaggaagaggtcataggggtaattgtttagtaggtagagagtttcagtttaaaatgatgaaaaagctcatgagagatcagtgatggcggcacaacattgtgactatacttagtaacactgaaaggttaaaaatagtaccttttattatgtatatcttaccacaataaaaagccccacagggtagtcaatgttatgtttaaaagagaagaaataaatgggaagtcattttagatatgtatttacacaggtcttagaagagctattcagcagatgagtacctaatgaactggaattttggcagagatcctgggagtgaagtgaaccaaatcacttgggaagtgtgaagtaatttcctcctccagggaggtcagcagatagaacatgtgaagccaatgttaagatttctctggagtctaaaagattatcaaattggacaagtctgttctcagtgttttccaacaaggtgcaactgacgttttggacagaacaactgcttcatcctgtaggactctcctgcctgccacatggtacttaatacccctgaactccaaaccacttaccaggggcattcccctcaccctcatcactctaacaatcaaaaagaaacccacccacgtttgttaccacgactaccatgaccccagatcactcagatgacaaccacagagtgattgaatccaaaactgaaataggagcaccctggtctgttaggatatgacaagctataaagcagtagcaaacaaccctaaatctcaatcaatagcttcaaaccaaaaaaaaaaaaaaaaaaaaaggcttccgtcttgttcacattacatgtccatcacaggccagcccaaggctctattccacactgtcctcacaccagaacctgggctgatagagctaccactctgcagaatgctgacagatgcagtggcagagggaatgagatacagtaagtggtatgctggcatttaaataattcacttagaagtgacatatagtacttctcatattccactggccaaagcaagtcaaatagccttgactgtttcagggccaggaaagtgcaaccctacaccacttacctggaaggaaaagaaccagccctgatgacttccaaactatgcctgcgaagtgctctgaaaagtagaaaacgctatataaatgttaattaaaagagtatattactaacaatactactttgcccttccatccattcaatggatatttattaggcatctaatacatgctggacatcgtctcctaagcatcaaatatatgccagacaccatgctaagagagctgatgaaaactgagtcgtaagtggtagggtaagagaaacaatctttaaacaattccagtgtggtatgataaatgtgatcagggaagtcagcccaggtactccagaagttcccagggcgagcacctgagccagcggtgggggcaatggatgggaagacttccaggagcagtaacctacatagctgcaggatgcagtcaccctggagaacctgctgtagatgcacaggtggaagcatgaatgtgggcgctgtggatggggtgtccctgccttccgccaagtcaatgagaccaacttgccacaaattccccatagccctaatctgcagtcacttccactaaatgtccactgacacatttataggttttcttggttttctaggcagaccggatgtaaagaacagatttctgggactactctccactttccccccaactagaacattctatgagatgctctaagttcaaggagacaacattctttcagtccagttatcataagcttggttctaacctcagcaaaaactgctttctttcagctaatatagcgcaacaaaaggggaaatgccctaggaaaacaatgtgtcagaggctcctaaccattgaaaatcaggcacattccctttatgagatattaaatacattataaagagttattaaaaatagtgcagactccaacacaagccgtaagatatacagtataccaccctgagatatttatttcctctaataaagaaaaaaatattttttcaacagaaaatacataaaatacacatctagaaacactagacagtcactaaaaatgaaaactgtaaagatctctacgctactaggaaaagtaatgctgatagtgctaaggaaagcagattccaacagcaatcatactgtaaaggttagacaaagatgacgactgtgctacaggcaaacacttcatggaaactgcagaaaatggggcacggagagtaggggaagcagagaagtggttcagtgcagcttacggtaacatgttattgtttgtacaatgcaaatttcacataaaagtcattcctatgtaaaagcttggtggatcttattcacattcccaaactgacttttacaggcagtataaagcataatctggtgagttcctaaaaaagaaccagactagctgctgttaacactccagcccttctagttaaagggaggagggaacagggcaagtttcctgactcaccaaggcccggtgattccagcagcaagggccaattccttacaaattgccctgagcaaattagtcaatttagccttatctttaaaaggcagataacacaacctacttcacagaactacagtggggattaaatctgataacttttaagtacttagcacagcatgacttttaaaaggaagtgatagtttccattccttgggggcaaaaaaggatggctcttaaggtctccctctactctccaaacccaaggtcccccaggtccccatagcacagagcaggagccagctgagctctggcaaaagcagaagaggaagggagttcaagcatggccttctggtagagagtgtggggaaagaggcgtgttttctgtgtctttgttcttccaccctaccaatgcctagcacataaccggtgctcaactgactatctgatcagtgtactaacccagtcagcaagccctctatcctcagctgatgatcatgaaggaaaacaggcaggaaacatcaacgatttatttgaactaaagctcaggccccttgcactgtgagactccacactttatttctgtgctgcatgcagggtgctagcatttactactatggaagatacatttttctgagtgttaacttcagtggtatttaccaaatatgcctctgaatggtcctatttcaaaaaaactacagaaagcactgcttttcataaacaaaaagaacaaaatggccccagtagtattttcttatctctatccctacctactttaagtagcctgtaatctattccattttggtgaataaagccgagtcttttctaaaacaaaactgtatactggaggtaaatattctaaaacataactttgagtaaaggaaaactctcaagagcagtttaaatgtaatgcctggcttattctattccaatgatgttctaatctttttcattaatttactctaatgtttgtaattgttttaggccacaattatctcattgtttcctggcctgtgtacctgatcagaatcattatgatctctgaggttttcgcctgatttttgagaatcctgctctgctatggatggggtagccagcagaacacagaacaaccaaggagcgttttaaatacaagactattagagtggcaaatcattgtcctttctgtgaccagcttctggggctctggaattacatgttaaacaacaggatcagatgggagcactttgcagctaagagaccaataccagaaaaatacccctttaccccttcaacagcgtgctcctgcctatttacaagaacatttagcatcatttccttctcaaatgggccatcctgtactctggagctagaacagagtacgaggagaacactgacattcagtgcctaccagtttctctcctacggagctgcagcaagctggagctcccatgagctgcactgttgacagctcttagtcagggatcacacccttgcctttacgagctatttctgtcattttatataaaagcacaaagacacagtggtcagcacgacaagactacagcctgggggaagcgtaatcactgtcagaggacatcaaatccaacacactggtgggatggcaggaaagcagactcgaaagtagttcagagtaaatgagtctccttgtttgcttcttactcataacattaggcctaagctgctttgctgaaacacttagctctgcgctttccaagcgatagaaattatacttactccaatgtgtgagatgaaaacccactgcacactgagctgagcgacatttgatgtgcagtaatgccacttcaggtggttcatcacattgctttattcataaggctgggggacagggtggaaccacacgaatttaacatcttgctgtgcctgaaatgttcattaagtgttcttatccgcagtcacctgcccaccccacagaaccactctccactaatttagagactataatctgtgcacatttaaattacgatgaacaggaacatttccactggaaaaaccatcacacatctttgatttgcactgccaattaggtcttcagaaaaggaaaaaaaa

SEQ ID NO: 109 - DNA, 339434 bp, Homo sapiens
tcccagacctcaaacatattaagatggattttatcaattgtcccatcaacatttgcttctcatcccctgttccctttcttcatcaatgcttctaatctgatccgtttatctaagctatttctctctgacacacaggcattcagtgacttcacaaccactgcgaatcagcctctcctgtttctaccttccacataattgctctttgtcctactttctgttctttttctggaaaattatgaaaacttcttaaacaatcttggttcatttaactaaaataatctttaagaggtacagcaaggaccaaacaattttcttgccccttatatgttgaaccattttagggtgccacttagagggtcccgcacattttaaactctttgccctaaatgtacttaatttttcaaccaagatatacaatcagcctgtcctcaaattgcccttcttcaatttcaaaatcaggtctgctgcttctccccatgtagattgattgctaagtagccccccaaattttaatttattttatttcctctcatttacgttagtactttatccatatgtatgctaattatttaagaactacttataaaagtaatcaatttaaattttccaaggaggagttatcagagaaattgatatttccacttcttaagaaaaaccaaacaggagagggaggggtatagtcacgttgccccacaaagttggtctgccatctagtgacagctccatcacactacaagccttgtctttgacacctggagtctgaggctcggccttcaaattttcctcaaggaatgtgtcaaacagtccttttattccccctcggataacatactgtcataaggtaaaatattgcatattgcttaatttttatatgagattaaacactgtaaacaattaatttaggactaattatatagatcagagaaagggtaggatgtgaaatgttcatctgtgttaacgttgatcagtgaggcatatgggtctactttgaaagaagaaatgtagaggaatacctgaaagcttgaataaatctgtgagaaagtgtgagacattttttcttctgagctaacatacataacatacccagcagagtgatattaaaataataaacattgcttatctgaagcagcataggtttggaggcagtttgtcactgtcacctttgtgagttggagccgaatactcaaccattcaacatgaccactttcacatttgaaaacgtagggataacaatatctttgttgtcagtataagaaaaaatatatatagacacttcgttgagaagaggctcccaataaataagtgatagtttgtttttaatgattaccatccttttcacttctgatgatgtgtatggaaacacatatctaaatatcaagctttgaaaatctgttatttttagatcctcaatttgtttctttctcatagtgtggagtgcatgtgttgataggtatcattattttcagtacctggtgaaaggttacatgcctattcagtaaatatgtgaccaaaatgattacaaaataaattatccatattaggcattaaaagcttgtatctactataatgtaaaagtattttaaaaagtaagtggttcatacttacagctttccagttgcattatacatgtttgtacatccatgggaaaattcttgagatccattggacaggaaagtgttaatgttaatctgaaagtcaaagtaattatttttaaaggaaatttatgacattatattaatattctattgtacaggagaaacaatgttgctttgctggtgactaactcagatttaagtaaaaatttctccagcttatgtatcctacttactataaaatagctatgcccttatatacaaatctggctttggtgggctgggggttggataattgcatatcttaggctggtgctaaagtaatcgtgggttttgccattaaaagtgctggcaaaacagcaattacttttgcactaacctaaatataagcatcccgtcatatttatatatctatatgtttatttattcaattagaaagggctgtggatgtctagaaaatgtctgtattccaagacgacatcctcaaaagagaaattcaagagtggatcctataaaattaatgccaaacgtcaaaaggtatctttccttgcaaatcacatgctatattccagaggcattagagttctaaacgtggaaaagcagggtggagaggagcaatcatatgtaacgttcagtcatcattctaacgaccctgatgttgtcagtgaacattcagcagtgtatttagtaaagtgaatctggaggacttgaaaagttcggcctcatgttccccggtgtgggataagggaatcatcagggtcaggaaatagccctctagaatattcatgatctgattctatgctcatcaaacaaacttctgatttggcttcacacaaaggataacctagatgctgtataccagtattccgctcattggaaaggctctcctccaacttccagagagaattagtatgttgacattccagaaaattcatcacctttgaatactttttgctggaaaagcattctacccagatctcttcagggtagtttttctggttcctacacctgaggaagagatggtgagatccactcaagtttattcaaatgaagttcttttctgagaactctttagcaagcctcttgcactgagaatattcccattgaaattcagtgtcttcatgagcaccctaggtggattagtttacttaaacttcgtgaccctaggcagattacttcaaatcccctatattgcagttttctcatctttaaaatgaagataacaatagtacctactccagagagttgctatgagcagtacatgcgttaacacacataagtgcttagacaagtgcttaagccatagcaaacactcaacaaacagtggttgttagtgattattagtatattcagccactcctagactccttcatttactcatctgccaaattctatagtgtgggcacaaagatgactaaattaaattacatattaagaactatttagccaggcgtggtgtcttacgcctgtaattccagcgctttgggaggctaagaagagaggatcgcttgagcccagtagtttgtgatcatcctgggcaacataaaaatactctatctctacaaatatatatatatatatattttaaattagccaggtatggcttgtgcacctgtaatcctggctactcaggaagctgaggtgagagtatggcttgagcccaggaggtcgagactgcagtgagctaggctcacactgctgaactatagcctgggtgacagagcaagatcttgtctcttaaaaaaaaaaaaaagaaaggaaggcatgcaggaaggaagggagggagggagggagagagagagagagaaagagagagaaagaaagaaaaagaaagaaggaaagaaagaagaaacaaagaaacaaagaaaggagggaggaaagaaagaaggaaaggaaggaaggaaaaagaaagaagaaaggaataaaaaagaactatttaagctttaacaaaaaatagtctgcagctctactaaatataaccacattcgtcaagctgacatttttatgtagaccatagacataaagttagaatgatgtatagtctacagagagtatgcttggtgagttaggtccaattaacataatttgggacacataaatggagagacagtgaagctgctgaattttaagagtcttaggaggataatctggtaattcattcgagtcagagtccataacacactagaataattcatggagttcaacattcaaaaggaatttttctcctggctcagctaggttaagtatgattgtgtaattttacaaagttctctcttaaaaaggcaattttaaaattaggtagacacaatgttttttgccttgtgaaagggcttattagaagtgtatgcacacatatattttgaatgtacacacattaattttccaaatatccaaggctctcagacagccagtttcaaatgttgacttgcagaattaattctgtgaccttttgtttggaagtaaatagcattctcagaatcttttccatgctctcaccatgcatgtgatgtcaaattcatatcctggctatttttctggcataaaaaaagagacattacataattctaaaaaaatagcacttgaaaggaattatttggcaaagaaaaacacagtttgtaggacttcggtcataaatcatatcctgaaaaaatctattcatcgacttttctttctttttgtttaaggtacaatacaattgctcctttcacagcatactgaaaaatacgtgtcaacttggtgggtttgatactgaatttctttgtcaaaacactacatataaattaaagacatgtcttgaccacatcaaaagaaaattaaatcaagaggcaattaatcacattctactgttttggaaataaatgtttacttgtgtaagagagacactaagttctctttctgagacaagatacataaacaggatatggcgtttcttcttttcctttaagaagtcttgggaaagacttttaacattagtacttagtgaaacagtaatgtttaaaaagctgataataatttgtgacaaacaattgacctcattaaaattcaattattgaccacttttgtacaagcattgtttcatgtgtctatctcaaccactagttgaattaaaaaatgtttgctgactctattatagactttgtatataaatgagtatttttattagatcctaatatttctctatttggtgtcttaaaaacaatggcttcaattagcaatttaatcagttttaatctatattatctgtaatatcatattagctaacacatctattagacaatgtttactgtgcagtaggcagtattttaaacactttgtgtatgttaactcatttactccgtactacaaatttacaagaataggtaaatgatatcaccctgttttagagatgaggaaacttagaggttaagtaactcacctgacattacacagcaaaaattgctacagctgaatttgcagccctggggttctagttctagatttcgtgctttttttttttttttttttttttgagacggagtctcgctgtcgcccaggctggagtgcagtggcgcaatctcggctcactgcaggctccgccccctggggttcaccccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcgtgcttttaacctttaagtatactgcctctcaaaagcattgaagcatttttcatgaaaatgggttctgtaattaatatgacattttaaattatgtatttcttataatacaagaaatgatatattgcatgcacatatcagttatttatagtgaaattatagttatattatagtgaaatttaaagtaaaacatgcataaataatttttataaaaacctacataaataattcttccaaaagaaatcagagaaatgtagttaaactgtagaaaatataaggaatttccccagagatttgatatatttgaatgatttggtatatgattatgaatgattttctaaggggtaaatcactcttaggagagattagattgctggagcactagaagggagattagaatgagcttctgtaacctacttctggagcttaattgtcatctgatcatagagacaatcattaactcagcaacccattaccaaagcaatctcattattgttgatggtttctttatgaagctatggaccgcttaagaaaaacatacacaattaaatgtatgccaaattcttcttacgacatgcattttatagcattgtaaattgattacccttgaataaacagcacttaaaaaagcaactgtcaaaataagtttgctttcttatttaaaaattaatggctatcaatgttaaaaatacatattctcatacaagtaaactttagttattttcacaaatttcacagagtgattatatttagcttaaataaaaattaaaattatatcatgatctttgtcaagttgctatgcatagcatctttaacataaaatttcttcccgtgatctgatttttaatgcaagaatgcctctgtactacgagtagaaaagttgggtttcttagtaatattagtaaagtaagaaagtatatcatatttaactgcctatgatgggattccattattctgtggtaaagatattactatcctctttttacaagtgacaaaactgaggctgagacatcttaataactcaagagtccatgcagtacaggtttatggattctgtaaaaaaacagaacgtatacttttctttaaaggtaaaaataacaactttagtgcctattgtatgtctggcactatgctgggtgctttatttaatgtattttaatacattatttcaggctcaaggtaattagtattgtcactgccatgtatctaagaaaaaatgagccttttagaagtaaagagacttaacccaaatcacagctagtcaatagcagagcctcgatctgggctgggagatatatttctccttgatcctcttgtgctcctatacctcctctagcttgtatgccaagactgcaaagctctaatcattctttcatctgagccattttccagggttgtttatgcagctgataattttgagagatgagaacatctttcaaagagaaggcttgcttacagcttgctataaaagtagtggattcccaaagtcagtggtagagagttaaatgtacatggagtatcatatcagggaaacaaactctagttttcctttataagaattaatagacaatttcaaatattttaaaaatcaagcatgatattacagcaacttaagtatatgaatgtgagtggtagacaaatagctaaacaaaggctacctctctgacaagccagaactgggtgtaaggatgggcagggcaaaagtacaactgttttttatatgttttatagaactgtgtgaactttgtgtgtgtgtgtgtgtgtgtgtgtgtgtgtgtgtttttgagatggagtcttgctctgtcatcagggctggagtgcggtggtgtgatcttggcacactggaacctccacctccctggttcaagagattctcctgcctcagcctcccgagtagctgagattacaggcatgcgccaccacgcctagctaatttttgtatttttagtagagacggggtttcaccgtgttggctaggatggtctccatctcctgacctcatgatcttcccacctcagcttcccaaagtgaaaactgtgtgaacttttaagtgacattcatgaattatataaagatttgtggttaaattaatattcagtgtttacatgttataaatatgtaattcttgctcctgattaagcttggtagtttgttatagcacttgtataactttttgttatatataacatatatatacacacatatatataacatatataacatatataaacaagtaataattatgttacaaatttcataaaattttaaatatatttaagaatgaggcactaaaaactatctggagctcagttagtagcagatggctcattgagtaatggtcttgactgtaggatagtaatatggctgctcagaggttctccaaatgccagaatgtgtagatcttttctcttaggcaaattagttttccagatacatatatatctatatatctaagacagatataaatgccatataactaagaggaaaaaaatatgtgtgtatatatatgtgtgtgtgtgtgtatatatacatatagatgtatatgaaaaaatatgtgtgtgtatatatatgtgtgtgtatatgtgtgtatacatatgtgtgtgtatatgtgtgtgtatatatatatgtgtgtgtatgtgtgtatgtgtatatatgtgtatatatataacaaatagggaaactaacttgcctaagagaaaagatctacagattctggcatttggagaaactctggacagccatattgcctatacctgtatctataaggtataatctatctgtatatctatctatatctatatctatatctgtatctatatgtatcatctgtattcttgtctactgctcagtggaagaagtttaagtctgcctttcagcattttagggccagcaaggggtcctgtcattcttattttgttggtatgatgcctcatgacaggtagcagttgtgcctgaaacccctatgcctaaagcttttgaaagagcctctccagcattttctgtcctcttgcttcctgcttagttcaaaaggtaaaaagggcagtccctaacctgagtgcatgggaaggaaatcaggaatagagggtccacttgtcctacaaagcttaaataaattatactcctcttagatctcttctggcctctactttctgaagtcccaggtgctttacatttctaaaaatttgaaaatattaattattctcttccttttgaattcccctatgttgacgtaggtttccactatctctgtctaagtcagttttcagaagtgcattcatttttaagtttcctaaacatgttatcactcatctgttgctgttttttccccattactttcatcctcctgtgtgttaacgacatttttattctttattccgtttatttcctttttttaatggggtttcagaggaaatacagataaatatgtaagttcaattagtcgtctttgcaaggaccttcttcttctttctttaaaaaagcaggaaagccagatctctcatgaaacataacagatgctccatttgtaaattcaacaagattttttctttttctagcacaatttttgttaacaaagaaactgaagatatgaagcatttgaagatttcaaagtcctgtgagattttcaaaaacaactcagaaaaaattaagttttggattgtgcaagccaggatatagcaaacaaaatctaggagccgagagaccatctgtttcatttgaattcatactgaaagacaaaagatgcatttctaaattatttcatacctttcttcaaaatattagaagaaatgtgagcaattcataatggatgatgtcatttataagagacaaaattccagttttattccaatactttatgacagaaaatacttgagcatttccaggggacatagtagcaagatctcattaattgtatttaaattatttaagtgttcaatataataaatttagtattctttaatataatgcatttgaatgggcacagttaagggttttagtacaactgtcatcttgaaatcttcttaataacaagatctatcctatttgacaaatttttaggatggacggaattaagcgcttttgtctttgatgacatattgttagtaagaagcctctcaaacaaaaagtagtctaggttttatattctattttgttcaatgatcagggaaatactaaaagctcagtagtgtgttctttgtgttgactttctccaactccaataagacttaaaataaacaaatacatgttgataatcatgtaagatatgttacatacaaacacacacaactacaataaataatctagatattctatctttgcaaaatgactattccatgctacctggtgatatatttttgcaacctatgcaaccccaaatctgtctgaagtgaaacagtacttcaaaatataattaaaaataaaatgacaccttttacaaaaataatttttaacttagcaggaaagaatgaaatttattttatttataccctgtcatgggtcccctgataatattcttgagcccacagcacagaggagtgaagaatcatgacctcatgttaagagactttataacttaaaatatatgtgtttaattcataagtgatacataacttgttatgaaaaattcaaacaatataaaattacatatagcaaaatgtacagttcccctttattcctgcccaaattccactattcctattcatttctaaattgtttggggttcgtctaaacttcttctatagacatatatatgtatatttttacatacatagctatgcatatatatatttgtgtgtgtgtgtgtatatatatatgtatatatatatatatgccttaaaaatatacaaaacatttttcttgaactgaaatatatcatgtaggcttacactcaggtctatctcatgcaagttatttcataatatggggttattactgtgttcagtcatgttcttattagtgaacatatataggcccttttttgttgctatttcagtgtttcagtgggtctctttgtaaaagatatcttatgtacacatacatatgtaatttagattcctagaaatagaaatgctgaattgaaggataaatgagtttcatatttttatatatcttgacaaatcctcttcccagttaacatcaagtcatgtgaccacagaagggctattagacagctcgaaatcttaccggtctcattaacttctgtcaatgcatttataaaaaaagttatctcatttgtttctttcattttccccttacatctgtcttataatttttgcttgaactgtcaaatataatttaggaaactcaaaatgagaaggaaagtctattgtattcactcatatttttgcttcctgtgtccttttttccttcttgatattcgtatgcttcttcttttatcattttcttttttttagaaagcttctttgaccatactttccaggcagatttacttgtgattaattctctattttcctttatccaagaatgttttgatttcccctttattcccgaaggatatattccctgggtacaagattctcagatgagagttccttcctttcagcacctaaaaaaatatttgtagcttctttctggcttcagtgacgtctagaaaaatctactctcattctcattgtttttcctgcataagatatcactattttctggatgctttcaggatttgtatttagttttcagaagtttatgcattatgtgtcttcatatggacatctttggatttatcttgtttgggaactcaacttcttgaatctgcaggctcacgccatttgcaaaatgtattaacatttcagccattgttttctctagttttttttagcttcataccctttccccctctatctgacactctgatgacatgaatgttagatcatttgttgtaatctcacagatccctgaggctgtttcccaggccccacggccaatctattcatctctgttgctcagattgggtaatttttgttattctgttttatggttcactgattctcttttccatcttctccattttttttggtccacccatacactgagctttcattttgattattgtatttttaggtctaaaattttgatttggtttcactttgtagcttctatttctttgctgaggctatttttctcatttgtttcaagcatatttgtaattgctcactgaagcaaatttatcatggctactttaaagtctttgccagatatctaacatttttgtcttttcttttgagacagggacttgcttttttacccaggctggagtgcagtggtgcgatctgggctcactgcaaccgctgcctcttaggctcaagagatcctcccaccttagtcttcctagtcactgggaacacaggtgaacgccaccttgcccagctaatttttgtgtttttttgtagagacagggttttatcacgttgcctgggctggtctcaaactcctgggctcaagcaatttgcctgcctcagcctcccaaagtgctgagattacagggtgtgagccaccactcctggcctcatctttgtcatttggatgttgctatcagttgattgtctttttccagaattattgaacatttatggttctttgtatgatttctggttctttgtatgatgaatgtttcttggttgaagcctagacatataaatactattttattagactctggctcttatttaaacttttttggttttctctgacattgctctgcttaggcaagggaaggtgttatcttgtgtctgtttcctaaccactctctatacaggcctgtgaggggagaggctccgccttattgctggatgtcccaggtgtaagcatgatgtccactgacactatggtgagagtggcctcagaactgctaggtgatgttgaaaatattgactgtccactaagtcttctctaaaaccacctcagcagagagggaaggtatgccttgtttctgcagggaaagggaggaattcctggctttctatgtggtcttcctggctctgtgaggtatgaagctcactataggatggtggggcatgaaaatccagttcattatttgtcctttcctgacactatcttgagttaggtgtgatggtacctcaataccacctggtaagactggaagtctgggctccccatttgggctttgctgtcttaagggggattgcatttcttcctgtggtgttgggctggagtagagcagttgtctaaagcttttctgtcttgctaggcttcccctttcctaacctctagggaatattagatttgctagagaaattaggcttttgttgggactttgatttttgtctgtacctgctgatgttgccatgttgccagtttcttcatcttcaagtctaggatgtacgaagcaaaaggaaaattctgggaattcacctccacgttgttcctcaggttccaaggtacacagccagcctgtgcttatatccaccactgggcatctccctaagtttgttatacatactgtgtccaggttttttagttgtacttagcaggtagaatagaaaaaagtatgtctgttccatcttccccgaagtgagattcttgctatcttttgatatttagtggtggggcggggttgggggaggggtggacttttggtaatttttttaaaaggtgcaaaattatcttgcatagacctggaattcaccattaatttactcatccatatgggagtatagggcttattagtggtggaacctgaaatcttcctttgtgccatatgtagcagttaatcacttaagattatattagtacatattagttgtttctcagaattctgatgaaagggtcaattcacaatagagtgatgtcaccctgtcacttttagaaatcaataaatctatggaaaagaaatctgttctcatgaactaggtaaatgtgaaaagcagacataatgtattgggatgcagagatgaagagcagacatgggataaagcattatttataaaaccactttgcagaaaaaaacattttcaaaatcactaagctattaagattacattttagaatcctactattttatccctgatattgggcatatgaactccaaatcaaatacccccattcctgatgagaaggaaagtttacaaaagagaagataagagagagataaaacagaatgaattaattttaagcctaagacctcaatattaagcctaccttgataccttttaaaacatgatactggtgaaaaaagtatttaaatatttggctcttgctagaagtataacatattctccctcttctaagagacatgacatgaattctgttcttacgtcctgttcttcacaactaaactaaattagaaaaacaattatggaaaatttttaaataatcactattttagaagattttttcagatgtgacaaagatcatcaaatatatcatgtaagtagctatttactgactctacatttgtttcatatttaatgaactgccaaagttaagtgaatcctagagttcaactgtcaaaaatttttattagtgtttattgtttggtattaattattattcaatattgggttttttttaatgctatacacttttctgataagtcaataattaggaacataaatgtaaataaggtcttttccagggattgtgattaaggttttgtcatccattttcacataatacagtgattttttttcttccctgccttgttcaaagtttattaacaaatcatcactttgcagcatgttagaaaggatgaaacttgaacagttagggcaaaaatgcaaaagaatgaccagagaagctcaaggatatttttaaaaaacaacacatatacctgaaaaataatctatgtagaatgtatctcagatgagaaacctaaacatttcttaacctgtaaatatttaaagaagacatatatacataaaagtattatcacaatgcatgattcagctgcctttcactttgcctttaagattcctgacaacctggctgatattaagaatcaccagggacatttgtttaaaaagtggatttccaagaattacttatatagttcctgaatctggaacttgggtctgttattattgatcagacatatttgggaaacagtctattagaggaactgaagtgcaacaatgatagcacttgttcaaaaatgtcaaaactttcaccaaacaaaccaaccaacaatacaccatgatattctatttcactgaaatcggcaatttaagtccacgactcaccttattgaataaagaacatttccatttttgaaaattcttagcaatttgttgtctgtagtgacttcatgaaagttggcacccttttcattggcaaagaacaaatcaggtttccaaatggagtccaacatggaggggtcgaggtctaaagagtcgtcaggatattcactgtacgcgaggcggggatcattccatttctgacgaagaaagatattcactctgtaatcctatgataaaataatgaaagaaagaaaaaaaaaaaccctgctttaaaaagtttaaaatccatagtgtcagtgtggtgccaaggcaggctcatcaactgtagaaaatatacccctcttggggacggggtgtatagttaatggaggaggctatacaagtgttgggacagagggaggatggaaatctctgtaccttcttctcaattttgctgtaaacctaaaactcctctaaaaaataaagtcttataaaaaagagttttggatcttatatactgttctttgggtttttctgaattataacaggaaccaatggcatcctcgggtactcccatcccccaggatcctcactgattaccacgtaaaacagtcatcctagttctgaggttttggccatgtcttcagtgacctatatgcctccaaagaaaagaccacaatttatcatgtttaaaacttgctgttccattcaaattttactttcttgctttgtcagaataaaatgttggaatgctgttagacacttagagaaagatattttcttctttgcatttatttttagaataatttattttagtagatatccaataacatccagaatatatttagtgaacttttcttaaaagctctctgtgttacaaaaatgaccatatacactttttcacaatgaaagcccattttctcatgtttaatatagcatgtaagttctatgaaataagtaatttgagaaaaataaaagctgattttataataatgaaagaataataaaggacgattattgtccataatacttcaagaagatttggctaaagagatttcccaattagatctttcatagttaattttaaaaggagtcaatgatttcaactaaattattgctcacaattttggactaacgcgtagaatgacaaatgttgacagctgagtatatgtgtagtgtttgtatatacacagtatatgaaaataagtaccatatatgtctttataaatatttttttctagatttttgaaatgagccaataaattaaatatagacctcattgtaagcatgattaaagcaaacattataagaccacttcatttgcatgcaaaatagccaaggctgaagatactcacaagaactgaaaaccatttttcatctatttttctatttcttgaataccaaattatgagacatcagaatatagtaaccaaccaatcacaacggatgctttaataatatcagaacaggtagattgcttatgttattggtaggtcaaagtcagagtttgtactgaatgttacaaatctgtacatcctcttgatcaatatttgtgccctgagactatattctaactgcaactaaggttacacaccagaaaatattttttctgcttgctagctgccccatgtatcttccaaagtgacaatggagcagaattcacttcagctttttgccagaaagctcacgatattgtggaaatctcactcgccacaaggatctacagaacctgtaaatggggatatgtgaacaagcttctaccagcctagaataggtcatcttctcttagcctgtagtccagggcaccaggaagcacagctccatggttggtggccagttcttgtttccttcgccattctccagtgtgtgccctcaataccactaaaggaatcagtgattgaccaaatcagtttctctctgctttatagccaggagaagactgaacaaggtcaagttataatcatacctgccaggaaagataactgactagtaaagaatgtacatttgtactgatttataagatacataatcaagttgtttgaagcacttttgctgtaacatttcttgatttagaactctctgtagctgttcaccacacttaggctaaaataaaagtactctttaagttgcagtatatgtaataaaatttggtagaatctctttatccttatgttattagtactagtgataaactttacagatacattttcatttcttccgggaacactttttgctccaaatatgtgctagaaaagatgtttagtatctttcagcttctaagtaatacaaggaaaaagcaacagtcacctgtcaccaaggccaaatgttatcatatacccattgtaatgctctttctgaaatatctctatctcttaatacatttagtttagggaagtaagaaccacatgaggcccctggatgacaataatcctgtcattcatgacagcatggaaaatatgattttgtggtctattgtactgcatggtaagtacagttaataataatgtatatttcaaaatcgctaaaagaataaatttttgacattctcactcctaaactatattaagttagtgagatgatgaatatgttaattagcttgattaaatctttctatgctttggttcagggccagggttcaaagcaaaacaaaaataaccatgtcctgaaaaccttagaaactaagattttactgctccttacagttttggttttgctttgcctgcaaatgaacattgagatggaaagctattaaataaccaaattcagcatttcaaaaatgtttttttaaggctgattcttcatagccacagtatcccattatacccagcaaccaattatattaattatttttgaattttggccatttgtgaaaatgtgtaaagaaaggggcaagtaaacggacagtcaaaatagtaccaccctaagagaagtcctaataactagacttgaaataacttgcctgtaataaaattccctggagtgaagaagaaaaagggccttgtacaacacattttgtatatggcaaaaggttaaattacatctctacatgacgctactcaagaaggcaacttggagtgaattaaaagttcaaatatgatgggtaaaattttttaaaagaaaatttagcagagtatgtggccttgaggtaggacaaattatttaaaaagcacaataatattgatcataaaataaaggttaataaattctacgatgtcagaattaagaaattctgttcatccaaaggtcacttaaggttaatgaaaacataaattatactgcaagaaggtatttgccacatatacaactgacagttgattattaacatgctttaaaatatttcataccaataattgagaaaaagagaaacaactgagtagaaaaatggccaaaacaatcacaacattttactaggcaggcattgcaaatacccaagaagtatctgaaaaaatgttcaaccacataagtaaacaaagaagtgcaaattaagatactaatgagataccattttatatttactgggctgttaaaaatgagacttttgatgatatcagaatttgtcaaaaatacagggcaaaatgatcctttatacatcgccgcgaaaagtataaaaagatggaaaaaattggccaggtgcagtggcttatgcctttaatcccagcacttcgggaggccgaggtgggcggatcacgaggtcaagagacagagaccatcctggccaacatggtgaaaccccatctctactaaaaacacaaaaattagctgggtgtggtggcgtgcgcctgtagtcccagctacttgggaggctgaagcaggagagacgcttgaacccaggaggcggagcttgcagtgagccgagatcacgcctctgcactccagcctggcgacagagcgagactccgactcaaaaattaaaaaaaaaaaaaaaaggaaaaattaacattgtaacataaatttgatatatgcacactcaggatacaaacattttagttcaaaatacaaaacttaaatccttatgcttgtgcaacagaagacatatacaaaagtatttatagcaacactgttagctctaaggaaaaaccaagacaaaccaaaccaaaacctggaaccaattcaaatatccattggcagaaaaatgcgtaataaactgtgccacgtcaataaaatcaaatacctagtagtgaaaataaattaccaccatttccaatgatgaggatgaatcttacaaatgtaaaacagtaaaaacaaaaaaagcaaatgctggagatataatgtatggcaccatttttgtaaaattcaaaaccaagcaatttctctctctctctctctctatatatatatatatttatgtgtatgtatgtatgtgtgtatgtatgtgtatgtgtgtgtatatacatacatatacatattcatcaatatagaattataactaccaactttatgatagtgattagctagggaaatgctggggaatgagatagtgaattatacaggtatctttaatattggtaatgttttagctctaagtctaggtaaaggattcaatagtgtttatgttattaaattatacatcatcacatatatattatgtatgtaattatataccaaaagaaattgtgttatcataagaatccttatagctgaaagaggaggaagagagtcagtgccaaaatgaggtgatgtgaaactgactgggtctctggtagaggaaaaaggccaagaaagagccaaagaatgtgggcagcctctagaagctgtaaaagcaaaggaatggattttctcctagagcctccagaaggaacacagccctgtagacaccttgaatttagtctggcaaaacacactggacctctgacctcaagaagtgtaaggtaatacatttgtgttgtttaagccacttgcagaataaatatttttaaagttttctgtatgttgtgtttttttgacatcttaaaaaatccttctggctgtgaagagactacctctccccagtgccagtcaaatttcaaagatagcaaagggcccagcctggagcatgtcttgagtaaacaaactcataacctcagaaccttcccccctctatcagccagtgcacccagaagacagtgttcctgtgccttagtcatctcagggctaggtaccaggcaactagaaaccatctctatagcccaaagcctggcaaaattattcaaacgaggcaaccttaaataaacagttcaccttgccctgcctgcctttgcagaagaaacctcaataaaggctgtggcttaaactttcatgctcctaccttctgcttcctgaccaccatgatgtctttcccacatggccctgcatgggatgctgtgcctcttgtctctaggacccgtgagtataataaactgtgttttttcctgagtctccctgtttcttctgtggccacatcagactgaccatctcataaaagaataaaaacaccactcaatttgtggcaatgtgttacagtagcaataggaaactattatatctttttgaactgatttgcatacaatattattaccagttttcgaagacatctctaaaacaatagactttcttttttttttggccggtaattggagatggtagaaaacttaaggcaaataccactggattcatagccagatggaaaaaataatccagaattctttctgttttaaaaaatcctaatcagagatcttggcaaatttcaaaatgatcagaaaataattcacctttgtcaaataatcaagaatgaagctcagacttcttaccaatgtctcactggtttagctgcataagcttttacagttctgaagtgctgtacaatataggttcccatgcgtcaggaagcacagaataccgacacccaatggtgcaataattgcttctaacatcatctctgtaatatcccccatgttgcctataccatctgctctaagaaccccgccacagggagagttgtcgtctggggccactgattctgcagtaatggcccattgggaaagtgcctttcaattctcagttactaaagcaacagggaagaaagtcattttataagaactatttagaggcttaaaaggttatcttaaatctccctctgacttctccattatccatatgtacaattattctcctagaaaaaagaagattttaaaattccaaaatttttttaaaaagcaatctaattgtgtaccagttctggaaacatgcaattaagagggattgattagaacataaaatgtgctgaatcaattaaataacactcttcatatctcatttagtaacctctgcgtaaatataagattgaaaattaaaatactagcaaaaacaatacaaagctgtattccattaagaatactacccattctgtacactcgaatgcaataatttctggagaggtaaacttagttcatgggaacactctttcagaagttgaaataaattgatttcaattaatatagctcattcagtttgtgggcacctcgatttaggtgtaaacacctacaaagggccagtactcctagtagctgcttgctgtcaatgaaaaatagtaatttttgttgctcttggattgcaaggtaacaaattaatctcccgctaaggtgctgcacagctgtgctccacaagcccccattcatccaccagccccttctgtctttgatgctcacttaatatttctattcaattctcctttgtctgctaattgtatgactaattttcagccttaaaaaaaaaaggctagataaccaggtggacttcactctgtccttcacagcaagttgtgtcaacaagcctgtgggtaggagaaaaaaatggcagaagtttctacatcatttttctgcccacttctcagctcctaaactccaatttactccattttgtgtcaaacccactaggaagaggaagctcatctacttctcctggtttagacaacatggacatggaagtctactaatacttttgctcatgacctgaaatttgcatcacaaatccactcattccaacagaatattgtctctggattgattttattgctgcttgatgttaattacacaatttacatgttaaaataaacataatcgtttacacataagacattagtttgtattttgtatatttatttatttattttttgagatggagcatggctctgtctcccaggctggaatgcagtggtgccaactctgctcatggcaacctccacctctctggttcaagcgattctcctgcctcagcctcccaagtagctggggttacaggcacctgccactgcgtccatgtaatttttggattttttagcagagatggggttccgtcatgttcgccaggctggtctggaactcctgacctcaggtgatatgcccacgtcagcctcccaaagtgttgggattccaccacgcctggcctcattttgtatatttaatatgtgggcatctgcttactattatttttggaccttcactaaacaattgttctactactggaacatatgacgtggctcctaaaacagtgaaaatctctggggaaatgaagtatcatttggtctttggaacattctattatcaatcaacactacaaatgatcttcaaatcagatttctaagaatttcttcccagtaatgggaagaaaattttttgagaaaagttggagatacttcaaaattttgaggtggataagagtgtcatagaatcataatgattttgaagacattctaactactgtgtttccttaaatgtctgatataaactgtattctattttattaatgtgtgtttttaaaatttaaaaaattgtggtcaaatatacataacatttatcatcaaagatgataaatttaaatttaaaattttaaaaatttaaaaatttaaaaaatcgtgatcaaatatacgtaacatttatcatcagagacattttatacattaacagtattatgcagtattacagtattacgcagccatcaccaccaccacctagtttcacaacatttttttcaccccacaaggaaatcctgtatccagttagtgatctcctttcctcctcctctagtctctggcaagcactcatctgcttcccgtccccatagatttacctactctggatattttaaataaatagaatcacactatacgtgaccttttgcatctggcttcttccacttagcataagtttttacaaggttttatggtacatttaagaacacagaggtcatttgtttatagaagtgtgaagggcctttttgagagaattatgtatgtaaggtgatatgtaatatgtaatagtttcagagatatatttttggaagtgagtgttctatacacaatgatgtatatgtacatgtataagccatcacaatgcctgtatatatgtattatacataaaacccatgggaatccacaatcatcataaaatatgaaaacaatagctactattaataaaatgatactaactttcaggcataaaactagatgctttaaaaataatttggaattgaagaaataataagtaaaattgccctgtatataaagtttcaggatcatactgatgcttgtaaaggcctaacagcttcatcttgcatacaagtacttttcatgatagcgacatctgacactgtcagggtttatctatttacttcacactaatcagtgttttttttaaaatatcatatgtaatttgggactaatgttatagaactaacaaagaaaaaaagatttattttgggcctgtgtaagatcaaattttaccaaaataaataatgtgaaccaagtttgtttacctcaagtgtttccagtttaaagatatctagatttttagttatacacacacatatttaaaaatttcatctatttaaaggttcacacttcccttcacagttttattaaactattaacacgtagtagcttggcatttgataaaagatatggtttagtaaataagaacaaaggaatagacattattggcaaaaactttgttgtatttgacatttgtcctcagtaagaaaactgaacataaatataattattccaataattattttcaaatttttctgaatgctaaggcttttttttgtggttttttgttgttgttgttgttgagacagtctctctctgtcgcccaggctggagtgcagtggcacaatcttagctcactgtgacctctgccacctgggttcaagcaattttggtgcctcagctctaagaagccaggattataggtgcccaccaccatgtctggagaaattttgtatttttagtagagacggggtttctccaagttggccagactggtctcgaactcctgacctcatcagatccgcacgcctcgatctcccaaagtgctgggattacaggcgtgagccacggtgcccagccaatgctcatgcttgttatcacagttttacattttaactgatatttaaattttcagaaatttaaaccacttattttctttgggaatttttttaattcatgaggacttttatggcatacaactaactatgaaatgtgagaggttaaaaattaaaggaaaaatgttccactttggaagaattttagttaatgaaatattatgtcaaagaaaaaaaataaattgcatttgttttctttctgagcaattcagataattcttacatagttgtttattgatttggagattggccaaggaactctgtggaggttaagtgtactgtaaagctggagaggaattaacttcttttagaaactatcattgaatattgctgcctcatttaggacagctcttgacagtaacagatgaaatgtttgcttcttctgcaacaaataaaattttaaagtccacaattcactcttaactgaataagacatatataacctattaaaatcagaattaaaagaaaaatgtaatcaatcattagatattttctacttgggtagagaacaccactcattttaatatttctacatttacaggtatttgggtttatgcatacatatataaaggtatttgaatgtagggtatcacaggcaaaagataggttgcaaaattttggtgtgttcttgcattgcatacaaatatttggcaacctgtgagtattaccttctatttgagcatgtaaacttgaggaaattcatattttgttgaatgtaaatcctagtgtaggtttagcataatgttgcagctgaaacttttagaaatacttaagtatgattatttcatttccacattatagttttgatctgttcggaatcgattgatatttcttttctctgtaaaattagcttgctatttatactcgaatactttcatgacaaaaaaattatttgaagtgatgagaacacatgtactaaattaagcatctttaccagtggtgtattgtaggacaagaacaacaactgagatctcactgcttttcattcaggccttttgctatcaaaataactcagcatgccacataatatactgcttaccacaagtgacaccatctcataggcaaggtctcttttatggtggcagattattttctctcagggactatgcccatataccagctgaattccactgagcaacttctgttcaaaccatgtagaaaaggctcagtaaagccctgctcagatctctggcttacaaaatcatggcatgtaatgaaatgtttgttttgtataaaccacaaagttttgggatagtttgctatgcagcaacaactggaatagaactaggaaactagaagtgggtgctgctctaagaagaaaacttaaaacatgttcccttgactctgggagcaggtagcaagaagtaggttgcaaggatttgaagagattgttgtgatggttaaaggaatgagaaggaaattcttattagaggagagaaaagaaaatccacccctacattgtggggcagaaagcttgacaactcatttcagtaatgtagaaaacagaatatgcaactaatgaactgttgcatttggccaagaatattttctggtaaattcctgaaaaattccacttcacttttttgtgggctctgggtaaagatcttctcaaggatgtgactacgaccccttgcctatacttcagaaatattaaaaatgtgcctcataaatgttctcaattagattaaaaagtttctaagaatcataagagcattatctcaaagaatcttgattcccaacccaaggtagagaatcataggaagcccacaaaaatgttaagagaattagactagtagaagcaccattggcttcatttgaaatgggcagggacagttcaaaatgcaaagagcttgcaaggttcccacatttctatgagcaggaagcggtatgaaaaggctactttgtagcaaacatggctcatttttaccgaaaaggaaagatgactcagaaggcagaaacaagagccaacacggtaaagtcaagatccacattttctgggagcaggactgggccttaataatgtaactggaaggatatgctttcccaggctccagaattgctatgaaccagtgactacaatgtacttcccatcaccctttccctattgaatgggaacaccttatccctattgcagttttcctattctgtatcgcctctgtaggctgactttgtgtgggatagaaaacctgttcttaaattcacaggtcttttgatcgagaggaatcataagatccaccttttgggaacctcatttgcactcgcatctaatttagttgacacaattccagacttcaaaacaatgctatagtgggacaaaaaagctggggtctttaggaaggggtgtttatgttttgcatattggaagaatgtaaacaatgtcactagaaggccgactgtgtcagattaaagatgtcctatgggttgtaagaatcctcaaagcttttaccctgtctcttgaagcgctctgagacacagctggctgccatgtcagaagttagaaaccccagagaaactacactgaaggagccacatgtaagaactctggtcaacagtcccagctgggtccagatttccaggcttcctcaccaagacactaggcatatgaatgaaaccattttgaatgctgatcctccagctgaaaccagagattttatatcaatgacaagaggagcagaaaagttacccagcaaatccctgcctatattcctgatccacatacatgtgagacctaataaaattggtgttgttttaagccattttattgttgatgttcctgctttaatttgttttaaaattcagatagagcttacatacagatctgtaccaaatgcatagagatgtgtaatcaccatcacaggcaggttacagaatagagctctcacccacagatattccctgtgttgcccttttgtcttgaaaccatccctacacctattccctcaaagccagtgatgccttcttcatcctcattgttttgccttttctagaatgttgtataaatggaatcacacaatatttaacattttgagtctggctctttcttgacttaagttattgtgtgtatcagtttattcctcctaattgctgagttgcattcaattgtacgggcgtgccacagggcttattcacccattgatggacttctggtgtttttccagtattttgtgattatggataatgctgatgtatacacttgtgtatgggattttatgtaagcatacgtgtttgtttctcgtaagtaaatatctacgagtgagattactgggtcatattaagtgcatgtttacatttagaaaaaaagtgctaaactgttttctagaatggctgtactatttgcacttccgtcaattatatatgagagttacagtttctttgcactcttatcagtaattagtaaattcagatttgtttaaaaaattaatttcaccttttctaatatgtgtgtagttgttctcattgtggttttaatttgcattttgctaatggctaatgatgtcaagtagtgttttctacctatttgcaatgcgtatatctttttagtgaagtgtaacaaacatttaaattgctcattaaaagtattgtttttattttactattaagtttctagagttctttataactattctggatacatatcctttgccagacatgagattggcaaacttgttttttcacagcatgtagcttttttttccttctattaacagcatttttcacagaaataaaggtgtttaattatgataaagatccctttatccattatttatattttttaaattgtgcttttggtgttatatctaagagctcgttacctaacccaaagtcacaaagattttctatgtttttgttttcttctaatcattttataattttaaatttcatatttaggtttgcggtcaactacgagttaatttttgtatgaggtatgagtacgtattgcagcttatttttttcttctgcatagttgacaaattattccaacactatttgttgaaaagattagaatgctattttcttatggtgcagaacctaggaagagcagatttaaaactgtgtgaggcaagaggttatttgttcacacctgagttttgctcatctttgaatccaaatatataaaatgttttttcttttgctcagacacacagaataattggcattagctagaaattccctagcatggtttttgtgagagtaatgattaaaaaacaacaaaaaagtcaggtatgacaaaacacaatatatcacagcaattttgttgttaaaagaaagtaattttaaaaataatagttaaaattttaagaaatcttatttgttagaaagctgacaagctaaaattgaatctgtagttcaatatttaacatcagtagaagctgtgtgaatggatattgaccaaggactcacctaattaagttgagggtaagaaaatatattattcgaggtttttaataagctattttaagaaacataatttgaagagtaggaacactaaagcttgctttgagtattgttcagaatgaaatagttgtataacatattctgcaataactctggtactaaaattgtcaagagcaagcaatttagtcttaatataagtaataagaaagagaaactccagaaaggaaagagaattgcaaaaatatgttgcattctgaatcaaatagccactgggcttttacagggcaagacactgctaaactcatggggaaatttaaggaggaaaaatctctctctcctttgtttctgatgtttgctttttcttcagtgttttgagagtaaaaagaagatagatggaaattcagacttgcaatatgtgccattagaaaattacaaagcccttatgatctcagcagaaaaatgatagcttttaaagcctgttccctggtgcttcatcacctttcccagaaggatataaattactggaagataattgctatgaatacatcattctttttcttgagattccctggtccttgtgaaactcaatctatgtccctaggagcagagttggtggagaaggatgataccatagaagagagaggcaaaattattgaagatccattctgttggcttgttttgttttactttaccctccccatttaaaagaatcaagaaaggacaacctatttgattatataaaactctgtatctgttgtggaatatccatagctgttgtgggataaaaattatttcaaaaggaaattcagaattaagctatttcctctcttttaaatttagtcttacagaaaagttgcagaaaataagagtttctgtaaaccttttatacagcttctgctaatgttaatattttacatattcatagtagtttttgaaacctaaaaattaacattgatacaataccattaacttacctgcagacctattttgaatttcacgagattatgaaaaaagaattcaagattataaaattaaagaatctaatatcctctaatatccctttttttctcgtgtaggatctaatctaggatcccacattgcatttagcttttaacttagtctcttctaatctgtgacagccccatagtcttttttttcttttttcatttttttctgtctttcatatccttaacactttttgagatataccagccagttattttgttgaatgtccctcagtttgggtttgtctgatgttttctcataattagattggtattagtcctttttaacaaaaatgctgcagaaaggatactgtgcccttctcattgcatcattccaatagcacatgatgtagacctgtttcatgggtgatgtttagcttggtcacttgattaaagaagtacctgccaggatgattcatggtaaagatatagtgaagcttatttggtactatttgcatgatattttaggtttccttataacccttgcatcttggtggatttcaacaattcttatagatatttagtgcatttttgaaacattttgtaatttctaaagttgagatattacatacaataggtgttcaaattgaaaaaaaacacaaataatgtatcttagaagtgacagctctgtgcctgggtttatgagtacagaacaggaccccctctcttgatccatacaccactgcagctgcagctgttgctgctgccattgtaggctgggacaggcaagccagagggctgccggtctgtggctgtgagtggtgactatgtccccactagtagcatggcctttgtgcttgggctcacaagggaaggagagggttcttcccctactctgtatggtgctgtggtgctgcagccatcaaaagtagttaggcctgagagctatgtgtctggggctatggttggcaacccagcattgcagccactggcaacaccaccgtgcggtgcttgggacccagagggttgtagtgccactgccactgccattgcccacaccacactggctgctcagggacctaagaacgcaatcacctacgtggcctgtgactgccattactggcatcagagcaagccacttggaggaccaagaagaggcctgcctggtcctactgacacaggtgctggtgtatgctgccctgggagccgaagaacaggcacattcgaaaccctgctacccccactgggaccaggacctaaagactggcccacctggcgtccctgcccccagcaaaatttaaccataccctccactagttcctgtaccctaaaccactgaggaaatcacaaataccaccaatgctgtttatagtcaagtaaatcatacaaagattgcacgactgcatgcacccagaatcaaagccaaagggttctaaccaattgaaaccattgatacatattcaggaaaaagtcattccttgtgaattcaaagaattgtaagaaatgactattacaccagttacatatatatcaacataaggacaccagaaacatgataaagcaaagaaatatgacgccttcaagggaacacaataattccttagcaacagatcccaactgcaaagaaattaacaaaattatgaaaaaggaattcaaaattatgatattaaaaaagcttagtgagataaagagactttgaaaatacaatacacagaaatcagaaaaacaattcaggatatgaatgagaaatttacaaaagggatagctatcttagtgaagaaccaaacacaaattctgtaactgaagaactccccgaataaaatgcaaaatacactcaaaagcttcaacaatagactgaatctaacagaagaaagaaccacagaacttgaagacaggtcttttgaaataactcagggaaaaataaagaaaaaagaatgaacaaaatctttatgatatgtgggatagcataaagcaaccaaacatacaaattattggtattcctgaaggtgaagaaatgttaaaagggtttgaaagcctatttaatgaaataatagatgaatacttcccaagtctagcaggatatttagacatccatatacaggaggcccagtgtcccccaaagagatacaatgcaaaatggtctccgtgacactttataggcacactgtctgaagtcaatggcaaaggagaattctaaaaacagcaagagaaaagcatctagtcacccctaaagtagttaccgtcagactaacagtaagcacttactatgtattttcacagttttaggtcgtacatttaagtatacttactatgtattttcatagttttgggtctaacacttaagacccatttaagtgctgacttttccctataaaaaggacattggtcttggcaaagattttatggctaaaacctcaaaagcataggcacaaaaataaaaatagacaaatgagaccatattaaactaaaaagcccctacaaagcaaaataaacagtcaacaaaatgaggagataagctgcagaatgggagaaaatatttgcaagttactcatctgacaggtgactaatatttggaccatataaggaacttgaacaactcaataggaaaaaaaaaaaaagttccaaataatcccattaaaagatgggcaaaaaacatgagtatacatttctcgaaagaagacacagaagtggccaacacatatcttaaaaagtgctcaacatcactatcattaaggaaattcaaataaaaaacacaattagatattatcttatgccagttagaatggctattattaataagaaaaaataacagatgctggtgaggacgcagagaaaagagaactcatacactcttggcaggaatgtaaattagtacaaccactatgggaaacagaatggagatttctcagaaaactaaaagtagaactaccacacaatccagcaatcttactactgggtatctatccaaaggaaaataattcagtatatcaaggggatacctgcacttgtacgtttatcacagcactattcgcagtagcaaagatatggaataaacctaactgtctattaacaggtgaatgagtaaagaaaatgtgtcatatatacaccatgggatactgttcagcctaaaaaaagtttgaaataatttcattctcagcaacatggaaagagctgcaggtcattcttttaagtgaaataagtcaggtatggaaagacaaatattgcaccttcacactcatatgtgggagctaaaaaaactcatcacttcacggacatagagaatagaatgatagataccagggactggggagaccgggtagtgggaagagagggattaagagaggttggttatggttataaatatacaattagatagaagaaataaattctagagtttgatagaggacgagaatggctatacttagcaacaatatcatgtatatttcacagtaactggaagagttaccaatatagttaccagttaccaacacaattcctgagtcaccaataccaatatctgccaccaatatttctgataccaatacataaaaatggtaaacccatgtgaaaatgatgtatgccccaggtacgctgacttgaacactacacattctatgcatgaaacaaatactcacatgtacccaataaatatgtaaatcattatattaggttggtgcaaaagtaattgtcattacttttaatggtgaaaaccgcaattatttttgcaccaacctaatatatcaacaaaagagggaaaaatagtgacagaatcttagattgacatgtactcacaggaagaatgaagtcttacaattaaagaatatgggcttgtctgtgttacactcagaatttgtttgtttacataattataatcaaactacatatattatggatccttctattattggtcaccaattattctggcttctgcctttgtggctctttccttgaagaagaattatatatccctgctttgctgtactcaggagtggccatgtgacctaagaggtgaatatcaaagagttagacaacgaggacataagggcagtggtggaaagagtagtcgatgaaggaacagcaaatgcaaggaacagatgtgagataaaatattgctactctaaaaagtaagagttcaaagggcattctgaaatgcacagtgggttaggagatggggtggggcgagaattcagtctgatgacttaaggtgagacagattatacagggctagtataagccatggaaatttgaattttgctccaacaggaattatttgagagccaatgaaagagcagaaaaatgacaagatcttatttgagttttagaaagatccagggtagtgattgggtgggtagtaagggaggagcagagttagattctgtgacggttcctgtcacaacagtgagaggtgatccccaaagtggtgaaaaagtgacatatctgggaaatatttgcggggtagaattgctgtgcctttgtgattcattagatattgagcttaaggcaggaagaaataggtcctcaattttctggctgactcaatgagatagcaaacaggtgaagcagatttggatatgatgagctccaggaatttgtacaattgagggagataatcagttcagatatttgagaaaccaacttactgattagactactgtgtcagtgtacagttaatcttgcctttaacattatagcatatatatatgctgttccaataacattatagcatatatatatgctgttccaaatactatgttttaatgttattttggtttgttttatacttccccatgcctttcacatggagacacttgggctatagctattgactggacaattaccactatacatgtggatggccataaagccaaggacaaggataaatgtacatacagagcatatgtgtagcaaaggcagtgcctctgattgaaccttaataatggctggcattcaagaaatagaaagaagataatagtgcaaatagatttgggaaggagtggccagagagtcagaaaaccagagatggttgaattagaaaagccaaagtaagacagttttcaagagcataatcaacagtggcagattctgcaaagatgtcaagaaagtttaagcttaagtggttcattgttgttattgaatactttggaaatagcaattttagtgaagcgattggtgaaaaaccaggaattgaggaatagcatcaggtacaaccatttaaagtaatttggctgtgaatagaaagagaaatatgggaataactagaaataaacaaatccagggaaagctttcattttaggagggcagttagcaaatcaaaacattaaagggagaagacacataaagaagagttgaaatacattgagtgtggtcctggagtaaaaaggacttcaggatttgatgtagaaaaaattgggaactaatcttatataaaaggagggaaatatgcctcaatgtatcagcaggaacattatacccaggttaaattttaggtttggtggcaggttgctaaaaggtttcttgtgttccggtctctacgttttctgtgaagacaaaggtaaggtcatctgttgagaatcagaagacaggtttggaggttaagggtaggtttgtgtgaaagactagcactcaccctccatttgacctgtcttgtaacctgtcagctagtattgcagaaattagaaagatagaaagatattaaagctagggaccttgatgtgatttctgtttagtcaattacatgcacttgtgggagattgagacaaagccatgatctgctcattctgagtttctacttgcaagtggatttatgggattatagtatcattgagtttttccacagtagtgtcaatggagattccctgtcatgtcactagtttcatgattgttgaaagaacaaataaatgtaaattatctagtaataattataattgcggctcagtgactgctattgtttctcgattcgtagatttcagcagtgtgttcctggagccaactgttccagtagcagccttcccacttcctgattcaggcaagggtagcagctttgcttacaagccaaatctgtggtataatcctcctcccccagctttccagtacttttataaacatctgattcccagaaataaattcctttctgtgaggtggctggcatggtttctgttacaaccactgaatgcaactggagcaatctttgccatcagaggagttgtgggaataggcactttgtactgttcagttggcctatttgtgtttgaaggccaggcatatctgaatccattaaatgataggatactagaagtacacagaaaccagtggcaaaatcagttaaattttttacctatggccacctgaattgaagtacatgattttgcaaaccaagtattgaaagccatagcaaagaataatgtcacaggcatgagggagtcagggactgagaaatgggttgcctgcttctgattgcattggggagctaaaagaaaaaataaaatctggtgcagaaaattaaattctcatattaaggcatggtcagagaaccagggatttttcatgactctcctgaatgtgtatcttatctcttgtaccttcatggatgaagatggtagggctgaaaactaaacacaaaggattaatctgtggactactaaactaaaaggtacattatattcactctcttgcagagtgacatatatgagtgttagctccttggttgggaaagagtaaaagttcaaatattagaaaaataaaattgggaagatttagaaaattctaacaaaatctaaggctcttgtgttagcagaagcagctcctcctcccatgtatgatgaaggaggggtatacctatttttcttatatcccacctcaaccttccatcactgccctcatggagtagatctctgaaagcagctagaaagccaattatactcaatccaaggaagagaagttttgtatcctaaggaagtgctagattttaccattttttgtgcataaattgttatatgtggaatagattctgagagtgctagaccatggattatgaaacaaaattttagaattggctaaactgattgctataggtgtgtttacagagattctagatgctgtgtattagctcagatagccaggaatggctcctatgggttatttggctgactgaaagctgggcctagcaggggactatgctgaatgatgtttatatattacaaatttcttagtctgtcatatatgagacatccaaagacatagaaaataagagacatagaaacggatttaatatgtatcctcatttaattctcttttcccagctatgtaccctaagagggcccatttaccaagggattaagattatattagtaaatgaaaggccagcatctttaaaaaaaaatgcattgtgatggctgtcctctgtaagctgaacatattgctcctgaaatgagctcccagatttcaatagtgataattgccaaggtgacagataaaaacttagcagtacttaatccaagtagcaaaatggatcctgttatcataaatggagcagctttggagtggtattcataacatgtaaaccttagtgatctttgactgcagatggttgctcaggaggttaatagacttgaaataaatgggtagctcattaaggaagatcccacttgttttgaataatcaaaataacactgggaaataaagggcccaggacatctctaggctggaagctttactgatagatgaattaatgatcttcaaattcttaggggaagttttcagacaaaacttaagaatgtctcatgaagaacttttacatagggatctatctaggacagtttcaaaacaaagtttacccttatatcagctaacccagaaaaaagagaagcctgtctgtctgtctatctatctatctatctatctatctatctatctatctatctatcaatcatctatctacctacctaccttcctgctacctacctatctatctacattttttagtaagtcacacctttatagaagctttttctggttaaagcatgatagaaacatcataagtgtggtgtaaatttcacaaagaatttgttgccatcgaaggagacatcaagaatgaactccatgtaaatattttgagaacaattttatcaaataatgaaagacaggatgcaacaatcattttatgagtgaaataaatagataaatataatcacagcagaaaaagaaagtaatatggcccttgcatcagatgtggaagataaatgtgaaacaagtctgaatgtatttataattagtacacgtgtttgtgtgcaggcacacaaagaaagtttaaaaaataacatcaaagaataaattcatacaaaaataaaagagaatatagtttgatctccagtttataagtattactaattttgcaaataggtaggggcataatcatgaatcccttcctcgtcagaatacccagtgctcttcccattatatgacagcattgctgttacgtagcccactgagtaatgagtacagaaatattactcttgggcaagtttactcattagtatccttataaatatacactttagagcacacattattttcaaagaggacagtatggttcctgagggagcaaaaattggttcttggtgggtgaaagaatgcttaccctttttatgtataattcagagatatgtacagagcatataaataaatttacagttcatctgaagtactaaaatttcacggggagggcaattagggaaaagatgtctaaaaagtgtctttagggaggcataatgaaaaaaagtgttgagaaacactgctttaggagaaactaaacagaaaagggatgcaaagcatagtcatttctttttatgtctgctgtcaaattttgattaatcatcttaatcttatagtgcatggatgaggaatagcaattatctttatagctagttataatatgaaaagaagtaaagtatatttagaatcagaatttttagcctttttagtagctgcttcttgagatgcatatataacaagcatacgatgtagggtatattagcacagtgagtgatcattgaaagacggagtgagcagaaaaacacaagagaagctgatgcaatgtatgaaatgatgctcatagggagaaacagtgaaataacaacctgaagcaaacaaagtgacttccatcagggaaagaggttaaatttcatctcataagctcaaagaggcacctggctattctcttattacctctggtagaaagtcttgtgccagttccgaggcttcctgagagactggaagtgaaacaatgtcacagcttagcatcattaaggagtggaggcaactccattggagagagagagaatgagagaaaggggtgggtatgagtccttataggaaaaggtagagagtaattcttcactattccgaaagtttgacgatagaaaagagtcccagaagcgctggaagacttaatggagaaggaagcactcccaaatgtcttccttaccgtaggaggaaattaatacttcattaatatccatagtaaagtgaatgggttttgcgggtgaaggttgcccaggatttatcagtgaatattttcagtttatcttcttaatgttaatatatgttataagctcatttttgttaattatacctcttaatataatcttgtgacaagattatttgtcttatgctttatctagcctctggagtgttggcaatattccaagaaactactaaaatttttgaaaagatgctgcagattatagtactacctttgtgacagtaaatccatgtttcttcatgttctccatagaacaaatggcttatgttatcaagcctccttgatgagattgagaataacttcccttttgttttaaaaccaaatttttaagaactaaattcattttgatatacatatgtcattgttgagaaggaatctttcagtttctcattgacttcctaagtaacaaggaaggcttaactcttgcgtgcatctgttctacttgacaggacacttgtggcacagccccaggttcttgtcagtctggcatgtttgaatccttctgaagcatttagttggcttgttgttttgtgggtaacctggaagtctcatcgcagcaacagaaatatgccgtttgaacggtccagagagctacagtgttaatattaactcacacatctgtcagagattcagcctaagagctgaagagctatctgcaatttaaattgattgccaagaacttaacactaattgacatgctagattcataactaagtaacacattatgactagtgccagtcatcttagagaacacaattcccaatcttgctgcccattttatctttagaggctgaaatgacattttggagaggattctttcagaaaatcaaattctcttagaaaaatgtgatgatgatgaatataatgaagaggaatagcattgctgtgatctgttcatgataatctgatcatttctatgttatgagaggtggccaagagaagtgtttaattgatctctacgataccttcctctagagagatccttgaccaggtaatggtcattttccattgcaaattaagaggaggcagaaaagagaagagttgaatttgacacatatctttgccattacatttaactctacaatctttatttctctttcccagcccaaatatttcaaatgccttaaaaatgcaatttttaaatttacttgtcgaaaggaaactctacaatgatatacagtctgataaaggagatagcttatagaggtctgtgcctgacgactctctctcaggatacagattttttttttccgttgtcattagcaccagtttctccttgacatttccctccacagaactggaaatgtgccttttaacattgttttaacaacattatagcactaataaacaattgtattctctatgatattctgtatgagatttttacctttgtgaacaggatctgtagacagtccctttctgagcatgatgattataaggatgacttggtggatgaattcattaagcagagatttattcatatgcctcatggggtcaccaaagtgtataacattcatgcatacttatcttttgcaagcatccccataaataagcccatttctgattgatgcttatatgtgatagatcagagcacaatcattctgccaatcactggttactcatgcatggaattaaaaatcttccagatccatgccatttctatatttggtttggctttacctattactcaaagtaagaaaaaaaagagaaggaggataagatgtaaacagatataattttaacattaaaaggatagcaggatactttcaggctgttccaaaagaactgaaatagcatcaatctaataatatcctacatgaacattgttgaatttataaatatgaatgacatcggaatagccactgaatgctattatggtacttacaaatagtgaataaatgtacctttgtaagaatttaacccattggcattagataaaaaggaccaatggcacattttaggggaagtttacaaaagaacagaaaaaaatggacttttcttcaaattacacacattttatttcagttgtgataaaaattactgtaaaacctagcctgtttatgaaatagttgcaccctaatatttttgatttttgaaaattattcttggatcactatataaataggagctctaatttcttatcatggagaactctccataaaaatttcagcatttttcacaaaattatctttctataaacatgcgtgaaagagcaaatgcttttagaagaaagattatagaattacactgaaagatttgaataaaaaagccaagttcattaaggctatattatccaacattaacttgattgtacaattagctgcttaattcatattttagagactgtagcattgatttatgacaatgatcaggactcagaattcagaaacagatcatattgcaaagcagtaaaaatagcagtttatccacttgtgtcaagaacacataatgaagttctctttttggaaaaaaatagtcttttttggccagaataaatacatgcttacatatatttgacaatataaacttaagagctactttatgctgagcatgtcgctagctgttaatgatacaatgatgagcaaatcacagagaactgctgccctatggacactgcattacaaaattttaaataaatattcatggctttaaacaaaatattaaaaaaagaaaaaggatacttaaaagtaaattggatgaaataatagtatgtcattgaagtatgacaaattagcataaggagaaaaggcaattccaacaaagccaaataaagtagcacaggaaaatatcatcatagactgtgaataaattgcctttatgtaagtcattaaattgttttcagtgaaggaatctaaaatggattgatatgaattataagttatttgggatgtttatgaatttccaataagttatttaccagaggcaattcttaaatatagaagtataagagatagaaacacagaaatataaagagatattatagaaactctgacagagagattaagatatagagaaagcaatcagaatatacagtatagtaatttctgcagaaagaacaaatgaagagacaaaaacgaactattattattcatagaagataaacattaattataaattcagaaagcagcaaaaatatctatcagaacgaataaaaatacacccatatataaactaatttaaaaaatgagtgaaaaccaaattacccgtaagaataataaaattggaaacattacaaagacttctcatcttgcaagataagatgtggtaagtgtatgtaaataatttgacaaggaaaggaaaaattcattgaaaaacaaaactattacaaaactgatgctatgaaaaaccgaatagttttatatctaaggaatggaacttggaacttaaaacctttacacaaataaaatgactggcttggatggcattactggtgaattttaataaacactcatggaagaaataacagttcatcaattttacatgaaccattttaaagagtagaagaaaaaggaacactttcaacatagttttaggaaaccagcataatactgataccacacgccactcttgacattgtaagaaaataatagttcaacatccaaagttaacacagtagcaaatatcctaaaccaaatattagaaatttaaatctagcaatatataaaaagaataataaattatggtcaaatgagatttatacaaggaacgcaagaaggatttactacttggaaataaatcaatataattaataatattaacagagtgaaggagaaaaacataatcatttaaatgaatgttcagacagcattgaataaaattgaattccttttcataataaaacatctcagcaaacaacagtggaagtaaactcaatctaataaggaggatttatgggaaacctacagttaatgccattcttttttttctttttttttttttgagacagagtctcgctcttttgcccaggctggagtgcagtggcgcgatctcagctcactgcaagctccgcctcccgggttcacgccattctcctgcctcagcctcccgagtagctggaactacaggcacccgtcacctcccctggctaatattttgtattttttttagtagagacggggtttccccatgttagccaggatggtctcgtctcctgacctcgtgatccacccgccacggcctcccaaagtgccgggattacaggcgtgagcccccgcgcccggccaaatgccattcttaattgtgaaatgctgtgcgcttttcaactgatgtcaaacaacaaaaagacaaaggtagccattctccattgttatttagcattgtacaggagttctgaaccagtgcaataaggtaagagggattggaaaggaaaaagtacaactgtcttaacagtttgcattaacatattcatagaaaatacaaaaaattggaaaagtactagaactattgaattaagttatcaagttgagaatatgtcaatattgcaaaatttattgtttgcccatatattaattagaaacaattggtaaataaaatttaaaatacaacatttacacacacacacacacacacacacacttccaagctctgtctgctgtgaagcctagacgcaatgaaacctctgtagcaatgaacacatctggtgatcagatctgggtttctactaccattctccaattaaaagaaaaagaattcttgcagaaatgactgatctatggttggggtgggaaaaatacaagatgagtctggaacatcttatatttacagaacacaaatgctcaaaaaccaaagtggtaggaatgtgtcagagacacagaagctaagggaataaactcccagtggccaaactgaacaatttgagcagcaaattaaataacatagcttagaattttaactcaaagcataaaataaatgtgcaagagtctatattgatatgaataaattattgtataaataaaaaatgggaaggaataaatctctatcaaagaatctcaaataatatgcagaaatggttccctcaggtaggtggaacataatctctttatccccttaagttgggctacatgcagtgacttactttcaaagagtgctgatacagtttggatatttgccccttccaaatctcgtgttgaaatttgatccccagtgttgcaggtggggcctggtgggagatgtttgggtcacgggggtggatccctcatgaatggctttgtgctgtccccatggtaaccaatgagttgtcactatataagttcccgcaagaactgcttgttaaaaagagtctggcacctttccctctctcttttcctgtactctcgtcctgtaatctcctcatgctggctcctgttcccttcctacttctgccatgagtggaagtagatgctggtgccatgcttcttgaacagcctacagaactatgggccaaaaaactgttttctttataaattacccagcctgaggtattcctttatagcaatgcaaaacagactatgacaagaacagcacagtgaaggttaaaaaaaggagttactttacaatggaaaaatcagacagataccacctcagggctgtaatcaagcttaacatattcaataataagtcatattgatagtatatactcttgataaaaagtaatgagagtggtactttacttctgtgggcttccttccaaaaatctcataatctaatctattcataagaaaaatatctatgaacccaattgagagacattctacaaaatacctgactaatactcaggttgaggttataaaaataatgtaaaaaattttcacaatctagaggatcctgtggaaacatggcaactaaatataatgtagtatcctggataggataacgggacagaaaaataacattagtaaaaactaaagaaatccaaaaagcacagaccttaattaataataatgcatcaatatttgttcacaaatgttaacaaatatatcatcctaactaatgtaacatggtaataatagaggaaactgggcatgggatctaggaaaattctctgtactgcctttgcaaatttcttgtagacctaaactattctaaaataaaaaggttatttttaaaatataacatgtacaagcatgcatccatacttaggaataaactaagagatatgacaacccctgaaaaacatagttctgagtaactgagtaactgaagaaggcaaataaattgatatactatgttcatggattagagcacttaatacctattttatgtttgttttgtatttaatgcttttcatattcttcagaaagtatggtagagagaactttgaattttgataaaggatatttatagcaaactcaagcaaacaccatatttattttggaaacattagaaatattctctttaaagccaggaataaactcaatttcatttaacattgcttttgttgaaacatcaagacaagaaaaagtggcagagtgtgtaagtactgacaggaagaaattaacatgttactattcctaggtggtgtaattatatgaagaaattataaagcatgaggactaaaatgagagtattttgggcaatgtaaaaaataatcatgttcttatgtattgacaatgaagtgttaaaaaataactaaaaggttataattttaaaagcctattttaataatgaagtataaataattaaatctaaaagatatgcaagaatttatgaggcatatgcctttgttaaatgatattaataatatttaaataaagagagtgatgcatcgtattcatggacagaaagactcagtagtttgagatgacagtttccccagtgctcatctttatattcaactcaagtttattttgtggaatttgacaagataattctaaactttatgaaaagccaattcccaagaatactaattaatactttaaacagaatttttaaactgtgtgtttggtaagttgtcctattaaatatcaagtctaatataaactgtactaaacaagacaacgtgatatcagtgcaggcatagacaaatagatcattagcatagaacttgaaaccgacccattaaatttcattacaaattattggaagtaattattcaattgtgaaatgaaaataaatgcctaccttacaaattacatgtacgtatacatatacaactgtacaaaactccaaggggactaaaacctaaacaagaaagcaaaactcttttatcagatagtataagaaaatatctttatgcacttgggtgagagaagaatttcttatggcaaagaagcatagagtattaagcaaacaaggttaaattttgtgaattaaaattatttatacatcaaaaagaatgccttgaagagtagaataaatgtttaaaatgcatatagctgacaaagtattcatcttcagaatattgtgtgtgtatgtgttaattgtgtgtgtataataaaaacaagcaaccttaaatggagaaaatatattaagaagcattttgcataaagaacatctgaatcatttattaaaatgcttaacctcactgtttatcaaggaagtacatgataagcaggaattaagtccaactttacaaccattatgtaagttaaaaaattagaagtgggtaaatactaagtgttggagaacatgtaaaacaataggaaatctcataaaattgctaataggtgcttcaaacagaatgaccacattggagagcaatttagtaatttgaatggggagcaatttagtaatttccaagtaattaccaagttatctcactcctaggaatataccctgtagaatagcttgcatatatatactatattagaaggtaatacacaatgattttttttttttgagagggagtctggctctgtagcctaggctggagtgcagtggcaccatttcagctggctgcaaactccgcctcctgggttcaagcaattctcctgcctcagcctcccgagtagccggaattaccggctcctgccaccctgccggctaattcttgtttttttagtagagatggggtttcaccatgttggccaggctggtcttgaactcctgacctcaggtgatccgccctatgcaatgattttcaatgcagagatgatctgtagtattgaaaacattagaaacaacctacatgtctagcaaagtagaatggataaatatattatgaaatactgaaatgaaaatgaaaaaaaccttgtctacatatacaagcatggagtatctcaaaaaaaacataaatttatacctgaaaaatgaagccaaactaagctacatgtgtatacttcaatatggtcattttgattatattttcatacatacagaatgaacatttatatcttaatatcaaactcaggaataaagcttaccttaagaaaggaagtttcatgtatttgtactgtttaatttcttaagatggtgatagttttttttagtgttacttataatccatgcatcttggtatgcctgtaacttttttttaataaaaaatacttcaaaaagaatgtctagtagtttaaagattcccttaacatatatatagatatatggagagatagatagataatatcattttttatgctgtattggcttaggtatctctcgagaatctaacgactcaataatttaaagtagcatttatatataagtgcttactgttgcaagtaaaatgtgagcctatcatttgtatgaaaattgaaaaactgtaggtttggacacttctgtgagatcacactggaccctcagatccttccttccaatgtgccatgcatctatgtacaccgacacctgaaaaactattaacccaaaatgtctcatcttttttgttctcattttataaaaatggtttattttatgggcactggtgaaaagtaatggttcaatgtataaatattgatttaaatcacatagcagcacaattctctaactttctaacatatgtgtaacaagatggagagtcatctgttttttgaagatagataaaaccaatatgttcatttaaaaatactgtactactgtatatacatgcccaaactactatggagactgtgaggggtaggatttaaaaggggtataagcaggctctgggatgctacttttgacttgagtgtggttacatgaatgtgtgcactttgtattaattcactgtacttcactcctataatttgtgcacttttttgcatatgtattgaataaaaagttaggaaaaggaggctcattattttatctttataatggaaaaaagtttatgattcagtaataagtaaagaagtgatttgtcagaataaaatgattacatcatcctttgtgcttagcaaaatgtttggttcattatatgctcccacaaaaagattcactgaatgaatgaatgcataaaccatgtaaaaaatatgtgcagtcaaaacatttagaagtaaatataaatgtagctaactgctaatagtgctgggtttgtgtgggggcgttatgggtggttgttttctctctttttcaaattttaaaataaataatggacttttaatgtcatcgtgggtgtagccagtcccataaggtgcttctatgatggaaatttctttcttgcttctgtcatagttatgcttcatagtgtgtgtatatatatacatatttctattttggagtttttcttaaaagtttgacagttagctgagaacatctggaccacctatagccagcccccatccccagatcagatcaaatggaattcccttttacctatatcatggaagctgcttatcatctcagtgatttttttcttcaagattattcatttttggttcttataactaggtattttaagtactggaaggcatagggttagagaaatcacatattaatgctgtagacattcatagtcctgcagactttttctgatgaaaaataaaagctttcatttaaagctttttgtctaacttctaacgttctcacctgtgatcaccaaatagatatgctctgcctgacacacttggcgtgttaaattttaaatttgtgaaggtttttgtttacttttaaataatcttttgaattaagatataacagccattcataacatacacaagtctgcagtgtccattaaaagattctgacatatgcatatacctgtgttactactacccagatcaaaaaatagaacaattttggtacccagaaggctccgtggtacctcctcacaatcagttaccaaccacctcccacccctgaccaaagatagtctatcagaattcagaagtcttttatcatcagaattgattttttcatgttattgaacttcatacaaacggaagtaattggtacatgttctattgtgtttgttttctttagctcataattatgtttatgagaaatatccatgttgttgctatgtaatattccattgtctcaattgtgaaaattaatgatgtgacttggggttattacagtcatacccaactagatgggagttaaggaccatggggaaaaagcactcaggtcacaaagctcctgctccaggaactgtctggcaagccaggctgcagaaataacttgctatatcttaaaacccattttacctagtaactgcttccatgtaactgctaccttccatgcctcaaagattagtttaccttccaccaagattagttttacctaccaccatcactcaacaattacagcttgccaaagctggaagaacttgtctaggccaatgaactttctttcaaaacattttacaaaacttttctcttaaccaataaaaccccaatcttttcttttgttctgtggacaccctgaagaccagccaggtctgtgtgtatgcaccaaattacaatttggtttttgcgtatatttccaaagaaaacctttctttgcatttgcatttctttgcattgttagacccaacttaacaaatgctttcatcctggcacataagccttatccacaactcatcataggtttgcaggagcacacttcatataaaagccacttaatgtggagatcttaagcttcccctcattgaaataatcacgtgcttcttttatcatcacagtttaaaaggcaggacagatgtgcctctctcgccaagaccatgttcccaaacagtaatgatggtaaactagttttatttttaatttaatatttttaagaacgggaatttccagtagttgttaaatcattatctgtttaagaagaatgtgaacttgaaataattgaggtggaacaagtccttaaagaatctcattatgactcatatatgagggtaataaggaagttaaaatgctcataatatttgtagaaaaaagtttggtgactatgtgtaaaataatgaaactgtactcaagtgagaatggttggtactacatgaaattaatcagattaacaatattgggaaaggagtttaacagctaaaaagagatttgagtttatattgttaaactgcacacgcatttttttaaatttgtgcaagaaaaatatgaaaaatacattgtttgaattaacttaattaacaaaaagtggcctaaaaagtagactaatagagaaattttcccaaggattaaagaataacctcaaatgggagagctgtatttaaaagtgagacataccagttatagactagaccagcagagggagctcaatatatttagccagtaaagacattgaagacagttaagattcttgttaagcagacacatatggaagaggataattacgtagttttattttaaatatgaattctcagacataaatatattcattaatgattacagataatttgagattccatcctctcaattttaattgactgccttagttgaattcaattattcgtattataagaacagaagtcagcctgtgcgacagactccgtctcaaaaaaaaaaagaacagaagtaaactatattcagcgtaagaagtgtgaataagtttaaaaaatacattaacacatatattagcatttttactgaattaaaaaaatacagcaatagaataatgagataaagttttgttgtagagtcgtgatagtggaccctgtgaataaaatacaacaacttaaccaagtgggagcaaaacattttatgattcttatgatagaaatatactaacaagttctaattttctttgtgcctatatagatgaacatcaaaatcacagctattttagctgataccattaaaaattaataaatattgaatctgatcattttaatggaaatgatatatgtttagaaatttggaagaataaaaagaaaaataccaaggtggacatgattaggtttgtaatacttaacttctgggatatttgaacaatgttcattgacactgcttgagactgtgaagaagtgagtgatagatgctcaaagtgatttcaaaaggaatacataatgatggagtatgtaggtaaggaaaggcttgcatgctgaaggagagaaataaaacttatggtgagagtgtgtttgcaatatcctgcaagcttttgcagaatgctattctataaagtctggctaaattgttaaggtaagaaatttaactggtgtagccatcttatagattgtgttataacagttttagtggtagactgatgaattatgtcataaaaaaggcactttcagaaaactggcaatctttaagtcttaatgggaaggaaatctgcctatgccctctcttttttccaagtcccttccctccctaccccataaagatgggtaagactttaaatctttccagctattgctgtgggaagtatttcatggacgcaatcatgtaaaagaaaaatatagagaagtatatttccaggtttttaggattacacatgtatagaaacaaaatgagaaaattgccagggctggaaatacaatttgagaagcctaaatagaacaaagccaatagtgattccttcaactgtggattttatggactgaatatgtacaaatgttgggtataaatcagggccaatttttccacaagaatctagaatatatcaaagtctaaaacaggattatagccactttagagaagaaattgcaccagaaccagactgtttctaaccaaatgacatacgtcttctctgcgtttacattcatatacacacattcatgttaacttagattgtatcatattgaagataattctatataatgcctccaaatttaaattcagttcttttccacaaatgcttattgtagttaagctatactaactttgaatagaatcacagagatgctggtaaatgacttatattgcatacatgagggaaacagctttttttttttaaatgatgcctgtataaagcctcttcctgttgagatagattccaacacacactcacacacacctctacacacacttacaccctcatatatgtaaaaatttgcatattagattgtttttcctagaaaatttactacctatttactattctaagtaaatagaacataattctctaatattggttttttaaactaataaatccttaagtattttatatcatcttttagttaatattaactttgagaagtatcacaaaccatacttactaaatttacaaagacaattctagctaatttaagaatcatcatctatacagtttcaaaaaaaataaaattggctgctagacaattttatagatgttcagtggttcatgtgtctatttctgcattttattacagttaaattgcccaataaaagctaaagggcaaagcagagataccatgtgctctttagaaaaagctataaaatttaagacagaagaaatttggtctgtaatgacaatttttatgtttttctggctttaataacttgattatataaaatgttttcaaatacagttgataaaatctataagtataatgttttggcaaataccatattcatttgaaaaagtaatcgaattgaatatttaaaataacattataaacaaatttgtaagtggggtacagagtaaacatgtaagtatttactactctgcttatgtctggatattaaagattattggaaaaaaataattgctatggtgacattttagcttttaatttgaagtttaatattagattgttgaatggagaaaatcaatgttgttttcacttatatttatatactctaatataccatctctaactgaaatgttattacctgcaggtgactgtaatttaattatactattaattttacattttaaaatcttgttatactaatttgggttttaaattacataaaatgttgccattaatgtaattacagattactctagtgtgaaacttgttgcaaagtaaaatgcctaccatggtcgtctctgcgatagagccaaagctgttgatgaatatgttgcatgtgacattaactggagggcctgaaaaagagatgaaaacataagggctgtttagagacttatctaaaacattttcaaataattccttgcattccattattattattccattttacacacacacacacacacacacacacacacacagatgcttaaaattgaagcaataattccacacaacaatatgtactgagaatcacaaggttcacaaggaacactgatgctgatcatttttttacctctcttggtcttagtttttaaaatctagatgtctctaatggctctgtaatgcctgatgctgtaagtccagtttctaagctcattcagggatagtttctattgatcttttccccgctgcatgggctatacttttctatttctttgcatgtcttatatttttttttgttgaaaattgaatactttaggtaacataaagtggcaactctggaaaccaggccttcccacctccaatccaaagtttgttgttgctggtttttcttgcagttgttgtttgttctttagtgacttacctggaccaatatggtaaagttttcatttccctagagtgcacagccagtgaaatctccatttagtgagcttagtggtaaactaatatttgattagagatttctttaaagccttgagccaataaatcttccactcttgccaagggtcttccatgggtttggggacatgtcttcagtgctcaggcagtttacaactctaccttacccttcacttcctgcttgcacagagcctgatgtccaccagaagtgagatactgggactctctgaggacttccctggacaggcacacagccctatgtgcatatgtaaactccagattgcaaggatatgttagagcttttcagagctgcctaagaacatagaattttccaggtcctttataatttttgttcaggctcttacttgtcccaactagtgtcacagccttaggcagctacaatgttaaacaatcttctaattattttccacaaatgccctagagatagaaatttttcccaccaagtgagttcttagtgaagtcaaataatggaaagctctttgagtgaggctcttccagggagctaccagacaggcagaatactgacaaagctctggggatggaccttctgaggaattccaaacttggtcagccagctctggtggttttacaacttctattgtttaggggtggctggattgcaaggctgctgtggaactgggaaggtcggtgaaattaatatcccttctgttcttacagaaattcatcagtttttcttgaataaacactcttcaggttgttgtaagctttttatcaattttaaaagttctaacggttaatcttgacaattttgccaatgtttttgttgcttttttggagaagtgaacttattgagtttctcactcctccattctggaaatttcttattaatgcccgacttagtattcatcataaatccaaggatttttatttttataaggcccatttattcattcctttactaaatatccaaagcctttgcacacaaaactgaagaagacacaaaaagattatcatctagcagagaaggaggagcagaaattggtaaattgttgtaagtttcttgctgccaggcactaccttagctgattcatagatatttaatccatagtaactctgaaagagggaaatattccatcattaacattttagggaattaaagcacagtgaccctacgtaagatgccagtaggtagcacatttagaacgtgaaccattgctctgattctagaaatcattcttttcccaccaccttgtttatatgaccttcaaaacatttcattatctggccacaaactttgttattaggcagatacctgtataaatagaaacgtaaaaatattttgtgctaggggctaaaatagctctgagttacactctatgtaagttagtcggagaacaccacatacagaaactaatatctaagactaatttctttgtttttttttaaactgagcgtaatttttgagtaaattgatcttacaaggtttgctacaaaaatgcctagtagccccttgacttatttctgtttccctctttttcagagataattacttcaattcatttaatcatcaattcttcggatatttacctcaatttctctacataatatgttttttcttttagacacatcttctgatgcccacaaagaagataaagatttagccttttttcatacatcatccctatctctactaacataagccttttttctgtcttcctgttatccaatatttttgtatgaaaaaaggcttggtcttttttgttagatcaatattcactttttacattaatatgacaaggtagatatttaccccagccaaacaatagaatatgttatgcttactttttcctttcctgcagaacattttcctgatattggcaattgcttcatatataatatttcacatagctttctccacatgaatcgttaacttatccacaagccctgaaatgtctaagttttgattcaatatgtacagatccatcaggttctctatgaactttaccttcctctggatttacagaggaatgtaatgagaatgttttgctctggttcaaagcaatcgttctatgacctcccaatcatgctaggaattacttccatagctttctgttgtgggatcctcgttcatggtcccatacttctttcttggtttatttcttcattttagtggaacatatgctccagtaatgttttgacaaatgctgcataaggctatgaagcttttgagagagtccttgttcatcaatgtctgtttttttgcattcacacttaatgtatagctagagttggtagaaacttttaggctggaaatgttttcttcttatgaattttgaagatactttttcactattttctatttttcagcattgccattgaaaagcccaaagccattttgtagatgacctgtttttctttctgaaaataaataggatgtttcatttgttccaatattttttaaaaactatttcattagttagaatggtctaaaatatcatttgaagttgcaatttacatttatttgattactggttcatgattttcatcttaatttgcttttcaacctattctctagatggctatttatcttgctgaattaaggtagaggaaaaatcaataaaattatttaaaaataaagtttaggtttcaaaggcctttaaatcctatactacacattgaaatcacctggcaatctttacaaaccatagatgcttaattctcacctatgttacttggtatggcatgcaaccaaggcatcagtatttttaaaagcttcctaggtcattataatgtgcaagaatgcttggaaaccactatcctaaggaattacagactagaaaatatctggggccattatactacagggttatcagagattttcttagaaatagaaaaatacagagagaggagtcagggcttgggagcattgaaaattccaggctattaatttcattaaaagcgttgcctattataaattcggtgaacactgttaataaaacagagtagatgctatgtactttgaaagggcctaaagtttactaaacataggaatgtctagaacacataattcaaacatgtatagaagttaaattgttttaaatatgaaggatgaacatgtaataataagaaccttataaaagacctgcatcctaggggcgctgtatttagttactaatgaacattttaaaatatcttcattgcttatttctgaacatttacaaatttctaaaatttgtaagatgagagcagtgtgttatgtgccactatgtgggagaggagtaaacttagtttactccatgattaaaacaaaattccatatatacaccatggaatactatgcagccataaaaaatgaaagagttcatgtcctttgtagggacatggatgaaactggaaaccatcattctcagcaaactatcgcaaggacaaaaaaccaaaaaccacatgttctcactcataggtgggaactgaacaatgagaacacatggacacaggaaagagaacattacactctgggaactgttgtggggtggggggaggggggatggatagcattaggagatatacctaatgctaaatgacgagttaatgggtgcagcacaccaacatggcacatgtatacatatgtaacaaacctgcacattgtgcacatgtaacttaaaacttaaagtataataatgataaaataaaaaaataaataaatgaaatttccgtcctaaaaaaggatgaggttacaactgtcagaagataattttttcttaatgtgagtctaatatgaactctgaaaagtatctgtaggctgactggcatccttgaaaagctaaaaccaatctttcatattttctaggttattctctttttccaccagataatactagactcctactattttctttttttttttcttggaatagcaatatgaatctgagaaacattatttggcttgagataaattctgtcatgctctattgactcatatcctctggaaaaaggaaaacataagaacatcagtattgggttaattcacctgtaaataaaatgctgatggggtacagccatgttgggggaacatggcccaggaggaagctactattagaccactgctagctgcacctgattgggatctttttggctgaaacggaaataaataaaagagtggggagataatttttcttattttagtttagaaagggaaggggtctttatttcttggattttagtttgtcacaggcattgaataaaggatgaggcattctctataatacattttgtctcgtcttttaaatttaattagtttctatatatttatggacaattgtggtgaaagaggcaaaatggaggcaaaaattcagcataggcttcaaggttctgaagttagtgaaatctgtgctggcacatttcagtgtcccttgggagcaagtgttatgtggcacatcctaatgagtccattaaggttctgaaaggagcagtgttaggtaccgtctttggaggagcaaacttctgatatatttgttttctttctaaaatatggtgctgacatccctggttgaccagaggctcaaatagtaaggccgatggatgaaatacagaaaataacatcatttccacagaagaataatggtcaaagaattgactaatttaggctttcactaataggtgggatcataatgcctcattgtatttgaaacagacttcagcctcagcctccataacattcctccaataagaagcagaaagctcttcctaaaggtgaaaagttgcctggcttcaaaacctaaatttcacgtgcaagtaaagtaactcacaatggtctcaggcctaaactttattctccacctggttataacatgttccttgattggatgttagaacataaaaaagtgtgatttggttcccatttgactatttacttgtgtatatattttcttcttcagcagaaagaagggtgaatgaatttggacatcaaatcctaattccaaatttcaaaactatggtagacacttacttgaaaggcagatagatagacacatatgcataaataagaataacttaaaattttaaaatattcaaataaaaaacagtttggaaataaaaatcatttcagatcatagagtctcctcaatgtaataacaaggtatttgggatttactttaggaaagctttggagccataacagattcttaaccttggaagtgtaggaactaacatgactcgtgaatgtttgcatgaacaggcaaaagcatagagacagaaaaaacagaaatttatgataatagtctgggatggggacagaatggacctgaccccgaaggacaatgacagtccttggagatagattacaaagaatgaaatggatacagcatcataatattttaaaggtatcacgttctaccccttcggtttctggtgcacatgagattagtgcagcaatcttggagtagtctttctatcctagctttgaaatagacattcaaaaattgtgtagagaacgaagctcagagaagattatgaatcttctattgccattacagagagcacctgtttagtagctcttggccaatctgctacttctctgtgccaatgcaaaagctgttatatctatccaatacactcctatgttaagcaacagagcaaataactgctatagcatccatatggcaaattgtgcttttaaattgttcacgactttaggcatagtccttaaaagcaaatgacagtagttgcagatgttttcagcagtaagttttcgtttagatgttttttttttttaaagaaatagaagatggcccttaagtttaagaaatgaagtgatggcagaatagcaaagtacaatgcaaaatcttggcaacgatattattgttattcatattggggaaaaattgttcactaggcagacctagagcaagtaagaaaacaaacaaacaactcatatgttcataaaaatgactaaggaagttttcagggagtgttgtattaaagttttatctttttaaagacacagaatgcaactaaaagattaaatttcaaaataattccaactagagacttgttttattttagataaatgcacacacatgtcacaaggagagacgttattttattttttattcacaaagcatatttgatgacttaaaatccagattttaaattatctgttaggtgctttaaaaaggtttgtaaattatggcatagaagcagaatcctgtttgttcttcccctttctctttcccttcccttctcttcccttcccccaaatgctgcactaaagtcatttgtttgggcagtgcaaaataggcttaagtgctgggatggctgagggggtcgtagtaacctaaggcaggagagaaggacattgtggaaaagctccacatgcaggaaatgttggaggtccggtgagagaggaaaatgtacacccacaatagggaagcctgttgttgggtgttagaaccatagatgggcaaggtgtgtgtctccatggggccatcctggcttgcagagttggagtctgaacaggcatctacacaaggagatgaacctgaggaaggcttcagagtcccaccaggccaaggaaggtacttgtgtaaaagaagaagtagcagcaaacaagggagattcattacatattgattaaataagtaattatattgaggataatgggagcctggtttcttgctgttggaagaggaagttaaaatatggaaacttagaaactagactaaacatatggtattgacagtgtgaattcatggttttcaatagatacagaagtatagaagaaaatcgatgtgtaaatgtatgtgtgtgtgtatgtgtgtgtgtgtgtatgtgtgtgtgtgcatgcatatgtgtgtgtttatttatgcttatatgtgtgggtatatatagatatatcctggcaggcaccaacttaatcaggtaatcataacctgtaatggcaaaatctgacatggtccaccatcaaatagaatgcagtcaaaacacatcatcattcctgtaatatccctgctaaatgcactacctaatttgaatcatgaggaagaatcagacaaatgcaaagtgaagtatattcttctaaataactgaataagaatatttttaaatgtcaacatcatgacagtcacagaaagaataaagtgctggttcagactgaaaaagacaatgagaaatgacaaataaaatatgatgtgattctaaactgaatacttttataataaattatcagagagtggatgaaatttgaataaagatcagcaaattagaaggtagcaatctattcaactacttttcttgttataatggttagattgtgattatcaaggagaatgtttttatttgtagtaaatactcaagtattggggcatcaggtcaacaacttacattgaagtggttcagaaaaaaagcttttgcacttgtaacacttctgttagtttgagattattgtaaaatacaaaaaagagaaataattactacagaaataattaattaaaaacaaaaagcaaatacaaacaaaaaatacagggtttagaatctaaccccatcaacatttcaaatgaacatgtatagttttagaagagcttattattcaagagatacttcttgttaaagtgacctcgtactaagtaaaaatgcaaacagaaatgtaccattttcaaaaataattgtaaatgttattcaagaacaatagtgtcttggtggataggaatagtaaaaatgggtaaaggagacctttaaaatgctaacatttaccctaataaaaatgcatgtagaaaatgagtttgggtacacatgccacccttggcatggatgttgttgtagaatagagtactagaaagagtcaatttgtgatgaagggagaaaaggattagtgaaatatttaagggtaaaagacagaaaccacaaatacatcgtgagggcaaacaaaagttatatctacatacaaagagagtggccattggagataacataagaaaacaaaaatgcaataaatacttgggaggaagacagaattgggtgattactgaaggaatactttctgaagttgcacttatgagtcataagagggaccccaagattaggatcaaaagaaagaagtaaaatccagcagtggtgggtaaaatattctagtgaaataatgttttgttgtcttataaacatacttttacttgcaattcaattgttttatgttaaacatgcttctagtttcagatgacaccttgaagcttctatttcaagacagagaattgaacgtcattttctttctttctgaagacataaaaatgacattacataataaaattttagtgagaataaatgtatcataccaaaaataatggaaaaaaaataataattagtttaatgacataaaatatagagccagataaaaatggttgacaaatgaaacagaggtaagcctaaaataaaagcaagcagggactgcatggagaggggaaggaggtggagagtgagaaggggaccccagggatagggcctggcatctgtcttgagagctttctgcttcccctctgtatttctgttgagcaacggttgcctggtatttagccctatggaatttttgaggaaatggaaataacttctttgatgattagggcaaacacagtacctgaaaatacctcaaaccttaagcctgctctatttcaccatctgcaggacccaagaataatgcctagtcgaagctcaacactcacctaaagcaaagctctggccagggcaatgcagcctgtgtcagagttccctttcgaagtagagaaataacagaaaaatggccctcctatagcacccaagctaatcacccctcaattcttcctgaatcacagacattctatcacacataagaaaactagtggtttaaagagaatgaacaatataaataaacataatttatcctgcaggaagaagcaacaaatcattgggcagagaagaaaaacaaaaggggcagaatgcaataaaagacgcattaaattagcagtctacttagtgcaaaggaatctcgtaatgcctgtgttgtgaaaggcctagaaagcaatcaaacaaattagaacagacaatcaacagaaataaccaatttttttggagtgtttgcctcaaagaagtagaactgtgcatcgttagtgttgagggtgaaccgctgcttttcatcattgacacttgtagacatttttttagcagcttcagggacatgattgttactattgtcataaataaaactgacaagcaaataaacatacaaaatagcacctgcgtagcagcttgtaacacaacgtccacaacttcgcattcaaggaaaatggtttaagataaagaggattgtgaagagaccaaaacacaattacagagttaaaatctccctaaacattcacaaattggataaatggcaccatgtaactgaggacaaatctgaacaattctgtttataatgtagagggaaaggagaaaggagagaaggggatgagggcaatgtgttagacacagatgactggggaagatagcagattttttaaaaataaagaatattgttttacagaaatgacacaaaacagtgccagcataagcaaaaatcctcctactgaaaaatgtccagagataggcagaaaaaaatagcctatatataaaggagcagaaatcaaaatgagatttgacttctttatgatattaaatgtcagtaggcaatgaatcaacatctgcaaacttctgagctagaattctggagctcgataattgtataaagtttctttaatgtcaaatgcatacaaaacagattatcctggaatattattcaatgatgaaaagaaatgagctatcaagccacgaaaagacacagaggaacctgaaaagcatattgctacctgaaagaagccaatttgaaaaagtctacatactctatgattctaattatatgacatcctggaaaaggcaaaactctagagacagtgaaaagatcattgattgccagagactgggggtagatgaggggaagtgggagagagatatactcataccacaagcacaggagattttagggcagtgaaattattctgtatgatacagtaatgacaaacacacgttgttatgaatttgtcaaaacccataaaaaatgtacagcacaaaaatgaactctaatgtaaattatggatttcagttcataacgtactaatcttggttcatcaataataataaatataccacatgaatatgaagatgccaataacagggtacactgttggggaggagagggcagatatgcactttccaatcaattattctgtaaacctaaaactgctctttaaaacaagtctattaatttaaaaaagtcagaaaaaccagaactcagaaaatatataagcattactcctgtcttgaaaatgaaaacctattttattttattttattttgtttttcagcaaatggagacaaagctagaatatcctactgtttagtcttcaagttataatttatatgtgtgtgtatgtatgtatatatatatataaagaaactaccagtttcaaggattattaagtcttcccttaattcttaacctggccctccaactctgtaacatcgttaggcagtgcctcccagtgagcgccaaggcctgtggtctgcgcctggggatgtggtgctttctctcactgggccggttctgtttctgctcttttccctaaccagaaaggcttctaaagagaaaagatttccaattctgagaaagaaatggtggaatctacctattattttcattttcaaaataaaaataactatttcttttcttttctttttttttctttttttgcttttaccatgtctcatatatttttctcagccacatcatgggataaaacaataacaagctaaccagatctgatgtgaggttggtaaaagaaaaaaaacacaggggggatgagccaagatggccgaataggaacagctcctgtctacagctcccagcgtgaccgatgcagaagacgggtgatttctgcatttccacctgaggtaccgggttcatctcactggggagtgccagacagtgggcgcaggtcagtgggtgcacgcaccgtgcgcgagccgaagcagggcgaggcattgcctcacttgggaagtgcaaggggtcagggagttccctttccgagtcaaagaaaggggtgacgcacctggaaaatcgggtcactcccacccgaatactgcgcttttccgacaggcttaaaaaacggcgcaccacgaggttataccccgcacctggcttggagggtcctaccccacggagtctcgctgattgctagcacagcagtctgagatcaaactgcaaggcggcagtgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagacaaacaaaaagacagcagtaacttctgcagacttaaatgtccctgtctgacagctttgaagagagcagtggttctcccagcacgcagctggagatctgagaacgggcagactgcttcctcaagtgggtccctgacccccaagcagcctaactgggaggcaccccccagcaggggcacactgacacctcacacggcagggtactccaacagacctgcagctgagggtcctgtctgttagaaggaaaactaacaaacagaaagaacatccacaccaaaaacccatctgtacatcaccatcatcaaagaccaaaagtagataaaaccacaaagatggggaaaaaacagaacagaaaaactcgaaactctaaaaagcagagtgactctcctcttccaaaggaacacagttcctaccagcaacggaacaaagctggacggagaatgactttgacgagctgagagaaggcggcttcagatgatcaaattactctgagctaagggaggacattcaaaccaaaggcaaagaagttgaaaactttgaaaaaaatttagaagaatgtataactagaataaccaatacagagaagtgcttaaaggagctgacggagctgaaaaccaaggctcgagaactacatgaagaatgcagaagcctcaggagccgatgcgatcaactggaagaaagggtatcagagatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaagatatcatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagtggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagctgctgcaaaatcatgccaaaatgtaaagaccatcgagactaggaagaaactgcatcaactaaccagcaaaagaaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaagtcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccacattcataaagcaagtcctgagtgacctacaaagagacgtagacacccacacaataatgatgggagactttaacaccccactgtcaacattagacggatcaacgagacagaaagtcaaaaaggatacccaggaattgaactcagctctgcaccaagtggacctaatagacatctatagaactctccaccccaaatcaacagaatatacatttttttcagcaccgtaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatagaaactgaacaacctgctcctgaatgactactgggtacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcactattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgagaaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacatgctctgcaattgtggcaataatcaatagcttaccaaccaaaaagagtccaggaccaaaaatggattcacagccgaattctaccagaggtataaggaggagctggtaccattccttctgaaactattccaatcaatagaaaaagagggaatccttcctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctctataaattaggtattcatgggacgtatttcaaaataataagagctatctatgacaaacccacagccaatatcatactgaatggggaaaaactggaagcattccctttgaaaactggcacaagacagggatgccctctctcaccactcctattcaacatagtgttggaagttctggccagggaaattaggcaggagaaggaaataaagggtattcaattaggaaaagaggaagtcaaattgtccctgtttgcaggcgacatgattgtatatctagaaaaccccattgtctcagcccaaaatctccttaagctgataagcaacttcagcaaagtctcaggatacaatatcaatgtacaaaaatcacaagcattcttatacaccaacaacagacaaaaagagagccaaatcatgagtgaaatcccattcacaattgtttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcctgaaaatggccatactgcccaaggtaatttacagattcaatgccatccccatcaagctaccaatgactttcttcacagaattggaaaaaactactttaaagttcacatggaaccaaaaaagagcctgcatcaccaactcaatcctaagccaaaagaacaaagctggaagcatcacacgacctgacttccaactatactacaaggctacagtaaacaaaacagcatggtactggtaccaaaacagagatatagatcaatggaacagaacagagccctcagaaataacgccgcgtatctacaactatctgatctttgacaaacctgagaaaaacaaacaatggggaaaggattccctatttaataagtggtgctgggaaaactggctagccatatgtagaaagctgaaactggaacccttccttacaccttatacaaaaatcaattcaggatggattaaagacttacatgttagacctaaaaccataaaaaccctagaagaaaacctaggcattaccattcaggacataggcatgggcaaggacttcatgtctaaaacaccaaaagcaacggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagagtggcaatcattaaaaagtcaggaatcaacaggtgctggagaggatgtggaggaataggaacacttttacactgttggtggtactgtaaactagttcaaccattgtggaagtcagtgtggcgattcctcagggatctagaactagaaataccatttgatccagccatcccattactgggtatatacccaaaggactataaatcatgctgctataaagacacatgcacacgtatgtttattgcggcattattcacatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaccaaacaccgcatattctcactcataggtgggaattgaacaatgagatcacatggacacaggaaggggaatatcacactctggggactgttgtggggtgcggggaggggggagggatagcattgggagatatacctaatgctagatgacgagttagtgggtgcagcacaccagcatggcacatgtatacatatgtaactaacctgcacaatgtgcacatgtaccctaaaacttaaagtataattaaaaaaaaaatacaaaaaaaaaaccaaaaacacaaagaacccctaataacatcaaaacttagatgcaaattcactattcttaccaatgacctgtgcctaagtgaacataaaatcaaccatttctatacataacatttctcttccttaagaccaaatttttgaaataatgacttggacaaaattctaatttctattgcatgatcaactggttgagtgatattttcagctttactttctaattctttttagcagctctcagaacatttctaaacccatatatcattattaaatgccttttaaataatagtttttaaaatcattatatttaataggactaagatataatagaaatttgaagtagtttttatacttatgtcaaattatcctaaaggcacaggatcattagtggagaaatctgattctcaaaaatgtttcagataaattaatactattctggaggggaagagaacagattaatcagtgaaaaggaaagataatgttaatgagttaagcacctaattattttaacttatttcagtattgatttaaataatgttcgatggaagaggctgtcttatccatggtcaataccaatttaaattgctttaagagaattatttatttatacttttctgtggtacattttaataacattaaactacttagtcttcaagaggtgagatttttttaaagtgtactttttaaagagaaatgacaaaacaataaaaacaaacaccataattttggttaagtaaaaaaatctacttctaaatttttgtaaatgttagaagtagaaagcagcaaaatcaaagttgcatttttacaaagtcgtttgtattttttaatagttgttttcccactatggccttcaaaataaattttctttcaatataaagatacttgtgaaaacaatcacaaattttatactattactccagaaataaattcataattatgtatataatgctggaacatttcttatttttaaatatttgaaaggcaaaaatgttatattactgttatacactttgcttttggctaatgagattaaacatttccatttcgtttctgttaattgtctgataatgtccatactgaaattttatgtttgccttttacaaaactttgaagtccagagagggcaaacagataggtattttccaatgctttcatattttataagcacctttctatcagctgattacttatctaggtaagttatgtttctgtgtgtttaggaagaagtgaggatcaaatcatttaggttatagtaatatatttttacatatatcacaattcccattcttcttcttttttaagagatagagtcttactgtgttgcccaggctggagtgcagtggcacaaccatagctcactgtaacctcaaacaactgggctcaagtaatcctcctgcctcagcctcccaagaagccaggactaaaggtgtgtgccaccatgcctggctagtttttttttttttttttttttttggatagatgggtgtctcagagctggtctcaaactcctagcctcaatcaatcctcctgcctcagcctcccaaagtgctgggattagaggcatgagacccattcttcttttaaaattattttagctaattatgctcatttttaaaattttaatatatattactgatattcatgtctctaaacttgcttactattaattcattgtctttgacaattggataggaaagcatacataacaccaattttaaattagttcatttgatgagctaactagattccttccaaaaacattgatgtggggaaaggcacaaaatcaacaaggcaagggattgtatttttagtcatgtgaactaccacagagaaaaaatgagtgcaatattatcaggagaacaggttcttcattttctacatctatgtttgatgagcttatttttgcctgaggtgaggtgggcccctaggtacatgacgacacaagggctgatcattctcacctccttttgtgtaaatgtcttctgttaggtattggattcagtttgttagcacctaaatatcctcctgatagccgtaaggaagaaatagcatgtaaatactattttatttatatttcaatattgggtaatgaaatgatggtcaaaagatgatgatgttattttatccaatgaaatgacacggtgttgaatatacttaattagggagtagagttataagtatgtttgctgaagtcaataatgtttgacctttgcaaaagatgacaaagcaaaagtgttagctaaaaactaatccattaaattattactttttataattgatattatttttggctatcaaatgcagcctgaattttttttctaatgttcagagcacaagatattttgaaaaacaatgagagaaaatcttcctttttctttttcttcctttagtgacactggggtgtaagaatgaattttagtctcccccaaaatctaatcacctctgaactggcttggtgatcagcttgtttttaggaatacatttttacttagaaaagaatcagtatttgttttaagcaacaccaaatccttgggggtcctttcctgatcttacatataaatagtaataatcacatttttaaatagtttaatgtttctgttatcttttaaactattaaaaaaataaactaacactaaactttccaagagaatggcaaaagcactgaggccactcttgtgtggttggtaacttatctgcagttttattaaaataactgctgagactgtttatatgctttttaaatattcacagacatttaaaaatagaatgcattttcttctttaattttcagttaaaagaaagaaatacttctgaatcactgaatatggactcaccataatgaatctgctaattcccgattatgtgtcttgtggtttagttaaatgacaactgcatatttttgaagatcaactactaattagttctcagcggattcacaggaatactgctttccctcaatttggaaaagatcattataatactgaaatttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtgctatttttgcacaacttgtactcagtgctttcctcctgaagttgaaaatatttatggttgaaagcttaaaaacaaatcaagacatgtgatccacaatttaaatattaaactcattttaaaattgaagccattcataattttccactcagacattatcagtgagttttacttcttttgttcctgctacccaatcttgatatttttttactccattctagttatttcacccactgctaagcatttctttttttcttccataaggacaaattcaaggaaaaatggtagttatagacaacacttttttaaactttagcaatgaaacagcttaactgaatcccatgaaaaaagtgtatgttctttaactttgtttattttctttattgggtaaagtaatattcaagaacatgttaaataagttgggatctggaagcagctttctaatattttaccattaaagtgaaattacaggatatattgtggttctggataagttacatatccttatataaacatgttacttacaactatattaaacagaagaataaaaagtggtactcttaaataattgacaattacactctttcctagaaatttgggtaaaacatttggtaggtgcaataatgtcttatacatttcaaaggctgtcagttagcaatccagactgtttcccaataggtaaattcaacaacggttagattccccacaatatagacagtagtaaagtggctgattaaaaagatgggaaagtttatcactagcaattaaagaagcttccattccagttagataactgatagaataattaaataaaggatacgtacatatatgtatattcctaaaatcaatggtcaagacaagaagtattataacagttagagaagtaaaaaaaaaaaaaaaaaaaaaagacatagctgggccaaagaaggcaaattatgataattgagaacatgggaatggatttctttttcaagacaccttggtgactaatgcaatatttggaagattgttgaaaataagcattagaatttctggtggaattaatttaaaactgtaccttgttgaagtatatttaaaacacacatataaagtagcaaacagaacaattacctttaaaattgggtctgattcttgcatcatatcctgatgtcctgcccattaatttatccagaaaatcagaaggtgacattggagcacttcgagatcttgcactgtctgtttcctttgtggcaaccaaactacaaataagaacaaaaatatagactttacaaaaagaagtatttctaataattgttacctacaaatataaaatagaaatgctgagctaaatatctttggcaacaaaacataaacctttagatatcatacagtgaagattataataagatagacatttatagatttatagtcaatacttgtaaggtttcatatctattcagtccaattgtcagaggtggcattcttttgtattagacctgaaaacaaaggccacttccaaaatattaagctttcaaatctgtgtttacaaaagccttatttctgatagcaatttttaaccaaatgtatccttattgctttaggtgtaagaaaacattaaaattcaactgtgaactacaatcttattgcttttattgagggaaaacatctcttttcaggttttgtgaattattcttagcagtaaaaaacttctgtctaataaattaaacaatgtttttttcttcaattagagtgcttcctgaattagcaacacacaaagttaaattcattctgcttttacctacatgtcattagtctacaatacctttcgttcagatctaaaatttgtgtgtcaagattgagaaattgccataaatgtaccatgtgcacctggatattatattagtagaacctgtgtccaggaaaggtagtgtgttcctatattcttttcattcaattttttcctttgtgtccagccacttatcctagaaacccatagtgtaggctgcttctcctgtccagctcttcacttacatagccttctccaacagaagctggggcctgcttgttaagatcaaatgattctttttatccacagagttttgctcaggaaagtgacactgactttctggaactgatgtgttcaagctgatgtcacttcctgaagatcatcaatcatcacatgctcccagctctgtcattcaactcaggacattgccaaatcaaaccatttgggtcaccacatgatcataacaagatcagttattaaattccttagatttctcctgccagaattttagtgagaagtacaactggggcttagagccatcatcattaagttgtttaccacagggatatatgcagtgattcatgggcacagttttaaaatctcatcaatcttggtgataatatgagaatgagatttctgtaagcacagaatcacaaataacactatctattagctgttgccctgttctagaggttctgtctggttctgggcactctgagtcacttgtttccccagtgactctcattctgtcattctcgctttcttccagaatggaagcgttttttctccctattctgttggctccatgtgacttcgtgatcctttatctctgattattattgctcaaccaaactgtcattgtgatcattgggaagtttattctaatacaaaaatcattataataataaatatatttttttaaaaaaacctatcttctcaatgactctagagctttattctaccatctggttttaagtaactttttcctctcctatcaagaagcatttgtttatattccatggttcaagaatagtgtggaaaagcatcgttggattttgtagctacatgctgctgcttttaaaccattctctttatttcccttgcaaaatctctcctttcaattatcagaaaataaacttctacctcctcctaccaacaaatataccaatttatcttgacctgaaccaataatactctgcctccttctcttttaaaaatactagacgatggccgggtgcggtggctcacgcctgtaatcccagcactttgggaggccgaagcgggtggatcacgaggtaaggagatcgagaccattctggctaacatggtgaaaccgggtctctactaaaaaatacaaaaaaaaaaaaaaaaaaaaagaaagaaattagccgggcgtagtggcgggctcctgtagtcccagctactgggaaggctgaggcaggagaatggcgtgaacctgggaggtggggcttgcagtgagccgagatcacgcgacggcactgcagcctggaccacacagcgagactccatctcaaaaaaaaaaaaaaaatactagatgactatgtatactgaaccacaatccttcacattgtgcacagaatgtgggaacgttatcctagattatcaagggcagttctatatgcaacaacatgtaaggatatatgtatgtataaagatacatgaaacagtatccttataaggatatttatccttataaaaaggaggcagaattatatttgatgacagacagaagagggaaggcaatgtgaccatggagacaggaattggggtgacgcggccacagcaaaggaatgctggcagccaccagaagctggaagagaaaaggaatggattcttccccagagtttctggaggtagcacggacctactcacaccttgattttgacccagtgaactgattccagacttctggcctgcagaactgttagagaatagatttctgttctttgtggtaatttgctacagttgccattggaaacgaataccaaccttctattgaatttttcatgtctgtcatgctgcttttcaaccccagaattactctttggttctttttttataatctctatctcattatttcctttttggtgggacactatcatactttctttttagctctttgtacatggtttcctttaatttttaaaatgtgcttaaaatagttgatttgaagtctttgtcttgtaattgcaatgtctttgcctccctaagcatgcttctattgattgcatttttcctgtgtttggtccatatattttcgtttctttgagaaacttgtaacttttattgaaaactggacattttaagtaatatactgtggcgactatggaaatcatattgtcttttctccccagagtttggtgttgttgctcttttttaaatggacttttttgaactaattctgtaaagtctactttctttataatatgtgacaattagaatatctacttggttagcttagaggtcagctactaattgaacatggattttattaatttctagaaccaataagtgactcagtatttgctgggggttctgtgtcatggggtcataccttcaacactatgtcaggcagttgattactctggactttactttcacttgtgtgaggcctaaaagtcagccagagttgagcactaagggtgttttcaggtctttcctgagcatgcacacaaccctgggtgtactactttgctagtgctgccatgacatagtatcaagaacaggtggctaatgcaacagaaattaactttcccacaattctaaaagtccaagatcaagttgtcagcagggttggtttcctccgaggccctcccttgttggcttgtagatgtccattttctgtttttttttaatgatcttttcttcacgtgtgtctgttctaacttcttcttataagcacacaaggcatattggattagggcatattgttttacatcaattacctcttggtaaggtaacagaccttacctccaaataaagtcatgtctggaggtactggcaggtaggacttcaacataggagtgttgggagaaaaaaattcagcccatacgtgtggccttccagataaccaggaatatatgcagtttttccaaacccatatggacatatcattccaatgctttccgtttaacatttttgttaagtatattgtgtgcccacactattactgattgccttaggcacctgtgaagttaaaaaaatgactctaaatgttttaaacaaacttcttcaggaaaaaggcttttggcggtgggtgaactccaagttaggtcacagaaaaatagatttgcaaatggggtcttccagaaaacctgcagacaagttaaataatgatcattcttaaagaataaggccttaaaggagttcagactccatgctgtcccctctggtggctgccaggttgtggacttttcctgtaatttggggctattggtttacgttgtcaccacggagctgaagagagggggtgggaagttgagcaaattataatgccacaaatcccactgtttttactaagagaaaaatgtttttcttcaatatacaacttcaggaatcactacaagcctctgattaattgtcagacttttgaaaaagttgattctcacaattatttttttgccagttttcttgttgctttcataaagaagagaatttatggaggtccttactctactatgtgtttcttactgtattatttttgctgatgtcactctctaataatgccttcctagacttctttttatatttgttttactatatctttgctttaaataaccatgtccctcacagctccattctggagctcttccattgctctctttgtgagtaattttatttactcccatggtatcaactgcataccatgataccattttgcaggcctttcaaaaaaatacctgttttcttaagtaatgtcaaaatttacattcatttatttatttatttatttatttatttatttatttatttatatttagagacagggtcttgctctgttgcctaggctggagtgcagcagcacaatcacagctccccgcaacgttgaacttctgggcttaagcgatcctcctgtgtcagccgcctaatggggtctcactatgttgtacaggctggtctccagctcctggactcaaacaatcctcctaccttggcctgccaaagcactggaattagaggcatgagccactgcacctggccacgatttgcttttaaaagaaaggatgcaaagtctgtttttaggattttcctataatatatgtccaaaaactgtagagtaaatattctaagtgactgttattcttgtggcaataataaaggaataattctatctatcatctatcttttcatatatattttcagatatggcaagtattagtcagcacaataaagaaaaaataaaagactaagattaattaagattaaatcttaattaattttagatttaagattttcactatctaccaacaactttgacaaaaaagtaattttatttatctaggcagaccaatgctaaattttaatgataataatccctttcattcatgcaaatcatatcttgcaaaagtctgtctttttctagttttcattaactcatttctaaaatatttttccaaatgttacaattgaacattaatcttaaaatagaataagaaaataaaaaaatcacatttttctcatctcatactaagcaatcacttatccattgaaacccacctattataatagtttgatatttgaaccaatatgagaaataaggtattaaaaattctccagtagtggatgtagagatgtcatctctgtgcactttttaaaaaaatattactccaaatacaagtagtggtagggactggcatgttaagtgccacgtgatgcttgcattttctgtagtatatgatcatgttgcttaagaactcctagaattctggacatttataggaaggcaacagcgttaaacaatcaaaatacaacacaattttatgcacacacgcacacacacacatacacaccacacactatgctcactataattgtattgtcccaaattcctggttgaatatttcaaaccctattaacaagcactctcagcacccaattatccctttcgaataactaaatttaaaaagcaagatagttattgtttaaatatgacaaactcattcttaatctttttgaaggttaaaaattgttattaatattttaagtcttatctcatttcttttgatgtattcaaaaaacaataattgagctactgcaataactgctttcctgaaatttgatctgatattggttctgtaaaaattctatttgaaatatactttcattgccaaaaatatttgcttccaagtatattacgtaaaaatcatgactaattcaccaggggtgggaatatataaaaatccatttaatagaggacaagagttttatgagtagtggctcattcatttatttatttaacagccgttattgacatgttccaaagagcctggcatcatgcctagaatagtctcaaagagaaaaaagttagaaataaataaataattatatatatttatattgtatatatatataacctcagtgcttaacctttttaaagatcaacatgttgttaaaatagcttctgctaatatataaattttccttgtttatgcaattaataattaaattaaactggaggaagaaaaacatactaccttttatcactaacatagaccaagacggaagatatatctttggtaaatacctttagaaagatgtgaagtatttcatctggtagcagaaaatctactaaaattatctgctttctctgaaaacagttatatattttatagtcaaatgtcccattatttttttctattctttaatactggaaattaaaaatatattttaccataaatgtgaattaaacacaaaattatggttcttttgacatggcacttaaaattaataaatgcacaaatataatttgataaatgtattgagagctatacatgaaatatacattggtctgggatggaggaggaatatgtaagaggtgataaactgtttttaaagtacaatacacaaacttttataagccttttataaatggagaaaagtttactactaataaaattaaagtgcatttatttattatgtaaaagtatcctttcttataccataatgtaatcaaatatatggtatatattgcaaaaatgatttttgagttcttatgtaatttgttcgatgcaaagcactgtgctacaaacagtaaagtatataaaacacaaatctgaatctttaaagtgttcacagttcagtcgattactctgtgtggtctccttatgaagtgagcaggagctgaaaaatgagaagataatgaagtaaatgatccgttggttcccttcttaatacggtgtgagcaaaatccttatgttttgtaacaggaatcaaaaccaaactctacagattgatgcctataaaatgagaaaattctgaaaagattaatatttaaattttctttatgacttgctatggtctcaatgtcatatggtctcaatgccatgaattttggactccccaaaagtcatatgttaaaattctaaaccctaagttgatggtaataggagtggggacctttgggaggagattcggtcataagggctccaaatgagattagtgcctttatgaaagaggccccagagattttccttgccccttccaccatgtgaggttacagtgaaaagagagtggtcaatgtaccaggaagcaggcccaaaaccagacaatttgctggtgctctgatcttagacttcccagcctcaagaaccaggagaaataaattgtgttgtgtataagccatccagtttatagtattttgtttttgcagcctgaaaggactcaagtactactgatgtttccttcaatgatacagactcattcaattgcttatgggcaattgattttacttttaaagattcacattttttacacaaaagaatttattgttggcaaatttacattgagttattggctaaaaagcatttttacatagtctatccctttctttctttcttttttttttttagacggagtctcgctctgtcaccaggctggagtgcagaggcgcgatcttggctgactgaaacctccgcctcctgggttcaagcgattctcctgcctcagccccccgagtagctgggactacaggcatatgccaccacgcccagctaatttttgtactttcagcagagacagggtttctccatgttggccaagatggtctggatctcttgatttcgtgatccacccttctcagcctcccaaattgctgggattacaagcataagccaccgcgcctggccccttcctcttctgaaaggggtggaggctttgcttacagaaagacttcctatcagctaaactcttactttaatatatttctcctaaaactttcttcttattacagtaatatctgagccttgtaccatgtgaacattagcagacagcccttagaaaactagtcatttaagggaactcacagtaataaatacatagtatgaggctccatataaccaatttggcagcctactctaaatttgaaatagcccacatcatttgtacacacatattcaaaaactttttttaagttttttaaaactcagggtaggaagaggcagtgaaaagaaacccaatattaatttagaatgaattttggataagaaactttaccatcaaagccatttctattttgtctaaacctcctagtttcaacagagctgacgtatttatagcaagttactaagattgttagcaaattagctatgatcggtactttggaaggaagcagctttgactttttcgaatagtcttttatttatgaatctcctcaaaatctgtggtaattagcttgcctcccacacttcactcttcttttctgtgctgcaccaagtatttcatttactattaacttttcttgggaactctgtgtgggctcatacacattcccatcaatgaattttttttaacttaggtattttatatattcttatttatataaagacatgctacttgaaagttcagaaactttaatttcataaatgttggcagaaaccaattcattcaagtattgaaacagaacatcaaaatctaacaataatatccaataagataagagagtaatagctgggtgcattggctcacacctgtaatcccagcaccgggcggccaaggtgggaggatgactgagtccaggagtttgagaccagcctgagcaacatagcaagacctcttctctacaaaaaaatcaaaaattagctgaagagatagcaaacgcctctagtcccagctactctgaggcaggagaatcacctgatccctggtggtcaaagctgcagagagccatgactgtgtcactgcactccatcttgggcaacagagtgagaccctatctcaaaaaaaaaaaaaatgataggggagtaaaatatattcactcacttttggaggatgaaaatagccaataaatacagatgcttttatgatgacttttaatataattgccaataagtatctctgctaaatacaccttaaaattttcagagaaaatacgaaagttgaaggtgagaaacataacgtgggtttgagacagaccttgagacatggggccacaatgttccatgtatctcttttcaaaagttatttgcacagagggaagaatgactcttggggaacaaatcagtgcccaggctcctgaagcagggaaggtttagggtatgatggagaaagagagtttactatgtattcactacctccgtgggccagtcctgtagagttatgggcccttgtgaaaaaaaatttagtatttgggcttttctaatttgtaagtaacataagcaattgatatttctagccacagtttgaaaaataagatacagaatgaaagatatgagccttttacccatctccctatgcttcaatgtagggagaactaaagagaaacttggtcatctgggaatatgtgatgtttcgagtatttcaaactaaatcaaagtggctaagaaaaagaatcattgcagtgaagacactaccagtgaagtaggccttaagttaatttttggacattaataattaaaaaaagaaggccaccatggaagaatatttaaaagacttttaaggctgggcgcggtggctcatgcctgtaatcccagcactttgggaggccaaggcgggcggatcacgaggtcagtagacggagaccatcctggctaacacggtgaaaccccgtctctactaaaaatacaaaaaattagctgggtgtggtggtgagcgcctgtagtcccagctactcgggaggctgaggcagaatgccgtgaacccgggaggcggagcttgcagtgagccgagatagcaccactgcactccagcctgggcgacagagggagactctgcctgaaaaaaggaaaaaaaaaaaaagatttttaaaacacctctggagacagagaaatagctaaaacttgatgggctactaggatcttgattcttgtcactgtcagcaatgtgccagtgaaatatgattattattttgaagtgatctaatttctacctgcagttgaataaggacttaggaattttaatttttcgcagataaatgatagctgcttcctgatatcttaggcacaggattaatatacatatcatttaattaccataataatgttattagtcataattacctatggattacagatgaagaaacaaaggtatatagaaaagttagtaatttttctaggccactcaaatattgaaagtagaagcctacactttaaaacaaaccaaagcttccgcttaaagcaactagaaaaggttctttaaaaagtgccatggcagtgctaaaaacaccagtgaaaaatgacatgattgagacctagataaaaagaaattcgaaggcaatccctatatttggagatgcatgtccctttggggtggcaataaattccgtaagtcgtaactgagaggctaacaacctgaacaccagttttgaaaactttatggatttagtaagacaaaaattgcattctaggattcaccaaaatggcgaactcacatgagttagagatctcaaagaattacaacttttaagaattcaactttagtaagaatgacccagaaatacagaaccttagaaagaagataagtattacttgaaatcctctcaatttccaaagctggaatgcaatactaaccccaggttgctagcaacttacctctctaaataaatgcaaacatattaaatacatcattttgggaggaagaatatatcactctaaacctcaaattttatctgattcatatgtacaacacctgggatgtaatataaataagcaggaaaaaaagtaaaagagaattaactttaagatcttcaactcaagacaaatgtgaaatagaaatagataaaccaaagattcagatgatgaatttgttacagtgattaagctttatatgtttaagtagataaaaaataaaaaaactgagaatttcaacatggaaatctattataattaataactaaatggcaattccataatttaagaatgaaataaaattaagaactcaattatcttaacagcagattaggcatagctaaaaagagaattacttgttcggaaagcaaaccagaagaaaatgtatagaaggcagtatggaaagttgataaaatgaaagatagagaatagacttgatacatcatagtaaacatgcaaaaataaatgcaaaaagaaaaattataagggcagttgatagtaaagtaatttaaaatttttcatagattttatatggactttaagaagattaattttaactactttctgataattaatttttgtaattaatagacataacttaatgtggtgcactggctaattaattcaggaaagtgaggttttgctgatttctacatcagacattctgtctccttttcagtttgtgtagcatactctcaaatggattttagcacttcctttcagtcacactgcatctcctgatttcatttattttccaataaacaacaccctctctacagggtcattcctataagcattcaaaccatgcttttatttgtattgttaaaaccaaaccccccccgccaaaaaaactttctttactctatcacttgtctcagccacctgcccctttctcttaaaagcaaaactttaattacacatacgcacaatgtctaattcctctctgtatatagacagtgcctagcttatgatgatttgacttactattttttgactttctgttgtggaatctgatgcttatgcctgccttatgatgattcaacttactattttttgactttctgatggtttgggctgccatttgtttgttgttgttgttgttaaaaaactgacaatggctggcttaaaataatacagattacatctgttttttctctcagtacagttttcagtacattacatgagatattcaacacttcattataaaatagactttgtattagatgattttgtccaactgtaggctaataatgtaagtgtactcagcatgtttaaggtagagtcggctaaactatgatgtgcagtagcttaggtatactgaatatattttcaactcaggatattttcaacttatgatgagtttatcaagatgtaacctcatcataagttgagcaacatctgtatttactcttgaatccacaccagcctctttcaccactccatcagtaaaatgctcttgtcaaggtcctaatatcctccacagagctaaatccaattaattcatattgagacttttttctctaatgacacgtcccttggtgatattatccagtctaatagtttcagacatagtatagattacattgagcaatttcagtttatatctcgagctatgaattcccctgcactacagactattgggtccaactgcctacttgtcatctccacttggatatctgacattacatctaaatcaaactcttgtcatttccacacaagtttgctctttctgcattcctttcaaacttggttaatagcagctctattcttccaattctcaagatgaaaatctttgctaattactgactccacttctaacttttacatatcatatccatcctgttggccttaccatctaattttatccataattcaaccacaccttaccatgttctctttgactggtctattccaacttactactagtgattgcctttgcctaaagtgctcatggtcctctattcatctcattaactcttactttcattatgatccagatttaagcataattcccccaggaagccttaagtattctctctgattttagaaaatactgctaaaatgtgtctcaagtctgtctttccttggtagcacttgttgcaattgtaactgtcaatttttacaggattggtatatgtctatctgcctcctttgtagggtctactatttaagcaaaaattgtcactgtttcatttgtttaaatagccctaaaagtaatccaaagtatctagataaatatttttgaaataaatatttcaaaaataaatatttttgaaatgaattaactgaatataatgagggagaagtcaagcctcagaatttgatcctccaaaccaaccagtagtcatgctttgagtacatgtttgacactagagaaggtctaacctttctcatttctcatccttgtgcccaagttaggagtgatgctgatgaataataaaaataatattgaaattggcccaattttcccatagagctgatgtttacatttttttgaataagcatagaaattgctcctcctggtcttaaaacttgagacttacatttgtctcatctacgttcctttctcagaaaacctgccatcagttctcccagatagtatcaaggaactgaaatgtaccagatcactacatccagataatgaacaacaaaatcctcatctatcatgattgtccaactgactacacgctttctgttgatcaactcctcttctttacccctccctaattcttgtttttttgtgcatagttacattccttccctattatatagacctccaattttagtcaactggagaggaggtgaaactaatctcctgtctcctggctaacatcacccaaataaagactttctttcctggcaatactcgttgtctcagtgattggctttctgtgaggtgagcaatgggatctaaactgaacccctggtgtttggtaatggtattatagaacaaagatttagaagtagataaaaatcaagatgtagaaatttaaaagagaaacttgagtcatcaaaatcatagtctgaaaattgtcatttaaagatgaaaccagagttgtgaattgaaatgctgtcagtatctttttaaccaggcttgatattgcagtagtgttacattcaggacttacataaattagtgcttattaggggtatctatattcagtgcttgccagttgccagtgataaattatatatcgtttgtacatgaacatagcatatttgagtgtgaagacttaatattgggttatggtggggttggggtggggaaggaggactccattcaatagtgaaatatatgacaaaaattagtgtaattatttgagatttcttaaatctaatctttatacaatttattggttttatctataagatttattttcatcatgcactcattcattttgactaagctttgaaaatgctaaacttgaaattcatggtaattgttataacttcctaaaaattgtctcttctcgtgggtaatagtttatttctttatagatttggcatcagcttatttcaactgaaagagctaaaagaccataatgcagctaattaactcactgatttgtagcttcttaatgacttatttattttaaaggaaactaattaagtgtttcagaatacactgaaaattacttaggaaagacttattagctcctactgtgtcatgctcaagataataaaatgtaaggtaccatgatacaatggatgaggctccagatggctagccaggaagcttgtattttgttcttttctgtcattaactagttgttttgccttgggcaagccagacattttaccaatacatatttttcacagataagtttagtaaaacaaatgatgtgacatacacatatgtttagaaaactgccaaaatcttatgctgaaatttggctttttcattgaataccatgactctttcggtcagggatatttttaattgaaatgaagagaaatccactcaaccttgtttatgtaaaagagcgctgaatggtgatagtagtatcttatgagactcaaatgtagaaaaaacagacaaacttcagcaaagactgagcaccataaaattaagaatctgattgattcatcccagttcatgaattcaactcctggttgaaattgctttagcaaaagaggttcaaaatcactttgcaaacttgtagttgtaggggccttgactgacagacttgtctactagttttccttaaataatttctcattcatgacatttggttttttatagcccaactgctgaatggatatttaaagtagtctggggtttatattgttttgtatttaacagtttggttttggttttggtatactaagcaagattttgaataattcaaaagaaatatatcagtttatataaaactcagtgaaaatttataggatgaaggacttctgaaatagtgctccagagtttcaggcaggaaaatgttgaacagacaggtaaaaagagaaagtttcctagaacctgtgatgggaaagagtacggaaaatacaagagactagaagaatgtcagcatggctggaagagagaaagagagcaccaacctaataacaaatgaggctggagagcactacaagtacctgatcatgtagtgccttacagatcatattatggacatgtatcttcatagccccattaagagacaattctagtggtcaggaagagagttgagggtagtcttggtaattttaatagcagtaggggtggagaagagtggaacaacctaagagacatataattaataaaatccacagaatttggtggtggtttggtactggatgtgaaggagaagaatgtcctcaagattgaagtagtgtcattcatctgggataacacccaaggtttgttgtcccatgtccacagaaaactaggacatggatacaccagaatgaggttaagagtggaaatttaataggcgaaagcaagagaatagctctctgcacagaacgcgcggtcctggagaaaatgtgttactgcttctacagtgaaattcagaaggttatataaatgagcttgatggggtggtgtctgctttacatagggcatgaaagattggtcagaccaggtgtgccatttgcatagggtgcgaagaagctggccaccccaccctaatctttattatgcagatggcttctctacttggctagtgccatgttgcctggttctttactgtacacgtagcgacaaagaaaagtgaagatggagccttcgtgttgaacatacctggcttccagatagccttttctattggcacagctgtcggcattcccctgtgcaagcttccagcttgcttatctatgtttgcagttcgatttttcaggctgctttttgttaaaaaagaaatgatttgggagctgctttttgctaaaagggaagccgtgctgaggactcctttaccctctctatttgcctaaataatttctttctagctcctgtattaggatgagtgtggtggctttaaaattttttctcaaatttttttgcactcctctcttcaaagagtgctgttcaatttccctcctcttgaaatttggctgggtaaagtgacttgattgtgcatgaattttgtggttaggtcataaaatgcattgtaacttccatcttgcactcttttggatcactgactctgggaagctaatcatcatgttgtgagaacactcaagaagctacaagggagaaaccaagggcttctaccagtaggcttcattgacttcctgcccatttcactgagccatcttggaatcagcttctctatttcagtcaagacttcctctgacttgactgagatcttgacataaacctcatgaaagattcagagctaggacacctacttaagcagctcctgaattcctgactcacagaaactttgaggcttacaggtatttattgttgttttaagccacttaaatatcagggtaataaaaagtattttttaccaagaagtttctgcataataataaaacaggttgatatagaactcagtaaattttcaataaaccataacatttattatttttatggatattatagaagttgggtcttcaagaggatagtttaaatgaggaaatgtttcagtgatgctatttgacaaaggcagtgattcttcaactcttcaaacttttgtgtaattccagagagcaataaaaacacccttgatttgatttagagtatcactgtctctttgggaagggatcatgtggagcctttgtccggatattacttcaatgtcctctcagagaaaagaggtcttccttgaaaagatcaggtgaaaggtatagcaaagacttttcctgaagcttataactcctgttcttgttccttgtaaacatttttgataaatcacttttttaaatctgggatgttcaatattgttaattagcatttaaaataattaagcttaaaattataaacttaaatctgcagctttacacacacatctcattatactaatcgctgcatgcgtaagactttcaaaaaaacaaggtgtaattccccaaaacaactaaaaagcaggttttgaaaatctaagaggaaaccaaacaacaaaatttcaacattcttatagaagcagaatgttctataagacattgcagaatatttgtgcagattgttaagataagacaaagcagaatatttgttcccccatattgtatttcatatacataaaagttagccctctgtatctgtgtcaagttctgcatctgtggattcaaaaaaccagacattgaaaatattcagaaaaagaggatggttgtgtctgtactgaatatgtaaaggctttatttccttgtcgttatttcctaaacaatagagtataacaactatttaaatggcatttaccttgtgttaggtattatcagtaatctagagatgatttaaggtatgtgagaagatatgggtaggttatgtggaaatacgactttattttatataagggatttgaacatcagtgaattttggtatcctcgggagtcctggaatcaatcccttgtggatacaaagggatgactgtatatgtatctgtatatatttctatagacacccatatacatacaaaacacatattcttatattcatttagttgtatatatgtggtaaaataaagttatggaagactgtatatgcaatagatgaaataccaataaagtctctgtaactaaggaatataccttctgttggaagaaacagaaaataaacaaaataaacatatacataatcaagacagttagagactgctctatgttctcagaagaaaatagccagtatgatgaaatagaaaagacagtctatcttgaataggatgcttgaatagacttagaaagtctttactgagctgagtgtgaagcagacaaaagaagatacagagaacaactacttcaaacttacggtgttgtagcaataatcaatctactggaaaataataacataaacttggtctcttataccatgaaaataacttacagataaattaaatctctaaatatatgtaaatttttaaataaaacattcaaaaatagttcaagagtaagcacatttctattttctttcccttgcagtgttcattaaaggactactaaatgactaaacacagattcactttcaaagacaacaggaaggagataacagcaaacgagaaattcctacaagttttacaagtttctgggagatgaaaaagaaataatctataaagagatttatatgtatctatccagaaaattttcagaaatgataaaaacaggtattgtcaaagttaaatgagcctatttgagatcaaaggaggttaagcttaaatagagaattgtctagacctatttttgtaaacctgccaaaaattatgaagagaagattctgaaagatttcctgaatgaatattttgaaagaaaaagtaaaacacaaaacagtgagaccacttttaaattttcatttatggagcctacaagataaaaagataaagcctttgaaaattctgggtgagcattattttcattcagtgttttcaatccagttttccagccaatctatgaatcagaagtaactaagcagccataatacatggaatcaaatactctacctgcataaatgctctcctggaaaaatctttgagaaaataccatagcaaaatgaggaaatagacaagaaatagaccaagaatcctaggagctgatccaacttagaaagtagtgatgtgatttcctcaaatgaaatccatgcagaagatcttagaaaacacagatacagttttgatcagaagaagagagaactctaggatggtcgctgtgctgtggagtgcagtgaagtatggaatgtattgcaaagaggacatcataggtttgagagtgggaggaagaaaataaatatttgaaaaagcacttaaagccagaagaaaacaagtatggaattaaggaaaaacaaaaggtgaaccaaaaataatataagggtattattcagatgtatggatatacagtcatgcaccacgtaacgacattttggccaatgtcagactgcatgcagaattgtgatcccagaggattataatgaagctgaaaaattcctattgcctagtgatgtcatacccatggtaatatcatagggcaatagattactcatgtgcttgttgtgatgctggtataaacaaacctacagcattgccagtcatataaaagtataccacatacaattatgtacagtacataatacttggataatgataataaatgttactggtttatatatttaccctactatacttttaatctttattttagactgcatgcgttctagttagatttttcaaagttagctgtaaaatatcctcaggcaggtccttcaggaggtattccagaagaaggcgttgctattgcaggagataacagttccacacatgttatccctgaagactttccatgggacaagatgtggaggtggaagatggtgatagtgataatcctgattctctgtaggcacaggctaatgtgtgtgcttgtgtcttagtttttaacaaaaaaaaaatttaaatgtgaaaaaaatttaaacctagacaaaagcttatagaataaagatataaagaatacattttataagctgtaaaatgtcctttaagctaagcattgttatcaaagagtcaaaaatttaaaaaaattgaaagtttataaagtaagagttaccgtaagaaagaaaatattttttaatttagtgtagcctaagggcacagtgtttaaaaattcgacactagtgtacagtaatgtcctaggccttcacattcactcaccactcactcactgactcacttaatactgcaagcgccattcatcgtaagtgctctatacaggcaaatcatttgcttttacctttagcaaacgtagttttactgtatcatttctatgtttagatatgtttagacatatgtatacaattgtgttacaattgcctacagtatttaatactgtacatgctgtacaggtttgcagcctgggagccataggctgtaccacatagccttggtgtgcagtaggctattccatctaggtttgtgtaagtacactctatgatgttcatacaataactgtatcacctaacaatgtatttctcaaaacttttccctgctgttaagcaacaaacggctgtagtcataatagtaagaaaaatgtgaacatttaaaaatgattgcttagctgggtgctgtgactcacacctgtaatctcagcactttgggaagccaaagcaggtggatcactgaaggtcaggagtttgagaccagcctggacaacatggcgaaaccccatctctactaaaaatacaaaaatgagccaggtatggtggcacatgcctctaatcccagctacttgggaggctgaggtaagataatcgtttgaacccaggaggcagaggttgcaatgaaccaagattgtgccgctgcactccagcctgggtgacagagtgacactgtgtctcaaaattaattaattaaaaaataaaataaaaatgattgcttttaggaagcataactcagtataagggaggtaggactaaagaatgctatgaacagcattagagtgctatcctcaccatttgattttttaatccatatgcaaattttactttaaaaaataattcaaagtaaaggattagagatatagaagaaattaagacttttatagaagagaattttataaataagacaaaataaaaagccttaaagaaaaggctgatttatttagtacccacacttactcattttcatcttcaaataggttttgaaaatgtacaatgtgtcgagcactgtctgaggactctggattctgcaataaataaaatggaacagaatctttggtctcatggagtttacattctagcagaatggaacattataaaccagaaatatgagaaattggtaaattacatgctattttggaagaaaggagcagttagagaagaacagagcaaaggacaatcagaagtgagaggaaaggaaacaaaagatgctggactagaaacctcctcaacagaatattcacttctctattctgtggcagaatggattagcggtggggagaggcaagaacaaattctcaaggcaactctctccccttcaaagtaaaggaaacacatggaatggataagtagtattaatcccctaattggaacatttttcttaaatatatatatattatatacatatgtatttatttgtggtcacatatatttgtagaaatatataaaatataatctggaaagaaacatattaaatgatttcagtcattatctccaagaagggaactaagacagtgttggcaaccaagggaaacttttcatttatccaaaatatttggatttttatattgaagacataattatgtattacctaagtaattgtaagtgaaattaaatccacataaagactttgaaatccattttaattaaatggctataatgattagagtcaaaattataaatgcaagtttgtggttatatatcaattaccacagtagcagcttcatacacaagctttaaaaaaatgccagttacattctaaatccctgtagcagcatttcagggaaatagtttgtcaatattactttcctttgtcaaatccgtgaaatagcagttgatttcttaaaataaatctcaagctataaaatgtttctcataggtattgttgctcctagcttccttctgggaagggatagtctttcttttctctctcattcttttcatatgcaaaaagacttcctccctaagcctgattctagacaattcatctttacagtttgtttttgaaactgttttattctagttgtgttcattcaccacacacataacacacacacacacacagagagatgcatgcactcacacagacacagacacacacacagacagcatgcacaaggtacttccccgcctgttttttttttttttttttaatgaaaaataaacagggaatttgctctgactctagcctagagtgtgctgttggataacaaacttaataaaaacgttcagctaccaataaaatcaaaatttggaaggtaaaattttcttggaatagcagatgttaccttttctttagtcagaaaaaggtcagggcacccccagagtcacaagagtaattattcaaaatccaggatgtggcctgatctctgttaatttgactgtgcatttttgccaaagggaattttatcaattcttttgcttaaatgtcatgtcctccacattgcctttcttggcttagctgagccagaaatgatccctcctccactaaattcttataggccataggttatatcacaaatgtggttctcattcactggttttcaatgttgatatgtaatacttacaagtcataattctctttactagcctggaaacttaaaggctaagggcagcaatcatgtcatatgacacatatggtgaattagaaaaacaaataacacaactatgttgctttgctgtaatttctatagtcctctagaactcagtttgataacgggtggatcatttgaaactcaattcaagaacattttcttccttatattctaaatatacctcgagcagtttaacttaccaaaaggtcactgagcatgatttcaggtacatttttctagtcataatttcaaaatgattacataaaatcaatgtgaaaaaagttgatcaagaattgagattatcttctaaatcttatttggtaaaatacttcctagaactttaaaataagcacaaagcatgtttaaaataaaaacactatatacattttattttaatctatgtgtattatcagaaaaatactacaaaaatactgggaaaaagttatttcaccaatcagaaataagcaatactgacagaaattaccattttacttgggatattttaagttatagatttacaaaggaaaagatacagcaatagtactaatgaaatgcatttttataaatcttcaaatcaataagattcaggacataaaagcatgatattttgaagcaccaatctctagagtctccagacttaaaaacagatgtacacagatattgcagtgaaatcattctaaatttatttttataaatagtattgaaccagcagagtagggactcattcagattatggtagatattcatgcttgtataactacagatgtttatgttaatatcccctttaaatggaaggcattctatcttaagtatattcaagacagattgggcctttttattcctgtagtgcaagaagccctacctctgcctggagagagaaaatggcatagaacaaaggagaaaattaaacaataaagcagaaaaaaagagtctataattaaaagtggtaaggacaggtaaatatagcactaggaatggtgtcattcaatttcactctactgaatattacgctatacctcaaggtttttatagaattatattctttttaaaaagtaagagagagcaaagtttagcaagatgccatcactgatgttaacattattcttaagactaatactcagtttatacttaaagctaatattctaggttacccactctctcacctttctctccttttctcacccttcctccgtctttttttcctacctttcttctatctatatgcctaaactattataggcaaaacattaacagttccccaggaaacaaaagggttcagacagcctctaaattatagaagttatttcctgtggcaataagagcacacgcgttcctttaatcaagcataacaaaacccctagagactgtgctttgtacaaaaaggctagctattttcaacatgtaaagaaaatggttcagaaatataagtgaaaaatataagccaacactgccaaccttcatgctcatatatagaagaattttttaaaagagtcaaatgtctgaatttgtttcagtctcatattttccaatgaaaagattaaatattgtcctataattctaattaaatgagtcatattttaccttttacagagtgatgagatgattattttttctctagaaaagtctaatacagtgctcctttggaaaaataaacagagaattttaattaggtgatgtgggtcctatctctgactttgccaccaaaattagtgcagccttaataaataaagatcattccttggcttcattcacttcctcttcagagcaatagaaatgtctgctgcaatgaggctggactgaatcctctatgaaaactacagcgtagccacaccacagtaccagaaataacacagacttggctctattctgtgttgcctcgtaaccagttgcatcagcctacactggtctgtttcattgttcatctttatcatacttgagacttcccacttcaaagatataattgtgcattcaactgatgaattatgctgaattatgaaattacaacctccaaatctatagcctaatatattctgcctctattctaacctctttctatttagttccaaagacttagcccttttctgatttaaaatctatccttcaactattgctattaaaacttttctttgtcatctttatttaatgactttgccctatctcttctgtatccctcttgtctctttctaagtatttccaaatccgttgatgtcttttctccagactataaacaagctcacatcttctgaaacagatgccttggcgggactcacaaaggggttagctcgtttactcagcccacagctctcaaaccctcacgggaaggggagcacacaggtgagagtctgcaggaatcaggacaaaggcttctgggcgctggcaggagtagaactctgtgtggctctgcagcagcatcaagggggggtatccatgaccccagagctccaaagagcatgtattacagtgtgctcttttagctttgctgtccatggctggcttaagtgtttaacagctcaatagggggtcagggtgacagccttttgcacttgccttcttagtacctgagttcttgatggcatccaggaagaatcaggttgcatgaatgaattgaagggtggtgaatgtagaggattatattgattagtggaaatggctctcagcaggatgcggagctggaaaggggatgaagtgggaaggcagtcttcccctggagtttggccatccctgagcgaaattttcttcaaagttccactgtccaagcagtccctctgaagtcaagctgcttctctctgatgtccagctgcttcttctcctctctctttttctgccactctgccactctgccagtggagcttggaaagcttgatgtattagttcattttcatgctgatcataaagacataactgagactgggcaatttacaaaagaaagagttttaataggcttacagttgcatgtggctgaggagtcctcacaatcatggcaaaggagcaagtcatgtcttacatagattgcagcagacaaagagagagagcttgtgcagggaaattccccttttaaaaccatcagatctgatgagatttattcactgtcacaagaacagcatgggaaagacctgcccccatgattcaattacctcccaccatgtccctcccacaacatgtgggaattcaagatgtgatttgggtggggacagagacaaaccatatgattccatccccaacctcatccaaatctcatgtcctcagatttcaaaaccaatcatgccttcccaagagtccccccaaagtcttaactcatttcagcattagctcagaagtccacagtctaaagtctcataagtgacaaggcatgtcccttctgcccaggagcctgtaaaatcaaaagcaagctagttacttcctagatgcaatggggttataggcactgggtaaatacagccattccaaatggaagaaattgagcaaaacaaaaaggctagaggccccatacaagtccaaatgcagcagggcaatcaaacctcaaagctccaagatgatctcctttgactccatgtctcacatccatgtcatgcttatgcaagaggtgggctcccatggccttgagcagctccacattgtggctttgtgggtatagccccactcctggctgttttcatgggctggcattgagtgtctctagcttttccaggtgctcagagcaagctgtcagtggatctgctattctgaggtctggaagatggtggccctcttctcatagctccactaggtgatgtctcagtagggactctgcgtgggggctcccacttcacatttcccttctgcactgccctagcagaagttccccatgagggctccgcacctgcagcaaacttctgcctcatcatccaggcatttccatacatcctctgaaatctgggtggaggttcccaaacatcagttcttgacttgcgtgcacccacatgctcaacaccacatggaagttgccaaggctggtggcttccaccctctgaaacaacagcccaagctgtaccttggcccattttagtaatggctggaattgttgggatgcagggcaccaagtccctaggctgcacacagaaaagggatcctgggctgaaccacaaaaacattgtttcctcctaaacctccagacctgtgatgggagggtctgccacaaagttctctgacttgccctggagacattttccccattatcttggtgactaacatttggcttcccattacttatgtaaatttctgcagccagcttgaatttctcctcagaaaatgggagtttcttttccgtggcatcatcaggctacaaattttctgaacttttatgttgtctcccttttaaaaatgagtgcacgtgggaattcaagatgagatttgggtagggacacagccaaaccatatcccttgataaaatgcacattctgattcagtgagtatgtggtggaagacagtgtttgtagttctaataagcttcctaaaggtccacacattgaatagctaggtccatgatgggggaggacttctcctcatctgcatgccccagtgggttataggtttgctgtgttttccatagctcagtcttcagtgtgtgagctggggactggcacagccggatcccaaaggtcagggatctctgtgagtcaccaggtttatttaccccaactggatgaaacgtccaagtgtgcttctcaacaataaaaaatattggaaagccctgccccagaattctagccatcaaatctcacctatttccagttctgtatatttattaaatggatatctcataggcatcacgttcactatacatatctagaacttaactcacgatacttgtccataggactgttccttttcttgtatattctatttttgtcctggcactataattctccaagttactaaaagaataaatatgattatcttacattattctctctttttctcacatccaatcaatggacaagtggttttttttttttcttggtcatttctaattgtgtttccttctctctgtttttgaaatgtgctatagcattgatcacatactatgctctctgaagccagttttgcccctcttcactgatcaacacattttcttcacagttatccatattatttctctctttttttaatttgtgttcccaaattcttggcatgctttatattttaatttttaattttaattcttgtgggtacatagcaggtatatatatttatggtgtgcatgagattttttgatacaggcatgtgatatgtaataatatcatgtaaaatggggtatccacccctcaactatttccatattacttctttagtgatatttctgagacgatctgaccatgctcctttcctacctgtcacagttctttttgcttcagtgaaggtctgagctccacaaggcagaatgcatctggagcctctggacatcctttagagatgcttccaagaagttcagcatgccacttctatttacaacttcttggccagaacttggccacagaggcacacaagcctgccaggaaaactgcaaaatctttaacatcttggaagtgtctttaaagagaagcctcttcgttctgatggctaaaaagaagccagaatgaatgaaagcagagcatctatcttcgatctcaaagaagcaatcccgcgttaagggtggcaaaacaagagagaaggattggcaacctccattccagccttgagctgttcacttgcatagtttttcttttcctttctttcttttactcttgaaagggagaaaaatctttcttaaaccaatgctattgtgcactttttgtcactcacaaatgaaactaatctgtactaaaacaacaataagaggctggtctgttcatcccttatttactttcttgccgttcaacagccctcacttctactatacaatgaattttagaaacaaagatagataatctggcattaaggttactaatatatatacttttttgagatggagtcttgctctgttgcccaggctggagtgcagtgtcactatctcggctcactgcaacatccacctcctggttcaagcaattctcctgcctcagcctccctagtagctgggattaaaggtgtgcaccacaacacccagctaatttttgtatttttagtagagatggggtttcgtcatgttggccagtctggtcttgaacgcctgacctctaatgatccacccacctcagcctcccaaagtgctgggattacaggtgtgagccagtgcgcctgaccaaggttaccaatatttaattaaatatgaaattatagctataatgctaagtatatattttctgctaaagagagattatcagattttgaccatgttagtttttaaaaattgtagttggctagaacagctctacactttacattttaaaagtagcatattaaatataatcactcagtctatagaaaagtcactcagttcttcaaagaaagaatcaagatctaatcctgagtcttatttctccaaatttattcttattttcacatggcatacaagtgaatgaggagaggcaatagaattcaaggacagttaatttagaaaatatttaaaataaatgagctatttcttatagaggcatatatcttggctttttactactatgtttttgaaatttaattctgatttttctctaggaatttgaatttttttcatatcaagcttttccagtgtaatatttgatgtgagattatatttatgataactatacatatacccacagggaatgatatgtactttgcccttttgaaatagagcaaaattttagattcacagttatcacttagggggaaatatttaggctacacataaaacctaattctccactatagtctcaggaggcaccagcaaaggtctgcagcagagtcaatgactttgatgattctcactctatttaagatttgcaggaagagataccctaaatttcagagatttaaggggaaaaatattttagaatcttttcaactgttttaaggtctttacaaagaaacaacataaagcagaaggaagatttctaatagttctatctttataatcctctgctgcttctattcttaccaataaataaaccaggaggcaagttaaggactcagaggtccatttatttgtgctagacagtaggatacagaaaaaaagaaaagtctcttggtatcttaatagactaaatgtaagtcacttcttataaaggaatgatttaataatgtggaaaatagttaatgcatattagattgttttgttattaataagaaagtaatttacaaaggcagattgtctctaagttctttgggttaggatttcattacacacttccatctttatcacttatcagaaatgtaatcacttgtttataaaatcaagaaaacttgtacgtctcttttttattggatgtttgtcttgtttaacctactaataattaagtttccctttaaacttctgataagtagaacaaactgattttaaatgatggaaattaacaaaaacatgcctatgttgacaccaactggacaagtgaatatagagtagcttattagaatatgttcttccctaacagtcaagtgctgacaatgaaaaattttgtaacagagaaaattattatttgaataaacatttgctgatattttataactctcttgaagagtcatacagattttccccagcagctagtcctaacacaacaatacagcgtggatttatttgaaaagaaaacttgagggcccatgtggaaatatctccatgaagtttgccatattctctattccacatggaaactgtggcctgtgccaacagtgcttttcctgaccattcaaattccatcctcttttctgcccaaattctatcacctgctcaagattcacttaatatttcctccttctttataaagaatttatactcctttccattccagaaaaaaatgttttttctcaatatttatcattattactatttcgggtagttattcataattacattttcagttattttcagcaaagaatcatcactcatctaccttttatagagactcacaggattaatacataaatgtatgtaaacaaagagacaaatgttctgtggtaccaatggttctacatctatctagagaattggaaacttattagagattctgatcccagaactctgataggtgcaatagcagaaattcaagtatgataccttgagaatatgcatcatttatttgattaatatttagcattgtcatttagttatgctttctcttttcagtgcaaatatcttttttaaactagatgattacatcatacattgatttaaagatacacctcatatatgaaatagcaattttctacaactattatggtatgaagcgttattttagtgaaaaatatttaaaagagaaaccatcacacatgaaagctgattactgctgaaaagagtagagttgggaattgtttccaaataagaacaagtaaggcataactgagtaagaaaatgaacatttttagatatttttttctagacatttttccctgaaaaggagagataaggggcaagtggaaaatatattaccacagacacataaaattaggaataaagaaaaataagctgcaccaaattcctcgtcaaatgttcccctgaatgttagaagcgcagaatgataacatagtagttttggttatgcctggagttatttatctgaaattgttaatgtgctttagaaaagaagaaatagtgcttcatgacagaaattagtgagctctttcagcatgctagacactcttttaagcccagcagagagaactgggaatgtattttggtccctgccctcaaaaacttcacagtttgagctagacagagaactcagacagtggcaacagcgctgggatatgtggcactggcacacagaggaagcatcctcacctagactttagggagaccagaggcttcttagagaatgtgaaatgagttaaacaggaattagccaggcaaagagatgggattcacatttttttcccagtcatttgatgcaggacatttgggtagtcatttcactgagtctcaaataacttatcttcttcaggcttccacctaaagtattagatgaccaatccgacacactccctccaccacccacagaaaaggcaaacattatttgctagtgatttcctcacaccctactgctatagtaattacatctattttattttcattagtagtattttacttgttgccacagttagctgacaatcattttttttttaaatttcatagtaacattactgtcagatttttgtacatatttcctaacttctgaaaaggagaacatccagagctaatatcaggaccaactgttgaaatcttgctttataactaaaagttaactttaagaaggaatgtaaactttttacatgtatttgacattaaaaacaaagtcaacagagtctaaacctagtcaacagtgtatagaaaaacaaatgacatagaaatgaaaatatttccaatattatttttaaagttatttgaataaaattatgatatgacgttagtaagagcagcagtgtcatggagaaagtccagtggcttcttggaactatatgcatttatggaaaaatatactgctaaagttctctaatgcttttaaggctaacttattttacagagtgttttaattgtttattgtaaaaagctgcaaagccctagtaaaattcaaaataaataaatacttttttatggttttatttctatgtcatgacccaaaattgtaaattatatgaccctagtcaaagtagcatcataaaagcatagcaaccattataacaaggagtggtatcatcccaaggtgggtgggcagaagttttttctcagggggataaaaagcctttttatttttatttttaaaataaatatatagagagagtacataagaaaatacatgatgtatctgtggtattacaatttcttggaagtcagttacaaaaaatgtctacaaaaggtgctttaagaggcaataatgaaaaaagttgagaaatatacattacattacacaatacaaatgcattacacaatacaaattcggtttttcatggggcaaagaaccaaacccttctcttttccactagatgctgccaatttgtatctgttttacagcctcttcttgaagtagttaatatcttctaaggagattgtttgatcctataaactttatgatctcttgaacacaatacttcctttttctccacttgataacacaactaaatagaattcaaatctaaaatcttagaaagatgtgacagacaggcagatgtcatctcagtgcttatatattatttgttgagcatgcatgacattgaattaaacattatggaggtaaaacaaagaccagaaatgattctatccccatgggagttaaaatttagatacacagagacaacttgcatgaaaatctaaaacacaaattggaaatggatatcacaggttctcctctccacagtgatacagtgttaaaagttggggttttgcttccccagtacttaacacactgctttggatgtagccattgctccatacattattatagaagttatagagatattcaggtagaatgccatgggctctctgaaactagagaatccaaacttcatgcatggagcacctccatggacattatcatttaaaatcatggctcaaatataggcccaatttttatgaacaggaaggtcatcataagtggagaaaatccccaaagaacacagaaacaaacatttatggaagcacatataggaaaaaatagttcattttgtctaggagaaaacagaggacattttattttttactaattaaaaacaataaatattttccttctgagtaaacaagtccttatcactaggaattttaaagattaagggatgaccacctgttgaagatgttcagagattctaaaatttaggtaggatactggatggaccagttacctccattgtaagcccaatcattctatgttggcaatggttgtataatattatcagaaatatatcagggtttggccataattcctgattggttatggcaaatgtttgtatgtactcatggagaattcttcatcgcttacatcggaaatgcttccattcagtaagctttttccagagacctttaaattgtatgctattcctaattgtaccattgaggtgattgcttctgtgcatcacgttgcctacgaggtactagtaatacttcctcctaaaagcatctctagtaaggagattctgaaaaaatttcagaaatacattatgatggagctgcattgttttaccactgtttcctcttctgataacatctcaggatttaaaactccatttattgaaaatgtgtgttgttgccatgcagttgttagaatagcttcatttactgttactgaacagctcattccatatatacactgtttgttgctaaacagttggttctgtctttgaatttctgcctgcactccagaaccagttctctggagttacttgtctcttttggccatttccccaagcaaaataaagccacaggctgtaccatccacctaataaaaaaacaaaaaactaaaactcaaaaaaaaaatgtatttccacatatacatgtacatacatatgaatttgaggcgggtggaccgcgaggtcaggagatagagaccatcctggctaacatagtgaaaacctctctctaccaaaaatacaaaaaatttagctgggcgtggtggcatgttcctgtagtcccagctactcaggaggctgaggcagaagaattgcttgaacctgggaggcagaagttgcagtgagccgagattgcaccactgcactccagcctgggcaacagagcgagactctgtctcaaaaaaagaaaaaaaaagaatttattttctataagtactattaatgcaagtatataaataatcctgtggaaaagggtaggagacaagtttggtgggcaaattaaggaggctttgctagatatgtttcatgatataaggaaaagtagatgatctaccttctccaaaataattccctgaaaatgtcctgagaaaacttgagtaaagtatgtcatctgtaaatatggactagtttattagattagctgaaattagagaaatgctaatgttaaggtcctcttgataagtgatagaaagatattaatatatgctattaataataactggtccttgagataaatagcataaaactgtgataaatctgcaacttcatcacttggttctaataagcctcatctctacagctgagctcagagatctctgagtacttttccatgttctgttccaagtgttctatcctcatcgttgacaaatgtattttctattctttctttgcaccacagtatactcacctttataaccttttgtaaatctgttgtctggcaattaaatctatgcaaatacctgaattcctagctgaggccaggaaacctagctcttctgcaagcatcttaacctcaaaataccccgaaccaaattcaatgtcctcttttcctccaactatccaaatcctctactatatttcagtatttcttttaagaaactatattttgaagaaaaattctcacatggtttccaacttctaaaacaatcagattaaacttttattctagtagtgtgtcattgtttctttacatagctcttaaataattgctatcaccaatcctatgactaatagtaattttgaggtaaacactacctctgaagaagaaccgatagggatattttgagtcaagttataaaactattcctgtaatgatgactactcagttataattaaattacttctttctaaattttagccatattccatcgtgaagcaatgctgtgactcctccatattcttgtagttttattaatgtaactagctcaatagttgttgttagtagaatataattttaaatcatgaactgtaaattcttcaactgaatttgacagtcaccttttcccaatcacatactatatatctgtatcattcgttttgcatagaatattctctttatatatcattttgccccttgaacaaatatcttacaaggcccaccacaagtaccaaggtttcttgatagttgcgcttccttatattccctaaaatattgctatctgtacttttttcttttgatgtttgacccttttccgtttattctagactctaagttgctaaatggaaaaggtgacatttgttcaatcatccaaagctaaattgtgcttagcacaatttgtgcacagaatttcgtgaataaatcttgttaaattgcttaatcttacatagtaaacacataattgctgattgacttgcctcagtacacagttgtgtgtttaagggaagaaaaactatatagaagaggaaatatttttcaagatgttctttcaattggcagggcaaattgcttgaggcattgactggactatgattcttctatacctgggacaatttattgctattttcagggaaaaagggaaggataatgttatatatagcaaagatttttttaaaactatacagaatcttgctacacctccatgtagtaaatcataataatagtaaaattgtattcctagaaatatagttttcttcaatatcttacatagaaaaatagagacaacattaaaaaggattcctctcatcctccaaaacataccaaaagcaaaaccagtaagctctgtgctaagatattttactaaggctttgaagtaaaccaagaaaatattacattttttattattatgacatctgaaattcacacattcaagttttgacacgatgtgccctaatttattcaagtagcaatactgtgttgatatcaacttgtaaagatgaaaaattaaatgatatggcaagaaagtaatcaacttaaatgaaatattttctgttgcttccctgcttttggaagttgttctgcaagctcttcataatcatcacttatctgcatttcaaagaaagctgaacactgatgttttgttctttattttattaatatgataactaaaatccaaaagccatagaaaaattattacataaaatagcaatatccaaaacaagtatgaaagttttaaaaacttttttgtaaatattttgtaaatttttttctgctgcttttgccttaataatgcttatttactaaagtatagatgatactttagtgcttttatgtttttgaaagcactaaagtttcatctgtaggtttgtaaaaatatactagaaatactaaaaatttgtatagtacgataacattacactgatcaaattgtgtactagtaagcaacagaaactcttatacattactgatataagtgtaaaaacataaaactacataggaatactggcagtatctactaaagttaaacacacccatgcctgtgctatgcttagcaattccccttctagagaaagtcttggacctcaacatcatgatcccaaaatgaatacatgtattcaccacaaaagatgttcaatgatattcataacagtagtaacaaaccctaagaaatacccaaatacccatcaacaggacaatagataagttaattttgatgtattcatataatggcatatgatacaacaatgagaatgaataagctattgctacatgcaacaagatggataaatcatataaacataatgcttataaaaataaagcagactcagagtaattatataaagttctaaaatggaaaagatatacttattatataagtcaggagagtgattacctttggccaaggtagtgccttggaaaggattatggtggaggaagagggtggggtgagtgcttctgtgacagtcacacttctacttgctgaactgtagtctcttcacttgggtgtgttccctttgtaaaactttatctagagggaaatgtattatttgtgcacttttctttgtgtatgttgtatctcaataaaaattttaaaaaaatcttcaaagcctatgacataaaaagtctgtactagtgaattatttacttataaatatctgtggtttctggttgttgttgttgcctccaaattgccctggtaagctgttttgaaatttaaaaatatgttaagaattaatgccaatactttcttttgttttcatcttttttcttgtttcctttgtgctcaatacatcagggctagaattagagaataaagaatcatttccaggaagacatttattttacaaaatatttccagtagagggagcttcctttttttttttttttctataggaaatcctcttttgggggtcatcactaaaagtgaaaatgcttaattttttacatataattaaagttcttcatagagtgataacctactctcatctaagactagtcatggatagagaaaaatttatttgatttatgaatggagaaagaaaaacttgatgaagaatataagttatgaagtaaacttttgtatgttgtatgtcttttcaaagaagtacatttttgggcttctcataaaatttatttctaattaaaattatttaacattaaaaaagataaattcttataatcacaattatccatttgaaatactttttcataacttttaacaaaattggacaaaagtcagagaatctagtgatgaagattatttatctcagaacatgttttaacaaatatcatagtgattgccattatacaaatttaacctcattgaccaaaacattttagtttctgactttagcttcctaaatctaagtatctatcaactaagctaatctgatttctttgaaaaaaatgtattttaccatctaagccattaagaaatatagagaaataatcaatttatattttaacattaagtttgtactcctttacataataatttcagaaatataaaagctccatatacttggctttaattattacaaatcaaatttctgacaataataaagtcacaaaaattactagatcatatcaagatgatttttattgaaaatactttggttaaaaatagttcaacttcttattttgggaaaaaatcaataatttcagaaataataaccatcacagtttctattatatataggcaaatgaaaataatataactttctataaggtagtttgagatacactattggtttttataaggtagcccaaagatgaaaaatcgacatagcaataaagaatatttaaatacttcaagtagaaatcagtatgcatataacttagttactctagttattggacttcaatcctcctttgaaaaccttgcaagccataaaaatggaaatcctatggtaattaattgtaacagtaaaattaaatttatattggtgggtcaaaattctatatgagcagtaccttatttttacacattcattaagaacggggtaaaattatctgatcctttgtctagctctcttatactctttaaattatttttttaagcctaccaaatatgacaggatcatgataagaaaatgacatgtcatagaacaatttcatagtttaatggctttgttataatattactttactcaagaagattattcctgacatagaacatatctaataatctatttatgattttgccttcatgtattacctgagctaggtcattagaaaatagtacttgcaaggcccttattttgattcatttaacttaacctctgaatatagcaacaacatttggagtttctctcatcagtaaatgactatggtctgtatttctgcattaaaaaaagtaatgtctcgtttctaaatactaaatgttttgtaactttcaaaaaaagagtaacacccaaattatataattcacttagaaaacgggaactttaaaagcaatttgagaaggaaaacgtaggcttttaaaataatttttttttctcagctgcaaataacgcaagatgccagttactaaaatgcactaatcaatgaaaaagcaaatgagtaggtctcagtagatagactgctaaataatttagacagaaaacaatacgattaaattgattgtttcaacaagtcaatatagaattgcaaatttcccggtctcatcaataacaagtggttgcaacgtaatgcacaggcttaatgagttctccgactgttaaatccaagcgaactcacctgagtaacagtgctgcttcccagaagtaaaatcccgaaactaatgtccgaaagtgtctcacgtgggccatgatacggagagatattcacgatcctgaaaatagtcttatccaaggcatggggaaccagaaagacagaatgaaaatgtacaatctaaccccgcatggtgttggtgtagactgatgcttgggaagcttcagcaccttagacagctccccgcagtatgcggaccccttctcagcattgagcagaagtggagagtcacagtgttataaatgtgcaggtgatttttacagtgaaattacaaaaatgagtgagatgaaatgtctgaagtgcctaggtgctgggcaacagttctctaaagctccagcagcaaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgaccaatcacgaccgcacagcgggacggagtgacaggccacttacgacggtaggcggggcttagcgcttcaccctttaacaaaacccaaacaaaccaaacggcgactggagcgaggtgggcggaaaaagccacctgggaaagtcagcggttttgtggattaggtagtgtaaccccgcaggagggaccctttagtattcccttccgggaaaaggcacactttaggtcttctcggatgtgacactgtctgttacactctacaccgaaatacaagagtcagcagtaaacccagaccctggcggagggctggggaagagaagacaatgtggtgcgtgaacgcccgtggaacggaagaaccagctgcttctagaatcctctcaagcctggccagcttctggccaggaagcgttgttgactggatttaagttgggtttccttaagtaatagtaagggttctaaaaagatgaaggtgtgaagtctaaagagatggctgctagagacgcaaggcttcccaccattttttttttttttggtctttcccgttttacatcttcacagtaagtttaagtgagaagaacagctagatcacatggtactataaggtccatcttttctccgtcatgtcagctttctgtccttctctttctctattcttttccccctctccttctctgtccctgttttcctcccctcccacatttatttactttgggttttggatggaagactggaaaagaaaagtgtgtgtgtgtgtgtgtgtgtgtgtgtgtgtgtgttgtgttgtttatgtatttcaaagtaatagaagttttttaaaaattaaaacttctttgatctttatagtggctcttatttactatcagccatgatcaaatgttcattccttgaatcttagattttccccaaaacttcctcagatatttattctgaaatccctactttcatctcttaacttagtctaatgacatgtcaaaaatgattcctcatcttgacacgttggttattcctgaaattctctgtttaactggaaagcataagtcaccaccttccaaccctctcatatgaaaaatctctctctctacactttagtaaaaaagttttatttacattcagtgacaataaagagtttcctggatttatttctagatgtttttattatacttgtctcttttcacatagtggttttctgatttaaatcataaactgccagaagtttcataagggacaccattgattctgcccaggaatatttgtacctggagaagattcataccatttttatcaacttaattattcacgatgaatcttttgaaatctcactaagcacaaaagctttttagttggcgattctttgaatagcagtaataattgtttaaaaacgtacgcattaaaaaacttcaaaactttatttcaagaatacgtggattccttgctctgcttaaccactgactgggtactttgagaaaaggtatcctctttaaaaaatatctttatatatatatatatatttaaagtatatttattgagaaaattagattaaatgatcttgcagatttattctctggcttgatggagacaatgtatgtttaagtcagtaaattaatagataatattaaaactctctttagagtaatctggaaaattaaattacacaatggcttaaaagccaggataattttaactatttcaacttgtagttaacataaaacatagaaatatactttataaaattagtacggatatgaaattagtatggatctaatcctttttaaatataaagttcatatgaaagaatggctggaatcctcgtaatactcatttttcataacaccataattattgtcttcaaattacttgtcactctttgttatcatcctcctcatttatttgtttgactttttcactagagtgaggacaatggccactatttagcacaacacttagcatataatagatactcagtattcgttgggtgcattaattatcacattggaaacacaatatgtattttctctattagtaaatgaaggaagttgttacagtgcattgggaactagactaattaggtatatttaaaattgagtgattgtggtgctctgtttctttcagttaacgtttgatgtttaattttctagtgtatttttgttgagggatatttatattgtttgttttaatttctataaggtcaaacagaatattatgcatctacatatttttggtagctgtcttgtaaatcgtactcttttcagagtaatagtactgattgaatgggtaggcgagtgaatgtgtttttggggtagggggaaccttctgtggctgacgattagatgatcagcccattcatatacaactgtgctggattgtgacatggccacatctcagctttacctttcgtggcctttattattgctttcttgcactaatggattctacttcacattatataggacatgggacttcggagcttaatgggatatcgatcttcatcatgcttaatacttacttttcaagagaaagcaattgtagaccagtgtggttaagtgacggttacaagccctcatatccagtaagcagaaggtatcaaatttcaatctggggcttttggttcattgtctagttttcttttgttcactaccatggagctatttttaaggcacatttattctattttttcaaaatatgtgtacattgcctaagcaacagaaagatcaatttcagtataatgataaaggtgcctcttttatttagttagcttttttacatttcctcagttgttactaccaatgatctaaaacctgggatattttacacatattgttgagatgctttgctatttaataaaagccccatatactctttaagtcaatgtagtatagaattagtgctagtttactgagagttgattggattcagtagcattgaatcattctaaccatctcatcaaaagttgatatacagatcaaaatgccagtttaaacacttaccaaaagtaatgttacttttgaaataattagaatattgacatctttgaattaacactccctaaggttgaaataaagttttaatttaggaatcaatcagaaagttgcttatttaatataaatctagtagagaataattagccctatggcaggcttacatattgtcactgaatatgagcctagtgaacttaccttctgcataaggattgacctactgagaacactagaataatcatgaaatgttattagttgatttggtgaccctctattttgaatagagggagaatatccaataatttatttacatttgcttgtctaggctacacaattttgtacatgaatctcagcaacagcttcctaattgtttctcctgctaatctaattaaagttccattgtaaatattaagttttttaaagtaaatcaaacgatgctacttctattcccaaagccctttatttccaatgcaacaaattgaattcatactcccttttataactcacgagactctgaatactatcccgttggtaatctcctgagcctcatttttttaaatgtgaaattgtatttattttttgtacattttgtagacagttttaacttttcagaatatttaaatgagtaatttattgtaaaatccacagaaaatttattttgcttatttatttaaaaaaatatttattaagagatgatcgatgttcaaaaagctgtagatatttaacgtatacatcttaatgtgttcggagataagaatacacctttgaaaccgtcaacacaatcaatgctataatcctatccatgacctcccaaagttttctcccactcttttgattgttttgttttttctttctgtggtaagagcatttaacgtaagatttatcttcttaacaaattttaaagtatacaatacagcattgttaatcataggccctttgctgtgcaggagatattcaaaaattttttgtcttgtataactgaaactttagaccttttgtccaatccttccccagtttactcctcccctatcctctgataaccaaccctttactctgtttctgtgagtttgactgttttagactccacatatacgtgagatcatatagtatttatccttctgttgactggcttatttctcttaacataatgtccttcaggtccattcatgatgtcacaaatgttcaggttttcttctttttttaaggctaaataactttcctgcgtgtatatatattaccatgagtcatggtgtcacaactgatttctttatccattcatccaccaatggacacagaggttgtttccatatcttgactactgtgaataatgttgcagtgaacatggaagtgcagatatctcttcaacaaactaatttcaattcctttagatatgcactcagaagtaggatttctggatcaaatggtaattttagttttaatgtttgagtaatcttcatcttgttttccatagtggctttaccaatttacattcccatcaacagtgtaaagtgttctcttttctctacatcctagccaacacatgccctttgttttttgataatagccaacttaacaaatatgagctgatatctcattgtggttttaatttgtattttcctgatgactggtaaaagccatttttcatatacttattggctgttttatgtcttcttttgagaaatgtctattcagttcccttgtccattttttgtttgggttgttttattgctattgagttgtttgagtttattatacattttagatattaaccacttttcagatacgtggtctgcaaatatttactctcattctataatttactttttcattttgctaactgcttcctttgctgtgcagaagctttttcattagatgtaatcccacttgtttatccctgctttttttttcctgtgctttagtgtcatatccaagaaatcattgcccagtctaatttgtagaagattttctccaatgttttcttccaggacttgtattgttttatgttttacagttaagcctttaatccatattgagttgatttttgcatatagcgggagatcaagtccaatttcatttttttgtgtgttgaattttgatttttccaaaaccattcattgaacagactatctttccctcattgtgtattcttggcacctttgtggaagatcagttgaccttatatgcatcggtttatttatgggctctctgttctactcaactggtctgtatgtgtgtttttatgccagtgccttgtttcaataactagttttgtaatacatgttcaaatcagggagtgtgataccgtcagctttgttcttcttgctcaaaattgcttagactttttttttctttactggtttcccttttccccactatgtatcagtcacatgagctgtttcttttctcagaatttgtctactttaaacacctgtcctcttgggctttctatctttggttacctttcagcctttaactcacagtacggctatcagtttctttcttgagcacaatatataacaaaatttcccctttacttttaattcatggtgtttttttcttcacagatgaaatataatttgatgtttgcccttgtttgaatactccatgaagatgaggaaaatacatgtttgtgtctaacagtgtctggcatgtggtaagtggtcggtaaatatactttaaatcaatgattgagtgcataaatattctttgttctttggttaacccttttttaaattccatgcttactaagctttttaacccattctctcttcataaaattatttaagatctctaggttgtagtgtgttttctttggcgatcgaaaagcaactttggagtttttatgtgtgccctcagttcactctaagagcactttatttatttatttatttttgatacagagtattactgtgttgcccaggctggagtgcagtggtgcgatctcagctcactgagacatgtgcctcccaggttcagatgattctcctgcctcaggagagtgccttgtttatgaaaaataagttaatattatccattatactagaatttttacaattgtaacatgttaaaaaatattcaagacactctttagagacaatatggaagagcttattcaagggagaatattgcaataggtatagggattgttgcaatgggtcttatagtgtggtagagacattggtcttgactctgattacaagaggaacaagtgcgaatctatggtcaaggagtaggggctggtgaatgaaaagttactaagagaaaacatcagggataaggggattcttcttacactgacttgacaggatttttattgaaggtaaaccagcatgacaagatattgagggtaaggaataaggaatttgatcagatatcaagggtgtttatgtaagggcaggggattttcactagactagcccagcaagattcttgctaaaagtgctctaaacaggcagagccactggaactaaggacaaagcccaaggtcagggcctagtcagaaagaagactcagaggagtctgactcaggcttgggcaatagcttagacttttttgaagtctaaatatggcaattccattacattggaagataacatgttaataatgcatctattgatgtccacagctttggtcagaaccacactaaaaagaaacgttaagaacttacctattatagcattttaactggataacaagtaggctgcatatggtatcatcacagtatctaatgatatgctacagaattaataatttacctctatagaaaaaaattataatcagttaatttgtacagttaatacattttctgagttttgactattaatttctaacataacaactatcacatatgtaagtgttttataagaccattatcacttccagcttcttccaaaatctcattttcttaactaatgtttatagtatttttgccagagtatatatcctaaaaaaggtgcccataatcaaaatgtctaaagtactggaaatatattatttaaaaaaaaaactaaatacctagctgagatttcacagataaataataaaaaatacccacaggaccaaactattgaaaaggaatgaagcaaaaaaagaagtgaggactgaagctgaagggtgcccaaggggaaacaactgatctctcttcgactagagcttccattttaactcgaggcccgcagaattggagcaatgactacagcccaaacaaagccctaaacactatgtcttttaaaaccagcaatccctggagtgaataaccacaggacacaatctagaaaaactatttatatcccaaaggaaagaaggaaacttgtctgtctcagctttagctctgaatgaggccagcaaaatctcgctaaaatgtcatttaccaaaaacatatacagtttttgagccagaattaacaccacctatggccacagaaacaccaggttacaaatatgtatttaactggtgctgtgattttaatgtcccagaaatctggtagaaacaaccataattctccctggaggactatatcttaagttcaagtctgaagggaagaattcccacagagaaagttccaaagaacatatgctcagtatcaaaaacagaacacatgaagaaacaagctatgaatttgagtcaacaaagcaggtaaaacagagtttgaagtataaagattgtagatgttggaataagtggctagagaatataaagtaagtgtgtttgttagaagaataaaaatatggctggcactataaaattggtcagttagattttttaaataaccaggaaactatgtagaaatgaaaattattgtagctagaatttaaaaattatggatatttttaacagcagattaagcatgctggaagataataagtgggttaaaagatacatctggggctgggtgcggtggctcaagcctgtaattccagcactttgggaggcgaaggtgggcggatcacaaggtcaggagttcaagaccagcctggccaatatggtgaaacctcatctctactaaaaatacaaaaaaaaaaattagccaggcttggtggcagacacctttagtcccagctactcaggaggctgaggcaggagaatcgcttgaaccagggaggcagaggttgcagtgagccgagatagtgccactgcactccagcttgggtgacagagcgagactccatctcaaaaaaaaaaaaaaaaaagaaagaaaaagaaaaaagaaaaagatacatctgaaaattatacaatattaaccatacagagtcaaagatatttacaaaaacaggcttaaagacatggagaagacgtttaaagacatggagaagagattcatgatttctagcaaaaattagatgcatattaagaaaaaatataaattaaatggtgatacgtaaaatatgaagagacaataactgaaagttttatcaaaacgattagatatgaattttcatattatggaagtgaaaattattccagcaggacaatggagaaaaactacagctagactgcgtaatactaaaccgcgtatgcagtctagcctagactgatagtatttcttgtaaaatacttatatatgtgatagtttttaatgttagaaattaacagtcaaagcttacagactgactaggctagactgcataatgctaatgacaaagacatctcaaaagctgctacagaggagagcagcttttattattttaaaagaataaaaataatgaataacagctatatacagtttataagagtcaagtataaaccaaaggatatttagaagcataaaagtaaaaagagaggaaaacacatcaggtaaatgctgaaccctgcaaaagtaaaataaaatattaagcaaagtaaagaaattaacgtatttacacacgaacccacaaaaagcatctttatataatgaataaagttttaccaaatggataggaaatttctaaatttgcatacatctaataatatagcctcgaaacatgtaaagccaaaaaatcaaaaggataaatctagcactatagcagggcattttcatatgctattccatagcttttatgatatgaattaggacattaattttgaaaaatatatatgattaacaaatttgattaatgagaatagttaaacaacaatacaaccacaattttgtaataagcattttttttttttgagacaagggtctctgtgtcacccaggcttgagtgcagtggcatgacaatagtttgcagcagccttgaacttctgggctcaagagatcctcccacctcagactcctgagtagctaggactacagacatgtgccaccatgccggattaatgttttttgttttattttttgtagagatgggtctcttgctatgttgcacaggctgatcttgaactcctggcctcaagctatccaccttggcctcccaaagtgttgggattacaggcctgggccaccggacccagcccataataagcattctttttaagcatacattaagcatatagatgctcaaattatagaatttgaacatatagacgataaacaaatttcagctaattttaaaatgtgctatcatctcagagaatgaatttaaaattgaaattgaataaagttaaaatgaataattatataatgcaaattaggaaatatttataacttaaggtaataagaatactacataccgaaggcctctaaaactgtgattaaaaacaaacgggtatccctaaattgtcttaaagtcggaaaattaatgatgcacacatagaaattaagatgcggtcatgaacagctcaataaatctcataaatatacaaggaagtaaatacacataagagaataagtaattaataaagtagaaaacaaagataaaatagatcattataaaagcgaaatgtttttcaacagggtttaaattagcaaaatttctcacaataataaaaaagcagaaaaaagagaagcagcaaataaatagtattgaatactcaagtttggaaaataatatgatagtcaaatattgatagccagggcatttcctaaaaaatgaaaaaagaagagtgacaatctaataaaagacaaatgtggaaatattgcattaacaggaatttaaaaatacaaaataggtgtttgtataattaaagatgttagactttggccgggcatggtggctcacgcctgtaatcccagtactttgggaggctgaggcaggcagatcacttgaggtcaggagtttgataccagcttggccaacatagtgaaaccctgtctctactaaaaatacaaaaataaaaattagctgggtgtggtagtgtgcacctgtaactccagctactccaaaggctgaggcacaagaattgcttgaacccaggaggtggaggttgaattgagctcagattgcaccactgaactccagcgtgggtgacagagtgagactttgtctcagaaaaataaaaaaataaagatgttaaactttatttgtaattaaggaatacaaattaaattatgggcacaattttagagccgacatattgacaagtgtgtaattgtaataccaattgttgcatgagtgtggatcaacaaaaacttatatagggctaatgaaaatgtacacccattttaaaaaacaagttttctctacattaactataatcaagaatgctaatcttaattatatatcctagaaaataatctggcattggtacaacaggaagaatgtacaagaatgttcatagtttttaatggaaagttggcttgaaataaatgaaatgtctaccaataaacaaagaaacaataagtaagtaaatgagtgaagtatgtcgatgtagaagaatattatacaaccattaaaatggatataattcagctacttatttcaacatgagtgaatcataactacacaatgaaatacactgtagaaaacagagaattccacataaagaaagtgtcattgtttgtgtcaattgattgataagtagctgtattgaatactttactgtataataacccctatattatctgttgactcgagattccaaactttaaaaatattgtttctagagtttaaaatattattggagaaatcatacttatatacccaaatagtaaagaccaaaacaaaacaaacaaaaacattcgaggcaatatctaaccaacagctaatatgcttggttcagatagtatggattttaggaatttagaaaaatgtgaagccagaataatagagtgcactctatgaggaggtaagtgataatacagtgtaaaatttaggtaagttgttggaaggcatatcaaagacaccagacccggtttatgtgccgtacaatttgagattctgccccagtacttcagctagtaaattgctcccctgttggagtgatgtaaacttttaatcctgaaggatgtgaaaccttggttactttgtctttgttcagtcatgtttggtgaatttgccaacttatctctaatctctaggcatgaaacaaccaagagacaatgcattggatctcctggattcccaaatagatactgtaaattgtattgtatagcagaaatcttagcttccgattttaatcaatgctgattaccatggctacatggctgctgaagtgaaatgactttttttttttgtctgcagatccactggcatgataaaggcatggtagttggccagatggtacatgtagtttctagttcaatggaactcttcctgtatctctaacagatgagttttcccttgacaccagaaactattgcctattagagacaaaggttatgaagtgaggaagcacaaactctctaaataagtggaggtcgaaatgagaaagtttgatcctacttgtactcctaggttcctgaactcatatgttcccagcattggtgtctgtattcatttgctaggactgccaaaacaaaataccacagactgggtggcttcaacaactgaaatttattttcctaagttctggaggttagaagtccaagatcaaggtgccagcaggtttgatttcttctgaggcctttctccttggcttgcagatggccaccttctcacctcgcctcactgtggtctttcctctgtgcatccacatctctgctttctccctgtgggtcctaatctcctcttcttataaggacgccaatcagattggataagggcccatcctaagggcttcattttaactttattacctctttaaaaaccctacctccaaatacagtagcattctgaggtcctgaaggttaaggcttcagcatatgaatgtttggggaaacacaattcagccccatacattggcagttgatttcgggaatgtactgcatcatggagaacactactgcacagccacaggctgttgtcctaaagccaggatatttgctgaaccttcaatggggtactcagccattctattaggccaaatatgtataatatgtatgatataagaccaattaatctaatagtggtgagaccattattctgtattttgctgacaatagaaaatgttgacaaaaagaatcaaattctgtgaaatattttaagaggtttattctgagccaaatatgagtgaccacagcctgtgacacagccctcgggaggtcctgagaacatgtgcgcaaggtggttggggaacagcttggttttataaattttaagaaggcatgagacatcaatcaaacacatttaagaaatacattggtttggttcagaaaggtgggacaaatcaaagcgggggcttccaggctataggtaaatttaaacattttctggttgacaattggttgagtttgtctaaagacctgggatcgatataaaggaatgttcaggttaaagataaaggattttggagaccaagttttattgtgcagaggaagctcccagatagcggacttcagagagagcaggttgtaaattgtttcttaatgggacttaaaagggtgcctggctcttagttgattatctcctggataggaggaaaggaaggaaaacgaaggggaaaggggattctctatagaatgtggattttcctgcaagagaccttgaaggacaatgaaggtagggtaaggaaatatattttggggttaaatattttttctttgtctcataatgttatgccagagtcagattgagaagtaagtcataatatatagggtcaaaaaaacccatctgatgaaaattgtttgtagggcatgactccttagaccccttagggaggaatttgtgtaaaataaaaaaatcagagcttagtcctcaaaaattatctattttcttttaaattgaaaacatttaaaaatctttttgaggggtatatttcagaatattcctttttaaaagtctgtttaactgtctcatacacacatattcacaaacactgagaaattatttttgttcatgaaatgaaaaatggcattgtttaaaatgatttactaaatcatataagtcttcaaactaaaacatattattattctctctgtagttccttttttctatggctaaatgtatttggaatgctatgtgttgttttcctggagagcgtcccacgtgattcttgagtgattagacaatgactagccattaagccactttttttgctttattattattttaaattttaaaatgggaatattatgtgattatttttcactgaagtgaaaatgcaaataaattacccaagaggtggtttatagaggagatacttttgttgtaggtataataccttttagtgttttatgaaaatcctcatttgtttctcagctggtaatgtgtcaatacgatgtatgtgtgaaattctagagttgcttgtgacaatgttctgtttgtttccatgaccccagcagttcctcctgcatagcccttcaggctagagtccctttattatttcatctacctccagaatgttgttctgcaatttacccacttttatagcatatacgaccatgaccaaacaatctagaacttatttaatacatacaatagagtattcagggtagacagtttacctaaatatggccattataggttgaattttgtcctcccaaaagagatgtgctggagccctaaccaggggtatgtcatgtgaccttatttggagataggttctctatagatgtaatcaagttaaaacgaggtcattatggtgcgccctaatccattatgactgatgtccttatataaagaggaaatttggacacagagatagacaagcataaagggaaggtgataaaaagagagtagacgatggccatctgcaagccaaggcaagaggactggaacagacactcccttcacagtcctcagaggtaaccaactctgccattgccttgactttggacttttaacctccggaaatgtgaggcagtaaatttctgttgtttaagccacccagtctgtcatactttgtcacagcagctctagaaaactaataaattcggctctctacaccttctattcaaattcctgacaatctgtctgtcttttctaaatcaaattgccactggaatcagtgagagaataggcttgaagatctttatggaaagaacagataaggactctttcctccttgggctgaaggagagtttccagattcttggaagaacctatcacacagagactcttagattcttagaaggaaatttgacattggtaaaaatttctccagtcagtatgaccttagggacctaattcagctcctaattaggtcctctgctcctgaggttgagtatatgcctggagacctgggaacaggaaggcttcatcctgctcctccgcagtgggtgctggcagcccttctgctcgtgcaccactggctcagtgttgtagagagtagtctgcctgcttgcagttgtttacccccaccaccagatctaagggctaataaagaaaataacaaacaggggttctaacagccagagagaggatcagtcagcacaaacagatctcatgacagcaaaatagagttgctgcaggagacagaacatacttgaacaaacaaataataagaactcttaggaaaattcaagtgcaccccaatcacacatactttctggaaaatcacatgattttccaattaaatgtttcagtaggtaaactgaaggatgctataacagaggtatagaagatcttatagaataaatgtgtcaaagcacagaagtgcaagttataataaacaaacaaacaactagccatttggagagtagatgaaataaaaataaccggcaaaagttggacttacgtaagaaaaaacatgacagaagcttaagtaaacaaatacaagaagagataccatgaattgagacaaaattatcagaagaatgagtcttactaagttttaggcaattttaaagtgaaataagcaaagctagccatccctgctataattaagctttttaaaaagaaaaaaaaggttataatatttcacacagagattctaacagaaaaatctaaacaaacaattagtaaaaaagaacctagccaatttatcaaagaaaaaatgtactctacagccaaggagggttgatagcaagaagacgagactctctcaatataaaaaaactgccaacataattaccaacaaatttaagaaataaagcatatgatcatttatgaattttgacaagcagtgggtaaaatgtttaaatttccaaataaaacaggtatgtttgtaagatacttgaatttagtaaatattgtcaaaaatgctgcataggctgggcatggtggctcatgcctataatcccagtgctttgagagtcccaggtgggaggatgactttaggtcaggagttggaggccagcctgggcaacagagtggagaccctgtctctacaaaaagaaaaaaaaaaaaaagaaaacaataaaacaaccaagcatggtggtgcatgcctttagttccagctatttgcaggctaaggggggctaattccttgtgcccaggactttgatgctgcagtgagcctacgctagcacaacctcaccccagtctgggtgacaaagtgagaccctatctttccccccacctcccaaaaaggtgtgtagactataatgttaaaagttaaggcactaaaccatttcaatcaaaccaattattattctatgacgccctggagattcagtgaatgtagtgaagtaatgacatataaaacaaaactcacatagccaatgaatataagataaaatttttaggtgtagatagatagagggaatggaaaaccgtgtacaaatggacaaaaatgcatagaatccctcaatatcatgtctaatatacttttgcatttttagaaaatgatatatggtgtgtatacatacaaagaaaagaaattggcaaatttttcaataactactaagattagcaaaccttattacccactcttcaggagctataactgaagaaacatttttagacaaatgttcttatttggtattaacagattgttttacttatattcttcaaattatgtaagaaatgtggaagccagccattcgaattcgatttgtcacatgcagttttgccagagctttttctctcatgattattggtgttcaaaagtttaacacttactgtattatttaccgtagataatattcatgataggaatcccatggctaataagcacaacttgactttgtatttattttatgcattactaaaaaaaattccattcacaaatactgactgagcctcattctatgtagtgttaaagaaaataaatgagagtttaatttttttacaaaacattatttcctggcttgtatcctttacattttttttttttttttttttttttttttgagacggagtctcgctctgtcgcccaggctggagtgcagtggcgggatctcagctcactgcgagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcctttacatttttgaagttaaaaaatatgttacacagctcattcctttttttcaaaacatttgaattgtactcagaatattatgctttttgcctttataacatgaatttaaaacatacagataattttatttgaataggttacaaaatgcttaccttaaaaatatatatatatagtatttctttttttaattgattttttctgtgatgatgttatttatgccttattttgacactgtattttttaaaattaaattagattttttttaaacttccaggttacatgtgcaggatgtgcaggtttgttgcacaggtaaacatgtgccatggtggtatgctgcacctgtcaaccatcacctagatattaagcccagtatgcattagctcttttacctaatgctctcccctattgcccttccctgacaggccccagtgtgttttgttcccctccctgtgtccatgtattctcattgttcagtgcccacttataaatgagaacatgtggtgtttggtgttctgttcctgcatcagtttgctggggataatgacttccagctaatccatgtctctgcaaaggacatgattccttttcatggctgcatagtattccatggtgtatatataccactttttctttatccagtctatcattgatgggcatttgggttgattccatgtctttgctattgtgaataatgctgcagtcattgcatatttttaatgtttttccttttaggtaaacatttgatacattttcattgcaaaaattttctcccctcagattattacaatgattttcctgctaattatttatcctttctttctttattataacgtaattttcctatatactactttaagaacatttacaagtgtattagttgaaaagtactgtaatatcagaagaattgtgataatttatattacagatcttcaaatgatacccaaactcttaagtgtttcgttttatagatgatacattatctgttggggggataatgtttcattaaacttatgcctaattttgtgtttatacttgtctgaaactatacactgaattcttttttgtaagtacaatagtttggttgtagctgggagctgcttgctacttgaagtctggaattgttatactctcaataactgtcacaaattttttactttgtaaaagaaagttttaacttctcaattgagaaactttattttaacacctccatttattaacacccttaacaaatttaggcagcccttttctatactgtgtgattatttcaactacagagtttgtctaagtattgaaatttttatttacattcttgtttcttcattagactgagaacacatttttttaagggcaatgtcttgttttagtttacatcacaaccttaaaacttactgaagtgcctgacacagatataggataaaattaatatttagagtcaatgaataaataaaatgtatgtttccattaacaatcggtggggtgtcttttttggtaagttggaatttctctccagtgtgatcgatttgccttcatgtaatagttaacagaactgataaatggccaacataacaattcagccttttttcatattaaacagataccattgaaacagatgttcctgcattaggttctcaaaacaaatgaagcatggctttgattccacacatacaaaaacaagtgattcacaatggcagtttcaaatttgtggtcacaatgattagtgttctacttgttacaaaggatttgattagtcattttctagacattttgaaattttaattatctggaatatttaatatgcattttctttttttaatgccctgtaaatgttttaagaggatgaatttttaaaaccttgtagaacttttgtgttctagaaatatggttgagtgtgagaaagatctctatttgctgagatagcaaaatgtttaaggaaacctcaagaccaataaaaatatttttaacattggcttaactggcctgaattcaactcccagcattggcacctactctctcattaccttgcacaaagtcattctaactaagctttagtttgttatctataaaataaaagttgcaatctgtttcatattcatatttcatttcatacgtttttctttgctctcaattccttccaaaacgtttgatttttttagaattccttttgaaagttccaatgttatttatgggaacatttcttaactgtaataccattttattttttccacagaaaatcccaacaatttaaaggttaaaggtaatatttttattttattattaatataactttgaaataacagctttattgagatataatttacattcataccataaaattcactctttgaaagtatgcaattcagtagtttttaagtatattcatataattatgcaaccattaccactctctgattttagaacatataaccactccaaaaatagaccccacaccattaacagtcactactcatttccctctgcctctagttcttggcaaccacactaatctactttctctccatggactgacctattctgaacatttcatgtaagtcaaatcacatatatgtgggcttttgtgacaagtttctttcacatagcttaatgtttctcagatttgtggtaatacccttatgtttagaattagttttacgtctagcaaatatatgcgtttatggttctatttttaattcagtggactttatttttctagagcagttttaagttcacagcaaaattgggtggaatgtatagaggttttccaactgtatgaaattatagacccctacttccacaaaagtatagcctgtgtcataatcaacatcccctaccacataaataccccaactcccacaaatctatagcctatgtcataatcagcatcccttatcacagtggtactttttaaatttttacaaatgatgaacctacattgatagatcactgtcacccaaagtccgtagcttacattaaggttcattcttagtgttgtacattctataggtttagacaaatatacagtgggatttatcaaccattgtagtaccatacagagtagtttcactgccctaaaaattccttgtgttctgcctattcagccttccctccctccacccctgttatccactgatcttgttatattctccacaggtttgccttttccagatgtcatacagttggaaccataaagcatgtagccttttcagataggtttcttttacttagtaataagcatttaagtttcctccattctttttatgacttcatagttcatttcttattagtgctgaacaatgttctactattctgtgtagagcacactctatccatttgcctacttctgcaaatcttgattatttccaaatattggaaattatgaataatgcttccataaacatatttgtgtaggtcattttgtggacataaattttcctttaagtaaatatgaatgagcatggttgctaaatcatatggtaagaatatatttagtttttaaagaaactgccttctaaagtgtctgtcccatttcacattcccaccagcaatgaatgagagtttctgttgctctacatcctcccaactttggtgttgtcagtattctggattttggcttttctcatgggtgtgtagtgttaccctattgtcattttaattcccatttccctgatgacatgtgatgtgcagcatcttttcatatgttcactttttatctgtatatctttggtgaggtgtccatgaagacctttggctcattttaaaattaggttgttttcttactgttgagttttaagagttctttgtatattttggataccggtactttatcagataggtgttttgcaaataatttctcccagcctctggcttgtctttttattccctttagaatgtcttttgcatagcaggcttttaaaagttttaataaagtccagcttattaattctttctttcatatattgttcctttggtgttgtaactaaaaagttaccaccaaacctgaaatcatttatattttcttctaggctatcctctaggagttttatagatttatattttacatttaggtctgtgatttattttgagtcaacttttgtgaaggatgtaaggtctgtgtctagtttcaacatttttttttgtatatggatatccagttgttccagcaacatttgttgataggactgtattttctacattttttattgcttttgctccattgtcaaagataattttaccatatttgtgggttgtgggctctgaatactgttccattaatctatttatctatttttttaatacctctctcttgattactgtagttttacagtagttttgaatttgggtagtattagacatttgacttttatttcttcagtattgtattggctactctgggtcttttgatactacatataaactttagaatcattttatcaatatacacaaaataacttactgggattttcattgagattatgttgaatctatacagctgacatcttgacaatattgaatcttcctattcatgaacatggaatatctctccatttatttagttctttaatttctttcatcagcattttgtgatttccttcatataaatcttatataagtattattagatttctaccttttaagtatttcacttttgggtgatgctaatgtaaatgatactgtgtttttaatttcaaactccacttgttcattattggtatataggaaagtgatgaatttttatatatcaactttgcatactacaatcttgctataatcttactagctccaggacctttttcattgattattttggattttctacatggacaatcatgtcatcgacaaacaaagatagttttttttatttttatcttcctaatctataaacctattatttcctttttctgtcttattcaattagctgtgacatccagtatgatgttgaaaaacagtggttaagagaacatctttgacttgtgttttaatgggaaagcttgaagtttcctactgttgagtatcatgttagctgtaggctatttgtagataatctttattaagttgaggaagttttcctctagttctagtttactgacagtttgtataataagtggggcttagattttgtcaaatgctaattgatttttaaatgttgaaccagccttacataactgggatgaatccatttgggtcatggcgtataattcttttatacattgtttgatttgatttgctaatgtttttaaagattttataatctatgttcatgagtgatattggtcagtagttttcttttcttgtaatgcctgtggtttgatatcagtataatgctggcctcttatgagtgaggaagtattctatttgattttatcttctgaaagagtttctagatcattgatattatttcttccttaaatgtttggtagaatacaccagtgaacccatctgggcctgacactttcagttatccagttatcaatattgattaagtttttaatagttatgggcctattcagattttctatttcttcttgtatgagttttggaagatgtacctttaaagaattggtgtatctcatctaggtcatcaaatttgtgtgcatagagttgtttataatattttattttattcttttagtgactatggatctgtagtaatatctcttctttcatttgtgatattaatattttgtattatctctctttttttcttagctgatctagaaaattatagattttattcatctttttaaagaaccaggctttggtttcattgattttctttagtgaatttctattttcagtttcattgatttctgctctgatttttatttcttttctcctgtttactttggatttatttgctcttcttttcctagtttcggaaggtaaaattttagattgttgattttagatattccttctgttctaataaaagcattcaatgccataaatttccctttgagaactgctttttctgcatccacaaattttgataagttgtttttttcatttttatttactttgaaatacttttaaatttctcctaagatttctttttttggcccatgtgttatttacaagtatgttttttaatctccaagtaatttgggattttaaaactacctttttaaaattgatttctagttaaactccattctggtctaatagcagccactgtataatttctattcttttaaatttggtaactgtgttttatggctcagaatgtggtctctctttgtgaagcttccatacaatcttgagaagaatgttattgttgaaagaattagtctacagatgttcattatatccagttgatgatgtcactggtgtgttcagttatgccttaatgaattctagctgctggaattttccatttgtgagagaggggagctgaagtctttaattgtaatagtggattcatctactttttcttgcagttctatcagttttagcctcatatattttgatgccctattgttaggctcttatatattaataattattatgtcttcttggagaattgacctcattatcattgcgcagtgccccttgttatccctgataatttccttgctctgaaatctgctctgtctgcaattaatctcgctactcccactttctttcgattagtgttagcatggtacagtaatcccccttatccacaaggaatatgttccaagactcccagtggacacctgaaacagtggatagcatcaaaccttatatatgctgtgtttcttcctatgtatacatatctacgataaagtttaatttatacattggacacagtaagagattaccaacaataactaataataaaatataacaatcatgacaatatactgtaataaaagttatatgaatgtgatttctctgcctctctaaaaatattttattgtacagtattcacccttcttgtgatgttgtgaaatgatacaatgcctacgtgataagacaaagtgacatgaatcacataagccttgtgatgtagcagtaggctaatgatgaccttttgtattcttaaatctgtgtaaccatcttttaactttccattaatgacttggtgtcattcatatcaggagatttcttgatagagtctttgcataggttcaacactttttggcacaacacgttgctataattgaacatgttttcagttcatgtcttccatccatgaattatgtgctttttctacttaactaagtacttatcatacaatgtggctagagcttttgcagtttaaggtgtgacagaaaactaccataaatttcttttgcttcttcataagtttatggatagaatattcattcttactgtagatcttaacaacatcaatatatgctttttttccctttattaagttgaggatttttacctcttcacctaaaagaatcactttatgtcctttctttggcatgtttgaattttcagcatgactattattgcattttggaaccattattatgtaaaatacgaattaacctgaacacaagcactgagatatcatgatagtcaatctgataactgagacggttactaagcaactaatgggcaagtagcatatacagtgtgggtatgctggacaaaaggtttattcacatcccacacaagataatgcaggattgatggtgtgagagtttatcatgctaccaagaatgatgcacaatttaaaatttatgaattgtttacttctggaactttccatttaatattttcggactgtttgtggctgctgttaatgaaaactacaggaactaaaaacaaaaacaaaagcaaaaacaaaggtaaggggggcctactgtatatctttcctcatccatttacctgtaatctatatgtgtccttatatttaaagtgggatttttttagacaacatataatggggtattttttaaaatctgttgcttaattggtgcatttaaatcactgattcaaagtgattagtgatatagttgggttaatacctaacatatttgttagtttctgtttgttcaccttgttctttattcctatttttgtcttacactatttttctgtcgtttgtggttttaattgagcattttatatgatttcatttgctctccattcttagagactttttaatgtttgcacagagtttacaatataaatttacagtgaatccaagtcccctttcaaataacactatgccacttcatgtgtatcttataataacaaaataattcatatttttctctctcacccttattgtcattcatttcattcatgcataagcatagaaaagtctatgtatgtacgtaagcatacataattgaatatattattgctattgttaacaaacatctatcagatcaattaagaataaggaaaatacaagtttttattttactttcacttatttcttaagtaatgctttcctttctttatgtagatgtgtgtttctgaactatatcattttgtttttctttaaagaacttcttttaaaatttcttgcaagtcaggtctactggtaacaaatttattaaatttttatttacctaaaaaaaaaattcctttacatttgaagagtaatttctcagggtacagaactctaggtgttgtttttttttttttcctctctcaacactttaaatatttcactccactctcttcttggcttgcatggtttctgaagggaagtcagatgtaactattatctctgttcctctacaagtgtggtaggagttattaagaaattattttaggcagatagagaggaaaagaggtccttggaaggtttttcgcagctccaaaaaaacgtttcttgtatagcatgaaagccctggctcttaaacctgggacggcaacctttaatatgcaaatgccagcctttagaaactggttccacccaacatggcaattcccactgttgtcctcttgcccttgccccaacaggtgcctgacaacatggccacccccatatatccccatgtgtgtagaacatcatggtgccctgcatttgcatattaaagggctggggtggaaaggccagttttcttgctggctaagtgaataacatacctggtcaaaccaattccctgagccctgtgcaaatcaaacaccgcctcctccagccatggcataaaactggctggtatcctccaaatgtggggtctcctctttcagctttggagcccccctccctctgtctttgtacgtgtaaggactaaactctgtgtaaggactgtgtaagaactaaactctgacctttttcccccttcctgcccacattcttatctaagagccctggcaagtcatgccttatacaccatgaaatatctttagatgggtttttattaaccctatataagttgcttactttccaacctgactatagtatagcaccacatgacatatagcagactgaaggaaataaaaatattttacccctaaatgtacttctttgatatattttgaaatggctgtcacaagccagcagactgaagtaggagaaatttgtatctgtagagaatggagattaatgcagccacatttcccctttctatccctgtcctggatctaggagaaattgagagtctgacacctttgaaagtgagaagacacacatttaccatctattccctctgacagtttccacctttgagggtctatttacacaataagaagcctggtctccacaatcccattaatcttaactcagtcattcttttgtactggctttaagtctttagatagtttcttaattctctcaaccaattgtgaactaaagaatccctaaaactcacctatgacttgtaagccctcattttgggatgtcccacattttcaggacaaacccatgtataccttctgcatattgatttatgattttacctgcaatgtctgtctccctgaaatgtataaaaccaatgtgtaacccaatcaccttgggtacactttctctcaggacttgttgagattgtgtaacctgggctgcggttactcatattagctcagattaacatctattcgtatattttggcagatgttttttctccatcatcatgtggtttggtgtctgacttgatttggggaaaatcttggttattattatttcaaatgttcttctgttcctttatctcttctccttctgatagtgcccttacacatacattacagcttttgtggtttctcacagttcttaaatattgtgttctgactttttagttttcattctcttttctctttgcttttaaatttcagtgatttctattgagatggactcaatctcagagattctattctcagctgtgtccagtctactgagaggcccatcaaaggtactcttcacttttgttatagttttttgatctctagcatttggagggaagtctttcttataatttccacctctttgttcacattgaccacctgttcttacatgttgtctactttatccactagagcccttagcatattaatcatagttattttaaattccccgtctgttacttccaacaccctgccatcgctgagtctgattttaatgcattttctgtctcttcacactgtgttttacctatttgtatgtcttgtcatttttttcctgccaggtggacattatgtactggataaaatgaactgatgtaaacaggcttttagtaatgagctggtacagtgttgggggaggggaaatgttctatagtcctatgattaggtctcagtcttttagtgagcttgtgttctggactgtgaacttctcaagtgcttctcagttttctccacttagatgtgacaggatgactagagggatctgaaattgggtatttcctttcctccacaggggatgctagagccagctgtggttggatatttcacttcccccaggtctgtgaggctctgataaaaccaagaagttaggctttgattaaataatctcctctgagggcagaccttgttaagaataaatgaactctcaggcacattcaaatgggttattttcctctgacctggccaaaacatgatgggattttttatctattacttattgtgagggcctggagagctccaggaggtaacatgcatgcaagtgtgttgggggtggggggggggttgcaccgtaactgggttcccgtttttaactctcaagaattgtcctcactgagcctccactgactcacagttacacttttggttttcctatcctcgcactggttccaatggtggtttaaactcacaactctctgttccaatatgccctaactgcctgtattcacctgtttgtctctccaatttggggggcattggtttgtctgttaaggtactaagaagaattttcaatttgacttcctcttttcctaattgaataccctttatttccttctcctgcctgattgccctggccagaacttccaacactgtgttgaatagtagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggatttggtttgccagtattttactgaggatttttgcatcaatgtgaacaatgagaacacatggacacagaaaggggaacatcacactctggggactgttgtggggtggggggaggggggagggatagcattaggagataaacctaatgctaaatgacgagttaatgggtgcagcacaccaacatggcacatgtatacatatgtaacaaacctgcacattgtgcacatgtagcctaaaacttaaagtataataataataaaattaaacaaaaaaaaagaagaattttcagtttgttcaggatttttcttattgttagactgaagtggtgatttataagcttcttacatggtaggccagaaactggaagtttcttatggttctcttttaaactattttaaaaactttaactgatattagatttggggggttttttgtcattgtttgtttgtttgtagctttggtgaatatttggcctttttttattttttatttattttttattatactttaagttttagggtacatgtgcacattgtgcaggttagttacatatgtatacatgtgccatgctggtgcgctgcacccactaactcgtcatctagcattaggtatatctcccaatgctatccctcccccactccccccaccccacaacagtccccagagtgtgattttccccttcctgtgtccatgtgatctcattgttcaattcccacctatgagtgagaatatgcggtgtttggttttttgttgttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggtttcaagtctttgctattgtgaataatgccacaataaacatacgtgtgcatgtgtctttatagcagcatgatttatggtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatgtccttcgcccactttttgatagggttgtttgttttttccttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttaattagatcccatttgtcaattttgtcttttgttgccattgcttttggtgttttggacatgaagtccttgcccatgcctatgtcctgaatggtaatgcctaggttttcttctagggtttttatggttttaggtctaaggtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgtttaaacttctgcatattttgtcttgtaaagggaactttgctagagcgtgaaacacattcattttaaaaattaggcatgtttaaagcattcctagaagacaatgtggtagatgtagatgatgtacaaatgaatactagggaaaaaatcttattctaaaatagagtcaagtcacacaggttaaatgataaataagctttatttcagttcctcaaaatacttccctctctcttctctaaagcgtttatatttactcttgcctctaactgggatgttcaactctctgcatggttaacttctctagtcctccatgtctcagcttgaatacttcccagagaaagcttcttccatcttgtgtaaagcagcaccatacctgttactctatcacatcatctactttgtttaattaccaggtcatgataatctattttatggatttacttatttattttgactcttgtcttgtaaggtatgcttcatgaggtaagtacccccttagacttttttctttatattttcattacttagaatgatcactggcacaggatagatccttaaataatatttgaattcaaataatgaaaggactacaaatgagcttcagagaggagaagtttcaggatgtaaaatggcatttataattgagatcagtcttctcttccccttacccacttgcattcttttatcttaggataaaagaaaaaatgtgagagtgaaaaacacaaggtggtgggagagagagaaaaatagatgttttttatacaatgtgcaatattgaaaatttgagaacacagaccaggaagaacatttgcactgattgatggagtcaggctggaaaatttggcaccattcctggcttagtctgtggggtccttaacattgatagtcaacaataattggtgtagacttagcaccaaggtcagcctcagggtcagacatttgaatctgcggcagctgcagatgcagttgtgtctctagtgagtgtcaatagcatggttgacatttggaggaaggatatttactaagaaaaagaagaaagagaaagtgataaaacataatgcagtagccatggagaccagcagcttcatggagcattgggcatgacacttgtaggaacctctcaagattatctaggaagagattaagggaggttggctttgttgaaaaattaataggaacatgcagtaccagacaagttttacattgtgaacttgtttttaatcttttcttattgccagattgctgaggcctaagaaacaaaggtttgcttctaaaaataattatcttctttcttcgcccctttgatagagaaatcacaagacaaaacaaacaaacaaacaacaacaaaaaaaacaagccaaaaatccctcaagtacctccaaacattttctgtacccaaaatgttacaaatgtctaaaacaagtaaatgtttctttcttctagccatataaattaagaagaagaatatagacatttaggataattaaattcttttcccatgttccttgtgttcaaagcaaagttctctgggttttaaggtagcaaaaaatcgtgaaaattattattcccacacacttccatatattctcatatcttaattatgatatatgagttttttaccaatataggccacacttgacttgagtgttttaattattttttgctgaatgaagggaaatttatgacaattcagactcactcttggctgaatgaatgttggtagtgtccttgcagtctcttcttttagacaaaggactggtggtggtcacttatgttctctacaccactttcccatacttgtgagagaaaggtcccagcctggtcaaagtcttacaaaaataaatgctgagaatgtccgtcttggccattgatctgttttctgttccatgcttttgtaaacccctgtggtgatgtattagtccattttcacatcactataaagaactgcccaagactgggtaatttataaaggaaagaggtttaattgactcacagttcagcatggctggggaggcctcaggaaacttacgataatggcagaaggcaaaggggaagcaaggaccttcttcacagggtggcagaagagaatggagccggcagacgaaatgccaggcacttataaaaacatcaaatcttgtgagaactcacgatcacaagaatagcacggcggaaaccatccccatgattcaattatctccacctggtgtgtcgtttgaaaggtggggattaagggaattatggggattacaattcaagatgagattttgagtggggatacagccaaacaatatcaggtgactaataatatgaggaattttcctatgtctttctctaacttgtagcatatagaagacattccacctcacaatgacttcaatggtagtatgctctactacttttttctacagataattacttcaacagtactagaaatttatgtactacctttaacgcttagggtcccatgacacagagtgtaaatttttcatccaagtcttatacctgtacctaagttgtattaaaatggaatctttccttagagcattcagagactgacaaaaccttgaaataatttcaagtaaaattatatttatgtttatagatgtacattaaaaatcagattcattgttgaatcttgacatttattcaagaggacattcactttagaaatagctcaagggcatttctgaaattagatatcaaatttgaaggtcaataaaaagatgatgctttactttttagccattttctttgcctcggtgttgctctaggcatgtgtgtgtgtgtgtgtgtgtgtgtgtgtatgtgtgtgagcatatttgagttgttattagattctctccaatttatggtatattttatattcttgtaaaactgcctacaggaataggttctactatatctaagaaataagaatgacttttttaaacttagaaagaatgatacataaactgatatttcttattcaaaaatatctaataaattatataaatagcagatatttaagcacttattatctttcctttcagctatactcatattatggaatctttaagctgctttaactttttctcatactatttggtataaaattttcctatataaatgttttcagcttttaggtcaaatatagtagcataatattacaatatgaggacatcacataaaagtcacagaaataagtgaattaatatttatatgcatagcaatattttttagtataatacacatagtcacaattgaagtataaataaatgatcatatgctgtttaaatcgtaggttgttttagcttgaggactgccatatattgccatctacagtaacagctacttctttaacaaactgaaagactgctatatgtttccccctcaattaactgagtgatgagtctgaacagataaaggaaacaaattggcaaacgtgatctgtattgcctgccctggcattagaagtttggacagattatatttccataataagagtactgtctgcttgagagtacctagatgaagtggagtttttaacataccaaaccctcaaaccaattagaacactgcatggtggcaacaagagtctccttccctttaatgagcccttggtaataaaagtctaccactgctgctacaatctgtattggagataaatttagcaccaaaatattttcatataagcaatgggctttagtcgttgtacctaaactatataataggtgcccttcctacttaatagacttccttcctgaacctcttgatcttgactcccattgctgtctctgaagcagaaggcatggatgattattgccttataccaaagactcttgttctgtaagctcaaagatcctctaatgtaatgcaattcactgtgtgttcaggtatcatctggcctccttcacattgcactgtaggaaatgtgacttggaaaactggtacaaacaaaaaagctgatactccagctactcgaattgctgtagtaattcattatttttttgtctctgacctgggagtctggtgccttctgcaagcactcatgaggttctggtatgttagttggtaagtggcatgaatctttaatccttcagaattcttgttggtttgggctatgaaattgggacgctgaaagagatacaaaattttggagagaaagacaaaggcctagtgttcttggatcagtgatatgagaagacttcctggaatttgatggtgaattcctgcctgtaaatgaaagtctggagggtgagtggtgtcttggtcattctcactcttcttagggcaagcaaaggaagcagcagtatcagaaagagggggcagcaaacctcaagtcccaatctgaaaggccgtgtagttgtggctactgagtcagagttctgaagatgaagcagtgttggcaatgaataccttgctatcagtataaagcttggtgatgctgaaagcattagaagttcatttggttgtgccatgagtgactgacaattgaaactgaatgtgccttgcttacgaacatggaaccactctcttcctcttcacctacagttccttatttatcctctattctaatttaatatgctttaaggataaacaagattaatggtaaagccaagatttctttagttccaaggaggaccaaaggtcatatacatactgaactttggaataaagtggtattctaactttttgactgatggatcaggcacacaagtcaccaatgtacccactcccatgaggggagcagatgcttataaacagtcaatgtaatttggctagggtttataaggttcacagtaggagaacaaggctaatgtgaccttgtgtgtgagcctgttagaccaactcaatatacttttttggttgcttttacaactaaatatagcgtaaaaattaatgtgttaatacttgcaactcccatcccaataatatcagagcgcatgctttcaggagctggtgtagagaagtccttctgccgttgggggtacggaaaccctaatgacattgttaaatctcagtgactgataattttgctgattggagccctgtcatgagttgaaatgtttcccccccaaaaaatgtacgttgaagcctgaccgccaccccacttttaaatgtgacattatttggaaataggatctttgcaggtgtattcaagttaagatgaaatcatagaattagagtggaccttaatccaatatctggtgtccttataggaagaaagaaatttggacacacatagggagatccccatgtgaagacatggagaacacaaggagaaaggacttgtgatgactgaggctgagatttgagtaatatagttgcaagcaaaggaaagccaagtattttttggcaattactagaaagtaggaagaggcaaggaaggatcctttcctaagtcttcagagggaacatggccctgccaccactttgacttcagactttgaccatccggagctgtgaggacacaacttgctgttgttgcaagcctctcagtttctggtactttgttatggaaatcctagagaactaatacagaattcttggtcgttttggctatgaaattgggacagagcctctgatttccacatacaattgccacttggagttttatattcatgacttctctgacatgactctcaggaaaagcagctattagcttgcaactgggctcttgtggaaactagacacctcatttatggagtcattgtgactacaacctgatacttccattttagggtagttcaactcggactcaatgactaacaatgtgagaatgacctaacaagtctcacttgttaaatataaatggtatattcaagaatgcagccagccttgtcccattggaatctttgtttagatgaaaaaatggcagctgttcttttgggggaagcattccactgcttaaagcaaaactgctagctcaatggggcctacaatgcacagagagtttcttcaatgcctggtcctggatcactaagggtattcattgggattctgtggctgttcaagctctgcactgactatacagaaccaaaagcacaggtggtcatgccacccagtaggcagaactaaagcctcttctcatctctctttctggtcaatactcccacttagtaaaacattttattttatggattcatgaacagttgcaaataacatagctatttggaatgccattttaaacattacagactatcagattaaagacatccttgtttggaactgtggcctatggaaacaaattgcagctactgttcaaactgcctggttcgtttatgtagatattcatggtaagggcctgttttctgatgataccaactggaatcaacacttcaatcatagacaaaggtatttgatagacttttcacactccctactattcataaccatctaacattgctggacattggaatgacctcttcaaaaattgacttaaaaatatttctaaccctacatcctttgtgtcaccctgatcaacgtaccttagaaagaagggcattctagtaaattaatgtggctatctccagaaagggatttgctttcacgtgcttcctgggtagtgattgggagaaaagcaatgggagctatgtagacagattttgaaaatttgggatactgttgtaatcattcccaagtatgatgtttctttctttcctctagcaacaactccagtctgttcttgatgttataccctattagtggcagtccactgaaagcaggacctagctgattcaaaattaattctgatttagacacttgaattctcttattagatatgcatggtcatatattgaaatgaccacttggttgagtttactgcttgttaagtcccacagtagtggcccatgtgagccaaattgggtcccgtagaaggtttttgtaagttttataaaaattcctttgtctctcttagacttgagctttccagatcaaagatctgaatgtgagtagggaatgatttgaaaaaaacaaatgcagtgatagctactggaagagactttaaggttgtagcagacagaccatagagtggtccctggggaccctcacttgtttattatatagtgctagaaagcctggaaaaattgtctcctaatgtttatgggaagcagaacttctaatgatagacttatttatttagctaaagagatttccaaacaaagtgttgaaggtaccatctggtttcttcctcctgcttatagtaaaatgtgtgtgtgtgtgtgtgtgtgtgagagagagagagagagagaaagagagagagacacttgaggagaaaactgtgaagcaaaaaggaacgaggaaccaggacttgatgaatttgaaaattctcatcatattaaaatggcaaaagatgctaaaattcagacatcacttctgaaatcttgatatagagaaaaagccaaagatgtggctgtgttaattcttgctaaaacttaagaaaaaaacaaaaagttaaagttttcagttccacaaagaccctttgaagagtttaaaggtgtgtattgtagctcctcttaatcaaaccataaggcctacaggaggcttaagggcactgacccttacccatctcagcaggaggttaaaagagagaatggattaacttgaaaagatctgtggaggtagattttgtcaaatcgagtaaagtctacttaaaatccatgggagacctacaaagtttttgcaaaatttatttcattaaaaacactgctccatagactgaaaaggacagagagagtgtaaaatgaaagaaagttgttagatctctaaaattgtacttacaggaagcaggctgataaaaccacttagcagcaaaaattctaccttccatgaaaaaggaagaatccatagggtagatcttaataccatggagggcaattccaggtcttaaaaagcaattaagaaatgacaaacatttacctatttgtatttaagttctactgaaccactgtttctgccctccattttaccttctttttgactgggactgtcttctgctgttattctattttagtcttaccactttatattagtgttctaggggttgacaacttgtctttagtttttcagatccacagttagagaggaattgtcccctgggaactgtacttaaaagatttcagccagaagcctcatctgcgcctggacctggtttagatgatgaaattttgaactttgagcttgatgctataatgaatgacactcttgagaactttggaaggtagtgaatgtgtgttgcaggtagaagggacatgagtcattgggggccagagggcagactacggactatggtaggtagatcatgggatggttctccctgattcctctctcctggtgtatactccctcatataatctctttccattgatcacgggctggacattggacttataaccaatataattcagtgaaggtgatgggatgtgactcctgagattacattatgatgtgtaacattccagcaaacttagtttagagaacttctctgtgttggtggccttaaagcaagatgctatgtggtgagatacagtagttgcaataactgtggatggagcgtctagttcctgacatagtctctcataagaaactgaagcctcagtctttcagccataaagaaataaattctgccaacaacccgagggacccttgggagcatattttccccctgtcaaacctctgatgagaccacaaccctggtaacacctggattgtagcctggtgaaacccttagcagaggacccagttaagccatgcacagattcctgacctatagtaacaacaaaataataaatgatagttcttttaggatgctaagtttttaataatttgttacacaacatggaaacctaatgcaggaatgatgaagggagaacagcctcatcacctgagaaaggaatacctcaaaacccaggatgtaggaagaaggaaggatagtgatttttttttttgtctttcagattactcaaggagccgtctcatgtagaaagatgccctcataggctctcacaaactgttgcaagcatctcaaattttattgactgctgggtcttacaattcctcaccagatggctttgaacacagttcgatcatcaatctcattgatgctactgataattctgttggaacagcaggagatggctctagctcctaaacctgccactcgaaacacctgtcatcacctccaaagatctttccaatacccactggtacagttgtaactcaatcacttcgcaagacagataattgcatgtggccaaagatgtacctggtcaacaggacaggttagactatctgctctcaggtagtccctccaaatcaatggctggactcggttgttcaaaatgaataggaaatcctaaggcttatcagcaaattggaaagtcatgttcgaggtcctatcaagctaggctcctaaaagatatagtccccacctggaggaggggatcaaagaattttaaacagctctttcattttagggccactatttgtgccctaagactatgcttcttgtacagaagctagctattaatttgcctcccactcaaacatgtttgcttaaaaactttaattgtggttattagggaagttcagagtgatttgggtcacattaccagagatcatgtatccaaaacacaactgtagagatctctcccaaatgtatctacccttgtttactcatgggaacttcctgggaatgtaactgactcattacattgtcacaactgtgggcagtttccctaaaatgggaatcatccagttagaaagggtagtaaaaaatatgtgtccaactttatctaaagtcatcagtgatgccatctgacccttgaaaggtattcaggtcggccgggtgtggtggctcacacccgtaatcccagcagtttgggaggctgaggtgggcagaccacctgaggtcaggagtttgagaccagcctgaccgatatgatgaatttttagtctctactaaaaatacaaaagttagccaggcatggtggcatgcgcctgtaatcccagctactcaggagctgagacaggagaatcacttgaacacaggaggcggaggttgcagtgagccgagattgtaccattgtactccagcctgggcaacaagagcaaaactctgtctaaaaaaaaaaaaagaaaagaaagaaagaaaaaaggaaggtattcagatcagcctcaactcactggtaaggattgccttagatttttatccttgagggccaaggattagtctgtgtaattgaaaatatatcctgctggattaatgctatggaccatttcaatgcagaaacttgtgaaagacacttcttggttttctaaagtagaccttattgatgtataggaattattctataaataccttgaaggacatggatgagcataatattgcagattgaccagatctacttgtttagagtactagagatagtagccttatggtcagattattcagggtagctgttgagattattcagggcagctgttgacatggcataatctaatgggaaaatttgccagaaaccaagatgatattgattagagggagtgctgttttggggaaacaattctctatggatctctgatgtctccatgtcttacaagcagaagcactgactgctgtttgtcctggactatcttttaaggcatatttacatagagatagtgtcttcacgggagcaaagagcacacatgcttactgcccagataatgtttctctgagagcaaaaagcagaaatgcatcctgctcattactaaagattcgtgtttcttaagctcagtgtctctttcctgtggactacaacccactaaatgtgcatgtatcatctgtccctcctagtgtctccttatagaaatggggacctgggaacaggtgcaaaatatatgctgatacactggctactggaattagcttaaagtaataaactcccctttttctgtgactcaggagtctcatgtcttctgccaccaaccttgaagttgggtcagtctaacttgttaagttacaaatagggtagaacctcagacctttcgcaattcttaataaggtgatgtatgccacatttgggccaaggcagagaaaaaatgtgtatggttcccctcacctcccatcccccttttaaactgctattggatggaagcccacaatgaaaagagttgtttctctgacagccctctgcataacaggaaaaactggttgttctattaggtaagacagcaatcattttttagaaagctaacttactgaagtagggtttatttgctaccatggtgggaggtttgtgcattaatttgactaagaatgacagactaacaaatgtgagtagccagaaatcacacacatcacaccttctgaaaatgtctgtggaaccaactgcagatgaacacataggccagtacgtcttggtaggcagcacaggtggtgattcccttactcatctgctatggtgtataaacttcaacttcaaggcctaaaagcctcacaaccccataattggaggtgttctgagtttgtcttgctctgctaggtctctgagcattactctggtatgtgatgaccaatggaagacttgtctagctaccattggttttgagtcttttctagtacatgttgttcctattggtctagtatatctgctgtctgagcattcacctttgttcacttactatttcacacatttctagaattactctatcaacatagaaatagtattggatgatggatgccactccaactagttatgaacaaatgtggcactttatcagtagttgagcaacaggctaagaaacagtaaacacttcaggacagaaggttggataacttattatgtggcaaatatttcataaaattgctgtgtgccataatgtgaaaagcagaccaagattttactgtacctgtatttcttgggaaattttgttctaaaaattaaaaacatttgtgtatgttggctttactccctctccctgtaaaatgggactttaagaaataacagttcatgcaataactatctgctttgatagctgaaatgggaaagaatagagaaatttaccgcttagcaagattgagaaaatctacagacaagaagggtaaaacaagacagagaacaagttaagggcaacaaatacccagtaaagtttcccagttaatctaagtgactcagtccagaagcaaagatcagataaggttttactttgcctttcaagtgaagtgttttaggtggtctcaaaatagccaccattaggttgagagtgaaaggtgtggaagggagaaaacgaggtaagacagacttgagaattatttctaacaaaggactttcatatagttcctggtacttagcattgattagaagcaaaagcctccccaagtcacaggaaatttttctggggaaatttgataactagttgtatgtatcaacttgactggatattactttctcctacttgatgattcagacactcggactgtttctaaatttttgtgcaaatagttcccaaggattcagggacttctgttcccagctcaaaatctgggatctcactccctgattctgtattctagcaactccaacacagatcctacactgtcatgatcctgcgtttcagtaactagcagacaactatatgcccttatcccctttcccatccattttatagttacagtgcagggacaagacatccatgataaaaagcaaaacaaatatgccacctgaatattcagagaagggaagaataagaaaacacaccaactccagttcaaggcaaaggggcaatcctataggagggcgtcatgaagccctgctctggcaggggtggaagttcctgagtagacagtaattctgctctctgaaaggatcattgttctctgtgagccttcattgcactctacatagatttcctagttcatgttcctgttagagtcataggtgaggtggatgtctacaagagtatttaaggaggaaatcaaaacctgacttgatagactgagtaaagatcacccttcaccagtgcaggtgggcgtcattcaatccacagagaccctgaacagaacaaaaaggtgaaggaaggaagaattcacactctctttttcagccaggacatctgtcttctgctcttggacatcagtgctcctgattcccaggccttaggacttgagtcaggacttttatcattggccctccattcagttcttggattgcaagtataccagcagcttttctaagcctctagcttgcagacaacagaccatgtgacttctcagcctccagaagaatgtgagccaatccctcattaaaaaatctttttgtatatatcgctctatatatgtcctaacaattctgtttctctggagaaccgtagcaataaaaaaaaatcaaaatccctgaagtagaaagcctttgatatttgttcttgaactgctatcagatcccaaaacacacacaagcacaaagcatgctagtaaagccccacagccatcacagagggaataacgccaacatccacctcacctctgactctaacaggaacatgaactaggaaatctatgcagagtgcaatgaaggctcacagagaacaatgatcctttcagagagcagaattactgtctactcaggaacttccacccctgccagagcagggcttcatgacgccctcctataggattgcccctttgccttgaactggagttggtgtgttttcttattcttcccttctctgaatattcaggtggcatatttgttttgctttttgtcatggatgtcttatccctgcgctgtaactatataatggatggggaggggagataagggcatatagttgtctgctagttactgaaacgcaggatcatgacagtgtaggatctgtgttggagttgctagaatacagaatcggggagtgagatcccagattttgagctgggaacagaagtccctgaatccttgggaactatttgcacaaaaatttagaaacagtccgagtgcctgaatcatcaagtaggagaaagtaatatccacaagttatgatagtgtaaaattctattgtgttaagccactgaaatttgcaggtttctttcttaaaatactagtgttatccttagttggcaattctcaaattagtattcattttcagcacctaaagagccttttcagactttttatttataatgacctcttattaaattttactgtctgtttatgttttatatgtgtatctttgcattacatataagaagagaactattctccctccacaccagaatcatttttttttttgccccttgagggcgcaattgcctgattgagaacaggtgcccagaatgatgctaagatgtgttccctctcctgcccacctctctttcctctcttaaggttcccatctatcactgcacactaatcatgttcaccttctttctatttcttgaacatgaaaagctctttctaacctgaaggtcttttttatttgtttactcttttccttgaaaacttttaatttcagtctttgtactgctgacttcctctaattttttgtgatatttcttaacattttcttaaatgttaccttttcagagaaacctgtttctaaggtgatctactcttgttattcttagtattctgttttctttcatagcacttatgataattttaataatatatttgactattttgatatgtacttattcttatgcccgtcactcactacaagacactccatatatacttggaattaatatacttgctaattaatactgaagagcagacataaaaatgataagttaatgaataaagcaagcaagcaagaaagaaaggaatcaatagcaggtcaattccactatttttaaattaaccttcttttcactccatttcctcttttgctgtctagagttcaaagttcatatttggttttgctaaactttagagaaatttctcattaacctgtgaaagaaatgttaagtataaaatttcactaaagctgaacaagttcatgctcaccacttcaggtccatctggtagcttcttgcccagatttccttctcctgaacttctcatccagaactttcaagatgttttccagaggcccacgataatacttactaataaatatgttacaaaagttagtgaccacatgtactacctgaaggtgtttccaaggagaagatttcccctctccactgtctttcaaggccacccctcagtgaagttgtagtgttcagtcaacccttctgtgaaccaggctttagtttccttcttcctttttcattcttctattagctggtcactggggcttcacacaaaggcacaggtgtaggtggagatagatatgttgatgtagagtaggtggtggatggggtggttcctacttgtttatgtaatttacttatgccatccagatctgcttgggcttaatcccacatataccactttcaatttatactggtttgttgctaggtggcctacatttatgacatgatgagtctgacaatgattagtgtatgatgggcagctttagtcatatggtcgtttgatgccttacaatcagatattcagtttccagtaaggcccccaatccagaaattgtactgcaagtggtttacaattccctgctgaagaggaaggtcttattccaaaccctagtggcctgtgctgtaactttcttattagagtactctgaggactccacacaatgttcttttctacagcagagctcagaatattatagcctacgggacaaatctgactcagggcctggttttgtagttaaggttttattggaacatagacacacttatttgtttacatattgtctgtggttccatttgcactaccaaggcagagttgaataattttgggataatggtagcgttgaatagttgtactacatcagcagagtgtagtcattgcagcaaagaccctaaggccttcaaagcctaaaatatttactacctggccatttacagaaacattctgctgactcctgctctataacttgttggatctgccagatcatatcacccaagtggtaaggctgtttctacaacagcgtacaactgctgctaagctgacttcggctctagacccactcaaaattggcagtgttctaagtcacctgataaatgaatcaaagcagtacgccctagtatggtatgtgttatttcaaaaatctgcaaatgtctgccaagcattgcaacctttcagtagcaggaagttctgatgtcctggcatgcaccatatcattggatccttaaaagtttcattaatatggcaggtcccttgctctagcaagcagtcaacttaaaaaggcatacatgatccggcgcagttgctcacacctgtaatcccagcactttggaaggccgaggtgtgttggatcacctgaggtcaggggttcaagaccagcctggccaacatggtgaaaactcatctctaccaaaaatacaaaaagtagctgggcatggtggcagatgcctgtaatcccagttactcgggaggctgaggcaggagaattgcttgaactcgggaggcgaggttgcagtgagccgagatcgcgccactgcgctccagcctgggcgacagagagaaatgctgtttcaacaacaacaacaatgacaaaaacaaaggcatacagagtatctgttacttcctgcttcccaaagtcttgaaaaagagtcagagagattgtccatagaatgtccagataatcaagatcttttcagactacagtgtgacgatgtagcagagtcaataccatcctgaggcgagatcatgtgctatttactttccatccaaatgaatgcttctgattctttttctgacagggaataaaattaaattcattcactaaattaatagctactatatgaattttctgcggctgctgtgactatggcaacagtagcttaaaacaacacaaatttctcatctcgtgattctatagatcagaagtctgatatagatctctctgagctaagatcaaagagttggcaaagtgcattcttttctggagtctgtagggaagactcctttcctatgccttttccacccactttccttggcacatggcctctttctccatccttaaagccagcaatgtttggccagttctcacaatgccgtctctttggttctctctccctattcactcttctgcatttaaggacccttgagattatattaggcacacacagataatccaagataatcttcctattttaaggtctgatgtttagtaactttaattccatctacatcgttaattttcctttgccatgtaacctaacatatccacaggtttcagagagcaggacgtagacatctttgtagtgctgttactgcgtctgccacaactacatatcaagtatggagtctgtgttgccttcttgtaggaaatatgctaaagcagctgtgaaaatgagtgtgccacttggttaaagatatgaaacttcactttcaattgccatgacgtatctaatttgttataggccagtattggtgaattaaatgaggataagaattcagatcacaaaacttattttttaaaagtctttgagtttggcatcaatttctaccatttggcatgtaatgcagtagtgtttctgattttctatcctggataggttgaagaggcagtatcagagaggtctgcttatttttttctataataatgtttcttataccacagagcagggaaccaatgtgagggttctgctaagtatatcaatgttagcacaggcagggattatgaaaacaatagaaggaactgctcctatgtatacttctggtggcatcaggatccttcaatataacaatctgatttagcttccaatctttgttaataaaatttctgaaaaggagatatacctgctttgtcatgaaagatagttctctatggagatatgagtaataccgaacacactgttaactatgtacattgtgggaggcaggattctaagatggcccccaagattccttccccctggtgtatatacctttgtatgtttccctcctctttaatatgggcagaacctgtaaatatgataggatttcacgcttgtgaataggttactaatcagtcaactttgaattaatcgaaagggagattctctgagtgggcttaatctatcgctgaccccttaagagggattggaaccttcctgcagtctaagagattggaaatgtgggaggccctatggagggggccaggttagctgggtcctgagggcagccttgtgaactaggagcaacccctgactgagcagccaagaaaatagaatgtcagtcctacaatcacagggaactaaattctgccaacaccttgcatgagtttagatgaggacctctagatcctattgagtctaagtaaacaccttgagtttggtctggtgaggccctgagcagtgggcccagggaatccatgcctggactcctaacagatagaaactgggagattagaaatttgtgttaagatattaagtttgtagtagtttgttttgcagaaatagaaagctaatacacatttatacatttagcaagtatttataatattcctgcgaatgaactaaacaaagtattataaaaagttccactaaaattaaccaaaatagatttgacattttgtgtatgactctatgtggacaaaatcaattagaagacagttcgcttgtctgtttggggttaagaatgtgtgtatagcattttaatttattttctatttatgagaaatctaattacgattatcataatcgattcaatcatggcacttctttgtggtggtctttatgagcatgtgaaatagctgctttctattttcatatacttcattctgatgcatatttactgaagtaataatgtctgaagatctattttgtattttaattaccagcattttcttgcataatgagtgtaatcttttatacttatgctcaattacgattttgagataaaaatgtctatttacttctggcttcaaggaaaatatttttccttctcaactgttacaggcatagttcaaagaaaacctggtatcattttattggttctaagtttataaataaatatatgatatcctatttatatcgatttatagatatagttttcattctataccctacttagatgtatttgttgttttattttgcttgcttttacataaaactttacttttaaactgtttttcttacctatttaaaaatttttagccaagaattgatatgaaatttacaggcttccactgcaattgttggcttcaccccctaatctcccgcctggtgatgataggagtaataactaacgcaggtgacctaccaaggtagcacaataagtgggagaaccaggttgtctgaaacatagctcactaatttttataccacattggcagctattttttcagatatttataaacatgtgtagatatttatagaaagcaaatgaatgccagagaaaattcacttatctgttcttgaaagctaacatgctacataaaagaaaacgtcctttggaaattgcaatgctgatgtaaaacatagcaaaacaaaacaacacaaaaacaaaatttagagtttccaagtaaagtctatcaatcagaccacatcatgtgaaatatctgaggtgttctggaaactcagtaatattaaatactgattatatggagtatacttcatagcctctaattcatcatcctgctcattcattgtatatagacatttcttacttcatctgaattggtgtcctttcttctccaaaatgtacttagatggaaatacagatataagcaaatgtgtgtatgtgtgtggtgtgtgtgtgtgtgtgtgtgtgtgtgtgtgtatgttgctgtgtctcaggaaagaattcatgtgactgagattttttatatatatcatgttggtaaggaatagaattgagctggaagtattgaaagagaagacattcaaagtggaaaagatgccatttttgaaggcacagatgggttaataactaaaagttcagagaaaataaacagcttattaacttctgtgaaaaagaggacaaactggggacaaacaagagataaaatcctttaagagtgtgtattggaatatatttagtgagagacttgaatcatttggcatttaaagtaatccccaaatgaataagatggagatgaacactaattctcaaacatgtagctgcaaacgggaatgtaggagggaatttttttaagttactaagcaatctttccaaaaaaatcacacatttcccctcatcgtttattccaagtcctcgtctcagctttggatttttccggatggctcaggcctaacgaaggtaaatgtggcctggatgatgggagtgggttttgtgggctgccctagctcccacatggtgctctgagagcggcacagcatgctgttacagagtgtggcccgagagccagtctcacacttctgatctctgtttaagtacctgttaatgtctgatcctgggaaaattatttaacctatcattcttcatctataaaatgtggattataggatccctcacagggctattatagggatcaaatgagattttctccttttgtgtttaatgtgttccatagtatagcaatcaacatatcagcttcccagaaaggaaaagacatgaaaattttaggaaggtagtataatttgaaatagtacagcataaaattatccaaagaagtatataaggtatgtcatagttactatatagaaaatagtaagttttcattcagatactttaaagcaaggaaactgacaattaccacctaatctggtcctgctaataaggtttttcattattttatcttctcttaaaagtgacacctatatgcatagacagacagtgacctcagtcacatcatcagaataatttataaacactgtactaagttatgtgttttttaagaacctgaaaaacacaaatgagggtgctatgtgcttcgttcttctaccaagcctgcaaatactattaatatctttgcatgtgtatatatttaaaatttatctcacatttttgacaaagtatacaaacattgaaagctttgcaagtttacagcatttgggagttaaggtagattctgaaagtcttcctattatgtaacaattgtttagcatcaacactaaactatattcagtacaaaccaaagatttaatcatagtccaagactattacattcattaaaattccactaatgaggaaccgctaaggcaatatttcattttgaaaaaagggaaagttccaatttcaattttaagtgaatttaaattagcatttaaatatgttctataaacatgtgtctgactgagttatgatcagtatgatcgttactgtagtgattattatgtgccctttagtgagcactcactgtgtattgaaagccttgcaaaacacagtatgtttaattctgcagatttctgatgacttttttctcacgagaacacagaatacattataatatctttcctcagccctaacacatagtaataaaaaattaaaggaattttatttttgttcctaacagctttgtctattcattgaaatttaagaaaccaggtaaatataattttctaaaattacatctaatggttggttggtttcctgtttgtcttgtgaattttatgggtttcattttgacactatatctttaaaaacctgaaaacatctaaaatattgatttttaatctggttatttgattagtgttctttctaaactgtcacttttttctgctatatattatttatatttcataattttaattcaaacatatttctattaattttgaaaagacacaaaccaagtgctgtaattatataatgtaattctgtaaaaacaatattaaatatcataattgaaatattattttgtgtattcaaaattgttttttactttggtaagattgacaaatatttttgttggtaatctttcagtgctttcgcttagttacatgccttggatatcaatgcatttttttccacaaaaccttattgaagagctgaaacaaccacattcaagaaccacttcccttgttcctgtgaaggactataaaaaacaaattgagaaataaacagatacgtcacagaattaatattattaaacaccaaacactattcagtattaaatactgtagttggaagtttgttaacttgggtatttcttcaaagtgaggaacttttgctaacgtcagatcagttgatcacaatcactgtctttcaaagggctttgtttaaaaaagaaatctttctaaatcttgctattgtaaatcattttaatgaaatagtgatcgcgagttttatgaataaaatactttgtggtacaagatattaggccaaaactccacaaattcaacatataacaattcaataaaattttgaattgtgttaatgttatttgttattttgtgtctataatcgctaattactgcattgtagtgcatcctttttaacatattaatgaaaataagtaacataaaggtacaggcaatgacattatatgaagtgtctgcaaaaagtttatgaaaaaaaaatatatatgaggagaaaactatgcataaatttcagaaatgttttgtacccaaataaacttgtactaacttgttataacatgtctgagtaggatctaatttgagacactaagaaggataaggcatcagtgagaaaagagcccctagagctcctatcttagcaacacgaattctgctagcattgaagcaagaacagacatccaatttatggtgaggcttgagtagaagaagggcaaaattactgatgctttatgaaaagtttagggggacaatgcctcaaagatatcagcagcttataaatagagaactcattttaagaagggacaagattatgttgaagatgatgcctgcagcagcagaccatccatatcaatttgtgaggaaacaaattcgtcttgtgtgtgccctacttgaaaagaactgatgattaataacagaaacaataggtgacaccatagacatctcaaattgttcagcttacgaaattcttttttttttttttttttttttttgagacagagtttcactctcatcacccaggctggagtgcaatggcacggtctcggttcactgcaacctccacctcctggatttgagcgattctcctgcctcagcctcccaagtagttgggattacaggtgcctgccaccataccccggcttacataattcttatacagttatgtagtgaaatttgtgtttgccaaaagttaagctttaaactttagtaacttaaaaaatgtgaatgctacaattcaaactttttaaaaattatattttataaacaattttgtaaactttaaataataatgtttattttcaaacaactgtcatctttgatttaaagggctgaaaaaataagggtaaaatttaatttacaaaatcaaataagtgaaaaataaatatatataattaagttttaagtgaactttgtgtaaatttgtaacattgatactttgggagatgctacagctgaaaatagcataagattttggagacagcgtctacatttctaaaacatatttttcctttaagtagaaattttacctcaaagtagatagatgtctaccaaattgctcatattatcagatatgtcttaaatcttatttggataacttcaacagatatttgtagtttaactttttattgagataatggtagattcacatgcaatggtagaaaaataatagagaataaaataataataatgtctcagtcttcccccatccccaatgataatattttgcaagactacactataatatcacaacctgaatattgtcattgatttaatccacctgtctggttcagatttctcaaattttactgtgtcatttgtgggtgtatgtatttaattcaatatagttttctcatgagtcatttcatatatgattaccgtagtcaagatacttaacggttctagcattacaaggatgctatgttttgcccttttataaccatgccacgtgccttctgcttccacccactgctgcccaattcatttcaaaaacgttgtataaatggagtcatccatatgtaaatgttgtggattggctcttttttgttgttcttaattgattattctattggtaagacttctggtaaacagaaggcaattattagtagttaagttttgggggagccaaaagttatatgtgggtttttgactgtgtggagggttggtgcccataacctccattttttttttctttttcaacttctattttagaatcagggggcgcatgtgcaagtttgttacttgggtttgctgcatgatgctgcggtttggagcacaaatgatcccattaaccagctatggagtataatacccaacactttttcaactcttgtgcccctccacacctcccctctcaagcagtccccagtgtctattgttagcattgtggattggctttttcaatcagcataattccctggagagtcatgcaagttgtgtgtatactttttgtgactgagtagtattccctagaatgtatgtaccagagttttttaaccattctcttgttgaaggacatctgagttgatttcagtgtttggctattacagataaagcagctattaaatgtatggacaggttttcatgtaaatagacatttttcatttctggagaaaaagcccaagagaacaattgctggatcatatggtaattgcttgtttaattttattttatagccctgcccaactgtcttccagagtggttatatcattttacatttcttccagcagtgtgtgagtaatacagtttctcagccttaccaacttgtgttatcactattttttaattcattcagtgataaatagataatcggataggtgtgttgcaatatctcacttgtggttttcatttgcatttctctaatggcaaacaatgtcaaaacactgatcatcttttcatgtgcttattttccacctgtatgtcctcttcagtgaaatatctgctcatatttgaagcccattgtctttttaaggtatattgttcatgttttcaccattgggttttgagaggtctttccatattctaaataataggttttctgtccgatatgtgatttgtaaatattatctcctggactgtagctgttttcttttcatcttcagatgggctttcaagaacaaaagtcttcaagtttgatgaagtccaatttatttgcttttattttacgaatcatacttttggtgtcaagtgtaacaattctttgcctagctctagatctcaattactttctttaatttttttcaaaaaaagcttatcgttttatgttttacttttaagactgtaatccattttgttagttttgaataatagatgagatttaagtcaaattttctttttaaaaaaatttttgcctatgtatgtcaaatttctccagcactatttattaaaagagctattctttcttcactgaattgctgttgctcctttgtgacaaatcacttaggcatttttgtatgagtctatttttttcattctcttttctcttctgttgttcaataggtctctttcttcccactccacactatcttgcttactgtagctatataggaagctttaatattggggagagttattcttcccatttcattcttctttgtcaaaattgcatttgagggcctatgactttccaaataaattttagaataagcttttctatgtcttaaaaaagaaaatattgctgggactttgttaagaattgcattatacctataaatcaatttgagaagaattgacatccttattatgttgagtctttcaatccataaacatggtatgtctctccctttgtttaaatttctttattaatttatcaatgtattataatttttggcatacagatcttctacatgttttattaattatatatctatcaagttcacttttagagcagttgtaaatagtattgtggttttcatttttgcctatgttcattgttaatatagagagatatgattgatctttgtgtgttgatcttatattttgtgaccttgctagactcatgtattagttatagaaggtttttttttttagatttggaagatactttgggatagtctatgtagataatcttgttatctgcaaatagaaagttttattttttctcttttcaataagtatgccttttatttctacgtcctgcctattccagtgactacaacatctatgccaaataagagcagtgagagataatatcacttcttggtttctatcttagggaaaaagcatgcagttttaattattatattcactatagatatttgtatacattctctttatcaagttgagatatgttacctaacttgttgagagttttcattatgaatgagtattggattttgtcaaatgctttttctacatcagttgagatgagcataggaattttttcctttagctttttggattataattgatttttaaatgctgaaccagccttgcatacctggtaaatcccacttagtcatggtgtataattcatttttacactgttgaatttttgttgctaatattttgtggagaatgtttccatctaacctcatgaaatgtattggcatgtagttttctttttttgtactgcctttttctggctttggtatcagaataatactggctcatcaaattagtttgaaaatgttccttcctctttcattttttctggaagatatgtataaaattgctgttaattctttaaagagttgatacaattattcagttaaactatttaaacctggaaatttatttttctggctctttcaaattacaaattaaatttcatgaatggtaatagaaattattcacatgatctcattgtggttgatttttggtttgtggtttatgagaaattgatccatttttctaagttgtcaaattcatgagcacaagctcgtttgcagtatttgataattatctttttaaaggccataggatctgtaataatcccttatttcattcctgatattgcttatttctatctcttctttttttatgtcagtcttgctagaggtttattactttttttcaaagaacaagctttttattttactgattttctctactgtttttctacatcttttctgagtgacctgttgtcaaagactcggttctgcttgcttcatattagggtgctgcacactgtgagtgattacacattaaggaataaaaaataaaatgaggacctaaaagagctatgaagaaatttttagaaagggagagcagtttcttttgcaattcacttgggtcgagcttctgaaagaaagtcaattttaaagctatcgagcactgtattagtctctttgtgtgggtgtgtatgtgtgtgtgcatacggaaaaaaattatatacagaaacagatacatcatatattatatatagatgctactgaaacattaaagaattaaatagacacttaatttgggaatttggataaacttcctgtgttaaataattttttttgtgatgagttttgaaagactggaagggttttaagagatatggaaatgaattctaaagaagaaaacattgtgagaaaaaagttaaggatttggggaaacatagaaacagattgaagtgctgttgaaaggtaatttagtatttttgaagatactatttgagtgataagaatacaaacaggggccgggcatggtggctcacagctgtaatcccagcactttgggaggccgaggcgggcagatcacttgaggtcaggcattcgagaccagcctggccaacatggtgaaaacccatctctactaaaaatacaaaaaactagccaggcatggtggcgggcacctgtagtcccaaccacttgggaggctgaggcaggagaatcgcttgatcccaggagttggaggttgcagcaagccaagatcacaccactgcactccagcctgggtgccagcctgagtgacagagcaagactctgtctccaaaaaagaaaaaaaaaaaaaaaagaaaacacaaacagggagataatcaaggagataatggagagttggagggtgtccttaaatgtcaattaataatttaggttttattttgttggccataagccaaataggtataggttacataatgttcaaagaatatatgagagtctgaggatttctattcttgaagacaaaatgtgtaagtgaaatatctgttcctgaaagtgaaaaggtacaagacttaatgaagtgtaactaataactaataaatacgagtactccttggttttacggccattggatattctcttttgagaagtgaccgtgcaagtacttagcccaattttctattgtctttttcactgatttgaaggagaactgtctgttctggatgtgagttcttttcttttcttttttttttttttttagtctgttacatttatgggtttgtgagtgttctggaaaattgcagtatgtgtgaagaccaatttccttgctggcattgcatgcatccaaatattaatgcacagaggcacagaattagagcaacaagaaagcatattccaacactagcatgccccatacccccttttgattgcttgtttgcttagtacttcatatatgtgttttgtaagtattttgtccacatttgtggcttttattattttaagattttgctttgatgaagagaatctttcagtttaaatgtagtccagtttattcagtttttctttcaaatttagctgtttttcattttttttaacaaaattatttgcctactcaaaggtcctaacattgtttcccatgttttcctccaagagttttattgatttatctttgctatttagatctgaaatcaatcagggtcagaagcagaagaaacaggaatgagaaccctagggaacaaaaagaaaacaaataataaaatgaaagacttaatccctagttattaataactacttgataaatacttatttaactggttaatatattaacttgaacttaaatatagcaaaagcagaaattggcagaacagataaaaattttttgacccaactacatactttatttaaaaaactcacttacaaacgtactgacaaatgtaggcagaaaataagggatgaaaaatgattcatcatgcaaatgcaaatattaactaaaaaggaatgaataaatacattaacatcagataaatcagacttcagacataagaaaattactaggaaaaagagacatcacaagatgataaaatgatcaattcaccaaatacatatagaaatctcaagtgtatcaatactgctattgaccaaattgtgttgcctgaaacagtggtgttaaagacccatcctcaatgtggtggtatttggaataagtaagtaaacaaagttaaatgaaatcactttgataggatgagtgtcctcacaagaggagaaaccagagagctctctctctctctctctcccatatgaagaaatagtgagaaggttgctatctacaagccagtaagagagccctcatcacaaaccaaattggctagcaccttgatcttggacttacaagcctctagaattgtgagaaaatacatatgttttttggtcacacagtctatgacattttgttagagcagttcaaacagactaagaaaaatagaaaaagacgaggcttaaaaatacaggaagcaaaaactaatagaggttaaaggaggactagacaaacctacttatagttaagaactgaattcaggtgcggtggctcatgcctgtaatcccaatactttggggggccgaggtgggtggatcacctgaggtcaggagttcaagatcagcctggccaacatggtgaaaccccgtctcaactaaaaatataaaaactagctgggtgtggtgctgggtgcctgtaatcccagctactcgggaggctgaggcaggagaattgcttgaacccggatggaggttgctatgagctgacatggtgccactgtactctagcctcggtgacagtgagactccatctcaaaaaaaaaaaaaaaaagaacaaaaaagaacactaccactaccaactaacactaccaatgaattaacatttatagaacactccacatagcaacagctgaatgtttattcttctccagtgcccacagcacattacccaaagtaagcataccttggttcataaaacctcaatcaatttaaaagaattaaaatatttgagataggttctcttaccatagtggaaacaattagaaaccaatattagagagacgtcagaaaaatctttataaacgtggaaattaaacaacacaatatttaatatctcatggataaagaagtctttatacgtattaaaataaaattaagtacaaaatatcaaaatttgtaggatacaattagagcaatgctaagaaacaaatttgaaacactaaatttttactgtgatggtttattttttgtgtcaacttgactaggataagggatgccagatagctcgtaaaatattatttctgggcatgtttgtgagggtgtttccagaagagattaccaattttatcagcaaattgaaagagaatgccacctttactaatgtggatggtcatcacgcagtccattgagggcctgaagagtacaacaaggtggagaaagagtgaattcactctcttcacttgaactaaaacatctatcttctcttgatcagttgaaaaatttatctctcagatgcattcaattgaataatttatccctggatatttgtactaaaacctgttaaaaccaagagtctatacatcatattagttaacaggaagttgttctgatatatacagtaaaaggaaatggaaagcattattttcaaatcaatcacacaacataaattcgatcaaatatgagtctatcatattatgatgaactctgatggtcttgcaattgcttttatattttttccaataggacttgatatttggggtatgcacatcaagaggtgaaatgaaatggaagctgggatcattatgtatagactgatcatgttagaaacaaatgagagactgaatgttactatgggaaacccataagtcagattaaatgggagagccaggttgaactatgcatcacaaaataagcagcaaagttgggcagaatggtcaaataaccaacagctagctgacgggtagtatttatgataccaaaaccccatatttccctctccagaacatgaccatgataatagttgagtttgtggctaaaacaatacttgtcaatttgtaagtaaggacctggaccaccaatctgtatcagatgtagttcaaaataatacttgcatactttgctatagaaattgtagatgtcaactatagtatgggttgaaattccagtaatagcaatagccattttgtgtgtgactttcattcaccataagaatagatgatgaagccacattttcagggagacattgaattttgtgaaaaagattcctttcaaagagagacccacgacaattgtcaatttcagagagtacatttcctaaatagccatctttgcactgatatcataccatgtaccataaaggttagtgacaaaaagaacattcaggagccacatataacaaattaaaaacactaaaaagttttgaatttgacccacaagggttgatcacaattgattaatttgatgcaccacaattgaggaatttgattcacagggacaaattgttcaaatcatcttcttctcctgccttcggactcctggtgctcttggttctcaagcctttgcacttggacaggaacctacaccatcagcctttgtggtttttaagctctttcaactccaatcggatcttataccattggctcctcctggttctcaggcctatgggtttgggttgcaatgacaacactggttttcctgggcctccaccttgcagagagaagatagtgggacttctcagcctccataattgtgtgagccaatacctcacagtaaatctctttttgtattgattctgtttctttggaaatccctaagtaacacagttacattagaacagagatctcataactataatctatttttgcctcaggaaatgagttaaaaagagcaaaataaacccaagcagacaaaagtaaggaaataataaagataaaagcagaaataaatgacattgaaacagaaaaacaataaagaagatgatacaaaaaactcattcttcaaataaaatcaatcaatacaactgataaatcttcagcaagactgataaaaataaaaagagagaaaacacattattagtatcaggcactaagcagggatattataaaatatctggcaactattaaagagataagggaggccgggtgtggtggctcacgcctgtaatcccagcactttgggaggccgaggtggacggatcacgaggtcaggagatcgagaccatcctggctaacacagtgaaaccccgtctctactaaaaatacaaaaaaattagccgagcgtggttgcaggctcctgtagtctcagctacttgggaggctgagggaggagaatggcctgaaccctggaggcggagcttgcagtgagccgagatcccgccactgcactccagcctgggcgacagagcgagactccgtctcaaaaaaaaaaaaaaaaaaaacagagataaaggaataccatgaacaactttacactcatcaacttaactctttagaagaaatgaacaaattattcaaaaactaaacactagcagaaatcagccaggtgaaagagataaaagaaagagtcctataaccattaaataaattgaattcataattagaatatctccatcccccaacattcaggcccagacgttctggagaattttaccaaacatttaagaatttacaccaattttacataatctcttaaaaggcaaaaagattaggaggtaatacttctcgagttattttatggggtcaatactatcctgatagtaaaagcaagtaaagatagcacaaaagtctaaaaccacaggccaatatctctcaggaacatagacacaacaatcctcaacaaaatattagaaatcacatccaagaatggatgcttaaaagtatatattatgatcaaatgagattattgcagttattcaagcctgaatcaacatttgaaaacggatcaatgtaatttatcatatcaatatgctaaagaagaacaatcataggatcataaattgacacagaaaaaccatttttaacaaattcaacaaccattcatgcaaaaagtcaacaaacaaggaagagatgaatttcttaaacctcataatttcaaaaaccctacagctgacatcatagctaatgatgaaaaactgcacattttcctgtaagattgtgaataaggcaaaaatacctactctcagcatgcctattgaacatagtactgaaagttctagcctctccaataggcaggaaaataatttaaaaacacgcagattgactagtcatttagcattaggtatatctcctaatgctgtccctctcccctccccccaccccacaacagtccccagagtgtgatgttccccttcctgtgtccatgtgttctcattgttcaattcccacctatgagtgagaacatgcggtgtttggttttttgtccttgcgatagtttgctgagaatgatggtctccagtttcatccatgtccctacaaaggacatgaactcttcattttttatggctgcatagtattccatggtgtatatgtgccacattttcttaatctagtctattgttgttggacatttgggttggttccaagactttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgacttctacaatggttgaactagtttaccaacatggcacatgtatacatatgtaacaaacccgcacattgtgcacatgtaccctaaaacttaaagtagaataataataataaaaaacatgcagattgaaaaggcagaaataaacttgtctttatttgcaaatatcaaaattatcaacactaaaaaccctaagaaatctaccaaaaatctcataaatactgagttcagcaaatcacaggacacatacaaatcaacaactgaaatgaatcacatttctttaatttctaaaattaaaaacacaatacagtagtatttataactactccaaagataatgaaatatataggtatacacttggcaaaacatgtcccaggactttgtgctgaaaattccagaatgctgttggaagaaatgaaaaagacctaaataaatagaaatacacagcatttatgaaagagaaaactcaacatattaatcatgccagttgtctacaaattgatctatgtatttgatgctattcctatcaaaatctcagcaagaattgtatagatgtagagaagcttattctaaaatatatatggaaaggaaagatctataaatagccaaaacagtttgaaaaagaacaaaatgaatgattaactcttcccagtgttaatgggaaattataccaattttatataacattccctttaacattgggaagagttaatcatttgttttgttctttttcaaattgttttggctatttataactcttcctaatgaggagagtatgttactggaataggtataaacacagataaattggagcaaattacagaatctaaaaatatactgacatcaagatgcccagttaaattttgactaaggagcaaaagttatttaatgaagtaagaatagcatttttaataagtggtactgaaacaattgaacactgataggaaaataaaatgaacttcggtttaaaccttctatcttaaaattatctcaaagtggaccaaacacttaaatgttaaatttaaaagtataaaaaatgtaggataaaatgggaaaatcttttggatctaggattgggcagagtttttagacttaacattaaaagtgtaatcaattaaaagaaactttcataaattgcacctcaaaatagaaaaagaaaagaatactttattttgcaaaagatccagttaaaagtttagggcattgccctactggcttttacctgggttattcataatcagagatacaatttgtttaggtaatgcaacccttttttggtagatttccccagcatatatttctaatgtttgaaccaataaatgctatcacttgggtattttcagtgcataaattttacacaaggttatttagagcagcatgaaataccatagtacagtttgagatagccaatatgttttagtttcatcaggagagtttgttttaaataaatgatttctactcagaatcaatgtgcacaaattttaataatattaattgtgttacaacaactaataacttctttttgtttaatagtcaggtagaatatagaattcattataggcttgtaccaaaataactgaatttcttggatattactttataccctgtaagtaggtattcatatatttttgttttaaattattgcagtgtacatggaatactatgcagccataaagaagaataggaccatgtattttgcagggacatgaatggagctggaggccattatccttagcaaactaacacaggaacagacgaccaaataccatatgttctcactaaaaagtgggaactaaatgggaacacatggatacatagaggggaacaacacacactgacgcttattggagggtagaaggtggaggggggatcgggataaataactaaggagtagtaggtttaatacctgcgtaatgaaataatttatacaacaaaccaatatttattggcagtaaatagataattatatggccatattttaaaattttcttagcaactttagtaaatactccatttaatgttcagaaacatgctacaaatttgtgacactgtctttttggttttcatccaaaatctaatgcattcacacattcttatcagtgtgtgatggactgaatgttcctgtaccacaaaattcatatgctgaaaccctaatcatgctgaaaccctaatcttgctgaaaccctaatcttcaatgtggtgttatttggagatggagctttggggaagtaatgatgtcattagggtggagtcctcgtgatgggattagtgacctgataggaagagaggggaagagaacttgcttcctctttctgctcttggccaggtgaggatatatggagaagaggactgtctgcaaaccaggaagaggggcctccccaagtatggcatctgtgggctgcttggtcttagacgtcccaactttcagaactgtgagaaacaaatatttgttatttaagccacccagtctgtggtaatttgttatagcagcccaagcagactataacatagtgtgatattttaaaaacacgttttatggaatatataagcaaatcttcagtaataactatgtaatgatttttaaatgtctgtcctatattaaaatttttcaactttcatatatatcaaattctgtagatttaagtaaatagaaatgagcattaaatataaaagtatatgtaattctgtctgactggaatcacagacacacagacatttaaaatgttacttccaatagcattagcttcctgatctatatgaatttaggactatttgtagacttacagtaaacttaaaattatcctaaatgaaagtgattggcataggataaatacttaaacacgttaattgccttccctttagaaaacagagagatatatattcaccctcacacagacaaacacacatcagcaaagaaaaccaatgtctccacatagatgtttttgcttcccagacccaaaacatctggaggtgaaatgattgacattgaaatgtaacaattcctttaagggagaaaaagctttgggaatggtgttttttcacactaaaagagatattatatacacttactgtaatcagggttgcaaaattaagaatatgattatattagtttcctatttctgctgtaacaagttagcacagagcagtttaaaacaacacaaatgtttactttcctacagttccggagttaagtctgaagtaagtgttacaaggctaaaatcaagatctcagcaggagtgattgcttctggaggctccagaggatagcacctgtcctcaccttgtccagcttctagaggcagattgtggccccttcctatatcttcaagccagctacgtagcatttttttttctctttaaccaactgctttgttttataaataccttgtgattatattggagccatgcaggaagccaagatgatctcccagttccaagatctttaagataatcgcattagcaaatcccttttgccatatagagtagcatattgactggttttagagattggaatgtggacatatttggggacgcattatttagtctttcacagttataacagagcttttttttttttttttttttttttttttgatgaagtcttgctctgtcgcccaggctggagggcagtggcatgatctcggctcatagcaacctctgcctcccgggttcaaacaattctcccgcctcagcctcctgagtagctgggattacaggcacgcgccaccatgcctggctaatttttctatttttagtagagacagggtttcaccatgttggtcaggctggtcttgaactcccaacctcgtgatttgcccccccaggcctcccaaagtgccgggattacaggcgtgagccactgtgcccagccaataacagagcttttttttttttcttcactatataatttgaagcaaaatgccccagtaatacatgaagaagctgcaggcattcagtgttctttcagtatcctttaagaaagatgaatagtcttttccctacatatactgacttcacaacaaacttattcattttttgagatgcaaattacttcaatgtttcatattgatctaaattagctccctccttgtttctaatttttgattagcagctggtagcaatgaaagcagagtagagcaggggtgtgtaagggtatgtgtgtgtgtgtgtgtgtgtgtgtgtgtgtgtgtaaaagcaaatgctgtcacttacagcaatgatagaagatacctttgtggaattcaagaatctgtgcatcttcattaatgctttctgtgtcagctaaacgtattcgccatcaactttaaagcagcctattttaggatgtcatctgttggcttcatagggaggttttagccaaattccccactttaatgatttttcgcttcccaggtcatcttactaatattgtgatacaccacaaaaattatagcatttctcgatataattcaatataataggatcactgtaatgctacaaagcccaggcattttcatttctcatgctttccccttggaatcatgttaagaggctagattataggcttttgaaattgcaattttgccatttgggaggtaaaagtaattggatgaactatagcaagagataacatattaaaaatttcattaccatactgtttcaactaatctctcttctgaataaaggagcatacatctctttctgattctttttaggtccctaaatgtggaggtcaaatatcaagtttaaagaaagtgaaaaacagcattatgtatttttcctagtctatataaaataacagaccaatttttttcttcactgccatcaaatatattttatagacaaatcttttaataaacctcaaatatcaaataaaatgttttcacatcataatttaaataataaaatttattaatagatgtgtttataagtgcttctgatttctgatcattattcttcatcaggcatttaggcattcaatttatgaggtttcctttaatctcagatgaaactaactctgtttttcgtgtctctgtctttattgttgatatgtcacatttgaggccatcactgaagctccttgttttctgtatcctctctgagggctcactgttgcttttatcccctcctacaatttcccccacagaatacctgctgatattcattcatttttttttcagtttttgtaaccacttatttagcaattgaaattgcctgtttactgttctttcaatatcagcctcatttatctgattattcctctgaaacttgaagaggttgtgagggtctagtgtgacatgttacaaggagcttgatctgggtgtatgtagctcttcatgctgttcctcagaataagtagcatagaggcccaaactagcttcaattcccaatgaggaattatgagtcagtcatggactggagtcctgggtcaggcgaaccagtccaagtaaaaagggccaagaaccaaatgcaaaaagattctgaattgtgaaagccagtgtgcaggaaagtgcagcacaaataaccagaatgctcaaaaattccttagattaaaagtgtaaagctgcagacatatctttttgggaaccaccattaagccctctatgatgcgggaaattcattaataaaaataatttattaatgcaaaagaagggaagaaatgagaagatgtggaacataaaagagtttagacaaatagaaaattatagtaaaatgacagatacaaagagatcagtaatccatcaaatgctagtggaactaatgtagaactaacacattaaaggtaaatgtggtgatgctggcttaaaaatatttctagttatgaaaccactttaattaaaatgaaagctaaaatgttagaaaggttatataaatttcaccactatataaatggtttcaccatttaacatgcctctgcagctttacaattttaatgggtattaagtgagtgtcagggtaggtttaggaaggaaggaggtccataggagtgcagtctcctgagtatatgctacacagcacaaccctagacccagggccattttttttcaaagcactacttcatcatttagtgctattgcattgttcagaaatcttacttggagaattaaatttaatgctagtcttgcacttgaaaatctttacaacatggctacaaaccatttcccaaaatgatgtcactatgctcaccagtgtaaacctttgtgacagcaaactcttcaatcacctttttttcaaagcagtccttacactttcttacttgttttaaactaatcttctaccacattttcttctctcagtcctcttctgccaatttatctctgattcattcatcctgatggttcaaatctcacctttataaagcatttctggatataattcaatataataggatctctgtatatggaatatatccattccttggtgatgtctgtttcttaggaaacaggcattccttaatcattcatttttttcaatataaaatatttattgaatgcccacagtgtcccaggtaactccatcaattactgggggtccgctggtgctttgatagaaaatgaagtcatatatcctaatagattaaaggaggatatctttcttaagtcgtggaatttatataacttttctaacattatagcttctgttttaattaaagtggtttcacaactagaaatatttttaaaccagcatcatcacatttacgtttaattttactattagctcctctaacatttgatgaattactgatctatttgcacctgtcattttactatgtattttctatttgtctgaaatgttttatggtccacatcctctcatttcttcccttattctgtattaataaattatttttattaatgtatttcccccattgtagacggcttactgtgggtccccaaaaagatgtgtctacctgctaatccctgaaaactgtgaatagttccttatctagaaaaggttttttgcagatctaattaagtatggaacttgagatgaggagattatcctacttatcaggtaggtcctgaatgtcatctcaagtgtccttataaaagagagacacagggagattaaacaagcacgtacaaaggagaaggtaacgtgaagacagagcaggagagatgtggccacaagacaaggagcgttgacagccgccagcaaatgaacaagacaaggaacaggttcttcctcagagtttccagagaggatatggccctttcaactcctggatttcagacttctggcctttaggactgtgaaagaataaatctttgctgttttaagacatcaaatttgccataatttgttatagcagccataaaaacttacatacccataaattgacttttaattgtattctttcatttcatagttattctagaaattgcaacacccattttaaactctttaacttattaaaatctaatatttctgtagctttgtgattttcttggaaatgctctgacctagaaatatttttctactgtgttttatttttatgttattttgtcaggctttttgaattctacatgtttttgactccacaaactactattaatattatttttgttttagtgaaaaagctcttcaaaaaaggcagatcatttatttgatgttaccttctttctggaattttggtactaattaagaagcattttgtaagtatagttgatatttttatctcccacagatgaatttattttacagtgttttattaacccataaagaatctgaagtcaaggaaaaataggttagtacagcttggttatattgtagtctactaagatttagctacattcataactgaaaaatagattgaaattatgtaatttcctgattttaattgttaagaagcaaaacaaaaccattcaacggctacataaatcgatataatttttaggagtctactgtgttccataacctatgcttggtactgggtggcaaacattataggaataactagctaagtgagcaacaattcttccttaaggtagatattaataaaagtggtccaattctaactcaccaagtatcatacccgtgattcattatatttgtaataagaattcattcaatgttagaatcaaaagccttagtagctttttgtattatcagaatgtttttattcctgtatcttttagtggtctacatagttttagttacagtttagtgctataggatttcttaaaaccctaactaaagatcaaaggctagctctagcaacccactattaaattatctacaatcatcacacatatataaactaatttacttgttatgtttttatgttctcatttgaaaatatggccaactctcttattgtttaaaggtatattgttttatgtgtttgaatttcttctatatacaattaacacattacatgatggtaattatgtagaatagagtgaaaaactggacatagaaagaattctttattcaatcacattttaattcaaaactcagctctgcctctgcccctcagtttgattttgacttacatattagaatgccctaagcctcagtttcttcacaggaaaaaatgaagacaacggataacataagattgttgcagggatggaggatgatggatatataaagtgaatcatataggacgtggttgcagtaaagcatgtaaagataatatttgtgtttcaataatttaaggaaggtgatatcacacacacccacacatacacacacacacacaaacactccttctgtttctcttaggcttattttggctacaagttccaaatattacatatgaattttcttattgttatataataattgtacatatttatggggcacacgtgatattttgatacacatacattgtgtaataatcaaaccagagtaattcagatagccaccatctcaaacatttatcctttacttgtgttgaaaatatgccaaatcttctcttctagctatttaaaaatatacaataaattattaagaactatattcatactactgtgctattgaacactagaaattattccttctatctaagtgtatttttgtgtccattaaccaatctctctctatcccccttcccccatagttcccagcctgtggtaaccatcattctattctctatctccatgagtcagtgtttttctaagccttcacatatgtgtgaatgatatatgtgtttatgttcctagctcattttacttaacatattgtcatccaggcacatatatgttgccaaaatgaaaagatttcgttattttttatggctgaatgatgttttattgtgtgtatatataccacactttctgtatctcttcattgactgagggacacttaggttgattccatatcttgagtactgtgaatagctctgtaataaatatgggagtgtagatagctctttgatatactgatttctgttcttttttggtatatatccagcagtaggattactgaatcatatggcagttcttttttaggtttttacatactctttacattcccacaaatagtgtatgaaaattcccctccttccacatccttactagcttctgtcactttttgtctgtttgataatggccattgttactggggtgacatgatatcttattgcagtttcgatttgcatttctatgattattggtaatgttgatcatttttttatatacctgcttctcatttgtatgtcttcttttgagaaatgtctatggggatcatttacccattttaaaattgtattatttgtttttgtttttgtttgttttttgcttctgaattggttgagctccttatatgtcttggttaagcccttgttgaattgatagtttgcggattttttttcccattctgtaggttgtcttctcctctgttgattgttttctttgctgtgcagaaactttttagcttgatgtaataccatctatctatttctgcttttgtgacctgtgctttttaggtcttaccccaaaaattctttgcccacaccaatgtcctgaagcattctccctgttttcttctagtagtttcatagttttgtgtcttacatttaagtatttaatccattttgagttgacttttgtatatggtgagagacaggggtctagtttcattcttctgcatgtgcatatccagttttccagtcccatttattgaagagactgtcttttccccaatgtatgttcttggcaactttgtctgaaatgagtcggctctaaatacaaaaacttatttctgtgttatcttttctgttccattggtctctattctgttccactggtctgtgtgtctatttttatgccatgctgttttggttactgtagttttgtagtatattttgaggtcaagtagtgtgatgcctcaagctttgttctttatgctcaggattgctttggctatttggagtcttttgtggttccatacaaacttcaggagagtttttcctatttctggaagaatttcattgatattttggtaatgattgcattaaatctgtagatcacgttgaggaatattgacattttaacaatattaattctgctagactttgaacataaattatcccccccttttttgtgtccttgtcaatttatttcatcaggggtttatagttttttttttgcttttttgttttttgttttttgctttttttttgagacagagactcgctttttcacccagactggagtgcagtggcatgatctcagctcactgcaagctccacctcccgggttcacatcattctcctgcctcagcctcccaggtagctgggactacaggcacccgccaccacacctgactaattttttttgtatttttagtagagacaggtttcactgtgttagccaggatgtctcgatctcctgacttcatgatctgcccacctcagcctcccaaagtgctgggattacaggcgtgagccatcaagcccagcccatcaggggtttatattttttattgtagagaaatttcatttctttggttacttttatttctagatatttggtaactattgtaaaatgaactgtttgattttttttcaggtaaatcgaaactgacttatagaaatgctactgatttttgtacattgagtttgtatcctgtaactaaactgaatttgcttatctattctaacagttttttttttaaagtaaagtctatgtttttctaagtgtaagatcatttcttctccaaacaaggacaacttaacttcttcctttcccatgtgcatgtcctttatttattcctttttcctgattgctctagctgactcccagtatatgtaaaacaaaagtgatgaaagtgggcatccctgtcttctcctagatcttagaggaaaggcttccagttcttccccatgtagtatgatgttcgctgtgggtttgtcatgcgtggttggtatggttaggctttgtgtccccacccaaatttcatctagaattgtaattcctaggtgttgagggaagaacctggtgggaggtgattggatcacgggggtggttcccccatgctgttctcatgaaagtgagttctcatgagatctgatgcttttataagtgtttggcaagttcctctgctcactcttctcttgcctgccgccatgtaagatatgcctgcttctccttctaccatgattgtaagtttcctaaggccttcccagccatgccaaactgtgagtcaattaaatctctttcctttataaattacccagtcttggctattttttatagcagtgtgagaatggactaatacaatgctctctattgttttgtgtgaagttctttctatacagagtttgttgagagtttttaattatgaagcaatggggacttttaccaaatgctttttctgcatctattaagatgagtataaggttttttcctttactctttcgatgcagtgtatgatatttactgttttgcttatgttgaaccaaccatgcatccctgagataaatcccacttgatcatggtgtattatctttttgatctgttgttagatttggtttgctagtatattttaaaggatgtttgcatttatggtcatcagggatgttggcctatagtgttttcaatttttgttttatctttgtctgattttggcttgtgggtaatacttgcatgatagaatgaatcaggaagaattccttcctcttgaaattttttaaatagtttgagaagaactgatattagttcttctttaaaggtttagtggaattcagcagcaaagccattcagtgctgggcttttctttgttgagaggctttttattacagatttaatcctactagttactactggtctgtttaagttttctatttcttggtggttcaatattagtaggttatattccaggaatttgcccatttcctctaggttttccaattcatttgtgtatagatattcataagagtctctagtgatcatttgtatctctgtagtattagatctaatgtcttttttgtttctgattttagttgtttggggattatctgtttttttcttaatctagctaatagttaatttcattttcttttcaaaaacccatcttttcattttgtggatcttttttttattttggagactctatttcatttagttcttctccactctttattatttattttcttctgctaatttcaggtttggtttcttcttgcttttctagttccttgatgtgcatagttaagttgtttatttggagtctttctactgttttgatgtaggcatttattgttccaaacttacctcttagtactgcttttgctgcatcccataaattttaatatgttttgtttccatttttcatttgtttcatgaaatttttaaattttctttttaattttttcattgacccagtgttcattcaggagcatgttatgtagtttccatgtattagtacagtttccaatgtacttcttattaccaatttctagttattcccttgtggtcagaaaaagtacttgacataatttctactttttttatttgttgagactagttgtatggctcaacatgtggtctatgctggagaatgtttcatatgctgatgagaatgcgtattctgcagcttttggataaaatgttctgcaaatgtctgttagttctatttggcctacagtgtagtttaagtttttttttttttttaatttgtctaaataatatgtccaatgctgaaagtggggtgttaaagttgccacttttttgtgatctatctctctctttatctctaatgatatttgctttagatacctgggcactttaccgtttggtgcatacatatttctaattgttagaaattgctgaatatattcctttatcattatataatgaccttatttgcatcttttaaaaatgatttttaacttaaagtctactttgtatgatataagcataggtacttctgtatgcttttgttttccatttgcatggattatcttttcccacccttcactttcaggctatgtgtgcctttagagtgaagtgagtttctgtaggcagcatacagttcagtcttgtctttttaaaatttatttaaatagtctaaatctttcaattgagaaatttaaactgtttacattctaggttgttactgatagataagaagatactcctgtcattttgtaaattgttttctgattattttgcatatcttttcttcctttcttctcttattgcttatctttgtggcttggtggcattctgtagtgataacatttgattcctttctctttctcatttgtgcatctgctcttttgtgagttacacacttcagtgtattttcctgatggttaatattatcctgctgcatccaggtataggactcccttaagcatttattttaaggccagtccattttttgacaaatctccattttgtttgtttgggaaagacttattttttttttttttttaaatttctgaagtatagctttgctggaaatagtattcttgactgatagttttgttgtttcagagtttgaacatatcattccattctctcctgacctgtgagtttttggctgagaaatctgctgttagtcttatgggaattccatgtgacttcacactttatctatttttagaagtctttctttgcctttgactttggatggtttgactaaaatgtgccttggggaggatactttttgttgtaggatctataatatttggggatctttgagctttctttatctggatgtcaatattttttgtagaacttgggaagtttttagttattatttaattgaatagattttctatgcctctttttcatcttttctccttctggagctcccaaaaatcatatatttgtttgtttgatgttattccatatgacatgtaggctttcttccttctttcttattcttttttcctattttttgtctgactgtgttatttcaaaagaatatatttatatattcaagttcaggaattctttcttctacttggtttagtatattattaaaggtcttgattttttaaaaaataattcattgaattctctagttccagaatgtgtgtttggttcttttaaatgatatctatatttctgttgagttattcctcagatgatgaattttttttcttatttatttgtattatttatctgtgattttctgtatctcactagtttccttaaggttattattttgagttccttttcaggtgtcctacatattttcttttcttgggacctgttactaaagagctattgtgatcctttggagttgtcttgtttccttgttttttcatgtttcttgtattctaatgttgatgtctgtacatctgatgtagctgtcccttcttctagttttatggagtagtttccatatgaaaagtgttgttcctgtatccattctgttagttgggtagggtgctttggtttcgattctagatgaacatttcagtgtagtctctatatgattacttctgctataatcaatgtcattggtgtctgcaagttactaagtggcttaggctgtgactgcttttggaggctgtaatgagggtttgctggggattggggaatgtagcaggatagtcctcaggcaccaaggtgatgtgaagggggcatcagcactggtgacttcttgccctggatgggccagtctttaggtcctagtggggtccatgggtaccagtggtggcaatggcagatcagtcttcagccacctaagaaggtcacatgagtgccaattgtgtccacagtaggggaggcatcctagtccctaggcctctgaatggggcacatggcattagcagtgttcacagtggggtgaatgggccagttcctagaactctaaatggggtgcgtggatgctagaggtgttcacaatgaggcagatgtgccatttcattggcacatggcatggatagcctggtaccagtggtgtctgcagtggtatgtgtgagtgggtctccaggcctctgggtggggcaaacgagtcctgatggtgtccgtggtgtctcttagacttttaagataagcttgtgggctagtcaacttggagaatggaaatgacaaagtttagtagttttaggactatttcttgcactttgaattatgtaagaaaagggaaatataagcatatttagattactatgtgttcacattgagtataacccatataatgacccagataaacataaactgatatttatatctatctatctatctatctatctatctatctatctattgtgtatatatatataaatttaattcactggtggaatcagtgggaatatctctcagtgtcttgctgatgattttaacctacaatgacatttccccctctggtatgaacatataatattcaggttgggttatgttggtaatctctgtgaatattatagtgttattaattttacacctttatttattatatggcctaatatcatgatacagagaaccactgttgacaaataacccaataccaaatatgaaaaataaaattgatatgcaaaattaccattgctggttccatctaaacaaatttatttcttttgaaattattgttatgagttatataattaataaaaaggtgagttactattttgatttataagcatcctattcttaaagctgattacaataatcatgcagaaatggaaacagatgcttagaatttagcattatttcctaatttactctatgatttattataatctcctaactattccacacagctagtgaataggatgactttctagagaaaatggctttatttaagacctagtattggaaaatatatttatttcaacaacaatggttagacatttacataaaaggcagcttctgggttcttatgtcatttaagagataaagagaactggatagtatttctccctccttcacaataagaaaaaacagttttttaaaacatcttaaaaattgattacttttaccataagacaatgaatgttgtagggcaaaaaaagtaaatccagagtgacaaatgtgctctaaggaaggaacaagatccaggaatttgtttacctgaggcataagatgctgaatgtcatttgagttgatatgcggagtcaattagaagtttttcactaattactaatgtctgagtgtagttaagcatgaaaattggaagccacaacaagacactggcaaatgttaggtttgcaccctcttacaagattttcctctagcaaccacaccaggtactcacagggaatactgttgagaatactgagaaagcctccctcatggtgctggctgggcagtgagtgacactgcccagcccagtgtcagtctcatcttcggcctagtctcatcttctccacctctgctaatgaaaacaagccctcacaggcaaagcagaagtcatcaaaacctgtggcctgagggcacatatggaaatccccagcaactctgggaagaaaacaagaagaaaatattacttcttagggaagtggagaatatttagcccattattttgtctggaggtggggcagggatatctatgaaggctttaacctggtactcatttttgtagtacctgcctaggactacaactcaaagaaaacttcagagaatgactccccctcatttcctcccaaacaaaatactttcaagatacctgtgaaaataacaatgggatatagctggaagagcagcaagagagaaataatcctttcttgtgagcagcacaaagtggagatctaaagtcagtgggggaacaaagtccgtcaggaaacatttatacagaaaaaagcctttggtaaattagtcaatgctatgaacataggttatcactagaggaagttgaaggttttggtgtgctgaggtaacaacaccaacaacaagtgtcgacccatttcaactctcaactagattaagcataaaaaataaggcctagcaacaggtaaggtatattcattttcaagcataaaaaagcataagtccgtagtatctactgtcctatacaacaggactaccttttaaaaacaaagcctgcagagaaaacataatcatcaaaaccagtctcaaatattatacatatgttaagactacaataattaaaaataactataattaatattttaaaggctaatggaaaatgtagaaaatatggaagattagatagaaatttagcagagagattgaaactataagaaaaaaattgaactactagaaattggaaatatcataacagatataaagaagcccatctttgacagtctcggtagtatgggcaaactttggagatattgtaggttcagttccagaccactacaataaagtgaatattgcaataaagttagtaacttttttttgtttcccagtgcatataaatgttatatttacactatactgtagtgtattaattatgcaatagcatatgtctaaaagggacactgtacatactttaatttgaaaatactttattgctaaaaatatactactgatcttttgagtcttaagcaagtcataatctttttgctaatggagggtcttgcctcaatgttgatggctgctgacagaatagggtggtagttactgaaggttggggtggctgtggcaatttgttaaaaaacaagacaacaataaactttgccacattgatttactcttgatttcatgaaagatttctctgtagtgcatgatgctgtttgataacattttacccagaatagaacttctttccaacctggagtcaatcatctcaaatcctgctgctgctttatcaattaagtttatgcaatattctaaattattccttgtcatttcaataatgttcacagcatcttcacagggaaaagatttcatctcaagaaatcactttctttgttcatccagaagaagaaattccttatccgttcaaggtttattatgagatttaatcaattcaatcacatcttcaggctccacttctaattcttgttatcttgctatttccaccacatctgtagttacttcttccactgaagtcttagactctttaacgtcacccatgaaggttggaatcaacttctaaactctggttagcattgatattttgacaaatgttcttaatgacatctaaaatgctgaatcttttctagaagattttcaattgactttgaaagaaatacatttcataaggctaaagccatccattgtgatcagaggaatcacaatggatggctgtagccttatgaaatgtatttcttacataacaggaattgaaagtcaaaattcctcattgatccttgggctgcagagtggatactgtgttaacaggctaaaaaacaaaattaatcttgtacatgtccatcacagctcttgggggactaagtgcgttgtcaatgaacactaatattttgatggaatttttttttctgagcagtaggtttcaacagtgggcttgaaatattaagtaaaacatgctataaatagaagtactgtcatccatgttgttttgttcctttgatagagcacagacagagtagatttagtatctataagggtcctaggattttcagaatagtaaatgagcactggattcaacttaagataagtaggtatgttagttcctatcaagtaactcatcctatccttgaaaggtttaagccaggcattgccatctcttctcgtgttttgaagttttagatggcatccttttctaatacaagggattttgtctacattaaaaatctgttgtttactgtagccaccttcatcagtgatcttagctaaatattctgggtaacttgctgtagattctgcatcagtacttgatgcttcaccttgtcttttcatgttatggaaatggcttctttctttgaatctcacgaataaacctttgctagcttcaaactgttcttctccatcttcctcacctctctcagccttcacagaattgaaaagagttagggtcttcttctggatttggctttggcttaagggaatgttgtggctgtttagatctatccagatgataaaaatattctccatgtcagcaataatgctgctggttttcttattacttatgtgttatttggagcagcactttaattttcgtcaagaacctttcctttgaattcacaatttggctatgtgtttggtgcaaaaggcctagcttttggttgatcttggctttcatcatgcctttcttatttagcttaatcatttctagctttcgatttaaagtgagagacatgtaggtcttccttttaccctcacactcagagaccattatagggttagtaattggcctcatttcaatattgtgtctcaggcaatagggaagcttgaagagaggaagagagacagggaaatggctgcttggtggagtagttagaacacacatttaccagttaagtttaccatctaatatggtttgtagtgccccaaaacaatcacaacagttacatgaaagatcactgatcacaggttgccataacagatataataataatgaaaaggtttgaaatattgcaagaattacaaaaatgtgacacagagatttgaactgagcacatacttttggaaaaatgatgctgatagacttgctcaatagatggttatcacaaatcttctatttgtaaaaaatgaaatattggcaaagtttaagaaagcaaagcctaataaaatgagatattcctgtaaaatcaacccagcctgaggaaaataatcagtggatttctagattggtcaatagagattgccacaaataaaatgtaaagagataaaagagtgggaaaaaagagagcagagtaacaaaaagctatgaggcaatatcatctggtctaacacatgtgtaattagaatatcaaagggagaagaaataatgagcagaagaaattttttaaaaatgtgcctaagaattttctgaaattagtgacagacaccaatccacagatccaaagagctgagagaacaacaagcaggacaaattccaaaaagacacatctacatatatcatattcaaactgttgaaagccaagcaagtgagcaaccaaagtaacacacacacacacacacacacacacacacacacacacacacgagagagagagagagagagagaatcttaaggtagctggtatgggggttatataatttataatagtacttaaaatgaaatgctttggtgtaactaaatataacagaatgtgtggagaatctgtatgctgaaaaggaaataaatctgatggaaaaaataaaagacaatctaaataaatggaaagctacacagggttaagtatttgaaacacttaatatttgagatgtcaattcttaccaaactgatttttatcccaacaaaaatcccaactaacttctgtaaatattgacaagcagattcaaaatgtatacggaaaggcaaaggaaccagattaaccaaacaatttttataaagaaaaaaattgtgagggggatctgacactactacattatagtactgttataaagctacagcattcaagactacaatattaatgaaaggatcaagtcataaatcaatggagcagaataaatatcttagaaatagacccacaaaatgtagccaactgatttttcacaaatatagaaatagaaaaggcatagtctttttagcaaatggtactgaagcaattgaacttccatatgcaaaataaataaatgacacctcggcagacacttcatgcctaatataaaaataaactcacaatggattatagacccaaatagaaacataaactataaaagttctaggagaaggaggattgcatgaccttagcaatgaattcttaggtatagtgcaaaagcatgagccatatgttttataaatacagtttttctatttatgtttgataaatagagtttatcaaaattaaaacattttgctcttcaaaatatattctaatgaaagtgaaaatacaaacaacagactggtagaaaatatttgcaaattacattagagataaagaacttgtatctagaaatgtagagaacatttaacaatcacaagaaaacaaactacctaactaagatgggaaaggtctcaaacattttgagaaagaaaataaacagatgacaatcaaaaccatattgagttacctctacacacatatcagaatggcgaaaacaaaacaaaacaaacatacaaaaattgataatagcaaatgcttgtgaggatgcaggaaacagaaactctccttcattgctgttgggactgcaaaatggtatgtacagccactttggaaactgacagtttcttacgacgttaaatatatattcaccgtgtgaaccaacaataccatgtttggtttttctttttgttttttgttttttgtttttgagacggagtctcacactgttgcccaggctggagtgcagtggtgcgatctcggctcactgcaagctccgcctcccgggttcacgccattctcctgcctcagcctccagagtagctgggactacaggcgcccaccaccacgcccggctacttttttgtatttttagtagagacggggtttcaccgtgttagccaggatggtctcgatctcctgaccttgtgatctgcctgcctcggcctcccaaattgctgggattacaagtgtgagccaccgcgcccggccccattgtttagtttttaacctaggtaaattagtaaaagtctgtgtgcacaaaacctgaaacctgtatgcaaatttttctaaaagctttataatcaccacaaagcaaaaataaccaggattccctttaacatatgagtagattaacatgctgcaaagtacctatacaaagaaacattactcagcactaaaaagaaactgttgattcatacaacaatatgaagaaatcttgatttcattttgccaaatgaaagcagcaagacccaaagggctgtatactgtataatttcatttacatgacattttgctaaatgagaaaaaaaaatcagttgttgatcaggacatttagttttgatcactggagagcacacaatggaaatttagaatgaggcaactgttttatatggttctgcagtgatgtacaaatgacactacgcatttttcaaaatttcagaaaccatacaaaatagtgcattaaatgtactcatattaaaataaaaactaagcttttggaaatccaaggatgaaatgaagactgtgccaaataaatctaagtacagggtttaatctcactgaagtgtgtgagagaaacaagaaagagctcacaataacgttgggaacaatgttttgactagaccataaaattaaaggcagaaagaactttacataagcactttattttagctggtaattttgatctcacagggtaaatttagccattctggaactacaactcctaaagttgtacaagtaagtaaacaaaatgtagacagttcactacatggaatggaatgggaaccaaattctttatatcgaaaaaggaaattacaaatgagcaagtgggagaggctagaatgaccactgtggccatgagttacaattggaaataaaagattgagttcttgtttcttttaatatgcataaatataagtaaatacagaaatacatataaacgtgtgcatatgtacatataactttctctctctttccagaaaaagtaaacaagcaatgatagttctatagcaatgagcaccactgttgtttatatcatggattctaaatatgattctgcaatcatatttagagaaatgactgatttctttggtcatatttggagaaaatatggggcttgggcaggaaaaatacaaatgattctggagcatcctctggtgctagaaagcaagcaagggctgataaatacataaacatacagataaatacatagggcatgtcaaagtgatccaagagttatcctgaaacctcaaaaaatctcccaagacaaccctagaacaacttgagtaacaaaataaacaatgtcattattgaattacatccattagatcaaataaacacgtgcccatactgttataaataatcaaataaattaattgatgaagaaagggaaaagcttctttacaaatggtgaatgtagaagaatggcagaaataacaagtcaacaggtctgaaaatatctccccaaaatatttattaagtactatggtagttgaaacatatgcctgtaaattctctgatactcctctctccatggtggagcttgagggtgggttagatttgttaagaagcttctaatgaatagagcaggaaaagagacaaaaggcagctttccagtggagaaatctatcagtcgctaacttagccatggtgtcaaagtaagccatctccaataacaaatcatgttgatatcaagtttccctgacatattagaaaaaggctttaaatgatattcttcacaaaatccatacctcagttgcactgtgagaaccacagaaacccatatcaagggccattctacaaaataccttccaaagtatattggtaatgaacaacaaggaaaaactgacaaactgtcacaaactggaggaaactaaggggatacgatgacttagtaatgtggtaacctggactggatcctggaaatgaaaaaaaaattaggggaaaatacaggcaaatcctaatgaagtctgtaacttagttaatagtattataccaatggtaattttttacttttaataaatgtatcatggttattcaagatgttaacattaggggaagctagatgaagcatatatgaaaactctacaagctttgcaactcttctttaaggatttaatcattaaaaaattaaaaataaatgaaaaaaacagctgcaacaatggtctatacgttgagaatttcaaaaagatgctgtttactttgggattcaagtaaaaacactatagttgttaaaccctagagtactcttgaaaaagacggttttgtacactttaaactgaaagagtataggaaaaataatttcactcttacagctaggaaacaaaagggaacaaatacaaatgggataattattgaagtttctgcaagggggaataaatcgctcaatgtcccttcattgcataaaggcaaagttctctaattattaaagaaaaaaacctcaacattttgattgataggccctgtgacatctgtcatacatcttgacattgttacctaacttctccctgggactgaataactatcaggtgccgggtaccgctaataaacctcaaacactttgcatgccccagtgcataactgtcgccctcagactcttaattgagaaacattctttcctcctttgtgacatcacatccactaaccaaatggggtggtgtgagtatctcctataaaataaaagctctcctgatggcctgttcctgcacatttcctgaggacgccctcgatcacaagcaggttatagctatttaaaccttgccttacctgtactctttacacaaattgaaggtcaaagaagtagtcatacttctgggcatagattaaactgattttgtaatactgtttaggctgaacctatcagtttcagactaaaccctccaaatatctgcccaaacttgccccataccctctaaaaccaaggcctaacaaagcactaaaatcaatagatgaaaacctaattgagaaatgaatcatgaaactttgtactattccttgtagtacttctctaaatttaaaaaaaagaaaaagaaaaaaaaacacagggcagtgatataaatttgttcagaatctcaggagtataaattgaataatgatctcccacttctctgtagtaacaaattcaaatattattttgtctttggtgcataatgaaattgcatattttacagctgtaaatctgttttctgttcctttagaatctgtttaattcagagtcatatgtttgctttcttctgagaaattcgataacgtacactggtaattatgacttagggcttattgagatattgtcttaatttttaaaagtctttaaccagggcctcaaggaacttacatttccctatattctaccatactttgtggcattctaaagtttagctgagctctaggactgactccatccatctaattacttgttttatctctaatagtctataaactttctgatggggactaaaattttttctcaaagtaaagtgtatcatctgaagcataatatatcccaaggaggtaaatttctcttttctgaaagatcataaccattcagaatttttctagttagtaaccaggagattttagagatgattctttgggtctcattcactatagccaacaatgggtttccaaatgtattcattttctgtggctagatattaaattagcacagagttaggcgcaaaaagcaacacacatttatcacaccacagtttctgtggatgaggagtttgggtaaggcttaactaggtcctttgttcagggtctcacaagccgaaatcaaggcattagccacgttgcagttctcttctggagctcaaagttctcttccaagctcattaatgttggtagaatttagttacttgtggttgtagcatcaaggtcctctccttttagaggctccccctctttactggcagctttcaatacagctgtttctctttaaggctagctagagattcttttgcttttatggctttcacctgattaagtcagtgcccatccagaataatgtcccttttgagtcaaagtcaactaattagagatctcagttacagcggcaaaaccctttcaccttttctgtgttacataatccaatcactcaagtgacatttatcatattcaaagatcctacttatattcaagggagagggttatacaagaacatgcacatctgggcattttaggagtcattttcttattctgtctgccacgttgactttcagaaattgacacaatactgtatcacttaaccaaatctttgttaatcaaatctcttatctgagaatttatgcatatataggcatttcatgctttaaaaattagcccttcaacaacctctcattatgagcctgcgtcatcatgaatcatgttacctattcatacataaaagatctgaacaagtcaaatatctcttccatctcaacaaaccagtatcatgcaactatttttctactaacccaatgtcaaaatcctactttcctaagctgaaagcagaagttgaaacttgatggaggcttctactaacagttttactttctaccttaaacttaatggttccctattttgccagtctttgctgcccattaaaagtatgcaatatttcctaagaaagtaggcttactttctaaaattgaattactttcttctttccatgtttctgttcatcactgtaatactttaaatactattaatcttcttccattagaagagggaagctcatggccccctaaccactgcttcctgaatatctagtaaatttattaaaacacgctaataaattaattaaagcatgcccagaaatccagatttaatcttgatttgtttgtaggtcatatcctaagaatgaaaccagaaaatatcaggcagaaaacactggaacaaattttaactcaccattttgacccctttccagaaatgaaaatattcttagataacataattgtttccattcccatagcttgctggatgaataaaggaaagaaggtttatatacactaataatagaaatgttttgggatggttcatgatttcgaaaagcttcagagaaaataaagatgcttaatgtaagtatctttgcagtaagataatgtaattatcttacattatccataatttagaatggttagcagattaaaagtattttaataactctaatggttcctaagaagttgactattatcaaggtggatatcagttcaaaaagggacatcatcaaagcaaaagaaaatgtcgattgatcattacaccaatgggtagttctcaccaagatctctaacccacaacactcagagactacatctttgaagaagttcaaagagaatattatactatgccagtctttggttctacagtaagaaaactagaataataagcacaatggaattgtcaccagaaagtataaacaagatgagtataaacaaaatttataaacaagatgtaaacaaacacgtttttaaaaacctgtatttatgaaaacagtcaatcaactcaaatgttacatacaatttttcaacaagagaaataaaagctataatatgaaaatcacctctggcccacttagagtggcttctggtggccccaagtgaagtcttcttaaaaaggcatgtgacattacgcacacatgtaggacaaactggcctctgtactcaaccaacatcagtgagaaaatgaatttcatttcctgttgctggactactctttatgcatggtgccaaagaattataatattatctgacaaacccatatgggcattttggccaaaaccagatcattgaatggtccccaacaaccaatttccagatggacgcacaaaagcctactgcctattatccaaaaagtgaacaggaatatgttaccatgttaaactgatatccaccttaaggatagtggctaacaatgtcaactcacatatattttgatccatcagtttcccgtctcagtaaaagattaatatgctttctttgtatgttttacataaattgaatcatttttaaaagctttactaaatatgtaatatatggaaggtgtattattaactgctacaggaaatacctgtgggaataagttgtgtgtgtgtgcacatgtatacacacatacatgtgtggttaaatttcaaaatttcttccaagctataggtaaattttcaaatgacttttattttcgtatgtagttcaaaatgtggaatgataagataaagaaatgatactttaggaagccagacttatcaggtattataacaattaatttaaagttcaaactcaattgaaatcactctattgagtctccaactactaaattagttaatgattctttttaacctttgggatcttggtttgatggaagtgaatataagtatcaaaattccttaaatatttccaatatgaagacaagtttaaatcatatataaaattcaaataaaggtctgtcaccaggaacattaataagcataatgtaactgtcactataaagtcttaataaacaagttgtaaacaaaatacaatttttaaaaactgtgttgatgacaatagcttatcaacttgaatgttacatacactctttcaacaagagaaaaaagctgagcaaactgaaatcaatgaattttattggacccattagagaactgaagtcatagagcaaatcatcatcctgaaatctggagacaggcaaatacagagggtcataactggagtctgcttatttggagcagaagtttccaaagccataaactggtagtaacatttataaggtaattcttctgaactgctgaagctttttgatgaggctgagtttcaatcagcacgagcataagaaactcagaggtaccatttatggaggcttccatactttggtgggtttttacttctaggaaccccaccaacttatcattgtgaagaggtaagagagagaccctcacggctgtgacagtgggtagagaaagttaccatttgaaatatttgaaaccatttttattttatttttataaaataaatatttttatcctaaaaaatatttattctgttagttattttatccccccactatcacattcttgtgataatcacatcttttaaatctgtaagcaatgttatcttttaatataatctttgaaatataatcttcgaaatctcacaaaaatttatattttataattcaccgtgaatagcaaagccaaaagaataacccactatttcctatactcaaacatgttacacatcaacccaaaagaaaaaagacacgaaaccaaaaccaaggaaacacatatgcttagttaggagttaaagttactcaagctctccaaataaaacatacaaattattagcattaattaattattattatttttttgagatgcagtctcactctgttgcctaggctggagtgcagtggtgcgatctcggctcactgcaacctccacttcccgagttcaggtgattctcctggctcagcctccccttgtaactgggattacaggtctgcgccaccacacctggctaatttttgtatttttagtatagacgggatttcaccatgttggccaggctgatctccaactcctgacatcctgatccacccacctcggactcccaaagtgctgggattacagtcatgagccaccgtgcttggcctaatttaatacaattataacttaaatggccactttgtcattgacaatgattgcttgagcacagggtgagtgccccataagctgttaggagctgtttcttcagatcaatgtctcctctctgcactgccagctcctacctgtgcatcatcccctatatactgtgcattatatgtatatatatatatatatatatatatatatatatatacacacacacatatatatctttaaaaaatattttccaccacacatacttcctttcattaatcagataacagggaagaacaacaacaaaatctgaacaagccgatcactttctctttgggatatgatttttttccttgtgcatgaagtattcagcaacaacataagaaagggaaaagaagaaccatttcttgtgtatactccctaaacacacaagcctagtccactgggtgggatataactgtatttatatgcctacctccaggcatggtcacttgatgtttcactactactggttgctgtgtctaagttctcacactctgcttgacaagtgcttctttaaggggataacaggctagaactgcagctctgcaagaagtcattcttcccaaggccacttcttctcagcttctctgtcttcatgaattctttgagctcaatcttctgtgagaagaaggcagttgtcttcattttcaggatagaagacactgttaagagaatgaacagagtagtcacagactgagggaaatatgcaaaaatacaaaagaaattactttattgtaaatcatacctaacactcaacaataatagtacagacaactcaattaaaaaatgagcaaaagatctgacagacatgtcatcaaagaacatgtacagatagcaaataagcataggaaaattttatcaaaacatttgtctttaggaaattgcaaattaagacaaaatgctgctacatacttgttaaagaggttaaaatttaaaaaattggacaataccaatatgtggtaaggatgcagtgcaacaggaactctcattcactgctagttttggaagacagcttgggagtttcttacaaagttagagatagtcttacctcaacatccagaaattatactcttgaatattaatgcaactgacttgaaaacttatgtctacacaaaaacctgcatgtcaatgtatatagcagctttattcataatcatcagaaagtgtaagtcacaagatagccttcagtatgctaatgaataaacaaactacgacatatcaatacaatggatactgtttagtgataaaaagaaatgaaccattaagcaatgaaaagacatggatgaacctgaagtgcataatagtaggtgaaaaaagccagtctgaaaaggctacatggtatatcatttcagttatatgagattttagaaaggcagtaaaaagaccattaaaagactattgtatgttaggagtctggagaagcataattctccacttcttccatgtgggctatgcaagttgacaccctttcaaaggctacagtgtggacaatggaaaaagtaactttacattagagaaatggacaaatctacctaagcccgatgatgaaggccaacattaactgtgacaaggaatgtcgatagcagttgccttgatatgataaaaggcactttccctttgtggccttccaaatatgtataaattattctaaccatcaaacactaattgagggacattcaacaaaataccttcccagtactcctcaagattgtcaaagtcattaaaaacaaggaaagggcaaaactgcaatagccaaagaagctgaaaaagacatgactaattgtgatgtggtgtcctggatgggaccttggaatcacaaacagacattagcaaaaaattaaggaaatctgacaaaaggcatggatttaataacgaggtgttaatattggttctttcattgtgaaacatgtattatataatgtaagatgtttctaataggagaaagtgggtatggagatacatgaaactctgtgctatctttgcattttttttttctgtaaattaaaacggttttaaaaaacaaagtttatattaaaaatatttaaaatgtcatgaccatctgcctcttgtcatatagccatgcctccatggctaagacatataggagtaattaaatggttcttttattaaagaaaggaagaaaggaaatatcttacaatgtgatagaggaagtcactttaaactatgcagttttccctttcagaaccgtccaattcaaatgttctctgacagaatttgtttacattattaattctgagagtcttgataactcttatacttgagccaaaattaaaatgccaggagaagtatccatttcaaagggaaaaggaagtggctacccacgtagtttcgtaaagacttgtgctcctgagaaacaaagaagtgaaccagacagaagataaaatgctagatgaaaattgatgataataattgcttgagaaggcttagaaaaatagaaaatcacagtgggcactttctgttttccttgcttgctgaaagacaaatagaaacaaagtatcaggtacagatgcttctgatatgggatcacacaataacaacactgcttcagacacactctaatgaaagtcagctttctttcaaatcattttaaaaaaaattgtatcctttatttcctattttgtgtaaaaaaaggagtatggatctttatacagatagagtgaagtggagatttgcaaaaccactgaagtattttaaagattgtaaaataatcataataacaattatgtattgaataagaatggtagtcactgccctaaatatttaacctggtttatcgtatttaacttcccaaaccactgtatgaggtagacattactattatcattcccattttacaaaagaaaaaaccgtatcgataacgcttcaaattgatgctcagaccacttccctgccttccggtcataagcacacaagtttacttagcctaaagaaacttctcctagttgtcaatatgattaaattatataaatattatttaattatctcaagttctgaaaataagatatatttaactatgaagatttaataaggcaaaagtataaggacagatgagttatgttttccattaaaatactagtttttaaactcagagtattgacactctaaaacaatgttaaaaacaagctgaccggggaggattgcttgaggctaggagttcgagaccagcttgggcagcataatgagactccatcttaataaatacattaaaaaccattagggagtgtcgtggtgcaagcctataatccctgctactcaggaggctgagccatgatcacaccactgctctccagcctaggtgacagagcaagaccatgtccaaaaaaaaaaaaaaaaatgaaacataacaacaaaacataacactgtttccccagtttcaatttctattatataaaaatcctcatttgcagttttacaatgctatctatatggctaccaccttttcattaaatagttctattgtctttatgaactctctctgacttgcatttggcatatattgagaactcttaaaattcagtaaaatatacaaaaaacaatacaaactaggcaaaatatttcagcagacattccaccgaagaatatacataaatgtcaaatatacttatcaaagatactcagtatcattagtcattagtgaaatgcaaattaaactcaactagataccacaacaaatctcttagagtggctaagaaatactcaaaataccaagtgctagcaagaatgcagacaaactggaacattcaaacacaggtgttaggaaatagtacagcccatttgaactatttgacagttcattatacactcgctatcaaaccagccactctacttttaggtgtttgcccaactaaaaacttatgtttacgcaaaaacctgcatatcaatatttatagtagcttacacctgttggtgcaatagtaattgtgtttttttttaaacagcattactttcaatggtaaaaactgcaattacttttgcaccaaactaatataaaacaatttggggagaactggcacctttactatgttgaatgttctaatctatctgtatttgattttaaaaaatttcccttattaacattttgtagttttcaccacgtcaattctgtacatgttttgttatattactatctaagtagtaaattttctttggaatgattgcaaatggtagttgagttttaatttcaatttctaaatattccttgtttgcatacaaattgtgattaagttttgtctgttgatcttgtaacctgcagccttggtgaactcacttattggttctaggagtattttataatatatttatagggctagtctacacaccacctgttatggcgaggtccctcttgctggttggtgcacagctacctgggtattcctggatgtgggagtggggtttcaggataagcctggtgggagagtgcttctactggcccctctatgtttactgggtcctgattgattcctcttgctggtggaatcttgcttggtattattggagggacatgcatttgatccaagggagacttaatcctttctgagccaccttcttttgctagattatgggctgggaaacacttggcctgtgtggccttcttctgtttggtgggggaatataagacaaactgccattataatttggctttcctccagtcctaggattccaaatcagtttgtcttcctcttccctgcttaaaacgttttccctaagggtatacaaaaaccttcattttctggattttacctgtaagggataattggaaggacagctgagttcaggcaagctgatttattatcagtcctgccgggctacctcctgataaaagcagaggaggcagccctgctttcagaccattgcatggctttacaaggcgaggaacagggtcagggtgggggagctgagatgggtgtgcaggtgtcttgaccgcatcctggagatgttttttgccagctttgttatgcaaggtgaacagacatgtcaaccgcatcctgtaactgactggttagttactggaggggtcagtgaaggggggtttgtctttagccctgggggagctgtgcggatgtcacaaacgactgcattgtaagacccatgggaagggagggggaacagtctggttggggtgaccctaacattacctatctctacaaattccctgtcatgtgcttaaaaaaaaaaaagacaccagccagagttgacaggcaaagacaattgcagagggaggcaagactattgcaataggggagagagactaaatttaactcccctgaaacaaaagatgggacagtttttaatgacaaagtactagagaactttgcagggaggttggtaaacatgattcggccatctgtgtttgctaatacgtgcttatctaagttaagctcctacatttctatagagactggatgaaggcactccatctttcttggtgtatacttttcaaaaggatgactctcaggacctggagaaagacattcctagtctgtaaaacttgcaagagaagatttacatctctaagctgcagcgaaagaatttacaattttaacttttctaaagtaactgctctaagaaaagagagatcaagggcctagagtcaggaagaaacttgtctgaagttgagtcaggttcaggggaacttctaaggctgccttggtcagtgccagatgacttaaaatttccggaatgccatctgctaatttgcactttcttgtttttgcacatgttggtttctctgtaaaatatcctctcctctttgttttcctgacagtttccttattttgtttcaataatctgttcaatctttacctcttctgtgaggtacactcctggttactccatatcagttgataaggcacattttgtaccacctttttgaagcataatgttgactttctttagaaagcatattctgatgctttcaaaaagacccagccacctctttttgatcactttgtaaaacataaaatgtctttttgttacaggacttttcattagttcagctcaagatgaggtccttatcacacagctacgaaaatttaggctagcggacgatttgaggagtgaaaaaaatggaaaaggggggaaacacagactctccacaaaggcagagtccctgctggtgcgcttcccgcctcgcagtttgaatcccaggttccacacaggaagaggaggggctaagctcctccctgctgcaaaacccacaggaacttcctgagtttccaccccagtgcccaaggccagctggagtttttatggggagtccttcccacttgtctgcctcatttttgtataggatttacataatttcattgtttatacatctctccttcactctatctctcacatctctctctcttttttttttttttcagttgagacagactctcactctgttgcccaggctggagtgcagtggcgcgatctcagctcactgcaatctctgtctcctgggttcaagcgattcttctgtctcaccctcccaaggaactgcaattacaggcgcatgctacgacacctggctaatttttgtttgttagtttgtttttgggacagagcctcagtctgtcgcccaggctggagtgcagtggcctgatctctgctcactgcaacctctgcctcccgggttcactccattctcctgcctcagcctcccgagtagctgggactacaggcgcctgccaccatgcccggctcattttttgtatttttagtagagacggggtttcaccatgttagccaggatggtctcgatctcctgacctcaagtaatctgcccacttcggcctcccaaagtgctgggattataggcgtgagccaccgctcccagcctctctcatatatatctatatatgaaactctatccccactcatgatgtaaagcttgaagctaagtaagcactcaaaaatactttaaattgaataattaaagcaattttcacattgtgttaaaattttaataatatgtctcttcattcttgtctctgagtaacttgagttcattcatcttgtgaaaaaggccctagcaccttgtctggcagctgcttactgattatttaatgaacaaatggatgagtaataataatttataaagcaaaattatttttccagaaaagtaacaattttgtatcaaaacttggaatgtcatattaaagtccttaaaaattaaatttacttaagaattaaaagcctcagattttatgtttaaaaggtaactatgtcttttttccttcaactattaattttgtttttcacaaatggccaactcttttttttaaatgactccttttctcctagaatcagaaattgtactttgaaaatatactctagatttaacaattcaaatagcccactaacactgacaattttgatgtaaaagaatgattttcttctgggaaattttatatttatgcatttaaatttctcttgattgtttttccatgtacttcagaaagctgtgaatttttttttcagccttccacttttgtgtgtagttatcaagttttagctcatcaaactgctgaatttaagctttatctgtctaattaatattcttcagcagttcacagtcttcatttctcatttcaggttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcaggtaaaacaaataagcagaggcacaaaatcatcaccaaaccagactcactgaaatgccaacactggcatgtgcgcagacattttctattctggacttacttctaaacagcaatgccaacaagcatgagaggtgaaaaaatgtggataaatacatgtttggtttattgaactaggtcttatcatatccaaattaaaaacaaaaggcacatctcaatttcaaaataaggttctgaattttaattctcagattcattgaatttctttttgattcaaaattcaaactcttctatcgaatatatcctttagataaattgtctcccaaactcagcagcagattctccctttttcttgtagccacatgaatctatatattttcccgaccagagtctccatatatattgttgatagaaacataactttctattaacaaaaattgtttatgcatatctactaatttcttacattgtatttccaccaaccaaacataaccaagatcacacatatattcaatcttacactgagaataccttaaaagctaatattttaaactttgtaattaattctgtttgtctctattttcatttaaaaaaaatctctctcgttagtacctaccataatttatacccagtctctctctctctgtcacacacacacacacacacaagcacacatacacacagtgagagggagagtgggagagactgttttgaatgttttggttaattaactataatgtatttttctcatttgtattttatttaaattttcatatttactttcattgaaatgaaatatttttccacatttatttttattgaaatgacaatacatgaggccaggcaaggtggctaacacctgtaataccagcactttgggagggcaaggcaggtagatcacttgaggtcaggatttcgagaccagcctgattaacatggtgaaaaccagctctactaaaaatacaaaattagctaggtgtggtggcacatacccgtaatcccagctactcgagaggctgaggcaggagaatcacttgaacctgggaggtggaggttgcagtgagccaagatcatgccattgcattccagcctgggtgacaagaatgaaactctgtctcaaaaaagaagaaaaaaaaaggaatgacaatatatgaagttttcctgaatggggagaaagtataatcagagagtaaagatgtaacaattcttagtttataacttcaaatattaggatctagtggtaagctacctcagtctatttgggctgctataaccaagtctgtatcctcacatggtagcaaggaaggcctcacaagctccctcaggcctcttttacaaagacattaatcccattcatagggccacagcccataggacccaatcactcccaaaggccacacctcttaatattatcacattggggtttaagtttcaacatatgaattttgggggacacatacattcagaccatagcataagccaagtaaggattttgagtgatcttttaggaagtgggactattttttcccatccttcttttcccctttgtccaaactaaatgaaaattttgcagtgaaaaaaggggaaagtctgaggaggaaaccaaagggctagacactaatgagatctgggaaagcagttctttcgtctcaaaattagccacagtatggaacgatgaaaagaaaggatgtcaggaatcaaagaatagataagacttattgtgtgttcatacctgatcatctaggaaacctaaaaatctccccaaatctcctagggccaggaacatggatttggaacgtcctcacagataggtcccatgtgatttggtcagataagaggagcaatctcacatttccttaactggcagagagtggaagttaaggaacagaaagcaaacggctctgaggatgttttgtaattgtgattagaagaatctagagaataaattagattggaccataaagttagtgagcagaatggggtctgggataacaaaaagctctctgcctgaaagtgtggagaataggatcccagcagaggacagagcacatccacagggcaggggctttgctccttcctcactatatatagtggtcatacaacctcttagaaaagaaaattctagagagaagtgaaagagaaacttctcgagctccctaagtgtaaatttgaagtgacaaagaatactgaaataattgagtttaacttgaattgtttatgactatctaacatgaggtggaaaaggagcttttgtgatatgttaaatcatagaaaagtcaagaagttacatgcctaccaagctctatttaaaaaaaaaacttttaggttcaggggtacacgagcatgtttgctatataggtaaacatatgtcacaggagtttgttgtacagaatatttcttcgcccaggtattaagcctagtacccaatagttatttctcctaatcctcttcctcctcctttcctccatcctcaaggagaccccaatgtctattgttccctctttgtgtccatatgttctcatccttaagctccaacttataattgagaacatgcagtatttggttttctgtttctgtgttagtttgctaaggatgatggcctccagctccatccatgttcctgcaaaagacattatctctttcttttttatgcctgcacagtattccatggtgcacatgtacctcattttcttcatccagtttaccattgatggcatttaggttaattctgtgtctctactattgtgaatagcgctgcaatgaacataggtgttcttgtgtctttataggagaatgatttatattcctctggggtatacccagtaatatgattgctaggttgaacggtgcttctgtttttagctctttgaggagttgccacactgctttccacaatagttgaactaatttacattcccaccaacagtgttcccttttctctgcaacatcaccagcatctgttattttttgactttttaataatagccattctgactggtgtgagatggtatctcattgtgtttttgatttgcatttctctaatgatcagtcatattgagctttttttcatatgacaagtctatttttaagtatcattagtgaactaattatgaagtttattaccttatatttctctttgatataccagcattattatgatataatgcatatatcataaagtttgtagtttctcatttgctgataatttcagtatcagaaatctcaaagagttttaattttaatctctattttctccatatttaccattttctttctttgtatttttatttctattttttaatgtataatcttattgttcaaaacacttgggtttttctagtgtcaattgcaatcataatcttaactgatacaaattttaacgctgatattgcagtttaattttctataaccaaaactcttctttttcaattcatcttattattttttcactatgagccacatgtctgttgtgatatttaaaagtaacatatcagagcttcatccccagagattctgactcagatctggggtttcccatcttccgcaggagatgctgatgcacggatggaattgaaaaccgctgttgtagttaacttttcagggtctgtcagtcttttgtctagtgagtctgttcatctgaaatgggaccttcaatttggcccacagctaacttttctgatattataattagatgcaaaaagataggttaaaagagatataaacaattctctagtcccttagaaagctgtgaactaaagcaaaattaatacttttagttcatattatattacctgaatggatagaaagaaaaatggatacacagatgatagatagatacataatcaatagagataaagacatagtacatattattgtaactgtgttcatatattataggcatcaaagctatgaagagcgtgagctgccagtgttataaattttttaccgaaataccctagttttacaattgaggagcccttgtttggaaaaccagttaacttccttagataagatctctctgttgtcagttctcaaataaaataaagttatataacaatagaagggtctacatataatacaggatatgtcattagaaatgcattgaattcttatcaaatttcaaggtaccttcccatgtggaattcagaatttattgttagattaaaatatgtaaataagaaaaacaacataaactcaataagcccatgtatacacaggacacttttgggacactatgaggtttgggaccacagggaaccattctcagagatcttcatcaagttaaaatgttctattttaaagtaaacctactaccccattcatagtgaacgtctagtaagatttttttgcttgtttattttgttttttgttttgcctttttctgctttctgatacagttgaggcttaggtatttaggaagcaatataaaaattatccatatttacgaaataggcaagttaatctggttgacttaatctatttagaagttttgattcaatagattcccagtgctgcagtcctaccatttactctttccttcaaatacttaacacagtatttcacttcattattcattcagcaattattgaaaaggctgtgtgtctctgtaaatagaaagatgtagacttctgagtcagcaatttggggtttgctcctggattacatgaattacttatttatgtgaaggcttagtttcttcatttgaaaaatgggcacttctccaacaagtttgcttacgagaattatgtttgcactggtagaaacataaaaagtatgcctcagatattaactaaatagagtgaccatataatttactgtccaatctggatacttttgagaacaaaaggaggtcaatattaataagtacactgggacaacagttacaaatcacaacagcccagggcaaaattgggattcaggtcaatctaataaataatggcattgtagaccttcaataacagcaattcagtctctttcattgtattcctctgagagtagatagtttaaatccagcaatcaacttgcattgcggaaattctgtctctataatatcaatgtaatttcgacttgaattcccaaataaaagcaaaaagtgaaagaagtttttgagcagttttctttaccatgtagaacaaagaaaagtgcctaattaagattttgaaaggtcaaaagttattattattaatttatcttaatttttactgaacgaaaataaatttgttacttatttgacattttttggaacaacattttacgaagtttactactttagcagaatataccatttcctaaattgacttcctttatgttctattaccactgtaaacttgccccctcactcctcccctgccctggcaactcattataactttaaaaagttattttattttattgataaaacattgcagttaaaaactacctatgtatttgttctaagttgctcccacttgtatttgaatggcaaggataaaataaagcctcctaaacggtactatttttttcattgttattccacattacaactaaaatttaccttctattgaagcataaagttcatgtcatgtcaccaaaaagacatgggcatgatatccttatatatttttttcaattaagctcatatcactaagtgctatcctaggaggaaaaaatgatttggagagtgatctcgttcagtttaaaagagcatttttatgccaatatagaacaatgagaatttatcatctgtgataatattttaaatataatgagttcctcttattccagagaatgtgactttcctgaacaacaggagcaagaatcaatgccagattctcttctctaaaaataatcaatttgttactacaggtaaattaatttcacttttttcacttcttagtacaagggggttttaatttctatcacaataaaacacacattttaaatagatgccgtgctatacacattgacacttacttgttgcattatgtagagaaccagtaaaatctttactcacaatttgccaataatttccatagagctttctttctcaatgaaagaggtcactaattccttcacttcacatcctaaagctagaatgaattgtgtcaagctgttagccgtctaggccaccaaaaagagttacgcaaatgatgatgtattcatttataaacactcctagctattttctcagctatcatcaattttccattctatttttaaaaatcatattactttgatatatttctaaagattcttactgttgaatcctaagttattttactctttttcagttgtcaaagttcaaaaacatctgacttttatattgtgaaaaataaccttttataaacctaaacatctgtagtcagaccaggccatctctcccatttcatcaggtgatttctcaaccagaatttctataccaaaaactacagtattctttaaggttctcaaacagatcatatttcctttcctctgaatgtcttcatacatgctgctacctcatttctttacgtaccctattcgcctggctagttcctaagcatttcaaatttcagagtatttttttgttttctcagaaagcattttctgagcctcggattgaagcagttgctattccttatccaaatcacattttatactttttcatataagaaggatctcagaatagcaattaattagtgcctgccacaccacttgaataaggtattaaaacattatgacaaattgcaatgttaaaagccaggagtgaaagaagcaagtgatacaggttagggcaagtttttcagaaattaatgatatttcattgtttgtagtccaacaaaagtgtgttggcagctgcatggtctcgtgacaataatagatattagagatgatgaaagattttcatgactgcagctgaagaatatggggaaatattccgactagctatatctgaaaagacattggggacaatagattatttgaagggtctctaaatacaaatgaacatttcagcatgtggatatggccacaaggaaaattctaagtggagataacaaataagaaggaagatttaaatattaaaaaaccaagaaatcttggggcggggcaagaagtctactaggtagcatgaattatgtggaagatataaaactacagaatttggggaagttaactaaggatggaacagagagaaatggaatgggaatgtgaaaattctgttcctaagtccagtaatgctaccctaaaccaaaatattagagaagtagatgagcaattgagaagacttgagagtgaagggatgcatggtggatttcttaaggttttatttgtaatatcatttttatgaaggaggaggaaaaacttctgtatatacaaaagtgctctatgtttctctccttttttaaatattcagactttgctcaggtttcataaaataatgttttcataaaatgtacagcaaaacaaagataaacttatactactcagatgaccttgttttaagagatgcttgtgccaaatatgaattacaagatgatcatgagatcatctgaatatcttgactggggctcaggataagaaaacaggggattgttggtgtaatgttttattagggctgccattacaatctccacaaattggtggcttaaaacaacagaatttcattctcccaaaatgttggagttgaagagtccaaaatccaggtgtcggcagggaaaagctccctctgaagagactctggggcagaattcttccttgaatctttgagtttttggtggctcaaggaattccttggcttgtggcagcattactgcagtctttgtctccatcattatatgggtctccacgtggccttctctattatgtgaccatgtcttctcaccttctcctttctgataaaggcacttgtcactagatttagggcacacaataatccaggaagatctcatatcaaggtccttaacttacttatctgcaaagagtctttctgcaaagagtctttcttccaaataagagtacattcacaggttcctggggttaggacatgggacatatctttttgggagccaccatccaatccaccacagatagtagcacttcttttttgatcatagtactcataaagatatactttcttttccatttccttttctaagagcccacatcaaaacactgtctaattcatgaagtactgatgtcggctaagaagagactttaattacctcctccagaaatcatctagaataaggaatagtcaaagttttattattctggttcgaatattctgaaaataggacagaaaaatgaatcatcaaacaactggatattttcccctttaatatttcaagtatagatttcactccaagccagcatttgcaaataaatgccatttttatttttaaacaatttagaaaatattttatcacatacctttgagtgtaaataataaatgggttttggcaattgttcattagaattgagagatgtaaaataatttataatatttcattttgagttacgttcatcaattgttcacatttcctaaaatcaggacctcatggaaaaaataaaatttacctacaaaagcttaaaaggcagatcagatttcacaaggatggattatccaaataaaagacacaatacacctttagatggaaagaaacaaacaagcctgaggctaccaagtttatagttaactggtggaaaaatagccattttctcacatgattatcagaaacacaagactgatcacaagtcagtgttgcaaattttatgaatacaaactttcctttttctccctctcttccttctaccctccctcccttcctctctccttccttcctttcctccctacctccctacctttctccatcctttctttcttccttccccccttctttcccttttattgaggagtcagaaacatatataaagggtagattttatatagttaggggtatatttcaaggcacactgtttttgctattgtttttaatatctcagggtaaagtggttagttttcttccagggctgtgggaagtgaagtaagtgcatgatcacacctcatggtggcaaaacaagatactagttttgctttctcagtacctcctctggtcaaagatttgttcacatcagcttatttagctacttttagacttggtatcattaacatgaaggtttgcttatttagagttatttatgtagatataacatgagatattaatagacaaaaccgcaatgttaacatgatgacaggcatatgatattaaaacttgagggttaacatatgcctatagggtccataaagtccctaatgttataattaaaactacttgtgtgagtcagaattatttttacagcctttatctgcttttttatacagatcagaaaaaagagccacacaaagtatttttctcagatttctttgaagcctctctgactttttttcatactaggatcttctattttgccaacattccttgcctatttaaaagtgatattaattatttagtgacattaattatgtattctagaagcacttaatagacatcacttcacatgtgaagtggggtcttcttgcttaaaacagggcttataagacctatttaagtaatatttgactttatatgtgacattttcagcatggtcatgattatacattccatttatccaagtaaagccaaataaaaaaagacaaatctattgacctatgaaaatgattatgcattcataactagtaaagggaatcagtcaagccttttagcatggtgcataaccattgttttaagtggtgtcatactcaagaacaataaatgtatgccattagttagaaaatcatcattaagtttttatgattaagtttctatgttttaatctgtagaacaaacttttatatggttattatttataaattcagggggtcaattgagataaaattctatttaccatgaatttgatttccatttgtacaaataagcctgttaaattaaggattatagatggtataaaaaagaagaaatttcaaattatttaatttcattctggtccacctaataattcttgttatcttggtcttggggtaaaggtagcagtgtttttaaaaacggacctgcttctggattaaatgaatcatggaaatcctgatgcaatcacctgatgtgtctgataaatgtcaggttattgtggtgatgttgtctaatacagtgaagcctgtctccatgggttggttccctatatcaaatttaaaaatgctgtattaatttgtttttacactgctataaagaagtatgtgagactggctaatttataaagaaacaggtttaattgactcacagcttcacatagctggggaggcctcaagaaacttacaatgatggtggaaggggaagcaaggcatgtctcacatggcagcagggagcagggacagtgccacacttttaaccatcagatctcctgagaactcactcactgtcatgggaacagcatgggagaagttcacccccatgatcaaatcaccaccaggtccctctcctgacaaatgaggattgcaatttgagatgagattggggggacacagagccaaaccatatcactctacccctggcccctcacaaatctcatgtccttcttacattttaaaaccaattataccttcccaatagtccctcaaagtcttaactcattccagcgtaactcaaaagtccaagttcaaatactcacctgtgataaaaaaaagtcccttttgcatatgagcctgcaaagtaaaaaagttagttactttcaagatacaaagggggtagaggaattgggtatatttttccattccaaaagggaaaaattggccaaaacaaagaggctacaggccccacgcaattccaaaacccataagggcagtcattaaatcttaaacctttgaaatgatctcctttgacttcatgtctcacatcaagggcatgctgatgtgaggggtgggatcccatggccttgggaagctccacccttgtggctctgtagggtacagtccccatgacggctttcatgagctggcattgagtgctgcagcttttccaagcgcatggtgaaagctgttgggggatctaccattctggggtctggaggatggtggccctcttcttactgcttcactaggcattgctccagtgggaactctttgtgggggctccaaccccacatttcccctctgcattgccttaatagaggttctccatgcaggcttcactcctgcagcagacttctgcctggacatcgggacatttccatacatcatttgaaatctacgtagaggctcccaaagttcaactcttgtcttctgcacacccacaggcccaataccatgtggaatctgccaaggcttagggcttgtcccctctgaagcaatggtcagagctgtatcttgaccccttttagccacagctggagctggagtggctgggatgcagagcaccatctcctgaggcttcacagagcagttgggccctgagtctggcccacaaaaccatttttccctcctaggcttccaggactgtgatgggaggggctgctgtgaggatctctgaaatgccctggagacattttccccattgccttggctattaacattcagcttctctttgcttatgcaaatttctgcagtgagtggcttgaatttctccccagaaaatgggtttttcttttctaccaaatggtcaggctgcaaattttccaaacttttacactctgcttcccttttaaaaataagttccaatttcagaccatctctttgtgagtgcatgactttacactttcagaaaaagccaggtcacatcttgagtactttgctgcttagaaatttcttctgtcagatactttaaatcatctctctcaagttcaaagttccacagatctctaggccaggagaaaaatgttgccagtcgctttgctaaagtatagcaagagtgacctttgctccagttcccaatcaattcctcacctccacctgaaaccacctcagctgagacttcattgtccataccactattagcatgttgatcaaacgcattcagcaagtattttggaagttccaaactttcccacatcttcctgtctttttctaagccctccaaactcttctaacctctccccattagtcagttccaaagtcactttcacattttcaagtatctttatatcagcacctcacttccagtagcaattctctgtattggtccattttcacactgctataaagaactacctgagactgagtaatttatttttaaaaagaagcttaattgatttatagttccacatagctttggaggcttcaggaaaatgacaactatggtggaaggcaaaggggaagcaagtaacatcttatatagcagcaggaaagagagagagcaagggaggatcatcgctttccatcaaccatcaggtctctgagaatccactatcatgagaacagtatgggggaaatccacccccatgatccaaccacctcccaccaggtccctcccctgacacatggggattacaattcaagatgaggtttgggtggggacacaagagtcaaaccatattaaggaccttctttcgtcctgaattggtttgttattcttttgatatttcttccagaagagtcaacttctgatctttgacttgtagcatgagccttaccacaaatgtacaggaaaaaaaaaaaaggaagtcgttcagtgattataaaacctaatagttttattataataatacacactcattttatgagaaattattcaatggttacattaaaagtaagcatgtcaatttattgtccataattgcccccatctttgtacaagaacacgaaggtgcttttacttatactgaaaggtataccactgaaacactgttatatagtaatgttttattgtctataaataattataaatacaattataaattatatgttgttaaatataaaattataattaacagttataaataatgtggaatcaaaaagtaatagcaaaactttgaaagattttgaaatataaaataccacatagaaatcatgagatacagctaaagttgaacttagaatgaaatgtgtataatggcctacattagaaaaaaaagaaatcacccatctcaagaagtaaacacattcatttcaagaaataaaaactaagaacaaaaatccgagtaggaagaaaggaaagatagtttaaaaaaattaaattgtttttgtaaactaataaaatcagcactctgccatctcactccccaagctgttgatgtcctttcatttctttccatgcatgggtggaatattatatttttctctttgttttattttcatttcatattcaaaacatggttaggaaatgtcagcattctagtctccttatttgtatttttttttaattaaacttttctttagcttcagggatccacatgtaagtttgttgcataggcaaactgtgtgttatgggggtttgatgtactgattattttgtcacccaggtagtacgcatagtaccttataggtagtttttcaatccttatccttctcccaccttccaccctcaagtaagccctcatgtctgttgttctatcctttgtgtccatgtgtactcgatgtttagctcccacttataagtgacaacatgcagtatttggttttctgtttctgtgttagtttgctaaggataatagcctccagctctgcctatgtgttctcaaaggtcataatctcattctttttaatggctgcatagtattccatggtgtatatgtaccacattttctttatctagtctgtcattgatgggtacttgagttgattctttgctattgtgaacagtgctgtgatgaatatacatgtacatgtgtttttatggtggaacaatttatattcctatgagtatatacccaataggattgctggattaagtggtagttttgcaaaactgctttccacaatgccagaattaatttacaatcccattagacctgtataagcattcccttttcttcacaaccttgccagcatctgttattattattattttactttttaataatacccatactgaacatagtatctcattgtggttttgatttgcatttatctaattagtattgttgaactgtttcatatgcttgtttatccacatgtatgttttcttttgaaagggtgtctgcttatgtcatttgaacacttttaaatgggttgtttgtttttacttgctaatctgcttaatttccatatagattctggatattagacctttgtcagatgcatagtttgcaaatattttctccccttctgtaggttgtcttaaaaatttactttgttgatagtttcttgtgctgtgcagaagtcttttgtttacataggtcccaattgtcaatttttgttgcaattgcttttggcatcttcatcatgaagtctttgtccattcttatgtctagaattgtgttttctaggttatcttccagggtttttacagttttaggttttacatttaagtaattagtttatctcgagttgatttttgtatatggtgtaaggaaggggaccagtttcaatattatgcatgtgactagccagaattccagcaccatttattgaatagggagtcatttacccattgcttgtttttgccagctttgttgaagatcagatggttctacatgtgtggctttatttctgagtgctctgttccatttctttaatctatgtgtctgtttttgcaccagtaccatgccattttggttactgtagtcttgtagtatatttggaagtcaggtaatatgatgcctcagctttgttctttttgcttagaattgccttgactatttgagccttttttgattccatatgaatttttcaaaactttttttctaattatgtaaagaatgtcattggtagtttgattggaatagcactgaatctgaacattgctttgggtagtatgaccattttaagaatatcgattctttctctccatgagcacagaaagtttttccatctgtttgtgtcatttttgacttctttcagcagtgttatgtaattctcatggacaaaatcttttacctccctcattagctgtattactaggtattttatactttatacttttttggctattatgaatgggattatgttcttgatttggctctcagctaggacattgttgttgtatagaaatgctatagatttttgtactctgttttgtatcctgaaactttgcttaagtactgtattagatctaggagctttggggcagagactatgaggctttgtagttatagaattatattgtctgtaaagtgagataatttcacttcctttttcctatttagatgccctttatttctttcacttgcctgattgctctagctaggacttccagtaccttgttgaatgaaattggtgagagagggtatccttgtctttttctcattttcaagggggatgcttccaggtttttcccattcactgtgatattggctatgggattttaaagatggcttttagtattttattgaggatttttgcatctatgttcatcaaggatattggcctgaagttttctttttttgtggtatatcttccaggttttggtatcaggaagatgctggcctcatagaatgagttagggtggagtctctcctcaagtttttggaatagtttcattagaaatggtaccagctcttcattacacatctggtagaatttgtctgtaattctttctggtcctgagctttttctggttggtaggctttttattactgattcaattttggaactcattattggtctgttcagggattccatttcttcctggttcagtcttgtgacattgaatgttttcagcagtttatccatttcttctaggttttctagcttgtgttcatagagatgtttttaatagtctctgagggtttttttgtatttctatggggccaatggtaatttccttttcatcatttctcattgggcttatttggatctctctctctctctcttttattagtctatctagcagtctattaatcatatttattttttcaaaaagccaactcctgctggatttgttgatctttttatggtttcatgaatgtgtcagtttcactcagttcagctctgatttttattatttcttgtcttctgctagctttggggttggtttgctattattttcctagttcctctagataacatgttggttgtcaatttgagatctaacttttaggtgtgggcatctagcactaaaaacttttcccttaacactgctttagctgtgtccagagattctggtatgttgtatcatagttttcattagtttcaagtaatttcttaagttctgccttaatttcattgtttacccaaaagccattcagaaacaggttgtttaaatccctcgtaattgtatggttttgagcaatcttcttactattgatttctatttttattgtgttgtgataggagagtatagttggtatgatttagttgtttaattttctgagaattattttatggctgattgtatggtcaatattagagtgtgtgccatgtgcagataagaataatgtacactgtgttgtacttgggtagagagttctctagatgtctgttaggtccatttggtcatgtgccaagatcatgtcctgaataactttgttagttttctgcctctatggtctgtctaatactgtcaattggaggtgaagtttcccactgttattgtgtagttgtctaagtctcttcatatttttgtctgacagagctaatttggagaactagtctttgaactctgggattctttcctcagtttatctatcttgctattaatacatatgaccatattatgacattctttaagtgagtgttccaggtgtatcagatcagtttagttatatcttaagatggacatttcatcttttacctcctgtatagtttgtttgtattccttagattccttgtcttgggcttgcactttcctaaatcttgatgatccatctaccttctgaattctgtatctgtcatttcagccatttcagcttggttaagaaccattgctgggaaactactgcaatcatctgaaggtaagaagacaatctggctttttgagttgacagagttctcatgctggttctttcttatctgtctgggctgatgatcctcccatctttgaagttgctggcctttggatggggtattttgcttttatcttctttgttgctcttgggagtctgattgtggcagaaggtgggttcagtccactgacttcacttccggaggattttaggagtccaaagctcagctcggcactcctgggatgagtgctctaactctgatcagctggtactgagccccccagcttgttttttggccccttgaggttatgaacctggtgcactggaagggctgaggttttcctggtacactagccacaacactccaatttccaggggctgccaaccaaagtgctttgttgggacagaggcagtgggatctgtgcttgctcacatgtgccagcagctgcagcagcatggtggggtgcatgcatgttggctgggcaagggcatctagagggggtagggttgtcagcctctctgctagcacttgtgctgatagtggcagtggtgatgggggcactggcagagctgaggttgttggcacctgtgcacaagtttgtaccagcagtggtgatggcactgtgggggtgagtttcctggcatctgtgtatgagttcacatcggcggtggcaaagcagcatcacaaggaaggggtggctgggtgagcttgtgctggcaaagtggtaagggggccgtgagtgagtgcatgctggaaaagctgcacggggagtcttcagcgaggggaaactgggtgggctggtgtgcattggtaaggattagtctgctggagctttccaacagtcaggcatggtcttctggcaaaggagctataacgtgagcccccaggaactgccctggttgggtaaccgaggctgcactgcaagtggatgtggtcaggctggggccccaggagatgccagtagatggaggggcactcagtcatgccctcatcccatgggcgtgactgctctgctctgtccaggtcctacagtcaccctgaggctaaagtctcctagagttcctagaggagcatggcaagctttgagggatgagcatcactggccatgctccgctgaagccattcccatgccaaatcttctgaactacacaggctagagccctgccgtgtcatttctctaagcagatctttctgccagctcaagtgtctgtgggggtcaggaggtcttcttctgctaggattccagaggtccatgataagtgtaggtcactcctcacctgtgtgaattaccccttcgccaggagtcactgggggccaggaatgagtcctggtgcttatctaccctgtgcagggttctcagctttctccccattcagcccagcatttgtgtcttccctgtgtccactctcaattccttccctctgaagatctacttgtaggatgccagtctgccccgtatcacagtctcttggtgggagatgttcctcctggctgcagctagtcagccatcctgaatcccgtcctatttctgtttctgaaccaccattattcttgcacctcctgtaaaaatgcatccatccgcatttaaaataattgaattaaagctattaatcctttccccctcactttcctgtccttttccctcaatttctcatctttattatagtcctttatatcactccccatatttgttaaaatccttgtctatggattattaacatttcctacatataaaccccaaatttttcttgagagtttaaaaaaacacagaataactgtggatgacttaaccaataacctatcttggatctattcaacttcaaaatttaaaaacttcagtatctcattctgtgaccatagcctttaataagtaacaaataagcaaacaaataaaataagtaaaagtattgattttaccaggattctcttttcaaacctcttcttttctttacatatccctccattgatttccccactccatgcccatgatttaaatatcatttatatgttcatgtctctcaatcccattctttataggtaagcaccagaatagaatgtttcacaacttagtggaagtctccagtatgataaacccataggacttccaactaaagcattcaacactaatcttttcatctccctggcaaggttcccttcagacctggaatcctatatattgttagtggcataactaacaacctggtctcccagtataagcctaggaacttttgaattctctgacttctctactggacataagtaaattcatttttaccctatattgactatcctttctcttttccattctcctaactattgctatatgtaacttctaatgtgaatttctgaaaaaacttccacacacattgcttacaagtaatgatttaaagtgtataacttaaaagactataaacatagatttcataagctataaaaagtccttctagaattataaatcatacacacatgcatgtgtatatatacatacttgatgtggtttatctctgttcccacccaaatctgatgctgaattgcaatcttcagtgttgaaggaagggcctggtgggaagtgagtaattacatcatgggggcagacgtcccccttctgttcatgtgatagagttctcacgagatctgattgttggaaagtgtgtggcactttccccttctctctttctctctttgtctctctctcctgctcccccatggtaaaacatgcttgcttcccctttgccttccaccatgattgtaagtaagtttcctgaggcctcccagccatgcttcctctatagcctgaagaactgtgagttgattaaactacttttcttcataatttacacagtctcaggtagttctttatagtagtgtgaaaatggagtaatacaatactccacacacaaacatatgtacctgtggtggtaaatgctttatagatttctttagagttttgaaaaatacctgatacccaaaatgtttctatccactggccaatgtctccactcaagtcattttgtatgaacacgtgggctgacctgactcccatctatttcatagacagtatctcctaccattccttgcttcaaaacatatgccagttctaaatagcgttgattattattctttaaaggtacttattattacttcacacttctttccatttgagcattttgttatctctcccttagaaataaacttctctgattatttaactaggaaattcctatgtatctttcaaaacaaagaataaatatgttctttcttaggaagccttttgtataatggtttatttgtttgaaatgatgtttcacaacttgaggtgagttgtacattattcctatttaggtatgaaattgtatttgcagttatgtttcaaatctatcttcaatagtatgtgttaatgtcatttactttatatatcaagaatgcaggataatgcctggcacacagtaagctttgaatgagcagagaaaatggatgattagctgaggggttctgaaacagacagtatcatattgttgagtggccctgcgctctcaaccatcagcagtggtttcagtggtgttcatgccttttgagtagccttttccctgcttatagaatcccagaagtctgacagtctttcttcatttcatcccatatttgccccctttatttcaaggggattggggagatgttggttaaaggatgcaaaatttcagatagataagagcaattagttcaagaaatctattgtgcatcacggtgactataattaataacaatatattgtatacttgaaaattcccaagagagtagattttaagtgtttttaccacacaaatatgataagtatgtgaggtaatgcatatgctaattagcttgatttagccattccatgatatatacatgtatcaaaacatcatattgtataacaaaaatatatgcattttaatgtattaattaaaaagaaaacaaccttattgactttttttttggaatgtcaagggaatcaacatttgacatgagggctctccgcggattcttcctggataactttatctctattcctagctgctgcgatgatggctgttatgatccacaagtcacacatgtctctcccctcatgaaggtcaaaatttagtattacagtgcaataaccacacacacacacacacacacacacacacaccttaattacagcagtttaaaatgggtgactgagatcttcccaaaagtaaagggaatatcagtgcatactaacacatgagaatatgtttgaaacagcactgttagtcaggaccagaagatttcagatatccagttaatatattttttaaagaacacctttagaattatattacaaccagatcttccacaggaatagtctaaatgggcgatggaaactaacttcactcagagattcagaaaatttgagagagaaaaaaagtgggagatgagatgaaaatgatgagaatatgtaaactgagtatccgtacatgtgtttctggtattctgtcgttcacctctagtgtgaatgggaaataaaagcttcagattagaactaaggagcagtgtgcaaagactgtctgcagatggagtcaggacaactaccctgggcatagtacccgggggcaaaatattaatataatcttaatataatctgagtgacaagccaaacattttctggttctgttaaacatatgattcaaaaacttcacttgaatgctattttagagagggaaaactagtttcagtgctaaatttgtaacagtaattgaaaataactgaacaattttatcattaagaatgctaggctgggcgcgatggctcacgcctgtaatcctagcactttgggaggccaaggcaggtggatcacaaggtcaggagatcgagaccatcctggctaacacgatgaaaccccgtctctattaaaaatacaaaaaattagccgggcgtggtggccggtgcctgtagtcccagctacttgggaggctgaggcaggagaatggcatgaacccaggaggcggagcttgcagtgagctgagattgagccactgcactctagcctgggcaacagagcaagactctgtctaaaaacaaaaaaaaagaatgctaattatgttaattgatatcttagtgaatagatgtttactcttacttatttttcaataaattattctttactaaagtatactattttctttaatactcactgggttcattgaacaaaagggcctggaataaaataagcaaaaatagcagatatttgttcaattttcacatcctacagatttcaaaagattttctaacaacacacagcatgaaactcacataatatgaagacacaaaactggcccagatatacagcattcaaaggagaatactttagacctatcccctactacattattgttttggaagattacttagaatatattttaaaacccacaatacaaacatttattttaataaagtttatctgcaggaaaaattggtacattatgacccatgcttttttttattattatttttttctgagatggggtcttgctctgttgcccaggctggagtgccatgatgccatctcggctgactgcaacctccactcccaagttcaagctattctcctccctcagcctcctgagtagctgggactataggcatgcaccaccatgcccagctaattttattgtatttttagtagagatggggtttcaccacggttttcaggccagacttgaacttctgacctccaatgatcctcctgcctcggcctcccaaagtgttgggattacaggtgtgagccgccatgcctggcccccatctttattatatcatgtcatttcagctgtcatttccattctgccattatataactttccctcattttcaaaatccaccttaaaataaaaatcctcacaatggatttcaaaatatgcccccaatttacccttaaatgcattatttgaaatacctctgtattgatcttaagatgatcattgcttcttcatttcatattagatcttgccattccctaaattcttataatcagtccctttgcctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaatatttctccaatctttcaatagtctattccagcaaatgaccaccgaatctgtttaattatccataagccagaaacatgggcttatacatatttacaattccttttgccttcatattgaaacggttattgaaattgtaaggattcatgttccctttattttatcaagcttgttctgcctttcatttaacacctgagtcactgcattagccttttttacacacatctctgttccaggcttagtatccccaatctcaggcagtcagaagggtaagtaattaagattggatctgtagtggctgtaaaaactgagatgatcatccatctcaggtaggttacatatttatatttatgaatgaatgaatgggcttggattaaatgtaatcattttgctcctatgtctgtttatttttaaatgctctatttctagtatattctgaaattttcctcttatttgaaaacttttaaagtaaaaataagtcatttttataatcacttaatatatgacagtagagatgcattttctatttcattcatgtatgttttagatttatatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacatgaatccaagaacaaggtatgaaatcgtatgacatatttttgagctgaatgtatcaaatatctggctcattgaatcatgaattgtctgatcaggaaaggagaagaaaacaacccctactcctgacctagaataattcatatcctgtggtattaggaagatttaaaaaagaagaagaagacatgaattaacaaaaacaaaaaccactagactcttttaatatttgaatataagagggtactctgacacacagttattatatagctggaaagaggattttgagagatcaatattgtagctttcatcagcttattattgctatcaacaaacaattgttctgctttatcgagatgtttaagcattcttaaattattaggggcaataaagacaagcaaacataaagctaaacagaaaaataaatactcaaaatttcagctgtataagatctcaaaatttgttatgcattgtaaactgtcctatttgtaattacacttaagatcccagatcaattttattctgcatgtactttttgaaaaaagatcaaatatgtatattaagtacaaagttgcaaaagctaaaggttaaacttagttcattataagcctttactaaccctttattttctacctttccatatacaatttccttggaaattaccaaaaggaggaagctttgacttcaggaattgtttattctaccataatctttattggtttccttgcttcaattttcaaatctgcaattgaaattagatatgattgcctagctgaacttcagtaagatgcattttgattatgataccctctacttagaaacattatgttctttcctattgtgctcaggacagactatatgttttagacgaggtcttaagacacataataatctagcctcatgctatatggccagttatctctaaaatagctttaccattctcttcattatccctttggtacttgaagtcatatctcttactgagacgctttcttccatctcctcctcatcgatatttggtatctcattccttaaaatgtgttccgtctgtcaacttaagcacatacctttcccattccatgaaattctttgcagctacagtgattgttccttcctcaacatctatacaaattccattcaataatcaatttaatttctttaatgtatatatacttgtgtttcagtttaattttttagtaaatattcattcaaaatttctagagataattttattcattgcagctgtggcatataagccctaactatgaaaaatgtccatatctatatcttcaaattcctgttttaaaaaaaggtgtgtgtgtgtgtgtgtctgtgtgtgtgtgtttgtgagagagagagaaaaaaaagagagagaataatgaataagagctatagaatcactccctttataccatggctttgtgctcagtatagtcagtgctttgcatataatcattgtggtggtaatattagtagtttggcaacagaaaacacttgttttttctggccattgtactaagcatgcttcatgtgttaactctgaattctcctaccgtctctgtaaacacagatggaaaccctgctgcatacaggtcctaggtaattagcctaggatatcaggctgtagattacatacttatcacactatgcactctccataaatagatgattttattaattacttagttaagcttctataagcaaattttccaggaaataaaccatatgattcctaaaagtcatgttccatacatgtaacatgatgctttgtaaatcagcatagtcaaatatgaaagactgatccacttttcagtgttggctgaagttatttttacctttctttgcgtgcatccaaacatgcaaataatacttaagccattttcttttataaatcaataacaatgaaacacacaggcaacaattgcttcatatatgacagctaaattagcacctgattaattgcatttatgcgataggaaaaccatggaccctctcaacatctggacaaacagttcaatgaaagaactttcctcagttcagttctgtgtattcttttgtgttatgaataccttcaaaatataggttaatcaacatttattgagtactcactctgtaatgagcttaatgctaaggattatattattgcaaatgatattgttttatttcactgcctcctgttactcttatctgggtaccttagattttatctcttcacccactgacctgtacccagttggataaaatatcccccaaattttaatggccaaattgattcctccttctgctttaagatatggtgttcctctgccctaaaacttaccatttcagggacaaactgtttataacttagttgttgcaccagtttctgtgtatctaggagtaagaaataaagaaatcctagtaagttcctactctgggtctgctctctgctttatctaaactaaaactcagagaaaagaaaatacctacactgaagattcaagcagccaattaatatttttaatagatagagggctgtttgggtacccacaacacttattttcttacactccttatgagttatttttggaatttttcagtctgtgtattataattaatatgaatctatctttctaaaaatataattagatcagaatgaatttaaattgacctgaatttaaattgacaaggtttaaaatgtgcgatatttgtttctgtataatattttgaaaaggcatttggtgatgatgcctggatctgattttatgagcttttgatcttacaagattcactgctcatggatcacagctttgccagtattctgagtatttggagattttctagtcatctttctgttatagtttaattgtattgtagtctgagaaaatattttgtatgatttagattcttttaaatttgttaagctagatccaggatgtgatctaccttagtaaatattctatataagcttaaatatgtgttttgctgtttttaaatagagtgttctataaacgtcaatttgataaaatggatcaatactgctcttcatttcaaccatatccttgttgattttttgcctgctccatgtcaattactgatgggggggtggggaattatccaactataatagcaaatttgtgtctttctcttttcagttctatcaggttttccctcaaatattttgatactgtgttgttaggtacataccagttaaggttgtgttcttcttggagaattgaccttttttatcattatgtagttacccttcttatccctgacaatttcccctttcctgatgtcttcttgtctgaaatatactttggctttctcttgattagtgatagtatactatcttcctccatccttttaatttgtcataatcttcacatttaaaatgaatttcttgcagacagcatatagctggggcttgtaatttatctaggctaataattattgctattttaccgatgtcattagacatatttaaagtgattactcatatatttatgttaaaatgcaatatatttgtaacttttctttcattacgtttgttctttgttactagtctctacctcttgttctactttttttgttttaattattttatattattccattttatttggcacagtagttacacttcatttttacatatctgtaggtgaactaggttttataatatgcattgttaaataaagttagttcagcttcaaataacactatattttatttgtagcataggtaccttgtaacacagtgttccacattctcccttctgtcgcttctgatgttgctgtcatcattattttacttacttatattcttgaattacctaaatgtattattagtattgctttagataactaactgttagatcagttaaatacaagacaaataaaatatttcactttattccttttctgatgcccttttaaaaatgtagattcaagattctgacttatatcatttttcttcttccggaaaaactttttttaacatttcctgtatgacagttctgctgtcaatgtcattagttttggtttgagaatattacttctcctttatttttgaagaatgatttttgtggatgtagaattctaggttggcagggattttttttctccctcaatacattagagatttgataatcttcttgttttcattattttaggggcgaagtcagctataattctaaacttaattcttctgtaagtaaggtgccccttaccagcttccttcaagacctttttttttgtttgttttactgcaattgaaataaaatattcctactgtggtttgtgtgtatgagaaagactgtgtgtgtgtgtgtgtgtgtgtgtgtttgtgtgtttgtgtgtgtctgaatgaaatatttaccctgcttggtgttttctgagtttcttggtttgtggattagtggctgttattaattttgtaaagttcatggccattttagttctcatttactttttttctctagtgttttcttataaatttttaatatttctccacagttcctgaatattttgtttttaaaatcttttttcttctctttgtacttcaattggtaaatttctatcttcaagattgccgctagcttcgtttattattttcttaatagtgttgagtctactgataagttcattaaacacattcatttctgttactttaagaaagttttctgcattttattttttactttttcttaatgtagccatgtcaatgtgtcctgaagtagttggtgtaagattcagtttatacatttcttatgagattttatagaattcagtgtgaaaactacctggggctgcgttttctttgtaacaatgatttttacaatgaatccaataaaagactactcacattttctgtttattcttttgtgagtttgatgatgtgtttttaaaaataaacttatcatttcacctaagtattcataaaggtgttatgaagttgtttataatattttcttattaacattcaagtgtctatgtgatttatagtgataatctttctatccttgatattgataattttttgctcacttagtgttttctcgaataatatacctaggctactatcaattttcctggtgttggaaataataaactttggtctgttaatttttttcatcactttttagtatgaaatatttactaattttctttgtgattcttcctatcattatggattatttagaagttgtttaatctccaaattttaagtatcatatcttattattacttatgacaaatttaattattatcaaagtatattcactgtataatttcagttttttaaaaagtatttagatttgtttgattttttatgtggactttgtgtatgtatcatctgcagggagttttctgtattttttaggtatattgttctacaattctcaattaaatcattctggatgagaagggacctaagaatatttacatctttagtagttttttctctaattgctctatcaaatgctttgtgagacatgctaaaatttccacgcttgctgttttggacgcctctttgattctatcactatctttctcgtgcattttgaagctctgttattaagtgtaaacatatttgttaaacaaggtttacaggagggcattgttttgcactaacttcctgaactaggtctcatcaaaccaggccaaaccaaaatggtgtaacttatactatgtgcaaggaagtaggtagatccccaaatagaccagttttccctgaagacaggagattcatagcaaccaatcaaaaagagcccagtctacctgagtcagtgtgataagaactgtctcctttgcttcaaccttacaagaaaagtgacctgtagtaactttacgttaactgatctgctttctaaaattgttctgccttcttgctcctcccttacaaaaaccaaccattctggcatggcctgtggaatattcattctattttataaaatgaggtgtttcctgattccagaattaaaaataaaaaataattatatctttatgttaaatttgttgtaatattgtcttttgacacatttatgatggttattttttataaacttctcattatattgctagaaaatatccctttttacatacagtaatacattttactctgaagctcatcttatttgatattatgatatatttatctataatagatattattcattatatagttgatatattattgataatattaaatatgagagttctcttatatttcacctttagacagtgaaactttatgctgcaggtttagttaatgactcattataaggaagtaagaagtaagtctaaaattataatgacccacatagttacaatgactatcttgtgattctaatgcttttagtaatcatttcgtgctcattagtacaaatgagaaagattccataccaagctaaaaatttaaaaactaagttttagtttaaaagaaatatttaaaaatcatttctcgttattactacattagatacattccaaatttaaaacaaacatacctaagaaaaaaagatctaaaccatttcataataagaaataaaacaagaattagaaaaacattttttatcactggctttcagataagttatatgctaacagcaattctttcttgttttaattatcatgatgaatttgggattactgtattaccatacagcctatccagtcagagcacacactttgcttaaaccttaccaactccataaagatttcactggcttcttcatctttccttcagacactttctgtctttaagaattatggtgaccttctccaattaagaattatatagtgttctgtattttttctttctattaattattatattttaagtggtgccatttttatagaaacattcatagcaagtagtatgtatgttgtaatagaaagacaaggaaagaaaataaaaataataatttgatatgtaaacttttaaagtaaatactgattaacttcatatgtaaaatttgcataaacttttaaagtaaatactgattattaacttcatatgtaaagtttgcatctgaaattatcaattcatgttttctatagctatcatgttaaaaagatttacagttagaggcctggtgcagtggctcatgcctgtaatcccagtactttgggaggccggggcgggcagatcatgaggtcaggaaatcaagaccatcctggctaacacggtgaaaccccgtctctactaaaaatacaaaaaaattagctgggcgtggtggggggcgcctgtagtcccagctactcgggaggctgaggcaggagaatggcgtgaacccgggaagcagagcttgcagtgagccgagatcgcgccactgcactccagcctgggcgacagagcgagactccgtcacaaaaaaaaaaaaaaaaagatttacagagtaggagtactttcaagacattgtgcatcagagtgactgtaactgatgacaatatattgtattcttggaaaatgctagagtggattttaagtgttttcaccacaaaaatgataactgtgttaggttatacatttgttaaatagctagatttaaccatcccacaacgtatatgtacttcaaaacatcatgctgtacacagtaaatacatacagttttatatgtcaatgaaaaaaataaatttgaaagaaaaaaaaactttgaattacttgattcaacatttgtttgtattaattaatcatgatttcctagtatagtgaagagcaatttagtgttgataattgagtcaagcacgaattatcaataaaataacatgaaaaattattagaatgctctaccaatgcaaaaatgaagctgttaccacccaaatccactgaaaaactttagcatctcagaaaataagacaattagtgttttgtgcttcctgatgaaattcagtatgaagtacatgggacaatctatgaggtagtctcattaaaatacttggcctgaatctaatcaaaattctaagattaacttccatgtacatgggaaaacacataataaggaaaaaaaatataaatgcaactaaaaaatagacagacacattaggatatggtacattcaaatggatggctaacagggtgagggggacaaatctggactgtaagaaagttaagagacacatcaaatataaatgcaataggtggtctttatggatcctgattcacataaacacacggtgtaatttttatgatatcagacaaatttgattattgattatgtgtaaatttatataaaggaaacacttgataatttttcttgaaaaatactggctttaccattaagtaagactgtgtcctctgttcagagattcagtggtaaaatgacatgtggaatttgctttaaaggccttagcaaaaaaaagaatgaagggatgcatataaaccacatatagcaaaatcctgataagttgggaaataaagagattcactgtactttcctcactactttaaatatatattttaagttttattaaaattttgtatagtataatattttcactgacagaaacagaatgaaaaacttgaaggacaaatagtaaaggtttttttattttttttctgagatggaatcttgctctgtcacccaggctggagtgcagtggcacgatctcggctcactgcaacctctgcctcctgggttcaagcgattctcctgcctcagccttcgagtagctgggattacaggtgcccaccactgtgcccagctaagttttgcatttttagtagagacggggtttccaggctggtctcgaactcctgacctcgtgatctgcctgcctcaacctcccaaagtgctgggattacaggcatgagccactgtgcctggcctagcaaatgttaatttaaacatagtttgatcttatttatacttcctcttaagctatcttttgtgactcaattaatgggtcatttgttgattaaatacagtattatctaggataataaaattttttttctataaattatgtatggtttgaaggcccaacccccagtacttgagaatgtgactgcatttggagatagcttctataaagaggtgattaagattaactgaagtaattagggtgggctcgaatccaatttgaccagtgtccttataagaagagaaaattagtacacacaagaggcatcaaagattgtatgtacagaaaaaaaaaccatgtaaggccccagtcagaagacagccatctacaagccaagtgggaaggtttcaagagaaaccaaacctgccaacactttgatctcagacttctagataccataacagaaaataaattgtttaggccactcagtctgtgatactatacttttgttttggcagccctactaaactaatacagcattgcagagaatgcagaagtgtaaagataagaaaccccaaaataattaagaaaatatgaaacatgaaggaaattagtacagattcttaggagaccataatctatctattttactaaaaatattttactatgtaactaatattttttggactagatcttacattctcaaggacaaattttaaatgcattaatacagtattgcaccttgttaaaactgagttaatggaatgcagtggccggataaattaagaaatttaattaaaaattaaatataaacttgagtaaaactcttaacatagaaagttgaatttaaccacaagattatgggtaccttattttttaaaagatgatttatgaaatctttcttgtgtttgcaaaattctttatgtatatgttcataagtgtttggccaggtgagtaggcaaaaaaaataaaaaataaaaaacacagaaaatcaatgaacaggagatggtggtttatggaagtcaaagagaactggattctagagccagctccagcaattattagttactgactcacactaccaaaatctttagttatcatttcacagagaaaaagaggactatttatatattagtctttttagtgttgctataacagaatacttgaggctggataatttataaagaaaagaggtttatttggcttatgattttaggtcttgtgagggactccctcatgctgcttcctccgtggcagaaagcagaagggtgcaaaaagatcagagggtaagggaggaagcaagagagagagaaaccaaggaagccagaccctttttgaacaaccagctctcatgagaaataacccattctcttaacagtgagaactcactcccccaaataaatgcattaatgtattcataagaggtctacccccatgatctgaacatcacataccaggcctcacttccaatactactacatcagggatcaaattttaacatgagttttcatggggagaaaccacatcaagctctatctatcatctatctatctatctatctatctatctatctatctatcatctatcatctatttacttacctatgtacttatatatgattataagaaacatgaggttaattataagaaattggctcatgtgattatggagccttgaaatacgaagatagaggcagcagcagatttgatgtctgatgagagccctcttttgctcttaaaaaaatggtttgcctaccactgccttctttctgtgtctgtatttcagaggaggagagacgtggtgtcctcatcctcttataaaggcatgaatctcatcatgggggccttgctctcatgatctcatttaaacctaattaacatccacaggctccacttccaaataacattatgctgaagattagggcttcaacatgtgaattagtgggtacacaatttggtccacagcattgggccctggtacaacaaattcatgtctttctcaaaagcaaaatacagtcatcccttgatatccaaggaggattggtcccaggacctctcgcagataccaaaacccagatgttcaagtttctaaaatggtgtaatatttgcatataacttgtgcatgtcctttcatatactttaaatcatctctagattacttataatacctaacacaatgtaagtgctgtgtaaatatttgctatactctattgtttagggggtaaatgacaagaaaactgaatctgcacatgttcagtacagatgcaattttttttcaaatgtgtttgattcacagttggttgaatctatggatgtggaacccacagatacagaaggctgactatatattcattccattttaacagccgcatgagccttaattcatttcagcatcaactctgaagtctaaaattcaaagcttcttctaagcatttttaaaatcagatatgggtgagactccaagcaaaaatccatgctgaaactaaatatccctccagctatgaaactgtgaaactagataaggtatgcaatttcaaaatacagatatgggacaggagtaggatagacatcctattccaaaggtaaaaatctgaagaaagaaatggataatttatctcaaggtagtccaaaacctagcaaggcaaatatcattaaatattaacatgttaatcctgtctggtttgatgctctgcctttcagaaccactggggcagcacttctgcctccatggctctgctggtcatgggccgtacccccaaggatttgtggggcctggtagctggcctgggttagtcaagatcatgtccctcactctttgagaccaaagaggcatccccaatgatctctgaattgcctttgggataattcttccattctcttgaagaatagcatatatttgtagcagaatggcaaaataattcagtcctaaaaatagaaatccaagagctttccttcatttcatcccatcactttccctttcagttcaaactggtagtgtgcctgctcatataatcctgtgtgtacgttttcctgcatatatcgcccatctaagcactttgtgtacatacttgtatagaaaatttaattgtgctagctttcatttgtatgagtttgctagtgcctcccttattaaaacttattgcagcttcacctctttctaagataattcaatagaaagccatggaacttctaacatttttgagtttgttttaaatcagaagcccacctctgaagttttgaaatagtgaatcaaaggggcttcaaactgttaatttatttttcttattttattctctcaacattctaattaaatgtatatgtaaacttgttcatctcaatcattgaggtaacaagatttttcttttattatctcttcattttattattattattactataaaagcagtagtggtggttacctgaattagctttggtacttggagtttctaagaaatgtgtctgaatacttcatttatatcctgtctaccctcttttgctattttccaaaatttgttaagttgctcacaaagtggctctcatatattgcttcatttaattcacatcctttaaaaatctgtaatatttcaaaatgtgctaatttccttcaaaagcttttgacccaccttaatggatttgatgatgaaaggggaaacactgcacatagcaagaaatggtatgaaaggaaaagcactggatatttcctgagtttggtaataactagtgcaatttatttgcaatccctatgtattaaaacagtttggctcatccaagaaggtactgcagttctctagaattaagtcctgtcatgaaaccgcttggactcatttaatgcttattgattttcataaacaaacactgaattgttgggtggttaagacaaaaacaatcgcacaaactgatatgctttctccagtatagatatggtttctccaatacagacacccactacttggaatgtcttcgtttcatggccttttcttctgatttaatactcacaaattatttcttcccagaataattttgctatcaaatacctaaaatcttaacagaaactgaattattttgttcattatactcgctttattatttatttgtcaattcctctataaaaccatgatttttccttcgtgtttctttctaagtacattgcaggtgtcagtacacttgcctttaaatacttcgtcatgaacaccatgagctagatctgaattttgtttagctttttcttttgagttaaaatatacatacaatgaattacactagacaaagtgtgcattcactgtcatttgacaattgcacacacctttataatccaaagacctatcaagcaggaggacttaagcaagtgcatcagtggccctctggaacagctctagcttactgtgtttcagactacatcggggaaggattaaggctctagcactgcagcaggaagttaaatgtctgcagtcacactgcccatgccaactgtggatcagatcttctggccgtggggtccaatgcattgcaaaggactggatcttgtgtacagtgtctctctccactttttgtacgtaagcactttagacttgaccttagtgtgcatgttttttgttttcagcaatcttgaatcatgtgctggtttcttctctgggtggcaattatctgcttttaactttggccacattcatgtcatgttctattctgcagcacattctgactatccagtgaatagggaaataagtagcataaataatcaactttgtacttctttataaagattattgtggatattcctaggtactttgaacattcatataaactttaaaatcagtttgccactttccgcccacacacacacacacacacacacacacacacacacagcttaatgtaatttagatcgtgtttgtcttatatctgtaagtcaattaggaaaacaaaattgccactatcatagattgtcttcaagtattagtaccttgaattttatgaaattcatttcctacatttaaactcacataaatcctctctacatcattgttgctattcgtgtttttgcataaggggattggttctagaaaaaaaaagaaagatgagaggatcttcaccctagaaaattcaacgttcacaaagactttccatcacatagtcagatctgtcattagaaaacttagtctcttattttccagtattggaaaaattaacatcatcttcttcttcatttttcttttatttatttattaaaattttttttattattatactttaagttctagggtacatgtgcacattgttgaagacagtgtggcaattcatcctcttcatttttcttcatcaccatcatcattgtcttctttataccattatatattttaaataaaattacagaaccaaaaacaaagtaaaaattaaaaaaaacttctacataggatgtcagaatcctaactactaaaatgaattaaaattgaacctattttcaatgtcttcacttaaaaaatatctttttttctgattataaattgaatttatatgtatttgaaaaaaatttttagaggaaggccttagaaagaaaatacaagtaacaattaaactcacaattccagggaaaaccaatgttaatatttgtgtgtacttcacagtaaactatataaaataaatgaataaaaatataggaatatttatagtaatgtacatacataaaagaatgctataccaacataattttttaaagttaaaattaggttagttatttttatcatgcttttacatttcaaaataaacaccaagtattttgatgtgtcagttaatatcctttgaaaatataatttatactaattacttttccatataaaaatgaaatatcattaatttatttacccaaagttgagaatctttacatatttttactattataaataatgctatgatatttttcccataaatatttgattaaattacttaatattactctggaataatttcttaaaaggaaactctggatcttgaccatattgccacattttctctgcagtgtggggcttgatttatcattctatattctgtattagaaggcacctgtctccacatcctcactgactgttaagtgacaccatgtttatattacaacaccttgataggtacaagaaaaaaaaatatggaccctacattcctggaagaaaaattcacagaaagagaatatacacagattaaaagacaataggattagttattaagaagatgaatacaataaagaggatgaagtgggtggaataattgtctcccagaaatgttcctgtcctaatccctgaaaccgacaaagattccaatttacatggtaaagtgaattaaggttgcagatggaatcaaggttgtgaatcagatgaccctaaaatagggagatttccctgtattataccgtgagtccaatgcaattccaaaggttcttataagcgaaggagggaaacagaagaggcagagtcaaaatgaagtgatatgagaatgatttgacctgctacctcaaaccacccttgaaaattgaaggaataagtctatgagccattaatgtgggtggcttctagaagctggaaaggaatgagaaacaggtttttcccttttaacctccaaaaagaaactcagtcctgctgacactttcgttttggccaatgaaactcattttagcctccagaactacagaactataaggtaatacatttgtgttgctttaagacactgagattgtggtaattttttacagcagccataggaaactaatagaaaagctaaaagaaaaataaacatgctatggtagtattaaaatctatattgttgccaaaacattccatgaaaatccctttcatagtgttatcttacgatccattttatttctgtggcatctgtagtaatgttgcctctttcatttctgatattgagtcttctttttttctttatctagctaacatttatgaattttgtttgtctttattttaaaaactgcttaatagtctattttaagctgataagttcaatagcacacagaaactctagaataatctctgcagtcacacacaggagctctaacaccctaccccacactttattttattgttgctgcaatttacatccattcatattgtgtctcttttaacatattttatttctttttttaatacttttgtcttttgacttttatactagaattaaaagtcattattactgtagtaatcatttcactatgtatatgtatatgaaaacatcatgttgcataccttaaatatgtacaataacatatttgtaatgaataaaaaataatagtcatttatacaccactattgcagtaatgcaatatctgtatctgtccctatacttacctttattgtcaagtttcatactttcttatgctatggtgttgctgtttagtatcccatcatttcaacttgaagaactccttttagcattttttctaagacaggtaatatactattggtgatgatctctctcagattttgtttattttaagtagtttttaatctctcctccactattaaaggccaggtatagtgttcttggttggcagtttcttttcttttagaactttgaatgtatcatcccactccctctggcctgcaaggtttctgctgaaaattcagatagtttcatggacattttcttttatatgacaagttacttttctctttatctcaaaatacactttgtttttgactttttacaatgtgattacaatgtgtctcaatgttgatttgtttgagttcatcttatttgggaacttttgggcttcatggatctgaatgtctattgccttcctcagatttgggaagtgttcagccattatttctttaaataggctttctggccccttctctcttctcctctgatacttccttaatgcttatattggtgtccttgaagaggtcctatcagtttcttaagttttctccactcatttttgttctttttactctactgactgaatcatttccaatgatatgttttcaagttcactgattgtttcttctgcttcgcctagtccattgctgaagctctctattaaataatttaattcagttattgcgttcctcagcttcaagatttctgttttggtactttaaaaatattttctatggctttgttgaaattctaacttttttcctgcatttttctcttgacctccataaacatctttatatcatattttgcattctaaatgaagtaaatcatataatgatgtttcattagggttggtttctgaagatttatctcttctttctttgtttggaacatctttgcctgtttctacgttttccttagttatctgtgttgatatttgcacattagacacagaaggtcatctctcagtctttacagactagccttgtataggaggaaacctccaccaaccagcaaagccagagattctagtccttctaataactctctctctccatgaaaagaagcaggtgtgatttttgtctactcctctgtgctgacctggggtgggaaactattgtatcaaccagtccaaactaccatttctattaatcttttatcccaggtgtctagactgtaccagacccatcagagatccaagagtggcaagtctcttaccagttctttgtgtagtcctggagaggttgggtgctgggctcatgatcaattcttttcttctctagaagaaagctgacacttgggatattttttctgcttgctctgtgctgagcaggagggagtatctatggtgtccaccagcactagcttccatctattttcttccctggtggctagactgtgataggcctctcagagctctaagactggtcagtaagatgccagttctttggagagccctggagaaatttgggtgttggatgcaccagtcaagtcttccacacccttcccaatcccaggagaaagctgagagctggaattttttgtctgctctctatgtactgagaagtagggaagatctatgctgtctaccagctcaagccccatctccattctcccacaggtgtctagactgtgccagacccattcgagctctaaaactagttagatagatgctagatcttcaggcagccattgaaaagttggagtgtcagatacacagatcagcactcttcctccacagcaggaagctgaaagctgagatttcttatctgcttactgtatgccaagaagttgggttatgggggggcagggtctgtggcatccaccagatgaaaccaccatctccatcctctgcagaaagctagattgtggtagaccagtcagagctccaactgacagacgtaattcgtgtataaagcccctttaaaaattttggagtactggacacaaatcaatctcttccaatgactgggtgaagctgggaactaggggttctctttctgattgtatggcagtacactggggacagggactccactgagaggatgttctgaatctccctaccaactttggtaactctgatttttcattttcccaggatgtggtagtcattcaattagcttcagaatttcttacaaagataatttgttcaaattgttgttgaaatatgttctggggagtaggacggtgcagaacttcccactctgccgttttgctgatgtcactctgtaggagatgcttgatcctatttaaactttctattttagaagatagttgcctttctatgtttagagtatttatattctggtgtgcttttgtgggctgagttccaaaaatgtttaattttgatagctctttcaatattattatactttactttgcttttttaattctgaaggggtttcagctcaatcattgctggtgccatctggggcagaaggccctttctaggccattcaagtcattgggccactttgacgcctgaagatggaaggaacaaaaacaacgaggctttggtcttcctatgtcatttgatagagggctaggaaatatcaagtttgatggataatacttctgtggctcattcaggctgcatttcactggccttattctacagcagggttgtatcagctaggtaggccttcactgatgcctctgaaggcagatcagttagctagttacctggttatcgaatgacggttaggttagtcatccagtgctgtgatgttgccaatatgggtggaatggacagcccaccagtgcactgaatgtggactgtgtttggtgggcctgccaagtctgaaatggccactgtgggtgaatcaacacacacatgtgtcctgactccctgactctaaagaaggggctggagcaactccccatgtctttgccgagcttttccattcttagtcatttggccagaaagtgaaagcttttctttagctattattgttattatttttgtctatgcctgttggaggtttggggttaaagatctgtctagcacccagtttgggatatacatgaaagataagaagaaactcagataactgaccttcctcaagtccaaaggtcactagtcagaatttttctttttattaaccatccttctattctctatgtccatgagttttcagagtctttttgttgttgtccattgacttgtttcagagtattaaattgtatttagaacgaaggataaggaaaaactgaaactacaaaactttgttccagagcatgcatttatcatagatgttgaataatgttcttctttaaaaacataataaagtgtaaacatattttgagtaatacttatttcactccaagaacaatcagcttcaagtcaaccattatttattacataaagaattaaaccaggcattatatgagacactaatatttgtgaaagatgcaaatgatgctcttgaggatcttcctgctgacaaggctagtgagaagaggaagttagcgaagaaacagaaaattaaataaatattgtgccatagaaaggtatatgataagaaccaaaaatttaaaataacataagaatggtttttaaaaatgtctcttagataatgttttcaactaatttatcatctgaaatggaatagaaaatctattaatgcttatgacaatttaacacgtgtaaattgaaactgtctcagaaattgaagatataagttcagcttacccttaaaaaattttgtttcaattattgtggaaatatttgcaaataattacatatttaaagaactgtatagtgaatcaatttcccaccgtttatattcaataactatctgtgtatggccaagttttattttctgtacactccctattcccttttccctatcaatatttcagagcaaattctaggcaattttttgagtcattccttgatgaaagcactaatcacttttatctcatgtttttttctctttctcctcttccccactggattctcttataagaagaatttctgtacactcatccacatgctgctttttgttttacttatagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagtatgtttctacttactcttcattgttttaaataatttgaacgtttattttttctgaaaaacttgacactttgtatttcctaaaaaagccatggcatatgtgtggcataccaatttttaacttgttgtctttcagcttccaaatcctttcttctttttcactctactttataggaaccgtatctctgctaaaccagacctcatcctatagagttttgcaacagggagaaagaataggaaattagaaatctgggagatctgttttcttcgtttatcagtatttcctgaataataggttttacactggtaacaatacttgattttaatctccccctactttttaaaactcactccagaaaaacttcattgtctgctgtctgctgtgttacactcagggttctggattccagttctttgagctctatgcaaatgtctcaaacttccagcactggctgagcaatacctattgttagaattctgagtgtgagatccatggggccagtcctaccatcttccaggttcagctaactccagtcttttccatttgctacttagcttcatgaatggaatcatttttttgcaattagtagttcatatttagtagccaattagtagcgtggtgtctaccttaacttgttctgttcttcaattgctgtttacccaattacttatatttaattatgtccctccaaaatcactcatgtggtttccctttttctgactaagctctttatagtactaatcttgatataaggatgaagcaggagtgagaaggcatcttatgctttattttttaaaatttacttttaattttcagggtttttttttatcattgcccttcactgtctctggaaaattacttaaacttatagacagtttacctcaaaataaggtgggataataataacagttctctttcaacttctgggttcctctggttataaaatgccatgaagcacagcactatccacagcagcaaagacatggactcaacctaggtgcccatcaatggtgaaatggtgtattagggttctctagagggacagaactcatggaatacacacacacacacacacacacacacacacacacagagagagagagagagagagagagagagagagagagagagaaaggggagtttattaagtattaactcacacaataacaaggttccgcaataggccatctacaggttgtggagcaaagaaagcccatccgagttccaaaactgaaggagttggagtctgatgtttgaacgcaggaagcatccagcataggagaaagatgtaggctgggaggctaggccagtctctcttttcacatttttctgcctgcatatattctagctgtgctggcagctgattagattgtggcaacccagattaagggtgggtctgcctttcccagcccactgactcaaatgttaatctcttttggcaacacccacacagacacacccaggatcaatactttgtatccttcaatccaatcaaattgacagtaataaccattgcaagtccaccccttgtcaacttgaacccatacacatctcttgagatcatgcataatcttcaaataaagacaataatacagtcataattatgcctaaaataatacaactatcctttgtacaactggaaacgcaccaatctccaatccaaatactattacataaaattaacaatacttaaatgctgatatgaagtcaataaatcttgtcacatgataaatgagaaaagaaataaaatgaagatattttcttagtacaagtgtatacatgcacaaaaacgttttcaacaaaagaaagaggaaatactcatgacaatttcagtcctcatttctgcagctggtcacgtggtcatggctggtattgatgactaccttctactacccattctgtattccctttgcctttggcaagcacctcagcaggcccttttatttttttttaatttccctggtggagtgacccaaaccttcattcctgtggggtctggtcatttgtagtcttgcctggattgggctgttgtagtttcccatttaccttaatcacagagcatggtaatactaagagacgccctaatggatctcctgttttccatgcatactcttccttacctccattgtggagtaatagactgatttcctcttaatagtctgggtaaatcaccccagccaacactgtaactcccttcttagcctgttgacttaaagtaggaggagcccaaagtgtccaggtggcgatcttcatttccagtttaatggaatcgttgttgtgtatcctggtggcagcattcctccctctggaacgaagacctctgggccagcagaacgtaatgtcatggaaacaggaagcaaaaattttgctagtggatcactatgggtaatggtgagtggtgtcacttccaccccttgattccttgagccatgaatcctgcctacaggagaaacagtaccatatatcggatgctgattcagagcacatacagccttgtggagaactttgtcccagtcatgaaaagtatagtcacctagttggcattgtaattgtgacttcaaaaggccattctaccattctatcaatccagctgcttcaggatgatggggaacacggtaagaccagtgaattccagaagcatgagcccactgctacacttctttagttgtaaagtaagtgccttggtctgaggcaatgctgtgtggaataccacgatggtggataaggcattctgtgagtccacagatggtagtctggcagaagcattgcatgcaggataggcaaatccatatccggagtgtctattccagtgagggcaaacctctactcttcccatgatggaagaggtccaatataatcaacatgccaccagggagctagctgattaccctgaagaatggtgccaaatagagggctcagttttggtctctgctgctggcaaattgggcacccagctgtggccttagccaaatcagccttggtgagtggaagtccatgttgctgagcccatgcataacctctgtccctaccaccatggccgttttgttcatgggcccattgggtgatgatggggtggctggggaaagaggctgggtggtgtccacagaaagagtcatcttatccacttgatcattaaaatcctcatctgctgaggtcacctgttggtgcactcacatggaatacaaatatcttcacagtttttgaccactcagtgagttccatccacatacctcttcccaaatttctttgtcaccgacttttcaatcatgcttctcccaagtcccagaccatccagccaaaccattggctacagcccgtgaattagtatataattgcacatctggccattcctccttctatgcagattgcacaaccaggtgcattgcttgaagttctgtgcactgggaatacttcccttcaggtctatgcttcagagatgtcctagaaagggtctgcagtgctagagctgtccactttcgggtgatgcctgcatatcatgaagaaccatctgtgaatcaggccctagtcttctcttcctctgtcaactgatcatagataactccccatgaggccattggtgcaggctggggaagagaaggcagggtggcaggagtggagaccatgggcatttgagccacttcctcttgtaacttacttgcgccttcaggacctgcttgagcccgatcacatacataccacttccattgataatggaatgctgctgtgcatgacctaatttatggctaaatgggtcagaaagcacccagttcatgaaaggcagttcaggtcacatggtgacttgatgacccatagtcaaacattcaatttccaccaaagcccagtagcaggccaagagctgtctctcaaaaggagagtagttatctgcagaagatggcagggccttgttccaaaatcctaggggcctctgctctgattcacctatgggggcctgccaaaggctgcgaacagcatccctatcagccactgacacctcaagcaccactggatctgtggggtcatatggcccaagtggcagaacagcttgaacagcagcttggatctcttgcagaaccttctcctgttctggatcccactcaaaacttgcagcttttcgggtcacttgataaatggcctggagtaacacacccaactgaggaatgtgatgcctccaaaatccaaataggcccactaggtgtggtgcctcttttttgattgtaggaggggccaaatgcagcaacctatccttcatcctggaaggattatctcgacagtcccaacatcattggacccctagaaattttactgaggtagaaggttcctgaattttagtcagattaatttcccatcctctggcatgcaaatatctcaccaataagtccagtgtgtttgctacttcttgctcactggctccaatcagcataatgtcaccaatgtgatggaccagtgtgatatcttgtggaagtgaaaagtgatcaaggtatctctgaataagattatgacacaaagctgtagaattgacataccccttaggtagaatagtaaaggtatattgtgagccttgccaactgaaggcaaatttcttctggtggggctttggacaggaatggagaaaacaaatttgccaattcaatggctgtgtatcaggtaccaggagataccaagaccagctcagccgaggagaccccagcccagcagcgctagaggaattgaagacaaagacacagaaatagagtgcaaagtgagaatcagggggctaacagccttcagagctgacagccatgaacagagtttgacccacatatttattgatagcaaggcagtgataagcattgcttctatagattatagattaactgaaagcattccttacgggaaacaaagctttcttagtgaggagaagagaaataagctttggctgattatctgcagcaaaaatatattgttaaagtacaggccactcctgctgttgtttgtggtttgagcagttttccactccgggtgggccaggtgttccttgccctgctccagtaaaccaacaacttctagcagtgtgtgtgatagccatcaagagcatgtcacattgctgcagaaatcctgtttctggccagtttctttaaggcccgtttgtgacaggcttagggattgttcccagcatgtctgcctttctgtttttgcaaagcaataaaggcaaaggcagctttttcacagtgggctacttcttgcagaatttaggatccgcatctgcagactacacaaagacaacaccaattaaaagcacaatcatcattgaaatcacagagcctccgagtgtcttggtccgttttaaccagttaatagctgctaatccatctgcagctccttcaaacacttcagttcctggcattagcgtcagatgtgcctgagaggcttgaaatacttgttccttcagttttgcaatatccaaagataaatttccagtatgaccctttaaatgtctcttaattatttcccactcatgctctgtttcattatacaaatgaggagtaatgcaaaaatcagaagtattccagtcacattgtaactgtattctatattctaaactacttactcgatctcctagccacattacaatttatcggagatcattgatttgattagctagtttcaggtctatattagtttgggaattccacagcagagtagaatttaaaaaaaaaaattttttttttttgtatttattgatcattcttgggtgtttctcggagagggggatgtggcagggtcataggataatagtggagagaaggtcagcagataaacacatgaacaaaggtctctggttttcctaggcagaggtccctgcggccttctgcagtgtttgtgtccctgggtacttgagattagggagtggtgatgactcttaacgagcatgctgccttcaagcatctgtttaacaaagcacatcttgcaccgcccttaatccatttaaccctgagttgacacagcacatgtttcagagagcacggggttgggggtaaggttatagattaacagcatcccaaggcagaagaatttttcttagtacagaacaaaatggagtctcctatgtctacttctttctacacagacacagtaacaatctgatctttctttcttttccccacatttcccccttttcttttcgacaaaactgccatcgtcatcatggcccgttctcgatggttgctgtctttttggagcagttgggtacacctccagaaatgctgtcacttcacacttggaagattgcacagcagccaggcagaggcgctcctcacctcccagacagggcggctgggaagaggcgctcctcacttcccagacgggaattccacagaagagtagaatttttctgccaattatttacatagtctgctgtttgtactgtggaatgctaagaaactccagctaccatggcagtagctgtgacagcaatcaatcacataatgattaaaattaaagtagcaatgaaacaccaagagcgcctcaaaatcttttgaagaatttcagtaataatatgcacagaaggagagacttccaaaggatgggaaattcttacaggtatccatactccttctcaggctcttaccgctaaaatagaatgatcagtattatacaaggaagaattcacacaagaagacaatatacattattaacaagtcacatgatgattagtgagatcaagttttaaatcacccactacaagcaggaaagaggcctcattatcagtctcgacatggttgcaactggggagtcttcggggtgcctcccaaatctcttcctcagcatctggctcatgataaggtttcaggtgtcttgatggtatccaaattggctgctagttttggcctggagaaacacaagcataacctctaccccatattattttacctatttcccaactttttgttattggatctctccaccaaaccggttgttctgcttctgtctttgctgctggtttctgtagatgctgttcagttgctgatagcatctggcctttagataggctcaaaaaatttaaagtcaataatgctagattcaattgcatatgtggagtcccatattcactgtttccccctttttgtttttgtaactactgttttagggagagattcattctttccacaatggcttgtccttgtgaattatatgggatgccagtaatgtgtttaatattccttacagagaaaaatgtagctagagcttggctagtatagcctgaggcattgtccgttttaactgaatctggaatgcccatgactgtgaagcatttcagaagatgccatttaacataggcagaagattcccatttggcaggagcccaaacaaactgagaaaatgtatctatacatatatgtacataagccaatttaccaaaggaaggaacataagtgatatccatttgccaaagagaattaagttccaatcctcgaggattaattcctcttgtaaaagatgaggaatgcaccatttggcaagttgggcatcactggataatagctttagctcatttctgggttatgctgtatctgtgtttgagaccagaggtgttaacatgggttaaattgtgaaagtgtttagcattagataatgcagtagcaactagacaatcagccatttgagtcgctgcagtcaaaggtcctggaagagatatatgagccctaatgtgagtgatgtaaatagggtacattgtactcctaactgctgtttgcaattgggtaagtaaagtcatcagttgctcatctgtgtagaatcgtagctgagcattttcaactaactgtgtagaatgaaccacatatgaagaatcagaaattacatcaacagacatctcaaaagcagtcagcacctcaattacagctaccagctccgctttttgagctgaagtataggatgtctggaaaactttgctttttgatccagaataagaagctttaccattactagattcatctgtaaaaacattttcagcaccttcaattggtttaaatttagttattctagggagaatccaatgagttaatttcaaatatggaaataattttgttttcagaaagtgattatcaagaacacctatgaaatcagctaaatgggcttgccaagtaagactatttataaaggcctgttgtatttgtgccttcgtaagagggacaataatttttccatggtcatattcatgtaatttaacaatttgagttctcccatttcctatcagagtagcaatttgatccaaataaggagttagagtctgtgaattagtatgtggatgaaaacgccattctaccaagtcctgctcttgaacaataacaccagtaggtgaatgctgagttggaaaaatcaataagtctaaagtcttttctggatctattctatttatttgagctttatgcacttgcttctcaatcagctgtaactctgcctgagcctcctttaattgctgagggctagtgagactaggatctcctataaggatagaaaatagattacttatggcataggtaggaatgcctagagcagattgtatccaattaatgtcccctagtaatttttgaaagtcatttaatgttttcagttgatccctatgtatggttactttctgtggcacaatggtagtgccatttactaaggtccccaagtaggagtaaggggtagtagtctgaattttgtcaagagctataattaaattggcatgagaaatcgagttttgcaagtgatcataacattagagtaatatttcccgagtgggggcagcacaaagaatattatctatataacgaataatgtaacaatttgaaaattttttatgagtaggttcaattgcttgtcctacataagtctgacaaattgttggactgtttaacatgccttgtggcaacattttccaatgaaaatgcttatcagattgcaggttgtttaccgcaggaattgtaaatgcaaaccgttcatagtcttgctcagctaagggatagtaaagaaacagtcttttaaatccatgactattaaaggccaattttttggaatcatagcaggagaaggcaatcctggctgcaaagcgcccatagattgtataactgaattaatggctctaagatctgtcaacattctccatttacctgatttttttttttttaaataacaaagactggagaatcccagggggaaaatgttggagctatgtgtcctttttctaattgttcagtaactaagtcctctaaagcctccagtttctctttactcagcggccattgttctgtccaaattggcttatctgttaaccattttaaagatataggttctggaggcttaacaatggctgccatcaaaaatgatatcctacaccttgatgaggattctgtccttctgcttgaagtggtttctttaacccttgtaaattttttcctaatcccataccagggacataccccatttcatgcatcatatgttgactttgagggctatatagttgttctggaattaacgcttgtgctccccattgctgtaataaatctcttccccataaatttataggtacagaagttataattggttgaatagttccaggttgtccatcgggcccttcacaatgcaaaatataactgctttgatatacttcaggggctttaccaactccaactatgttaaatcgaacgggtggaattggccacatggatggccagtgctgtagagaaatgattgaaatgtctgctcctgtatctaccaatgctttaatttttttccctgaatagttatttcacaggtaggacgtttatcagtaatttgattcacccaataagctgctttgccttgtttattagtgcttccaaatcctcctgtttgtttagtttcacttttccccatttccacatatggcacaatcaggagctgtgatatgcgctctcctggccctgctttccagggaacagaagtagatataacaatttgaatttccccattgtaatctgaatcaatgactcctgtttgcacttgtaccccttttaaatttaaactagacctgcttagaagtaatcctactgtccctgctggcaagggtccacagactcctgttggcactttttgaggaggttccccaggcagaaggctcacagcttttgtacagcataaatctactgcagcactaccagttgtggtgggggacaggcattgtacaggggtgagggaatggcctgagctgggaatgccccagtttgaaccggggcctgggacaggcccctcatggcatttcctgaaattgggttcccatctttatcaaacttacagtgacactgattagcctagtgttttccttttctacattttggacatatttcagactcagcagttttcttttttcccccaactggcggcctgacttgctgattttttctacattcttttttggtatgaccatgcttcccacagttaaaacaagctccaggaaatggggtatttcctttacccaccctcagtcctgccattgcctgggctagcagagtagccttaatgcagattacctccaaaaccatcacaagctttaatatagtcaactaaatgtgcttttgctgtaataggtcgcagagtggcttggcactcaggattggcattgtcgaaagctaataaccgcaacactatatgctgagcagctgaatctgcaatcacctttttaagagactcctgtaactgagctataaaatccgcatacggttcttttggtccctgtttgacagcactagaggaagggtattgttctcctcctgaagtgatttttttcccaagctctaatgcacactgctctaagctgctctatggcatcatcctgcatgaccacttgtgcatctaaaccagcccagccgctgacccccaaaagttggtctgcagttatattaatttgaggttgggcctggacattgtgagcagcctgagtggaaccttcctctgcccaccaagttttaaattgtaagaactgagcaggagttagacaagctcaagtaagagcaccccagtcagtaggagtcatctgactgaagacagcaacattctttaacagtctcattacaaaaggagaacctggtccatattgattaatagcttgtttaaattatttaagtattttaaaaggaaaaggctcaaatgtagctataatattcccctgttgatcaggtctatgtattctaacagggaactgtcaagcatctatatcaccctctcgtctagcttgctggattcctgcctgaatagaactgagagtggtcgcttgaggcgctgctcgaacagtcactagggcaactacttgttgcccagtgtcctctggaaaagaaagatctggagggtcaggccactccttttcttcaaaataatgagggtgtgcagaggagtagggacaaacctctccctcctttaccgctttagttggcaagcaaacctgctctggtacttcattatactctccttcttcctctgattccttctcctcatcatctgtgtggaaaggctccaaggctgaacgaatcagagcccatactgaccagacagttataggaatatcctcagcaccatccttatatgcctttttcagtgtgctgcctacattttcccagacctctacattcatagttcctcagtccagaaaccaggggcaatatttctctactgcactaaaaagctgtgtaagtcagctagtgataactttcactcccccttttctgaggagcttccaaagcagactcaaataagccttgtgcctgctcaacccttgtcccattgttaccctggtgcttctgagttcctcttcttacttaccacggagattgcttaagagtacttgggtgtcctccagcatagttccacgttctccaaccatcactctggcgatgcttcaacccgggttcaggcccctacgttggacgccacttaccgagacaagctcggttgtggagaccccaacccagtggtgctagaggaattgaagccaaagacacagaaatagagtgcaaagtgagaatcggggctaacagccttcagagctgacagccacgaacagagtttgacccacatatttattgacagcaagacagtgataagcattgcttctatagattatagattaactaaaagtattccttacaggaaacaaagctttcttagtgaggagtagagaaacaggctctggctgattatctgcagcaaaaatatattgttaaggtacaggctgctcctgccattatttgtagtttgagcagttttccgctccgggcgggccaggtgttccttgccctgctgcagtaaaccaacaacttctagcagtatgtgtgatagccaccacgagcttgtcacattgctgcagaaatcctgtttatggccagtttctttaaggcctgcttatgacaggcttagggcttgttcccagcaaggagatgttttaattttctcaagcaatgaaaccacatttggtacagcagctgcagttggaatcaccacttggttaagcttaccataatccactctcattctccaagatccatctgtcttctgtacaggacaaataggagagttgaatggggatgtgttgggaatcaccacccctgcgactttcaagtccttgatggtggcactaatctccacaatccctacagcgatgcgttactgtttttgttttactatttttccaggtagaagctctaaagccttccatttggcctttccaactataatagaacttaccctaccagtcagggagtcaatgtgggggctctgccagctgctaagtatgtctatgtcaattgtgcattctggcactggggaaatgaccacaggatgagtctggtgacccactggacccactgtaagttggacctgagctaaaactctattaattacctggcttccatgagcacttactttaactggaggaccacagtgaagtttgtggaccccttagaatcaacgtcaactcagagccagtgtccagtagtcctcaaaatgtctgaactctttccattctacaatgcacagttaccctggtaaagggctgaaggtctccttgggaaatgattggagaaagattcactgcaataattgtcagtaatgtagtgggatctttcctcaaggggacccagactccccttcattcaaggggttctgggtctgtaaacaggaaccccaagtctggaaattgattgaggccatgattctctgtttttataattcaaattactctttcatcccttccacctagaagttttttgcttatataaattaagtaggaatgcagtaagcttcctatcaatttcacttctaggaacaccattgttaattagccaatgctagagctctacacaagtcagactattctgattgctgttttgtctctgctgtctattatggtagctatgcccacattggctatgatggttgagtgctgccttttggcccctggcacctcgggatccatttattcccattgtatttaaattttgtagttgagtgactgcagttcccactgttagatctgacatacagaaaagagcaattacagggcacttcaaagatgcaggtgctgtcctcacaaatctatttcacaaggcatcagtcaagggtatatctcctggatcctgccagctgggatgagtagatctaaagtgactaatccactccaccatctcaatctccctaagcctttggatcccttcctgcatattaaaccaaggcagatcaggcatttccagcttgctcacagtgggtgatcttttaatccgtatttcagctaaccaagcaaataaactattagaatttttttaactccccaagctgcaacattaaatgtggagtcctaacttagtgggcccaaattaataaatgcagcctgatccaactctatgttccttccaacattatttcacacccttaatatccattcccatgcctgttctccaggtttctgtttatataaattagagaactcaagtgggtctttttgagtatagcacacctcctcatgggtcacactctaacctcacctctaggggtccttcaggactttagtctagttataggtctagaagcaaacaggagtgttggaagtggctcctgaggagaatcaacattatcttgcttggcaactgcctcagaggaggccaccactgttgcctcagtcagcacagggtttatctcctcagacaaaggtgaaaaagctgatgccagcacgggttggagaggggatgttgccactactgaggatggggaagctgtttcttatgacaaaaagggttcatcagagtttacactcagtgttcacagcttcaacagggtcctcctacacgttcttattccaagttgcaaggtcccattcttttctaatcaatgccctcactttaacagtagacacctggtgaggctatgcatgcacccttcattgcaggtcagccacttgcatgataagaacttgtgtctgttattccataattgcagctctttccctactgaagctgggagatagaatctctgagttcatcattttctttcatcactttgtccactgaacttaggagcaaccaactaacatcattatttccttggttctccacatatggtcaaagttattgtgtcactaaattccttgcctctcacgagtgatgaatcaggagtgccacatgcatttattttgcataacgctctaaacagttcatgtcaagaactatcagtgttctccctactattagacgtaaagtccttagcatttttgggtctaatcgtgttaagcagccaagtccagaaacctccaaaccaatgaaagaactccatccttaatattatgttcttctagaaccacttctggtaccaaaatctatattagtcagggttctctagaggaacagaactaatggaatatatattccactttatatgtatatgtacatttctatatatatctcatacatatgtaacccatgtatatgggagtttattaagtattaaagcgtacattcacaaggtcccacaataggcagtctggaggttgaggaacaaagagagccagtctgaattccaaaactgaagaacttgggagtccagtgttcaagggcagaaagcattcagcatgggagaaagatgtaggctaggaggctaaaccagtctctcttttcacatttttctgcttgcttatattccagccatgctgccaactgattagattgtgcccacccagattaagggtggttctgcctttcccaacctgattcaaatgttaatctcctttggcaacagtcttacagacacacccaggatcaatactttgtatccttcaatctaatcaagttgacacttggtattaaccatcacaaatggataaagaaaatgttttgaatatgccccatggaataatatgcagccacataaaataacgaggtcatgtcatttgcagccacatggatgcagttgaaggccattattctatgtgaatttttacaaaaaaagaaaaccaaatactgcatgttatcacttataagtgggagctaaacactgggtacacacagacacaaatggagaacaagacatgggactagaaggggaaggagtgaggaagaaaggcaggagttgaaaaactacctattgggtattatactcactacctgtgtgacaggatcagtcatatcccaaatctcagcatcatgcaatgtagccaagtcataaacctgcacgtgtaccccttgaatctaaaatgaaagatatacataaataaataaataaggtacttatattttaggtagactgtagtaactctagaaaagcaagtgattcttctaggggaaaaactataccatgccaaatcaattaaaaaattattttaaatggatgaaggaggatttaaatgaaaagcagaaggcgccataattgcagagaagggaaaacaattctgaactgtcagcactttctttccttggaacatatgatgtttctgaatacaagttaaatatcagtcttggccaacccagttagagttcctctattgagaaaagagaaacctgaagaccccttagtgcctagaaaagattagattgataaattttaaattaagggatatcaaactcagtatcagtttttcttatgccacatttgttgagtttacatcctttgagggaggctgaggaggcagggtgaagctcttaaggcagaaatttctataatcctgttgtacttgggaaacaaagatcgaatggaaagaaggcttgtctcaagcacatgtgctgcctcccctttaaaacatttacctggttttgaataagcttgggacataggctagaggactgagatttgaagctctgagtaccagaaatcaatcatttactgtatttcaaagctgagaaaatagagttattctggctcttgagagaaattctgtagagtatctgagtcttactaaaactacacttttttgcctaatttaatttaaaatgtgctgaagttgtcagttactcagccctttttcaaaacagaagatggaaacttcctaagtcgaaagcaataccacctaaagcttctactgctttattaaatagaacataaagcatacaataaaaactgcacatagcaaaagcaaaaagttatggacaataacacaaagaaaaaacaacaaagatagaaaaaagaagccagaagctaagagatgatctatagagtcaaaaaggtgataacacacacacaaaaatcccactgttagagaaaatgaaagaaaaatgaacaaattacatgagggaagatagattcatttcaccagaaaatctgattctatagatttcacttgctatgtatatatttgataacaaaatatgtaaagaaatcagtaaatcatttgaattataggcctcatagttaaaaatactggattagttaactagaagaagagataatgaaaaacatctcaactgacagaacaaaacatttaaaaaatagtataagtaataattacaccatattaaaaagcctaaaacccataaaatagggaccaatttgtggaaaacaaagagaattgaataaaagttatgtaaaaacatacaatgcctgagaattttctaaaagtatggaatgatatcatcccattcaagcagctcactgaattccaacaggataaacacaaagaaaacacacctggtcatagtaagactgttgaaaaccagagacaccgagaaatcttataaacagccatagaaagaaggcctatattttaaaagacagcatgataagattgatgggtggcctcaaaaaatgaagtgcagaagacaacggaataaaaattgtatgccataaatataaactattgacctagttacttgttcttcaggtagagtaagtaactaggtcagcagttatatttaagagcaagacatcatcaggaaatgtgaatgtgaagatggcaatgaagtacacaaggtagagtaaatttgtgggtatatataataaaaattaactgcaaaaatcaatattaataatatcttatagattctaaaacatatgcaaaacaaaaatgcaaaataccacaaaagttgggaggcatgtaagtacacaaaaggttctaagtttccagtagtaataagaaatggtgaattaatgatatatattatattatattatattaatgtgaggatgcatgattcaatttctagtgggaccattaaaataataaaaaatataaatataagacacagaaaaattataataaatatttgatgactataaatacaggcaagaaagaagggaagcaaacaagacatttgtaaaaataagcaaacataactggtagatataagacctatgtaaaatagactaaataaagcaaacaattttgagatatttcacaatgaaataagtgtgctagcattttgctgcttataagacatgtaattttaaaataacaacacagagcatgaaagtgtgtgaaaatttttatgccttgcaaattttaaccataagaagatggaattctactaatattagataattaaggatttatggaaagaagcaagaatagaaataagaaaatatgttgcaacatatcattccccctcatccagtttcactttctgtggttttgctttctgtgatttcagttacccaccgttaaccaagtgaagaaagatgagtacattgtaagaagatattttgtgagagagagggaaagagaccacagtcacataatttttattgcagcatattgttaaaatgttctattttattattagttgttattgttaatctgtcagtgtgataacttataaattaaaacaatcatacatacagggaaaaaacatagtatatacaggggtccatactttccccaattcaggcacccactggggcttttggaacatatcccatgtggataaactgggtctactgtatttatctgcaaacataactttaacatatatggggaaaatttgaaaatagacaaattcacaatcatagagattaacccacttcctcaacagtggttgaagaagcagagaaaaatctcttaagaagagaagatcttcaatatataattgtaaacttgatcatcttatatgtatagtacaaaaagacttcaaaatgttcacggaaaatggaataaaaagataaaaagtataaactttatttctcaacataagctctatcaaggtcaagacagttttgtaagtgatgatagcagccatgtagtccatccctgaagaacagaaggtcctgagattttaaccatgtcaaggcaatcttttttacattattaactgaaggaaaaataggtgtcctttaaatattttgttaagattaggaaacaaaaacaagtcagaagaagtcatatcaggactataaggtagatgcctaactttcttactgaaactgtcagaaaattgctcttgtttgataagatgagtaaaagcactgtcatggtggagaaggactctctggtgaagttcttctggatgttgttttctgctaaagtcttggctaacactctcataataagcagatgttattgttctttggccctacagaaggtcaacaaggaaaatgacttgagtaacccaaaaaaactgttgccatggcctttgctcttgaccaatctgcttttgctttgacaggatcacttccacttcttggtagccagtgatttgtgctttgtcttcaggatcacactggtaaaactgttcatcttctgttacaattcttcaaaaaaatgcttcaggttcttcattccttttgtttaaaatttccattggaatttctgctcttgtctgcagctcatctgggtgcaatggttttggcagccattgactggagtgtaaaatttcctcagttttaatgtttgagtcagatttgcataaggtgcaccaaacgagacatctatagtgctcgtcattttttctgctgttaatcattggtacttttcaattagggcatggacaagatgagttttttttttttttttttttttccatgcaaactgatgtggatggtctgctgctgtgggcttcatctgcaatatcatcttttcccttcttaaaatacatttgtccacttgtaaactgctgatttatttgagacatcatccccataaacttttcacaaagcatcaattatttcaccgtttttacactcaagcttcacaataaattggaagtttgttcttgctttaattttatcagaattcatgttgctctgatagaggctcttttcataccgatgtcttagtgcttgaaactagatcctcttaaggcatgttctaacaagttaatatgagtgtattttggtgcaaaaaatcttgaaatccatgtgtagttttttcaaaatacacattttaatgaactttttgaagacccttaacatgtgtgtgtgttcacagttgtgaacttgattatatgtaatatatcagtgtgccccaaactgacaaaactcactttagttcaacttcatatggtctgtttaatgcaataaacaatgtatttagccaaaatatgtctcaataagttttgtaagtttgaaatgatgaacaatgttttttctatctacaataagattaagtggtaagtcaacagcattaaagataatgcttccaattccttggaaatgacagattccatttctaattaatgtataggtaaagaagaaatcagaatggaaaccataattttttaactaaggtataagtatgcacaacatatggaaacaccataggattaaactaaagcagtggtttaaggaaaatgtatagccatatatatactttaaaaaaatactgaaaaaataccaatgatttaacttttcttgtcgagaagtcaggaaaataacatattaagtctgagaaaattagaaatatagccataataaaactaggagaagaaacaacaaaatatgaaacaaatgcaaaatattgaaaataaatgaaagcaaaatttaatcaaatacactttgaaacataaaagtttaaaaacttatgaaaacatgagctaaaacaatagcagaaatgaaaagagaacaccataacacagcctatacaatttttggaaggaacaacatttagcaaataaatttgacaattttgataaagaagtttattgaacaaaccaagatactagccgacattaacaataaacgttaaagacactaaagaatgagcattacaaagaattagccagtctcaggtaagtgaatttttccaaaaataaagaaatgtgcatcatttttaaaaacttttattttaatgtccagggcaaaaatgcagatttgttacacaggtaaacttgtgttacgggggtttgttgtacagattatttcatcacccaggtattaagcctagtacctattagttgtttttcctgatcttctctctcttccctcccttcatcctcaagtcgtccccagtgtctgttgttcccctccttgtgtccatgtgttttcatcattttgctcctacttataaatgagaacatgcagtatttggttttctgttcctgtgttagttgcaaagggtaatggcctccagctccaaccatggccctgcaaaggacatgatctcattttttttaatggcttcatagtattccataatgcatatgcactgcattttctttatccaatctatcattgatgggcatttgggttgattccatgtcttgctattgtgaatattgctgcaatgaggatacatgtgcatgtatctttgtaataggataattatattcctttgggaatatacccagtaacgggactgctgggtcaaatggtatttctgtctttaggtctttcaagaatcgccacactgccttccacaatagctgaactaacttacactcccaccaacagtgtataagcattccttttcctccataaccttgtcagtatccgttattttctgacctttcaaataatagccattctgactggcatgagatggtgactcattgtggttttaacttgtatttctgtaatgatcagtgacgttgagctttttttcatatgcttgttggccacatgtatgtcatcttttgaagtgtctgttcatgtcctttgcacacttttttatgtttttttcttgtaaatttatttaagttccttataggtgctgtatagcagaccttcatcaggtgcatagtttgcaaaacatttctcacattctgtaggctgtctgtttgttctgttgatactttctttttgctgtgcagaagctctttagtttaattagattccatttgtcaatttttacttttgttgcagttgcttttggcatcttcatcatgaaatctttgcctgtgtctatgtgctgaatggtattgattaagctgtcttccgaggtttttatagttttgggtcttacatttacgtacttaatccatctgaagttaatttttgtatatggtgtaaggaagggatccagtttcaaccttctgcatatggctagccagtttctcccagcaccatttattgaatagggaatcctgccaaagatcaaatagttgtaagtgcatggtcttactactgagttctctattctgttccattggtctatgtgtctgtttttatactagttcatggtgtttaggttactgtagtatagtttgtggtcaggtagtgtgatgcctccaggtttgttctttttgcttaggattgccttgactattcgggctctttttatttttggctctatatgaattttaaaatagttttctctagttctgtgaagaatgtcaatagtagtttaataggaataatactatttttaaaagcaccccaaacccaaagtacttaggtagaaatcttaaaaatataaatatattcagaatctatatgcagaaataaaccaaatgttgattactgaaatcaaatatctaagcacatagagatatagttcatattcattgatcataagattcactattgttaaaatgtcagttcttcccaacatgatctacagattcattgttttctcagccaaaaatcacatcaaggtttctagagatacaaactgatcctaaggagtactcagaaaataaaaaacctaaacaaccaccaaacatacttgtattactgaagtcagaattacttattttaatattatatatcattaataaattttttgttatagttaatatttttgtctaacttttatattagagttaacattaatttatgcaccaacattagtgtcactactgtgtgtctatatattacatttactggtaaaatacccttttatatgcaaaatcattagcataattttgttcccattttaaaaactctcaagtttttctcgtaaggaaggtctggtaacgattctgtcggtgtttgtttggcagaagattttacctctccttcattttaaaagattgttttgctgggtatagtgtttatgattggcagtttgtttcttttcattaagtactttgtatagattatcccactctctcttgaactgcaagatttctcctgagaaatcagttgataatctcacagaggtttgcatattacaaattgcttttctcttgctactttcaaaattctgtctgcttttgacttttgccaacttaattgtaatgtgtcttggtgtaaacatttttatgttcaacatatgtggaatcatttgggcttcttggatctttgatcttctaagatgtccgttttcttctccagattaggtaagttttcagtcattatttattttaataaacttcctgcccctttgtattctctgggtaaacttctattatgcatatattgcatcacttaataatgtcacataactccacttccttctcctttctattctctggggaaacttctattatgcatatattgcttcacttgataatggcacatatatcccataggctttcttcactatttttcattcttttcttctcttttctcttctgactatataatgtcaaatgacgttgcttttagttcactatttttttcttctgcttgactgagtctactgttgaaactctttattgcactttctattacagcacgtgtgtgtgtgtgtgtgtgtgtgtgtgtgtgtgtgtgtgtgtgttgagaaagggtcttgctctgttacccaggctggaatgcagtggtataatcatggctcattgcagccatgacctcctggattcaagcgatcctccaacctcagcctcctgagtagctggaaacacaggtatgcactgccatgcccacctaattttttaaaaaatttggtagagacagagtctcactatgtttcccaggctattaactgtatgaactccaaaaacgggctcttttatgatttttaactcttttttaaacctctaattttgtttatgtgttgttgtgttgaaattgctgatttgtctttttgtgttatagcttgctgagcttctttaaagcaataattttgaattatttttggcaactcagatctccatttctttatggtttattagcagaaatttgtgttcctttggtattgtatgaatacttttttgtgttccttgtagccttgtcttagtgtttgatcatctgaagaaggtggctcctcttccagactttacagactagctttagcagaaaaaagccttaacctgtaaaaaggcttgagggcaacaactttatgggttttgtggtggttccaggtgcagaggggcatgacaatgctggtcctgtgggagaacatgggagctatttccaggggttgcacagagatgtcagttggcggggttgggttaaggcccagggctatgaaaacagggaggtattatggcataggctccacatggctccagcagaatctagtcggagacagtctcagacggagatgaagaacttgttgggaactggagcaaaggtgaccctttttatgttttagcaaagagactggtggcattttattcctacccttcagaattgtggaactttgaacttggaaaagatcatttagggtatccagcagaagaaatttcttagcagcaaagtgttcaagagctgacttgggtgctgttacaggcattcagttttaaaagggaagcagagcataaaagtttggagagtttgcaccctgacaatgtgataaaaaaggaaatcccattttctgaggaaaaatttaagctgactgcagaaatttgcataacaaggagctgaatcttaatcaccaaaacaacaagaaaaatgtctccagggcatgttagagacctacacagcagcccctcccatcacaggcccagaggactaagagaaaaaaatggcatcattggttgggcctagagtccctctgctgtttgcagtataagcatttggtgctctgcttcccatctgctccagccatggctaaaaggggtgaaagtagagctcaggccatggcttacaggcaacaaaatgaagaaaagatagcctttccaacaaatggtgctgaaaaaaaatatatacatgccaaaaatgaatctagatgtagaccacacacttttcacagaaataaactcaaaattgatcatatagctaaatgtaaaataaaaaattatacaactaatacataaggtaggagaaaatctagataaatttgagcttgattataactttttagatataacagcaaggacacaattcttgaaagaaagaattgatagctggacttcattaaaagtaaaaatttcttcttttataaatgcactgtcaagagaatgaaaagagaagacagaatgggataaaatattttcaaaagatgtttctgacaaagtatcgttattaaaaaatagagaaataactcttaaaactcaaaaataagaaaacaattgattaaaaatatgccaaagactttagcagacaactgatgaagaagatatacagatggcaaacaaacatgtatgaaaagatgttccacatactatatcatcagtgaaacgtaaattaatacaacagtaacataccatattacatattacgatggccgaaatctgaaatgctgatgacatcaaatgttagtgatggtgtagagcatgatagactctcattgatttttggttaaattcataatattaaaaaactattgcaatacatttgtcagtttcttaaaaatgtaagcttattcttccatatgatcagcaagtgcactccttagaatttattcaaaggaggtgaaagcttatgtccaaacaaacatctgcatgtggatattatatcagttttattcataattgccaaaacttagaagatgtccctaagtaggtgaacagctaaataaggtgtagcatatccagacaatgtagtattattcagctattaaaagaatgaaatatggcctggcgcggtggctcatgcctgtaatcccagcactttgggaggcagaggcgggcggatcatgaggtcaggagatcgagaccatcctggctaacacagtgaaaccccgcctctactaaaaatacaaaaaattagccgggcgtggtggcgggcgcctgtaatcccagctactcgggaggctgaggcaggagaatggcgtgaatccgggaggcggagcttgcagtaagccgagatcgcgccactgcactccagcctgggcgacagagcgagactccgtctcaaaaaaaaaaaaaaaaaaagaatgaaatatcaagctacacaaaaatacgtgaaggaaatttaaatgcataagatttttatgaaacttaaatgcataatcctttgctaagtaaaggaaccaattttgaaaagatcacatactgttttaatgcaaatacaacagctaaaattgaaaaaaactatggagacattgaaagggtcagtggttttcaggtgttggtggggaaggaggaataaacagaacagcacagaggatttttagagctgcgaaaggactttctgtaatactacaatgttggatatatgtcattatgtatttgtccaaacccatagaatgtacatcaagagtgaaccctaatataaatgatgattttggggtgataatgtgtcaatatagattcatcaattgtaacaaatataccactttggagagaaatgttgataagatgtgtgcatgtatgtgagaaggagctatttggattatctctctaccttcccctcaattgtgctgagaacctaaaactgctccaaatattatagtctattaaaaaaattcaacaccaaatttgaattgttgaagccagagtatggacttaagtagtttgtgtttatgacatatgttatctatatattccttatacaaacatacatgccactttctcatgtgaaatagtatatcttcctcctcttcatcaccttctcaaccacacttggatctgacctggctttcctccttgcttgagtaatataacttggcaaatttgacattctggtacttctgaagctaaatcataagaagactttcaagtgtctggctagaccaaccagaatgtttgctcctggaacacggtaatgtaaggagaaactgctacagaggtattatgtagcctctctaatacacaggcccaaccaaacccagacttctggccatcttgctcaagtcatagactgaataaaagtacctcagaccctcaacatcagccaaactaccagctgaataccaccagatgaacattggttgacatcacatatgaaaaacttgcccagccaaactctgccggaattcctggcctataaatttgtgagaaatcataacataaattttgttataagtcactaagttagactaattttttataggaaaataagtaacctgtaacatattttgttcagtaatctttcctctgggcaaacttctctttgtttacccacccagagacagagaagtctccagttctactttaatatataaacatttcaagaaaaggagcctctgtggcgtatcttggaggtaatcaatatgaattttatctgagtattaacaaaaaatgaaaagagctttgttgaaaatgcttctgcttcatagtgatgtcttagggattggaaccttcctgttacaaaaataaacaaacaaaaaatccccaactctgtaagctattttgtgtctaagcatggaggtatactcccttgattgttggccaaaatatccctaagattcgctccaccaaaatatactctcggtttctgactagacaattatatatgtctttgagttatttttgacatgtatcaggaggtttcactgagatacttaaaataaaaggtgctgttgaaacaaatacttgacactcctagaacatttaagcatttagctcattatccttaattccttctaaaagtgctaagtgtttcttataaaataatatttttggtctgattttgatttacacactgataattatgtcttccttaatcagcatgtgttctggtttttaatttcatggtatattcatttaaagatttctgttaggtgacagtctattttctttcaagtggcagaggactacaaatttggatttttcttatttactttattagttggattccaaagtttaatgatatccaaagttttagaattgattagtttattcactttccaattatagagccatctgtctttgtctggtgttacatgaaactatgatttttttaatccccaaaatggttgttttctttatacctctcaaatccacccattttgtctttaataattatggcaccagatagttaacaacatccacagaattggaattcctacaccaaagatgatgtttgtataaaaatgtccccatatgtgaaattttgaatctcttataatgatattcttttgaattgtgtgtcagaagaaacaaaattccagcagaaggtgttcagcttttttaaaaattaacatgcaaagcaactattgggtagcactattatctcttcaaacctctttaaataatactacagaaagcagagaaagggaacctattttctaaaatggacaatagttattgatgtattaaaaaattatcccaaatctagtgacttaaaataacacatatttatctcagaatttcagtgaatcaggcatctgaccacagcttagttagatcttttactcagggatctcacaagtctgtaatgaagaggttggccagactgtgttctcatctggaggctcaactgagattgaatccatttccaagctcattcagtcttagaacaattcattttcttgcaactttatgtctgacagtcctggcttattactgtccgttggctgggagcctctcactgtgttctctgccaactggaaaaataactatccttgctggattcataaggacttttataaactttcatattttaccagtaacactcctaacactccactgaaggatccagtagtgttaattatactgttattttgttctttagtcaatattctaaataaaaaacaatattttttgttccacttttaaggcttgctactttataacaacttgcccaaggttaattaaaaattttgtttggggagtacaagctaatttttttgaaaaacgtatttgcataacttttctatttctggagtaaattaatacatttaactatgtgatttcctgtaatttcaggaagataactgttttgcctggcttatagaaactataagccctatatttatagatttaaataaaggaaactcaaggatttctaggaaaagtcttccagttatattttatgctactcctataactccagcagagaaagctgcttaagctttcataatgctactggcctttgttactgaattataaaataagaagcaaataactaatgggaagtttacttattctaagtaacataaaataaaatatttcagaggtaattttactttacgagttaatgcaaccttcctgatcaagataataaatggaaaaattgtacctgttaaatagctggattataaaactatattcactcactctctctctcattttatctacatatagaaataaaattaacatgatattctagctgattcaaattttgtttttctcttcactttaacatctaataaatttagttatcttattcacataaggatttttttttctttttttccttattgtgataatacttaatctgagatcaacctatgctcttcacgagttaagggcacaatacagtatttaccataggcataatgttgtatacctaatctctggaacttattcaccttgcataaccgaaacaatgaacagtgagtctccatttccttctccccctacctcctaacaactaccaatctaccctctgtgtctgagtttgactaatttaaataactgaaatatcatgcaatatttgtcattctgagactggctaattttgcttagcataatgttcacacgttttgtccatgttgttacatattatggaatgtccaatttaaggctgaataatattccattgtaggtatatgacacattttacttattcattcatgtattaatcgacatttaggttgttgattccccttcttggttattgtgaatagtgctgcagtgacagagtgctaacatctctttgagaccgtgatttcaattcttctgaacaaatacccagaagtgagattgctggatcatatgatagttgcatgtttaatgttctgaataacctccatactattttccatagttgctgcaccattttacatttgcaacaacattatacaagcattccagtttctccacacccttggcaacatttatatcattatagtcttattttataatagccatcctaacccatgtgcagtgatacttcattatggttttgatttgcttttccctgatgaattgtgatgtttaaaatcttttcatgtgtctgttgaccttctgtatgtcttttttgaagaaatgtctatggaatccctttgtgcattttttaattgggttgcttttctattgagttttgtgatttctttgtatggtttaaatattaaccctttatcaggtctgtggcttgcaaatatttattcctattccttaggctgcctttaaactctgttgtttcctttgctgtgcagaagctttttaggttgatgtagtctctcttcctatttttgcatttgtttcctgtgctttttgtgtcatatccaagaaatcattgtaacaagcactttcaagaaggtttccctctgttttgttctaaaagttttacagtttctggtcttaggcatttgtctttcatctgtactgagttgattttgtgtatagtgtaagaaaaggatccaaattcatctttttgcatataaatatagttttcataacaccatttgttgaaaaaccccaatgctttcctcattgtgtagtattggtgcccttgtcaaagatcggttgactgtacatgtatgggcttatttctggactctccactctatttcattggtgaatatgtctatcttatgccactaccaaattgacttaattgctgtaatttgtgttatattttgaaatcagaaaatgtaatgcctctggctttgttgttcttgctcaagattactttggctatttggaatcttttgtaggtccctatgatttcttggattttttttctatttctgtaaaaatgccactgggattttgatgaggatcacatgaaatcactagattgctttgggtattatggccattttaacaacactacatcttctaatacatgaacacaagatgtctttccatttatgtgtcttctttaatatcttttatcaaggttttctattagcagtacggaagacttttatctccttcattaaatttattcctaagtactttactcattttcataccatcgtaaatgggatgtttcttaattattttcagatagttatttgttaatatagacaaatatcagtgatatgtgaatattaattttccatcttgtaacatcactgaatttatgtattagttttaaaaatgtttggttgttttgagtcttcagattttctacatatatgatcatgccatctgcaaaaagagatatttatccctgtctgatatggatgccttttatttcttttgtttatctgctctgactagaacttatactactatgtggaatgaaattgacaagagtgaacatccttgtctagtacctgttcttaaaggaaaaggttcagtttttcatcattgagtatattagctttggacttttcatagatggttcttattatgttgaggtaaattccttccatatatactttcttgagagattttgtcatgaaagaatgttgaattctgtcaaatgctttttccgtataggttgaggcgatcatgtattttttatccttcagtccgtgaatgtgatgtaccacattgattgatttgcatatactgaaccattcttacattccagaggtaattcctgctggttcgtgatgtatgatccttttagtgtgctattgaacttggttttacagtattttgtctttttttccctttcatgaagattggggtctcactatgttgcccaggcaggacttgaactcctgagctcatgctgtcctccttcctctgcctcccaaaatgctggggttacaggcatgagccactgcacccaggagtttactaatattttgttgaggatttttgtatctaggttcatcacggatattgacctatagttattttttttgtagtgccttcatttagctttggtataaggttaatgttggccttattaaatgagttagaaagtattttcttcaatgttttggaagagctggagaatgactagtgttaattctttaaatgtttgatagaattcactagaaaaaccatctggtcctgggtatttctttgttgtgaagattttgattgcttattaaatctccttatctgttttagtatgttcaaaaacctattttctgctttatgattcagctatagtacataggtgatatgtgtctaggaatttatgtattccttctagtttttccactttgttggcatctaattgttcatattagtccctttttatttttatgatgtcagttataatgttttttctttcacttctggttttatttatttgagttttccctttatttgttagtttcattaagggattaccatttttgttattttttaaaaatgtcaaactctagtaattattttcctgttgattttttcttctacttatgactgctctaatttttgtcattttctttttctgctcagttatgacatagttgttttttctttttctagttccttcgggtatactaagttaagttgttttggggggattcttcttctgttttataataggtatttgtcactataaactttcctcttggtaatgcttttgatgcaacccataagttgtgagatgttctgttttcccttttgtctcaaaatattttaaattttccttttaatttcttttttgacccattggttgttcactgtattgtttaatttgcacatatttatacattgttctagttatcttttgttattgatttctagtttccttcctttaacattgaaaaagacattaggcatgatttcaatctttttaaatttaaaatttcttttttgatgtgacatatgatctatactcaaagatgttctgtgtgtgcttgagaagaagatgtattcagttgctgttgggtggcttgttcttcgtacatctgttaaatacacttgttctacagtgttactcaaagctgtttacttactgattttctatctggatttctatccatcattgaaagtgaggtattgaagcctcctactagtaatgtgctgctgcatattattcccttaagttatgtcaatgtttgtttcacatatttaggtgctctgatgatgggtgcatatatatttatcattgttatacatcttcctgatgaactgaccctgtctatcattacacaatgaccttctttgtctcctgtaacagtatttggcttaattttattttattttatttttttttgacagagtctcgctctgtcgcccaggctggagtgcagtggctcgatctccactcactgcaagctccgcctcccgggttcatgccattctcctgcctcagcctccggagtagctgggactacaggcgcccgccaccacgcccagctaatttctttttgtattttttttagtaaagacggggtttcaccgtgttagccaggctggtcgcggtctcctgacctcatgatccgcccgcctgggcctcccaaagtgctgggattacaggcgtgagccaccgcgcccggccggcttaatgtttttattgtctgatgtaagtatgtgtcgctgtagaagaggagaattacagatacaaggaaatcagcagatgaatttggagttacgctgccagaaaccaagaaactaacggaaggtacgagaaaagcctgaaagagatctttccctagcaccttctgaggcagtatgaccctgacaatgccgtgatattgtgattctagtcttcagaattgtcagacaattgatgactattgtttaagccatgcatcttatgttacatggttatggaagccttagcaaactaacacagacattaaaatcaccatgtgtaactgtggtcctttaaaaaataactgcaataaaatatagagtaaaagtaaaaaggtcagtgaaggaaaaggtatagagcttaacttactaagatgaaggggcaatggaaacgcactagcagatatcacacttgtagatattaccagcccctctgccctacaagtaaactctcaagcataatagagactgaacttgtttccgtgatttccctaagccaacatgcggaatgcagtcttctcagactggtacttaaaatccaccagctaaccaacttaccaaatcaaatatattcccacactattactttattcatcgctctcttcttcaaattttgttttgtcttttcttactgacaacagccctccataagaaatgaagcatatgtatgtatagatgtgaaatgtctctcagttattcattgaccttagacaaaaagatatagatgattactgatagttgaattccttaaaaattgttttaaatgaggttgaatttttttctagaatttaaaatacctgaagtattccattatatggttcaattttgaggaaataatctgtgaccaggtaatagtatgagctaaagtacagaaggtaaagagattatttatcaggtatataaacggaggaaggaaatcagatttcttaatactgaagagttactggagcacacagaatgagaacaaagaaactatatttattaatgttaaagagtaattataaaatttggtagagataatgcagctagagtagggataaatcttacccaactgctatattctatagaactgagagactcctgttgctaggcaattaatctaaaacttaaatgagagacaattgaaggagagaatttatgattctcttcatcatgtgaggcctcaaataaaaatattcacaaagatgagtgtataaacaatcccagtccacgaatagggctacaattagataagatctgacaattggagctgacaattcatctgttggtaagtcattcaaaagtttagctctagaagagagaagcaccagtacttatgcatgcatgaatacacacagatacacatacacgcacaatgtaattctttaccaagtgttcagatattcaggaggatttacactcaattatttggtagtctacttacttgcttcagaatctttaacatgtttttaaggatttttttaaaattttactcatagtttataaacagtgaattaggctataaatgagagcgagagggatgtggtaattagggtacagagaatgatgaattcaatgagtgtggagacaaaaaacccaaactttgtaaagggtaatgtatgaccaactactttgaagtctctactattatagcactataccacattattaatgaaaatattatattttctcaggaggtgtagtctctggagtcattgtataagataatgtaataagtgcaaaggcagtctggctcaaatatttttttcaatttgtttcctactgcttgcaagataagttcttataaacaaattctgaaagatgtatactggttaagttcactctcaatggggctacattaatgaaaaataatccttttccatcacaacaaaaatccacactccataaaaattaacaaatatatatcaagagagatatggagagaaaatcagcgtaacaaaattttactcacaatgtatagatgttgtcctcaaagatttcttctactgatgtggctttcttcttgtggcctcttggcattttgtgaagtaaacctcccttttatatcacttgattactttacccaagcaatcaagccactcttttcactttagtgagaaggataacatattcagcctgcaaaaaatccgctgctacatacgtacaatgacaaaccaaatactaaatatctaatcctatattaaacaaacatgaaatgaaaaatttttggttttataacttaaaatcactgatacgcaataacaatagtaactcataaaaatgaagacaaggttgattttcacttagggtcctatgcattaatgaggaaacttagaaaaacagctagttaagaaaaaatgtgaacaaaataaaaattattaagagcataggagtgtttaaaatatctgtccatgatttcatcatttaagggtgaaatgtcaggccatttgatcttaattttatgtttcccctttttaagcacccctaaatatattctgcgatttattattccagaagtgttggcagtgagctgtaggagtggccaaagcagacaaaggattaatctagattcacttgaggattgtggtcaacagtggttgaactgaagaagtccagagctaggctatggggatggaaggcacaggaggggaatttggaaagagggaaaaaagaaaagaaagtgattttaatcctctatgaatttgatgtgtaagtttcaattaagaatacaagttgtggttaactaatatatccaaattaggatggtcaaggatggtaacaccatagaggtgatggccataggtcaacagcaaaagcttattgaagatgagatgtacaggtaacaacaaacaaacaaacaaacaaacaaacaaaaaactgggtgctgtatgggttttccatgcttggcaaacacagtaaatattattggcataattggataagatgattggcagagaagaaagtagtatcagacacccatttatttgtggtttgtgcaggactgatttgggaagttggtgtaatagtaaggaagaaaagtagataataatataatgagatggctgccagttaagtggtttgtaagggcctttggcaatcaaagcaaattatggccaaacatctggtttatagggaatatgagaatgctgagaatagaaaactccctctctgctgggcttcccatcgttgagatataagttttgtaaacttcagtagcaataatgagctctccataaagagatacgagtggagaagagattattgtggcttttcatgaaagaaaggttctgtaagtgacaggaaaatgattccagagaaaagaggtcaaacatcaagataaaacataattaagtagaaaagaatccaggtatagaagatgacaggtgctgaaactagcatttttgatttttgtattacctaccattgaaagtggtatttaatcggtgtgttttagattcctcatagcagatttcactttctcctgtgatttttttcaattaagccagtagttcttaatctcattactttgataatctcatcattaatagcctgataatcactgtgaatactctcactagctaaataaaactaggcattttctatgtaaaatatggaatggaattttacaaattcctaaagtgtatctttgccccaaacactctgcctgaatttatgctacgtatcattaacttattttggcctgtatcattcatttttgtttctaagtatgcagcttagtgtctacatattacatggtttaattaatgtgttattgaagagcaaagcaacaaatcagtgttgccagccatactagatttctcatttgcacaaatacgtggtaataaatttgtactattaggtaaaactttttattgtatttttatataagctatgtaaatgttttttcatatatgacataaatacttttggaggtcaatctcaggagctggtgactttatcgtcttaaaactgcaagggacattgatgcctttgttccagcataatattaccttccccaaagccttcctccccctttttggggttcattaatttccttttcatttctgaaggcagtttgttttgtcttcagcattttcacatctctgaccgttactttcctggcttgttttatttccttttcatttttcatagccaaaggctttgaaaagagttatttttattaagggtataactaaatatatacatctttgagtaatatctatctatggacacatggtactacctcatttaattccactatttttttattgtgttattccacaaaggtatccactacagtaaatactactatttttgaagagcaactgatgctttgtaatttgacaggaagaagtgaagataggacaagtaatgatttgttgcatggaagtatatattaagaaagatgaaaaaagatatgaaagtatttcatatatatatatatatctccagagtaatgtaactaaataatgtatcacttgaaactgaaaggaagaatattgatatttattccaattcaatatgtataaatcaagattcccttatcaaaacaagatatacgttcagcttttaagagcctttccttttaaatatttgtgaaaatgtgcacacatatacatatattttgataacagcataatgaatccatgtgttctttatctgggttcgggatttatcaactggcaggcaattgtcattttttagtatacagtctgagtttgcgtcaccaatgttgaaaagccaatccaatgtagtattatatattgagtcatgtgttgagccaaacactaatccattttcacccatatattcctgtttcttcttcaccctggcctattcataacaccacctgtgtgtcttcccttctttttattttgtcttttaatttggctgctctgatagattgactgtcagaaaacagaccactaagggtcagcattgcataaaatcaacccaagggagaaagacagacgaatcttgcctcctgccttcccctcttttgctctcactcatagctccatcatggtggctccataaaggctgcgggtgaggccctgctgcatatgaggatcacacacctgctgctctcactgaggatatttctcttccttttttgatgagcccatattgggcacaagaccacagccccccagaagtggtgataaccctgagggtaacttgcactggtagtggtatgaatcttctaagctggctctcctgtagcttgtaatttgggaaaaagagacatattgtccacatcagaagcttttgatttccaaacacctcccagtgttcacctacaaagaccaacatgctctcctggaagatcaccctattgtctggaatgactgctgctatcatagttttgtggaaagggatccagaatccctggttgctattagcaactgttttgggggttttcaaggaacgctacagataaattacattgattatgaaatgacacccaaaaggccttctgccacatctgagcatctggtataaaaagctgggtagtcaggagacaaaattcccaaccatgaaacgtggattaacagaagatatagtaagagaattaaagtttcaagaatgtgataattccactctgatgcaaagtggctatgagggctggagggagaacccacgcattttttcttgaactggcaatagtggtagactattcattatttggaaagtaatacctcccttgggcaggaggaaataatagttgttgccaacaaattaaatgttgtttaatagtgccataggacttaatgtgattttaactgtacttgagatctggaatgaagaaaaccaagttacagcaggtgacctatgtgttcttatataactttggcaaatggaaataaatagctataatttctacatatctgatgatggtgtagaacttgcagtaaaggataaatatggtagattattatcctataccattattggttcaacctgtaatattggttttaattatagagttatacagttccaaggtactgaatttatatcatttgcattgctgttggtacacgagttaggtcataggtttggtatgcagaatgatggtaaagattgttcttgtggtcatgaaacatgcacgatgtcttcaagaatataaagggcaacaaggtgaaacatcgtctccacaaaaaataaaaaattatccagatgtggtggtcccagcaactcaggaggctgagatgggcagatccattgagccactgagccaggaaaattgaggctggcaatgagctgtgattgtgccactgtattccagcctgagacagagtgagagcctgtcttaaaaaaaaaatatatatatatatcaaagacaagtcatctattcagacacagaaattattctatattggtcagccttttatctaagcactatttgtatactgaaatccagagaacatcattgcagagaagtgctgtggcaatggtgtggttgaagaaggagagaagtgtgactgtggatccttacgattgtgtgcaaaatatccatgttgtttggcaaactacactctgaaatctggggctgcttgtgcttttgggctttgatgcaaagcctgctaattcatgctgtcaggcaatatgtgcagagaagagaacaatgaatgcgttatctcatagtgtttcaatagaaattcacatattgtccagcagatatgaatgtgcacaacaggatccattgcatgggcagtgtctattgctatgaaaagggatgtattaactacgaacagtgtaggcaaatttttggcaaagaagcaaacagtgcaaatcagagttgctacagagaaattaatacctgtggttaccattttggtcactgtggtatctgaggctggacatgtaagatataatatctcagatatcttttgtgggagagttcaatgtgagaatgtgaaagaaattacccatttgagagatcacactactgagcactgaactcacatcagtggtgttaccagctacagtactgactttcatttggggatgacaataactgatattggtgtagtgaaaaatagcacagagtatggtccaaaacaagcgtacattgacaggaagtgtgttcattatcattttggaaaagtacttcttcttctaagacccgcaatatgagaggaatctgcaaccataaacattagtgccactgcaaccaaaggtggaaaatacttattgcctgatacagggcactggaggtagtgttgatagtgacctataccctgcccaccccaaaaagatgaaagagttgttcaaaaggattttcttgatagtaattttttaattcctttttctcttttgttttactgtttgttaattttgctttcagtgatacacacaacaaaagaaaaagaaagaaagaaacaaagaaagaaagaaaggaaagaaagaaaggaaagaaagaaagaaaagaaagaaagaaagagagaaaaacatcatctaagaaagaagtgcaaattgttcaaacttcacctgagatagaaaagcaaactgttcaaacttcacctaataaagaaatgcaaaatgttcaactttcaattatgaacaaagagcaaaatctttaaactttatttcagaaaaaaatagtaggggattcctggagaagctgcagtgtggggatgctctagaccgagtactgcccccagtgtctttccacctcctcctgcagcagcggcagcagcagcagcagttagcagtagcaacttgaggctgcaccccgggctgccactccaagagcggaggcagtgagagtacgcgtgtgcctcgcgccagtccacgctaggagagcactgggaccgagacccggcaccacctcccggtccgccctccagaactttgttgaggaggagccaagatggccgaataggaacagctccggtctacagctcccagcgtgagcgacgcaaaagacgggtgatttctgcatttccatctgaggtaccgggttcatctcactagggagtgccagacagtgggcgcaggtcagtgggtgcacgcaccctgcgcgagccgaagcagggtgaggcattgcctcactcgggaagcgcaagggatcagggagttccctttcctagtcaaagaaaggggtgacggacagcacctggaaaatcgggtcactcccacccgaatactgcgcttttccgacaggcttaaaaaacggcgcaccacgagattatatcccgcacctggctcagagggtcctaccccacggagtctcgctgattgcaagcacagcagtctgagatcaaactgcaaggcggcagcgaggctgggggaggggcgccctccattgcccaggcttgcttaggtaaacaaagcagccaggaagcttgaactgggtggagcccaccacagctcaaggaggcctgcctgcctctgtaagctccacctctgggggcagggcacagacaaacaaaaagacagcagtaacctctgcagacttaaatgtccctgtctgatagctttgaagagagcagtggttctcccagtacgcagctggagatctgagaacgggcagactgcctcctcaagtgggtccctgacccctgacccccgagcagcctaactgggagacaccccccagcaggggcacactgacacctcacacagcagggtactccatcagacctgcagctgagggtcctgtctgttagaaggaaaactaacagaaaggacatccacaccaaaaacccatctgtacatcaccatgatcaaagaccaaaagtagataaaaccacaaagatggggaaaaaacagaacagaaaaactggaaactctaaaaagcagagtgcctctcctcctccaaaggaacgcagttcctccccagcaatggaacaaagctggacggagaacgactttgacgagctgagaaaagaaggcttcagacgatcaaattactctgagctacgggaggacattcaaaccaaaggcaaagaagttgaaaactttgaaaaaaatttagaagaatgtataactagaataaccaatacagagaagtgcttaaaggaaccgatggagctgaaaaccaaggctcgagaactacgtgaaaaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctatgtctgattggtgtacctgaaagtgacggggagaatggaaccaagttggaaaacactcggcaggatatcatccaggagaacttccccaatctagtaaggcaggccaacgttcagattcaggaaatagagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagggctcctgaaggaagcactaaacatggaaaggaacaaccggtaccagccgctgccaaatcatgccaaaatgtaaagaccatcgagactaggaagaaactgcatcaactaatgagcaaaagaaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctatcaaacaaaaaaaggcaggggttgcaaccctagtctctgataaaacagactaaaccaataaagatcaaaagagacaaagaaggccattacataatggtaaagggatcaattcaacaagaagagctaactatcctaaatatatatgcacccaatacaggagcacccacattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctatagaactctccaccccaaatcaacagaatatacatttttttcagcaccacaccccacctattccaaaattgaccacatactgggaagtaaagctctcctcagcaaatgtaaaagaacagaaattataacaaactatctctcagaccacagtgcaatcaaactagaactcaggattcagaatctcactcaaaactgctcaactacatggaaactgaacaacctgctcctgaatgactactgggtacataacgaaatgaaggcagaaataaagatgttctttgaaaccaacaagaacaaagacacaacataccagaatctctgggacgcattcaaaggagtgtgtagagggaaatttatagcactaaatgcccacaagagaaagcaggaaagatccaaaattgacatcctaacatcacaattaaaagaactagaaaagcaagagcaaacacactcaaaaggtagcagaaggcaagaaataactaaaatcagagcagaactgaaggaaatagagacacgaaaaacccttcaaaaaattaatgaatccaggagctgatgttttgaaagatcaacaaaacagatagaccactagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaactgtggcaataatcaatagcttaccaaccaaaaagagtccaggaccagatggattcacagctgaattctaccagaggtacaaggaggaactggtaccattccctctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacagcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacaacgcttcatgctaaaaactctcaataaatcaggtattgatgggacgtatttcaaaataataagagctatctatgacaaacccacagccaatatcatactgaatggacaaaactggaagcattccctttgaaaaccggcacaagacagggataccctctctcaccactcctattcaacatagtgttggaagttctggccagggcaattaggcaggagaaggaaataaagtgtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttctacaccaactacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcatcgccaagtcaatcctaagccaaaaggacaaagctggaggcatcacattacctgacttcacactacactacaaggctacagtaaccaaaacagcatggtactggtaccaaaacagagatatagatcaatggaacagaacagagccctcagaaataatgccgcatatctacaactatcggatctttgacaaacctgagaaaaacaagcaatggggaaaggattccctatttaataaatggtgctgggaaacctggctagccatatgtagaaagctgaaactggatcccttccttacaccttatacaaaaatcaattcaagatggattaaagacttaaacgttagacctaaaaccataaaaactctagaagaaaacctaggcattaccattcaggacgtagctatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcagcctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagacctagaaataccatttgacccagccatcccattactgggtatatacccaaaggactataaatcatgctgctataaagatacatgcacacatatgtttattgcagcactattcacaatagaaagacttggaaccaacccaaatgtccaacaatgatagactggattaagaaaatgtggcacatatacaccatggaatactatgcagccataaaaaatgaagagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcgtggcacatgtatacatatgtaactaacctgcacaatttgcacatgtaccctaaaacttaaagtataataataaaagaaaaaaaaaaagaaaaaaatagtaaaaatttactatttcagaaaataaacccaattcctaatgaaatttttcgtctgttaatttttaatgacctggcagtagaaatgttattgtgtatgtcagagatcattgaaagaaaatcccagagatctattatatttaataatcacaaatagtagccattaaatgaaaaagttagtactagaatattaatacttttcattattttaagtaattttagtggtttatttttcatgaaattagtcacatgtttcctgagcaaaggccgggctcatggatgatatatgtgcattttaattttaatgtgctgtctctcaatttcaaaactccttcccttttccaatctgctttgtcacaagaaggatgggtgcctatacaataacagcttttctttgccagtcctctctctattagtgtcttccaatggggcggctagaggcagactagaaacctgagataaccatttcatagctgttcatgtcagcattggctcagtaaaagcttttaccttggcagcagcagtagttctcagtctgtacatgatttttattgttaaatcaaaaacttcagacaaataaaatttagcagagtttacttgaagaaagaatcattcatgaattagtagcactcagaaccaggagagattcagagacctccactaggcaacatggccattcagtatttgtagacaaaaatagtaactggtgtatagaagcacattgattgtttacagctgggcattggccttatttgggcatgatgtcataaggcatatgccttatgtggacatggtctgatcagctggcaccctgtgattaactgaagctcagctgccgtgattggctaggactcagccatttgttgcaggaatatacttttaagttaggtagcagttttttttttttaaatacaacattaggttgaactctgttatgaaggaattcaaagtatggagggagttttaggccatatttattttaatttaaaatgtccccatttggtcggcttctcaatttggaaagattgaccaaaaccttgggcactgacatcattctgtcaccatcacaatgatcttgtttggtctcagtatggaatttataattcacaattgggttagttgaatgtttcttctgttctttttaggttttcactattcaaactgtagtaagatcacttggcatatgacagatggctgcataagaacatttaagactcttgagagaatctggtgcaccagagaaaccattatgatggctatcaggaggataatactaagaaaatgaaatacactctaacaggagccccaaataagcaaactgatcaaaatcaaatatataaaatatgaaccacaagagaaatctatttgttttagccattcagcttgtttgttgatttcttgcagctgaatttcttccataccagatgtatttatccaagggcatcagaagtgttagctatcacacatgctcccccttgttaggccatcaatagatagtccaaagcaatcatgttatctaaggacaacattagtaagaaagtttcaagaaatttccttgggcaactgtaacctttgcagtagagtcagctatatatggtacctaatatttgagataggtttctataatcataacttaaatgacattaatgcgaagccagggaaaatcacccttcaaaaagatgcctatttggaaggatttatgtctgctagcaaattcctctttattctatagtgcaaattaagaagtgtggcccaatgatcagttttcaattggttatagagtgacagtggtagcattaaaatcactcatctacattggtccttcattagccacttactgaaacatagggttgccatgcacatggttaaatgatgacaatattgttaaatccttcacagataaatatacatcctggaaaggcacaacaaacagctctctgtgggatgccttgtgtgtgagcagtcatcagtagggaaacactagcagcatttatgccaggctccattactgaatcactgaatgctttgatgcttccaaaaattaaaggaataggttacacatttgtgtacaaattgttgaattatttttcctttcgtcttcttattcaacttatggcagagtttaactgcaaaaccatcactttagttttgtctattgttacatttaaacaagaaaactgaatacataagtctagaaagtatcagaaatcatatttgaaataccagttacagagtgaaccagaagctaagattatataaggacttacgtttcacatgacatatccaaaattcagttaagttccctgagtatcgggggaaattcagccagatatcggccgaaattcagccctgatacttcacgtacgttcttttctattttccctaagtgtcagccggtctgagatataaagggacagagtacaaaagagagaaattttaaagctgggtgtccgggggaagacatcacatgacggcaggttccatgatggcccctgagccgcaaaaccagcaagtttttattagtgattttcaaaaggggagggagtgtacaaatagggtgtgggtcacagagatcacgtgtttcacaaggtaatagaatatcacaaggcaaattgaggcagggtgagatcacaggaccacaggactggggcaaaattaaaattgctaatgaagtttcaggcacacattgtcattgataacatcttatcaggaggcagggtttcagagcagacaaccagtctgaccaaaatttattaggtgggaatttcctcatcctaataagcctgggagtgctatgggagactggggcttatttcatccctacagctttgaccataaaagatggctgccctccgaagcggccattttagagacctaccctcagggacgcattctctttctcagggatgttccttgctgagaaaaagaattcagtgatatttctcccatttgcttttgaaagaagagaaatatggctgtgttctgcctggctcaccggcggtcagagttagaggttatctctcttgttccctgaacattgctgttatcctgttcttttttcaaggtgcccacatattgttcaaacacatgtgctctacaagcaatttgtgcagttaatgcaatcatcacagggtcctgaggtggcatacatcctcctcagcttatgaagaggacaggattaagaaattagagtaaagacaggcataggaaatcacaagggtattgactggggaagtgataagtgtccatgaaatcttcacaatttatgttcagagattgcaataaagacaggcataagaaattataaaagtattaattttggggaactaataaatgttcatgaaatcttcacaatttatgttcttctgccatggcttcagctggtccctccattcagggtccctgacttcccgcaacacctgaggatgctatcaaatatgacatcttaattactgcattatcttgtcatgtatagaaagaaaagaaacacagagaaaaaagtcaggaggacaaaagtttcatgcaggtaacttcacctgtgatcttgggaaggttgtctacacctaggatgtcatctgcttctctgaagaaacctccctggccagtttgaccatgaggtctccaatgactgtacaatcccaggagtctggaatggctctcttaagttgagacatgaatccaagaatcaaggcaccgaagttgtacttccaaggggttccaagggcagtctttttctggtgttcattccaaaagactcaacatccagactctagatcattaatggtgtagcagatatctgctggtggttcacaaagggcttcttttcggtggaaaaaatatactttggcataatccattaaggtcttgcaatatcgagtcatttcagagttcatgagtgtgagatacatgaagtccaattattaggggcatggtccttctagtaattatttcataagcggtcagtctgtactttctagtggatcatcaatcagtagtaactttgatcaaagcaacccattcgattcagttagctttgcttaatggctttgtgtttgcaattccttatttgacacttttataatttttctagtgaaatgaataccttcattgctgaagatttctccaagaatgccccataaacaaaacacattttctaataatttttttttttttgcttatgttatagattcagccttctcgcatgggaaagattttatacaaacagaaaagagtcatcaaagttggcaattgagtaaaatccctctgtaaatattcaagtgatccagtaagtggcaaaaatgtatcaactgaggtcattttcttactagaattatgggtttgacaaccccaacaatggttataaaccacttcagcagttttagaatagtcaccccatcatttcttttcatgatttgtatcatctcatctattccataatgagtcagagtgttgtctttaataatgaaaactttaaaaagtcaggaaagatcaggcagctatcaaagcctccataagtctccacttaacattagatctacatatttttaaatactagatttttttccctccaagtaaggcatgtagcactgtttattaaatagttattataggtaatttgacttggatttatcttatgaaattcattcaaattgcatataataacaatttcagtactgactgacttagcataaaaatctgactacgcatttccttggtatttaattaactcttattctacttgatttttggttagcagttttatgaatcagtcagtctcttcattagagtttttgggaatacttacctggtacaatagtatgatcagatttctaagacaggcatgtaatttctggaatacataataacacatctacacaaatataattcaaagaaggtttggacttacttatttggcaatgctttcacataatttaatatatcaaataagccaaattaacttaatatctctcttttcacaaagatagatacctgtttgatttttccaatagcacccatgaaaaatctcaaggttaatttgagattaaaaaaaaagacttaatttaaatttggtttctgaaagtatgtcaaaaatatgaaggatgtgaaacactggatcaaaataggatcacaggctactgtgtatgatcattgttaatttaatcaaagtaataatttaaagacttccaaggcaaatacagaaagtttgttgtagaaaaattttagttctttcaataaagaaggcagttttcttaagccaacaaaaacctagtaaacactgaagtgcaagaagttatcttagtaaaacgcagaatcattgttttctatcgcctaggccatttaactaaaagataaagaaggctgggcatggttgctcacgcctgtaatgccagtactttgggaagcccaggcagccggatcatgcagtcaagagattgagatcatcctggccaacatggtgaaaccctgtctctactaaaaatacaaaaattagctgggtgtggtggtgcatgcctgtagtctcagctactcgggagggtgaggtaggagaatcgtttgaacccaggaggcagaggttgcagtgagagatcacaccactgcactccagcctggcgacaaagcgagattccatcaaaaaaaaaaaaaaaaaaaaaaaaagagagataaagaaaatcccttcacggtttcttttaagaacagaccaaaattccaagaaaactgttgtttaacacaaggctcaaaattctagtttcatatcagtgtacttttggtgttaatactccatttttagaaaaacttataaataattcctttctaagtttatctagcttaatcacacataaaattcctttcacaagattcatcttccacaaaccttctgacttccttatccattcagtttttatcatatactttccctcttctcattttagaactagtcattctttagaaaaaaaattactttcttcttcccttaacaaaacatcctcataccttatagtttttgcatataaagacacatcttaccttccttgtatactcgcatagagagttatttcccttattatttctaacagttttatttacacatagtattagaattcttaacccttagtgaccttagtttccagtaaacactaggaagcaaagaatttcaaaccatctttcttgctagcaatttgtagatcagcaaatctaagaattgtaatttcaagaaatatgtgtttcccaaactacaatttgtcagtgtggcacaaaacattagtatctttgataagaaactgtagatgaggcaaaacgtacctgtgttaggtttttttggctaggcatgagaatcaattgtttgtatagctatccctcagcctcaactttccattcttggtggtaagaatgttaaaaccttctgttacagggaggacatatttcatatgggaattttattttgcttacatctatttaactcaacttattaaaacaattatgcttacattattcataaagatgagacattaaatagcttgccatcatcttttcttggtgacaaattttgtaatatggtgttaagatgagctttttatcaggaaacctaggtaaaagaaattgtacatctgtattatatttaaagctgaggacactgaggatgtgcttgtcttaatcaaaccaagaaaatttttatttaccaaagattactcaagacacataaacttgaaagtttgggggacagttttcattttcctgagagaatatttagtttataaatgtgtttgtttttctttacactagttaaataaatctcttctacaatttaattctgccaatatcataagaagatagaaaaatattgatgctttttttttctttttggctgagctttgccagccagagacctctgtgccaggcaatgcccctgtccaggcctcagtcagtcccaggctcactacaggaggtgccgtgcccactcaccctgctgggctgtgcctcacttgcactccagtccagattccatgtttgctgtgggatccatattcagatcccagcaggagtggatgtgtaagcaagcgagtggggtccagctggccactccaagtgccagcactggagtgggctctgtatgaggcttgggctggaccaagcatgttgcaagtgactccctcggtggactccagcatccagacgaggggaatgtggtgatacccaaataggaatgcccgtgaccctgaagctccagagggcatgttacagtgtgctaacagctcttctagtcccaccactggcaacccaaatgggtttgttaacagctctgtcagtcccattgctccactctggcctgcagctcttgggctggcctagccccactgctacttcccacttctacttcccatgatgtagggcagcaggctacagtgctactgcctgcttcctacctgtgtttggcagggtctgaaattcttgtcccatatcaaagaagaatgaaatcatgctgacaactggagggcgaagagggcagaaaagagttttttgagcaatgaaacagctctcagtggagaggggaaaagagggtggtccccaccagaagtcaggtagtttgtctcccactgtggctgggtccagggcttttatgggctcagaatgaaggaatgtctgttgactggcttgtgagtatgcaaaaaagcctaaaacaaagacaccactgaaagatggacaatactgtgttaaaaaacaattagggaagggtagctatgtgtaaaataggtgaagagtggagatcaattggggataacatgccaaaaaggaagagacgttctcaatcgggtccatggatttatccaagacttgtagtttggctttcaggttttaaactgtctttggtttgaagatcaggtttcaccaggaactgcccctgtctgcttagaatttttctgcctcctgctgctatcaatatcacatatatgtatcattcataaacatatggacaggtacaaaaatacaaagctcgctagtttattaaagaatacctgtatccagattgttttttctttctggctgatgaattaagaccccttgcccagatggtcaaaatgcttcacttacatttgtgaaagaaagaaaaaggaaaaggaaaaaaaaatgacttagaatttttcattcatcagtttccaaatagtgcttttttattttgttctctcttttctcttcttctatgtcatcacctcgaaatttgcatttccaaagggaatagcccttaggtaagatcatgtagaaaatgtacatctcaaaggcacagagctgtaacttcaaggctaaatatcataatttgcctattgcaaaaaagaggagtataggaaaaagcccagttaagacaagatcgccaagaaaagcaccttaaacaaaggtaagacttgttatgtagatttaagccagcaaagcaccttaaacaaaggtaagacttgttatgtagatttaagccaatgtgctctccattgagagcattgctaatatttagtactcatcatattctgcttgtagagataaagacacccttacaaatagagatttccttcatagatgtatgtttttcttgcagaaagcagtcaaagtgaccagctgaaaataggtcatatgccagaaagtcttattttggagactaattggctagatgagcagttctccaacctagcgtgaatcctttagctaaaaatactgagtgaatgaagtatactgaagaaaaaacaaccatttttatggctgattacagcatagatacttctaatcttgccttatagtgagacgttgtcccatcttttgtttcctttcaagatgcagtgaaagaccaatcagctgcatttttttcccccaagaaatggttttggggcacagaaaaatcatgaaaacggctgggcaaagtggctcacgcttgtaatcccagcactttggaaggccaaggcaggtggttcatgaggttaggagatcaagaccagcctggccaagatggtgaaaccccgtttctactaaaaataaaaaaattaggcaggcacagtggcaggcaccaataatcccagctactcaggaggctgaggcaggagaattgcttgaacctgggaggcagaggttgcagtgagccgagatcccaccactgcattccagcctgggagatagactgagatatcaactcaaaaaaaaaaaaaaaaaaaaagaaagaaagaaagaaagaaagaaagaaagaaagaaaaatcatgaaaacaagaaagagctggacagagttgacagagtatttagtcagcagaggtttgagaaaagagatttcagtagactgagagtttcctatgggaaagaccaggaattaatgcttaaaatggttgttttactgaccatggattcttgggctttcaatgcaacagaaattgacatgaggccaaaagagttttcccacacaaagcttcattggagcttacacccatgcataaaggaggctgtacaagaaagagaattccccaactctccacagagagttggtagggcttttttttattagtcaaagcaaggtaactgacatcaggggtcaagtatgtatataagctggggtgggcaaagcaagtgatgggtagggtatgcaggtcagcattatcaggctgccgtagttatcttgactggccataactggtgacctgatggtctggccagtggcaacaaagctgtaaatgaactgttcagcattccttcctgaggtgggacattctccaacttttgttatctctaaggccagttcctggaattttttaattaaaaggactattagcagcgtggtatggtgtgggttttgtcatcactggaaatgcatgaaagaatgctccagtggggtgagctgaagcagagccccatctttactgtctcagttgttgcaaggggatagcttgttggttctagactggctgtaaggaataagtcccatagagctgagtgaactgacctgccagaagagctactacctctgacacaatcagtagattacacgtattcacagaatacatattattaaattagattgacttgaatatattattttatgcaaagatgagaaaaaagacgtgatctgaagatctttactattctacctattaaaaatgaagattctaattgcttctaaattcctttacaaattataagtctaagatacatatctatttacttcaaatcatcacactttgttatagaatggtctaagctatgcacatttatatgcaagcacacaaaatatgtagattcctctgaaaacagtcatactgttttacgtttccttcttagtcaaaggcaaaacacgagaaagaggtgtataatagcatcagggaaggtcttgccctagtttcttacttcttgcactgtggtcagcagatagttttatgtactgtggtgtggtcagcagagggttttctctattagtcattgagccactgctgttgcttgatttgcttctaaggcatgattccttttttttcatcttcaggtgttgagcccaagagcaattctgttctttttaagagatggggtctcacactcactatggctggagtgcagtggcacaatcagttcactgcagtcttgaactcccgaacgcaagcgacctcagcctccccagagctggggtttcagctgcacaacaccatgcccagcaatagaacatcttttaatcaacatcctgcacactaaattccaactatgatctcagagtctgcttcccccggaacccaacctgtaacagtgtgtcatttgaatggaaaataactatgaatttaaaatctcaggcttatatctactttggccagtactgtcttctttagattgtaaccaagctcaactgtagcacaattgaatcatttaagagatatcctctggtagtaattagtatcattaatcaatgtatctaggacttgtatctctgggttcttccttcaaatcagactggccaatgagactttcattttttttatttcttattttgagatggagtctcactctgtcacccaggctggagtacagtggcatgatctttggctcactgcaaactccacctccctggtccaagtgattctcatacctcagcctcccaagcagctgggattgcaggcacatgccaccaagcctggctaattttttgtgtgtgtattttttagtagagatgggtttctccatgttggccaggctggtcttgaactcccagccttaagtgatctgcctgccttggcctcccaaagttctgggattatatgtttgagccaccacaccctgcccaatgagacttttaaatgacagttgaaaggtttagctaataaaatgtaaacaaaagttttaatgtggtagtgcattgcctagcatgttcccttctctttgacacagcaagcaatcctatcgagatggaaaccagcacaaattagaggagtttttaaaattattttagaagaatttttcctattcaggttttttttttttctacaaaatcaacttatggccaatcactgctatatgtacaggtgaataagaggaaaagaagttaaagaaagaaaagtcaaatgaactttggttattttaattaccattgttagggattctgagaagcacctcttgaaggatttgaaattgcagtgaacataccagtacacaaacaaataaagccacattaaattgaaaccactcacttcaaattcagaaaggatattttgaaagaaaatattatttttttaaaaataggcatgtgtagctcttcagtaatataaagacctccttagggtcttgtacagtctgtaagaataagtacatgtttgttaaatgaaaatataaatgtttttaaacctttccggtttggagcacttctcccctacaatgcatttaaccaatccctcaaattaaacacatttttgtatttcaatattccagtgatttttaaagacactgattatatgtgaatcttaatttatccaaatgtttagtgtaactgttacctcatcaacaaagaattaactataatagcaatgagagagagagaaaagagaaactaccttctatttcactggaatattttattttacaattatggtggtggtattaacacattccattgagggaggaggtggttaggggctggataggcagacaaagagggagggtctcgggagaaggacagagaaaggcaatgttcacaggaacaacctcaacacagcacctacactgcctctgcagctaatgggaagaaacgtggttaagaatttccccttgtgccaggatgttgcccaaagggactgttccaacttaggcacaggcacaataaatcaacctaaatgtacttaacttaacccagctcattataatgtcattaacatggcattagtattgttgtgttagccctccctcggttttgcttaggtattcatgggtaataacaaacatgaagtcacaaacccacagaaaacatcctgacttctgccatatcaaaaacacagaactcagccccatttctggcaacttgctttcaggccccctctttttgctaagagctttcaatttgcttaataaatcctattctactcattctctggtgtccatgtcccttattcttattggttgtttgacaagaacttggacctaactaagctagggactaagcaaactgcaaccccatccaatattatcatcttttatgtaacactcattctttctttgaaggatcttgggtctatgagggtctgtgactaaaacagaattgatgctatgtgactttctatgctgtcataaaagcttccttctgggatactcacatttttatctctattaaaaaaatttaatagagagccttcagatgacctcagtctggtcttcaagctgcccaagctgatactgagtgagctgtctctcctcaggcctgcccaaatgggaggtttgacagcataacaggcaatgcaggaaagggcacctgagaaagagaaaggagaaatgtgaggggagccctgcaattgcccccacatactgcctgagggaatagctcaccaacagcccatataagaagagtccaactggagcttgacaatctccttgacttggaggagatgaagttgtgaatttgcagaggccaagggaactagagattgcaggaaacagtattgatcatttaaaatcactctagtaattaccaatgtaatttcattcttgtccaggggcccttgcatttgacattccttctgccctgtactctcttctagataaccatctggctgccttacaaggcattacattatctgtttctaactactttattaagatatcacttgctgtcaatctgaatccacttgtgttttttgcccttagaatttatcacaaataccatagacatcaaatgtccctgaaaattatgcaagcagattcagaaaagtccagtggagaaaaatagaatctaattatctgtcatttaaatatcttaagaaatgcaaaaacaaaaatgaaacaaagcattaaagtatcaaccacaaatttaatgttgtttgcagacgtggtagaggatacatttctaaaggtgttacttcctcatacctttaaattaggattatggttccaattccttcaagttataaagttcttattatcagagctatatataaaactaaatggttttcataagttttgtggacaaaaagttggtcttgattctagacctgtctgtgctccaattgctagatttttcagccatctgattaagaaaacaaaaccaaagaaatcatttgggcagggaaacatccaaatttttagatagtataatatatttcttaggggtaaatacatttattgccaagaaattctagattgaaatattataacaaatcaatcccataatttctgttaagaaataatttagcacttttgacattttgagtacattgtaacatttgaagtaattggcattttaaattattttctgattacacttgaggttataatcacaagtgtgtagttatttagttgagatagaactgcactatttactatcaaagtttttaaaatgattttacaaatgatattatctgatttaccaattacttaagtacttaggaaagttttatcataagatagttaaattttttaatagaaaactgaatattttatatttttcagcataagcatttttaatagattttggttatttcataaaatcctccatgaaaattattggtaaaagttttccgtatttataaatagagtaagattatagtttgaactcaagaggttaaggaaaaataaggcttttcattttttcactatcattagttgaatatttttgatataaaagttaaaaaaattcccttgaggaaaacactgaaaacactataaccacatatgtttaatcgttcatttatttattcttccctcaaaaaattaatctccatataaaccattgtcaaaaaaaatttcagcatcagatggctggcttcttcagcttgcccatttaagagattctatttttttaaatctgtaaagcatgtaaacctgagtatatgtcctaaagattaagaacattatttttagttaagatgactcaagatagtcttaacatgtatgcatactaggaagagaaaataagataaatgaatttagtgtggagaactatttaacagcagatatgttcaaatgattttagacaagcgaaccaagattattcaagcggaaagggtggtcttctcagtaaatggtgctgggaaaatggcatagtcacatgcaacgaatcaaattggacctttacctaacaatacacaacatggatcaaagacctaaacgcaagagctaggactatacaacactcagaagaaaacacaggagaaaagcttcataacattagaatttgcattgattttttgaatatgacatttaaggtacaggcaacaaaagaataaataagcaaataggaattcattagaatgaaaaacttttgttcatcaaaggatattatcaatacagttaaaaaaaacccagagagaaaatatttgcaaatcacatattctgataatggattaatatccagaatatatagagaatgtataaaactcaacaacagcaacaacaacaacaataaacaaacaacccgattcaaaaatggggaaaggactaaataaaacagacatttttttcaaagaaaatatacccatggtcatctgtatcttgaaaaactcattaaaagatgctgaatatcgctaatcatttggaaaatataaatcaaaaccacagtgagatacaactttaccctcattaggatgcctagtatcccaggaatcaaatattaatttttgaaggggatatggagaaattggaaacttcatgaactgctgatgggatggtaaaatggtgcagctgttatggaaaatattattttgttcctcaaaagttaaaaatagaatcactatattatccaacagttcacttctgagtttacaggcaaaataattaagaatggagacgtggacatatatttgtacactcacattagtagcagcattatccagaattgccaaaattggaagcaacccaaatgtccattcatgaatgagtagacaaaatgtggtacatacatacagtggcatataatttagccttaaaaaggaaggaaattctgacatatgctacaacatggatgaaccttaaagatattatgctaagcgataagccagtcataaaaggacaaatactatatgatagcactcatttaagttacctagggtagtacaattcatacagacagaaagtaaaatggtagttgcctggattgggggaagaggaaatagagagttattgcttattaggtacagaggtttagtttgtgatgatgagaagagttctgaggacaaatagtggcaatggttgtacgatgtaaatatacttaatgtcactgaacttcacacttaaaaatggttaaaatggcacattttatgttatatatattttaacatgacttgtaaaacaaatactgttttacaaaatctccacgatagtctagttggccttgggccaaagaaaggaaggagttcatgaagcactcgtcaaagaacgaaaaataactcacttgtttctcagctgtactggctttaactcttataaaaggcaaggcagagaaaagaaaaaaaaatgagagcagaaatccatggcaacaagcaattttttttattattgatagcatcttaggggaattaagtatctggctgctaaagagaccaagtttgtgtgaaatcttatgagtccatttactctattctgattgaccaaacagaaaattaatacctgttctatattcataagaaatatatttttgtatttttgtctgacaaaacattccaatatcacaattgtttcaggagttattaattaagagtacagcattaaaaaggggacaacaaataagcattgaggcagaaagcagacaataaaataatcatgggtagtaatgtagccagcctaaaagtactgggtattattggcctgatgagtgtagtacatgacaagttacataatctttagctttggtaaaagaaaaattaaggtaaacaattgactttagatgactttctaaatttgaaagagtactactgatatataatcttgttttataaacactaagataataaaaggtttaacagggtttagcaaagttcaaatatctcaattcagttcttactacaatatctgtttaagaatggaaacaccccattcactaactggacttcaaaagacatttattttagtcagcttgtagagtggctgaactacataaaatttagagaatacaaaacacatctaaatattttagtaaccctcacattataaagtaagtgatatggtttggatttgtgtctctgcccaaatatcatctcaaattgtaatccataatgttggaggtggggcctgatgggaggtaattggatcatggggctggatttccttcttggtgctgttctcatgataatgagtgaggaatccagatttggttgtttaaaactgtgtgctacctgaacccatctcctccccgcagtgcctgctctggccatgtgaagatgtgccttcttcccctttgtcttctgccatgattgtaagtttccttaggcctgcccagccatgtttcctgtacagcctgcagaattataagccaatgaaacatcttttcattataaattacccagtctcagttattcctttatagcagtgtgagaaaaaactactatagaaacctggtactaggagtcaggtattgctatgaagatagctgaaaatgtggaagtgactttgaaactgggtaatgtgcagaggttggaagagtttggaggactcagaagaagacaggaagatgatagaaagtttagaacttcctagagatttgttgaatgattgtgaccaaaacgctgatagtgatatagacagcaaaggccacgttgacgaggtctcagatggagatgaagaacttactgggaactggagtgaaggtcacttttgttatgcactagcaaattgagggagcattgtgcccctgccctaaggatctgtgggactttgaacttgagaatggtgatttagggtatctggtggaagaaatttctaagtagcaaagtgttcaagatatagcctggatgcttctagccttctatgttcatattcatgtgcaaagaaatgatgcaaaactgaaacttaaatttacaaaagaaggagagcgtagatgttaggaaaatttgcagcctggccatgtggtagaaaaaaaaaacaattttcaggggaggaattcaagccagctgcagaatttttcaaaattaaaaggaaagcaagtagtaatatccaagacaatggggaaaaggtcctgagtatatatcagagaactttgtggtggcccctcccatcctaggcctggagacataggagggaacaatggtttcatgggccagacccagggccccccctgccctgtgcagcctcaggacactgcttcttggatcttggctgttccagctctccagctgtcccttaaaggggtccaggtactcaaactcctgcttcagaaggtgcaagtcataagccttggtagcttccatgtggctatgcagagtgcaattgttgaggcttgggaccctctgcctagatttcagaagatgtacggaaaatcctggatgtccaggtagaagactcctgcagaggcagagccctcatggagaacctctactagggcactgcagagacaatatgtgggttaagagcccccacacagagtccccactggtgcattgtctagtggagctgtgagaagagggccaccaccttccagaccccagaatgatacaccaacagtttgcaccgtgcacctagaaaagtggcaagcattcaatgttagcccatgagagcagctgtggggactagccctatagagccacaggggtaggtctggccaaggctttgggagacaaccctttgcatcagtgtggcctggatgtgagacatggagtcaaaaaagattattttggagtttgagatttaataactgttctgctgggttttggatttgcatggggcttctagcccctttagtttggctgatttctcccttttggaacgggagtatctaaccaattcctgtactcccattgtatcttgggatcaactaacttgtttttgattttacagtctcataggcagaagggactagccttgtctcagataagactaaactttggccttttgagttaatgctggaattagttaagagttttggggaccgtgaggaaggcatgattgtattttgaaatgtgagaacatgagatttgggagggacacagggaagaatgatgtggtttggatttgtgtccatgcccaaatctcatgctactctcatgatagtcagtgagtgctcacaagatttgtttgtttaaaagtgtgtggcatcaacccctctctatcttactcctgctctggccatgtgaagatgtttctgcttcccctgcaccttacaccatgattgtaagtttcctgaggcctccccagacatgcttcctttacagtttgtggaaccgtgagccaatacaaattcgtttctttataaattactcagtctcagttatctctttataggagttcgagaaccaactaatacaatcagtgaaccaacttctttggttgtcagtatctatctgggaaaccccagagggttaacatgtagaagacattgcaacagctttttttttttttttttttttttataattccagatttggaggctgaattgaaaaaggcaaaagatttgagaacattgattaagatactggatattgtaattgattaaaatcaaggaaattgctactttttattttagagagagattacttaaagctaacacagtagaaagcaacaaaagtaagtccctgtagcaataagtaacttctattaaaatgatttaaaatactgcaatggcagcaaaaacattaaaaggtgcatagtgtctcaaaaagcaggtgaatatactacgacccagtttacatattttcatgtctaacaatagtacaagtatagtatcaacaatgtataaccagatatttgaattacaaccagtaaccaaagtatccaacttctgtttccttaaaaattgacagagaaaactaaaagacaagtaaccccaaactacatgctatggtattccatgagcatacattggatatccactttataattttataggagcaaaaataaacttgtatgttgacattatccaaaatcatttatacatcctctaatccattaattaatgaccataacgtaatgtctatacatgagaaacaaggtcaaaataatatgatttagatattttgccttacctagaaagtgttattatgcaaatatcactaataaatgatctaaattaaatctttacctaaagtagatgtcagcaaatgaatgccaatagaatacattcagcctatcttaatttttttgtacagactgttcttctaactgcctacaaattaggaattgttcttacatgcccattgacaatgagttctcatttgatttattagttctctcttggagtattaaagtattacaatttgaagaaaattttcagtatttttaaaacagaaaatgatgtccatttttgtcccctttagaggagctatttttgataaaccaaaaaaaaaaaaaatacaaagcagaaacagagaccctgttatcaacttaaaatattgatccactaaaacaaaaacaggattaattaacaattggtctcccagggaaatatcattttcaaggttctgagtaattttatgattctaacatatatttgacagataccaaagaaaataattctggtggtttatacattctccaaaaatctttaagagattagctgtaaagcatatgtgataagcagtctccatggaatgtatgccaggaagggtcctgtattaagtttatgctaattagtacagatcttcacattactgtagtaacatctcatcaattttatatgtaaattctaaattcaattgctttaggctaaaatataaaaagcaaatattttaagctgtataaataataaaataatatctttataacaggtaaaaatatcataaggtaaaaggttaatttattagaaatatattggtgtatttcacaaaatagcctcaagaaaatctataaacagaaaataaatattaagttgatctttctccttttattgcttctattattttttttcttccctccacctgctgccaagttgccctcacttttcattattgtggcaaatcatttttatgcacttctccacatgatacaaagcatactcttttagaactcatgtgattggccctagtgttttctcagacccccacgttcaaagcttgacataggttactctgttttcagataaatctgccacaaccaaaggggaagattatataaatacaagacaaattttaagtaaaactttaaaaatgaagttgaaagagtgcatgtttccagagcagtggatgttttgggaatgtccatatctttggctacacatcgctacgttaagacataaacacataaaactaaacaaataatattgtctagagttaaatatattatttttgtatgtatcagagaatagatttatgagctgaattagtaaacagaaatatttttgaacacgtcacaggacttttccctctcagtgtctgagttttttcactgctgcaagtgagatgttgaatcaaaacatctttctacaaacaataaatgatccaatgtaaaaagagtaggaagtaaccattgccacaaaaacatctctttgattatttttcaaaataacataaatgtttattttttcaaggaaataatttcccatatgcccaatatttagaatatataatatatatctttatggcttctttcatattgttggtttaaatgtattgtatgttgcattaagactaaaagacagggtatctgagcctgacaatcagtcaagtatggaagggaaatctctaagttctatgcttggaaaatgatgaacattcattgtattttaatactcaatcatgcccacatttgaacattttctctctctcttttttctttttctgtttcatttgcttccttcccgtagaagcattctactttctacaaagatttgttcggcaggtagcatggtataatgataagagtcaggcctgaattatgacactgaagttcccctataaattttagtggtttatatatcatgctataaaaatatcacattcttaatagtcatgctatctgcatgttttcatcaccctaagcctcagtgtcttcagctataaaactaaaatattattttaattattaaataagattgttactgaaacatcacaggtctacgtcctgttgctcactgcacagaaagccaatcactgagttaacaaggattgccaggtgatatgatttggttgtgttcacacccaaatgtcatcttgaattgtatctcccataattgccatgtattgtggaagggacccggtgggacataactgagtcatggtggcagtttcccctatactgttctagtggtactgaagaagtctcacaagacctgatggttttataaggggaaacccttttggcttggttctcattctctcttgtctgctgccgtttaagaggtgcctttcaccttccgccatgattctgaggcctccccagtcatgtggaaccgtgagcccgttaaacctctttttctttggaaattagtctcgggtatgtctttatcagcagtgtgagagcagactaatacatgagggaaccaggctttactttgggtgctgcacccaagaataacaggtaatacagtctctaaatctgtttctctaacatagcaaaaatggggtgtttatatagcagggaaggcaggaaaacaggaattagggagaggtaaggaagcaatcatgaggaatgaagtttattgcatctttttgtctgatccggatgtggtaatctagtgagtttcagtccctcacctgagggttggtttcctgaggagggaactcagatgagataaatgtaagttgcaagttttaagacaagggagggtcaatttctatgtctatttttaaaaacctatagatattttttgtatgggacaatttggctggtatcagtatcccctttctatttatcaattcctccatcatggggaatctggttgtcaatctttctggctgcttcttgctgaggagagctattatgggataatgctgaggaatgcaaaccttactcctgtaattgaaagcactcatgagcacctgaccagcatctggcttgttggagcaccatgacctagatagttttatcttggtttagaacaacatagtaagccacattgcctaggatgcttagtaacatagataaaccaaattttaaaataaaaccaaattttaaaataccagagaatatggagctgatcccctggggaatcccagagtgtaactctaatgctaccaaaaacttttcctgatgcattacatcctgcatgcataaagctatggtttcaggaagagcaacaacctgaaaagcacatggtccctttatgatttcttatccaggctctttggctgggctttgaatactaactttggccctctgagggttcataagcccatgacctgtttcccctggagggatcaaaaagggcttggttttaactgagtatgagtagtaaatatatttcatcttaaagccagtctcccgtgacttggatatgaagcatatcagctgcttcatctggggtgtttcacttggcattgatatgtgaagtttggcaattctccctctcggggtaaacagatcttacggtggcatttatccaatccaccaggctggctgttctctcggaaataacctcctgtgtgtctgaattacatatacccatctgtgattgttcaacagtgagctgtaggtcctgcatcaaccaaaacatgcatttccattctacaccatttaaaaccaaagtcagtgctcccaggttcgttaatctcataatctgttttagaaaagctgatgataccaatctacaaaatgaaacaatttctttacattgtaccctctgttttttttccatttatttatttattttattatactttaagttttagggtacatgtgcacaacgtgcaggttagttacatatgtatacatgtgccatgttggtgtgttgcacccagtaactcgtcatttaacattaggtatatctccaaatgctatccctcccccctcctaccaccccacaataggccccagtgtgtgatgttccccttccttcccccactttgcctaccttctggaaaaggcaggtctcagaggtactttctggtgctctggcataatttttccttttgtgggtagtcttgaggctacttatttgagctcagaaagttccacatctgagttggtccagccccaacacccaactcagcattctcttactttcattttagctattatagataacaaaccaagggattgcatgttttgctttttctttattcgtttgcatttccttatgcatcctgtgaactaattccctgggagtagaatctatctctaaattccatggtagcttttatcttaaataactgaacgcagcacaactgcaactctacacaataggtgaccaggtttccaccaaggaatcaaaagctaatctaatagagggcatactatagttttcttctgaaacataaatttttctctctttagtcaacaatttcaaccaaagacaaattgtggtagaaccaatttatttgcaatataagtttccatctatcatacttggcctggttatttgcataatgtgcctcaagaattattgtccatataggatcttttatattggggctttgctggactttttataaggaatctcagatttgactattaaaggcctctcaagcccaggcaaggatttatctctgccagcaggtgtctgtatgaactgggtgaattcctctcttctcaaggtcccaaaataacttaaggttcctggtcctgtcagaaagtgacattctttactcatcacagatcaggaaacttataaagggaccagttagacaaaatactagaccagtctttccaaggaacttttatcggctccataaatcaacctcaatctctgaaggcattctgctcatatctgagaatatatcattccagtcaaagctttgggaaaataaccagtgtttccaaatgtgtcctattacaaaagaaaacaaattcttattgaacatatgcaaataaacatattgccatgaattaagaatattcatagatgatttccaaaatctggagaaatcaggtagagaaagaaaaatatgcattaaattggtttacaagaatatattcaattgttaaaggctataaatatctaaaaataaagaaaaaatcttttatcaaccctcaaaaataaaacaaaacaccaatgtttcattataaaaaagccatacaaaattagtttggtcctttattagttcagtctatgcaattaactcttgtcctgcttcacattgggttaacaatctttctgaacacatcagtcttttaattagagtcctgaaagttctttctctagtccaatggcacatttctagagagagaaagttatctctctagtctctttgtgccattgcaaagttatcaaacacttgcattcaacagtttttttcatgaatttccctaaagaaagaagtttggaactgtagctaactgtaagccacttttttgacaagcatcaaagtaaaacaataattttgaatgataaaggtcttaggacagttctggttaaagacaagccttaggttagccataattaaagacacaattgataaggaaattcacttatttttttggcatacaacaataataatcataagtattgctgataacatatacttaagacatatcagaattttaggaatctcatacaaatttggaacacatgttcataacatacttacataaatataaccccaaagaaagttaaacaccatttcatgtttgaaaatgcttcctttataattttaacataccatataagcttactatgcctctcttggacttcaggggatgtaatatctaaaaagttattttaacatccaaaagactaaatttagaacttgaaactttgatattggaaagtttgtcaaatatcaaaggattaaaacacttactatcacaaaataggattataggtcattataaaatagtcattcacttagccaaaatgataattccaagatttttttaaaagcaaaaacctttattctttgatagagactcagtttcccaaacaataagaccttataaagacagcatgtgcctaactaaatctctctccctcccctcctttatgcccctgaagtttactcaaaaggtaaacaataatctttatatctcttattaatgttacatgaaaattttgttcaaaaggtaaaaccagaatttacctttgcatagtatattgttaatgttcaagcctataaaaccttataagtaaatctaattttaatatttgaccataatgtaagatttccttttatgaccttttactattttctattaaagaaaagatcagcgcacccagacactggtctcgcatcactgtgcctttgatattaatgtttaatttatagaaaaactctgaaccattcttatccctcaaaacaggcctttacaatctcatgcaccacctcttctgcaatagtccttgggcctagagggattgagaagttttaatttctgaccctgtgttttagcaaagcagttcatttcgattgctgctatctccaaggtctgaaaaagaggtgttgactaatgtcaacattcaagacttggcaggagtcaatgctttcttcagatccgggagtcaaagccctgtgatgtaacagcacaaggactttaaaagcaatatagaaagtcacatggatgtaaaaacctttgaaatctcagttttcctaagcaatcagaaacctaataatcatgacctaataatgatgacacaagaattattatgataaaatgtaaaatatcttccttaggctagttaccaaaaggcaaagaaaggccctctgttgtgtgattgtttctccttaagggaagaccatttagataatctgaaagtcaatcccgatgaataatttagacatatcaagaaaagtcaacagtacagaatcaagttacctgagggaaagcactgctttcctagaccatatatgagggttgaatttggcccatgggtttccattttgaagctctggcttgcaaattaggtactaataattggaataagactgtttagagaggaaagctacctggaaaagacattttggcaacactcaatatcagtcccacataaattgatggatgagagggaaaattatcctactttgagagatgataatgtaaaggcacaaaaatgaatgaaattcattatctgaaagagtctctaagaagaattaccttccttcaggggagaatactgtgaaataatgctggtgaaagaagcttgctatgtggaaagaaaaatgaatggtaatcaaggaatgatgagacattcttggtatctgggatggcaatttaactatatgaataaaagtacataaatgttctacttctagagaaacttactagaaaatagagatgaaatgaaataatgtctaaaatttgtttaaaataaccatgagtgagaggcaagagtaagacaatattacttatgtattgataattactaaaggtaactgaagggtacacagaaattcattgcactatataattttatatgttgtatatgtttgaacatttatataataaaagtttatatatcatgtttttatataataaaaggtttagaattaaaatagactaacacatagaatattggtgaaaatgaaaagtaaaaatcaaatgtaaggaatactatcaaatatacagcaataactggaaagctatattaaataatacaagaaataaagagaaacaactga

SEQ ID NO: 110 - DNA, 782 bp, Homo sapiens
ggcttgttttgttttactttaccctccccatttaaaagaatcaagaaaggacaacctatttgattatataaaactctgtatctgttgtggaatatccatagctgttgtgggataaaaattatttcaaaaggaaattcagaattaagctatttcctctcttttaaatttagtcttacagaaaagttgcagaaaataagagtttctgtaaaccttttatacagcttctgctaatgttaatattttacatattcatagtagtttttgaaacctaaaaattaacattgatacaataccattaacttacctgcagacctattttgaatttcacgagattatgaaaaaagaattcaagattataaaattaaagaatctaatatcctctaatatccctttttttctcgtgtaggatctaatctaggatcccacattgcatttagcttttaacttagtctcttctaatctgtgacagccccatagtcttttttttcttttttcatttttttctgtctttcatatccttaacactttttgagatataccagccagttattttgttgaatgtccctcagtttgggtttgtctgatgttttctcataattagattggtattagtcctttttaacaaaaatgctgcagaaaggatactgtgcccttctcattgcatcattccaatagcacatgatgtagacctgtttcatgggtgatgtttagcttggtcacttgattaaagaagtacctgccaggatgattcatggtaaagatatagtgaagcttatttggta

SEQ ID NO: 111 - DNA, 2290 bp, Homo sapiens
atgtattttcatagttttgggtctaacacttaagacccatttaagtgctgacttttccctataaaaaggacattggtcttggcaaagattttatggctaaaacctcaaaagcataggcacaaaaataaaaatagacaaatgagaccatattaaactaaaaagcccctacaaagcaaaataaacagtcaacaaaatgaggagataagctgcagaatgggagaaaatatttgcaagttactcatctgacaggtgactaatatttggaccatataaggaacttgaacaactcaataggaaaaaaaaaaaaagttccaaataatcccattaaaagatgggcaaaaaacatgagtatacatttctcgaaagaagacacagaagtggccaacacatatcttaaaaagtgctcaacatcactatcattaaggaaattcaaataaaaaacacaattagatattatcttatgccagttagaatggctattattaataagaaaaaataacagatgctggtgaggacgcagagaaaagagaactcatacactcttggcaggaatgtaaattagtacaaccactatgggaaacagaatggagatttctcagaaaactaaaagtagaactaccacacaatccagcaatcttactactgggtatctatccaaaggaaaataattcagtatatcaaggggatacctgcacttgtacgtttatcacagcactattcgcagtagcaaagatatggaataaacctaactgtctattaacaggtgaatgagtaaagaaaatgtgtcatatatacaccatgggatactgttcagcctaaaaaaagtttgaaataatttcattctcagcaacatggaaagagctgcaggtcattcttttaagtgaaataagtcaggtatggaaagacaaatattgcaccttcacactcatatgtgggagctaaaaaaactcatcacttcacggacatagagaatagaatgatagataccagggactggggagaccgggtagtgggaagagagggattaagagaggttggttatggttataaatatacaattagatagaagaaataaattctagagtttgatagaggacgagaatggctatacttagcaacaatatcatgtatatttcacagtaactggaagagttaccaatatagttaccagttaccaacacaattcctgagtcaccaataccaatatctgccaccaatatttctgataccaatacataaaaatggtaaacccatgtgaaaatgatgtatgccccaggtacgctgacttgaacactacacattctatgcatgaaacaaatactcacatgtacccaataaatatgtaaatcattatattaggttggtgcaaaagtaattgtcattacttttaatggtgaaaaccgcaattatttttgcaccaacctaatatatcaacaaaagagggaaaaatagtgacagaatcttagattgacatgtactcacaggaagaatgaagtcttacaattaaagaatatgggcttgtctgtgttacactcagaatttgtttgtttacataattataatcaaactacatatattatggatccttctattattggtcaccaattattctggcttctgcctttgtggctctttccttgaagaagaattatatatccctgctttgctgtactcaggagtggccatgtgacctaagaggtgaatatcaaagagttagacaacgaggacataagggcagtggtggaaagagtagtcgatgaaggaacagcaaatgcaaggaacagatgtgagataaaatattgctactctaaaaagtaagagttcaaagggcattctgaaatgcacagtgggttaggagatggggtggggcgagaattcagtctgatgacttaaggtgagacagattatacagggctagtataagccatggaaatttgaattttgctccaacaggaattatttgagagccaatgaaagagcagaaaaatgacaagatcttatttgagttttagaaagatccagggtagtgattgggtgggtagtaagggaggagcagagttagattctgtgacggttcctgtcacaacagtgagaggtgatccccaaagtggtgaaaaagtgacatatctgggaaatatttgcggggtagaattgctgtgcctttgtgattcattagatattgagcttaaggcaggaagaaataggtcctcaattttctggctgactcaatgagatagcaaacaggtgaagcagatttggatatgatgagctccaggaatttgtacaattg

SEQ ID NO: 112 - DNA, 113057 bp, Homo sapiens
cttcaagatcctgcagtctctgctctcagcctctcaaacataaaaagagattattatcacccctgtactggagaacagagcttcatctttcccaagaggtcttaacattgataccctaaaggcctcctatggctcgggactttccatttttaaaagacccagaaaaaaattacccagtgtcttagttactttgggctactattaaaaaaaaaaaaatagaccgggtaacttaaacaatagaaatttattctcacaggcatggaatctggaaagttctgggtcaaggtgctacctgatttggtttctgatgggggctctcctgacttgcagatggtaccttctcactacatcctcacatggtgttatggggtaaatgtttatgccccctcaaagtttatatgttggaattataacccccaaaatagaaggtgggatgttttggaggtgattaggtcatgagggtagagttctcatgaatgggattagtgcccttttatttattttatttttaatttttatggaggcagaatcttgctgtgttgcccaggctggtctgcaactcctggcctcaagcaatcctcctgccttggcctcccaaagtgctgggattacagacttgcctcctttccaccatgtgaggtgtaagaaactggcagtctttaacctgtgaggcatcactagaaccatactatgctggtaccctgatctcagacttctagcttctaaaattatagaaataaatttccattgttcataaaccacccagtctatggcactttgttatagcagtctgaactgactatgactcatggtctttgcttggcacttacacttggattgggggaaagttgagtggtggggaaatatctgttccttttattataaggccaataatcccatcaggaagcctccacccacatgacataatctaactctaattgcctcctatcctaagctctgataagggacaggctgcctcctcaagcgggtccccaaccccggtttttcctgactgggagaaacctcccataaggggccgacagacacctcatacaggagacctctcactggcatctggcaggtgaccccctgggacaaagcttccagaggaaggaaaaggcagcaatttttgctgttctgcaggctccgctggtgatacccatgaaatttatatttcatatataattttcattgtcatgtatcataaattattactcttttgatttctttcaagcatttaaggatgtgaaaaccattcttagctcataggccatataaaaataggcagcaagctaaatttggcccagaagccatagtttaccaacccctatgctagataattgagagccaaaataaataagctattgtgctctgtcctggaagaacaaacaatcacggtggagacttgggcattcaatgaagtaaatgtcccataaaatggtaagtaccataactgcaacagggagctatggaagactagaaaaattttaaaaaaagaagaaaaatatgctagaatgacaatttaaataaataaataaaaaagaagaaggaaaataattcaattcaatggaaatttcctgccactgcatcttcttactgctgtagctctgggatatcatgatatcttgtaaagggctggtgctctgtaaacattaattgaataaattaatgcttaatgaattcattaattaataaaaaaatctcaaggacccttcctaggaattaaataaacataaatgaatacactggatacaagtcattaagtaattgctactttgagaagagaggcaggtacttaggaaattaataatggcatagtgtgataggtgtaagtaacataattagcagtagcagagaaaagggagtgatataatcagttggatcaaagggaattaaaagaggatttctggagaaggtggcatttagtcgggcagaaattatgggaaaaagaaaatccaagtcattattctgttgtggtactgagaagaagagcaggtcataggtagctggggttgggaatgacaacttggagaagacagatacccactcaaggctaacataaaagctcttcacctggggatgccaaacacaaaacaggtgggcacaccccaggtggtacttctagggaattgttagccacatttcccaagcaaaattaactgacaaataagagagctgttggctttctattgaccttaccctccctcaagttcttacccacacatctggccactgctgccaagttggagcctagaaattcagtctgaaggagttgcagaatacatccagtgcctttatgaaagagtggaaaattaatacagcaaacatgaacttcatatctatcatttccagaagtatttcagaaaaaaaaatatttttatttcaatagttttggggaaacaggtagtttttggttacatggataagttctttagtggtgctttctgacatcttggtggatcatcacccaagcagtatacattgtacccaatatgcagtgtttaatccttcacctccaccccaaccttcctctctgccctgttcccaaagtccattatattattattattatgcctttgcatcctcatatcttaactcgcacttataaatgagaacatataacatttggttttccattcctgagttgcctcacttagaataatggctccagctccatccaaattgctgcaaaagacattatttcattcctttttatggatgagtagtattccatggtgtatatataccacattttctttatccactcattagttgatggacacttaagttggttccatatgtttgcatttgtactgctacaaacgtgcatgtgcatgtgtctttttcatataatctcttattttccattgggtagatacccaatagtgggattgctggatcaaatggtagttctatttttagttcttcacggaatctccatactgttttccataattgttgtactattttacattcccaccaacagtgtaaatgtgttcccttttcaccatatctatgtcaacatcttttattttttgactttttaattattgctattcttgcaggaatagggtggcatctcactgtggttttaatttgcatttccctgataattagtgatgttgaaatttttttcacatgcttgttggctgtttgtatatcttcttttgagaattgtttattcatgtcctttccctgctttttgatgggattatttatttttttcttgctgagttgtttgagttccttgtagattctggatattggtcctttgtcaaatgcatagtttgcaaatatttccctccattctatgggttgtctgcttactctgctgattatttctgttgctatgtagaagctttttagcttaattaggtcccatctatttatttttgtttttgttgcatttactttgggttcttgatcatgaactctgcctaggccaatgtctagaagagtttttgcaatgttatcttcccgaatttttatagttttaggtcttaggtttaagtctttgatccatctcgagttgatttttgtattaggtgagagatgaggacccctcattcttctacatgtagcttgccagttttcccagcaccatttattgaatagggtgtcatttccccaatctacatttttgtatgttttgtcaatgatcagttggctgtaaatatttggatttatttctggattctctattctgttcagttggtctacatgactatttttataccagtaccatgctgttttcgtaactatagcattgtagtatagcttgaagtcaggaaatatgatgcctccagatttgttctttttgcttagtattgctttggctatgtgggctcttttttggttccatatgagttttaggattctttagaaaatatatcttttaaatcccttttgtcaaaaaatacccggatataatagaaaaataagacagttccccttttaaagtcatagtcaagtatgtaagaaagtggaggaaattaccacggaccaaaaccaaagaggaagctggaaaaatctgtaaccataggttctcctttgtgtgggtttgagatttaaatttacattacctctcaataaatcaaagtgatccaaggttgatagccctcaggggacctggcagaagcaaacgcaaatactctctggaggatgaatactagaaattgaaatattggctaaaaatccatagttatagaatataaaacactgaaggaaataagccagcgtaagtaagatcaacaggaatttatcagatataaaatatcaaaaagtatatttaaatatttaaggaaataagaaaaaattaaaatatgagccaggaacaagaccaagtaggtttaaaaaaagaatgagagaaatatgaaaaatataatggttggacttaagcatctatgagttaaagagcatatagatacaactgaaaagaaaatttaggaaccagaaaatagatttgaagaaattattaatgcaatagaggccatgtatggtggctcatgcctataatcccagtgctttggacggtcaaagtgggaggacaccttaaggccagaaatttgaggccagcctgggtattatagcaagatcctgtatctttaaaaaaaattaaaaataataataatgaaataaacaaagagaaatatttcttacaagaagaggtgacaataaattgatgaaaggatgagaaagtctaatgtacatctattaaagtttccaggaaaaaagatagatggaattagagcaaatattaaaagagataatggttaagaattttccagaatggatcaaaagtatgatgcttttaataagaatgatacaatggactttggggtcatcggggggagagtgggaggaggcaagggataataataattagtactcatatgtttgctgttattagttatgattgtgtattatagtggaaagcacataaaagttggagacaaacagctgttttcaaattgaagtatgtttcctattagttgagtgatcttctctgtgttaatatttagactttctgatcctcaatcctttctctaaaaatagatgcttgcagtctctctcatactatggtttaatgataaaactaaggtattattatatgtgcaactcaggatagtgtcaagattaaaaccaacactctgtagacatcacatttcatggctctacttgctttatttttagcttttttcttgaaatggcattgatttctctgagcttaaatttctttatctgaaaaaaattaacagtaacctctgcttcatatgaatcattagtttattcaatttagtcattcaacactcatttgctgaggatgtactctgtgccaagcactgtgctttgttctggagatacaaatatgattacgtaaactgacagcttgtgggttgggagaaggattaaataaattaaggcatgtgaaataattagccccatgcctgtagctcaggaagcccacattccaggctgaaccatccatccttcctttccctgacttggtgtatcaggcattgtgtccactatcagcagataaaataagtgaggtacacgtctcactctgaggacttagggaaattgtgccccatgattaagaggcaagtctggatgctgccagccaagttcagattctggttcctctatttactaactgtaacttaattagtttcagtgaccaaacacagaacctaagacggatttagatgcaagcagttcatttaggaggtgatcccatgaagcctatgagagaatggagaagtgagagggagcttagaaagataatagatggtatattaatgagcaagttatttctaggtgcacttgggggtaattcccatggaaggacctgtgactttgtggaacacatcttagaactgtgccacagagagagaaaaagtctttggtaatttatccactaactcatgcccttcattggttagggcttgctcattagcccccacaagctggccaatcttgccctatgattggaaatctctcttaggcagagactcccagaaattggtgtatacaggaactttctggtaggattaggcctgtagatcaggcactgacagattcccttatggtgatttaatctatctaagcctatttccccatgctgtaaaatagtgaataattacttacctatattacctatatttcctctaatacttgtaactcccagtgcctggtgaaatctgttctccacttcacccatagaagaaacttgtgctcagctagactacacttttccagcctccctttgtgttaggtgtgtctgtgtgaataagttctggccagtggaatgcaatgggaggagtgcgggcctctttcaggtctgggaattaagatgttgggcatatcttctccatgtcctctgtccctgtctgcacgactaaaacacacccatggcagctatcaagctccaaatgtggaggatgatgtcctggaagcggctgagagactcagacaaaaggagctgggtgtctgaacagcacatagagcacagctgtcacagctgacctggaccactggcatcagaaccattataagagagagacataagcttcggtgccctctacatcataatatttggggttcctctgtgacagcacctttcctaccctctccagtacacttctttataggtagtgtacaaatgagataatccaggaaaagtgcttagaacaatgtctggcatctggtaaagttctgttaaataattaattgttattattactgtttgctaaggtctgatcttctcaatggtatctgaacaacttaaagtcagagtgggggaggaatggaactccaaagaaaattagaggttttgctataagaattacagaaactggattctgaatagtccaaaatgtcaatgttcatcccacagaatgatgacaataatgcctacagttttgagggtctactttgtgttagtccccgcatgagaaagttcacctacgttattttattcactcttacagcattcttacaggataactcttagcatccatattttactgttgaaacagagactcatgaaaatattagagcattaatctcaaggcaatcatcattaggaaaaaagaaagaaaagaagacctccttcaatcaagattctcactgaactctgggatacttgaaaatggaactgactttttaaaagatagaataaatgacaaaggtgcagggagtgtctgagtcatctgagggaatgtaaagtaacatgcaacatttcaattccatttgtctgtctcctctatgcctccactcttcagagagtctaatcattaatcacccagagactttttgtctatgctcaggctgtctttactgggggggaagtaatatatcttgaatttttaaagtcacagtaatggtcccgaaacaaggccagggtaccaatttttaccattatccatacagtcaacgtttctagacttacacaacggtagcagttttctctcctgggtgatgactttatataaatatgcatgcaaacaaaatcagagtttatttggaggaagtttctgcaggatcacttcacagactctgtatttttattaaggagatatcctggggcatgaagccagttctcaactttgtgaattccctgatattcagaactaaggatatgttttttccagaaaaaaaaaaatgtacaccacgtgggtagattcccagctaatcctgctctctctccagacaccattaaccatcctcagctccaactcccctttctctaatcctcttcttcctggccttgaaccagcccagggacaaatggaacagctgccaaaggaagtgatcactccagacttctcagcttccagaagcaagggatgtgaaaaaggagaaaactttcactctcaggtacagagaaccaaggtgagtccagggccactttaggacttaccatggccgactttatggcagtggccatggcaaggattctttccttgactgaactttagtcagactccttggtgcactcttcttgactaggtctggtccttggtgtgctgagtgcattttagcaaaaaattctaagccagtttattgaaaatccccccacccttgataacctatcaagctcttcttcccttttcacatttgatttttaatcaagtttctcttaccttcatctttaatacccaacaaagttcccataagtaatattccatccacttcatcatgctgtatgttggctataaatctccaatagtccctgttgtattcagagtaaagttcagcctctctactctattacaaaaatcttgtcccctattgcaatagtttggaatttttggcaaatgtagcctttgcttggtcaaactttagtcaggctcctgaaccttctgctaggcatatttgtatacttccttgtaaaatccagtttcagcaaagaactccactaagtgagtttagcaagaaccccctgccctggatatatatctgatcatcctcaatatttgattaggttcctcattctccaccatcctgcaggtgatgtctgatcaccatgactgtggcctatcttcagcaagaattgtgttaggtcagttcagtcagaatcacaattacccctgatgtttcttagtaattttccatccactggcctacaccctgctccctgctatacgttcccatatgtccatgctgtatttggagttgagcacaatctccctcccctactgcaagaccccattgcagtggtccctatacctatcataagagccctgaatagtctttttaaatgtgctttcgcaaatcattgaataaaactttctttaacagtaggagtcaaaatatttggaaaaagtgtaatcagaagattattttcttggtgataaatggtattgtggagcaggttagaagtcacacagccagggttcaaatcccagccctgctgtagctgaggctgtgaagttgattgagttactcaagcttcttgtgcttgtctgattaagtgtgggctatttttaaatccctggggtaggactgtttcggctaaagctactggttaaagatttaggtagctttcctgggagaaatagggctattagagggaaagatgaatttagaggttgggtaaatattgagtagccacccatcttggaaagtacatttagcaccaaacaggtgaaaatatactccaattaccattctcctaccagtccctaatattgtctaaataccccaattagacattacttagagctgataggagaatggtaataggtcccttaagtaatataaacaagtgtgattttttcttttggagttagggtgtgccatttacccccattaccccacaggagttgaaggacagttgctctgagattagtatagagcaggcagctcttgcacccaaaagggaaatttataattttacttgacacctccagaattgctctttgctttgccttattgatgatgatgtctgatttgcaagccagccagagcagagagccccttcagctcaaggccatcaggggttgggactctgtcccaggggccctggtcctcagggcagttccattttcagtggccaaacttctggcagagggagcaagctttgtagggctttttcccatttatcccattggggcagtttgccttccagtggcctaaccttctgcacaaatggcaggtacctggaagagtgttcttagagaaatctagagggggatgggggtttgtaaagcagccaacagttgagcatgcctcttgtccctgcatttttctttatccttagccctgtcctccttactcttctctcagttataaaagactgaggaggctaatgggattttttgcacagggaccatgctgcattacacaagaaaattcactgtttctttttgagagtctgagggttaaatatatcccaatgctttaaaatgcagcccaggggtgagtctgagggatgaatgagctttttctcatggtgggaccaggaagaaaacatctactggggacacaaactgcaatttctcttggggtgtcctgctgaggggaaacggttcaactcacatctgcagagggactctgagatgcactttcaaaaggtgcatcttacctattgggaagatggcactagggctttatgctgaatgaatcctggatgagctactccaggttagtctaggtgcaaattatgctggggagccagcccaggtacaagttatgctggtgctcaatccagctacaaggggaaagagttgaggaaagactcaccatccttatgctgtttgaaatcatttggcttaagatttctggactgggaggtccagtgggcatcacaggagaacttcgagtgagaaagaaggggtctgatttccctaaaacatgtgtaggttcaccctggttaagcttccactaccaatcatactacatgtagggattggggacttttgatcggaaaggataggagacagcctctgcccttccagcaaggcagccaaacctgttcactccctgaccttcaggctacaccagggagtggccctggcaggtgatgctaaattaccagagggatactaaaatttgtctgacagaagactgaaaaggaaagcaaactctgaactctcacccaattgggtaacagtggtcagacatctttcctctagaagcttctggtccccaagcagtggccccagctggggacctttaattgcctctgggcttggatgctgtctactgaggggttagagttggagaaaagggagagagtaagggaagacagtccccaatcactcactgatcagtccctgagcacttctaggcactccccggatgggccaccaaaatgtcatgggtgcgattagatggggctggcattgggggtagtgaaagaatttaccaagacagtcataggtaaagaaaggcagatttattagagggaaagtacaaagatacattgcaagcatgccacaggaagcaaagcagagaagtgctgtctacaaagaggcaggggctggagagaagttttacagggtcattctacatgcagaatgaggtcgtgctgctggggctatgtgtgaagtgaggcagttgtgctagcggcttttctatgattagctgtctcttggaagaattgttccccccacctgagaccccttccttgttgctgcttacttattagtactcaataatggggtagtccttcatgaatggtttagcatcatcctcttggtgctcttcttttgaaagtgagtgagtcaacatgaaatctggttgtttaaaagtatgcaatgcctttccatccccctctcttgctcctattccagccacatgaagtgctggcttactttttgccttccatcatggttgtaagtttcctaaggcctcctgagaagctgagcaggtgccagcattatggcttctgtacagcctatgaaactgtgagccaattaaactcttttaaataaattaccccatcttgggtatttctgtatagcaatgcaagaacagattaatacagaagccttactattttcttcttctatgtccctttatagagccgtcacttgtagaggaatcttctattcacagaaattcaagagtaataatgaccacttcatgcctattcaactgctaactcaattagataatgtgatacttagaattcattcacttcaaggctctattgttgactgtgttgatttcagtatgttgtaagcatttgctgtaaaggtctagatttaagggtaacatgtgtttccacggaggaatataaaacatacctggtgagttcagatgatgtgtcttggagtcttcaccaccaactgttagaggactgagatccctgcaagtgtccctcttcagcaatttttggcagtctaggaaggagcatagtcctctccacttccaccctttcaaggtgccacaaaactgtagttccatctttgcatctcctatcaatgcatagcagctgaagatgaaatgccgtgcctggggagggctgcagttttaaccagtgagcctactccatgatttaaagggctctgacagcaaaccaaaatggaaggtatatcagtttgttctcaggttgatataaagaactgtctggggctggggaatttacacaagaaaaaggtttaattgactcacagtttcgcagagctgggaaggcctcaggaaacttacaatcatggtggaaggggaaacaaacacgtccttcttcacgtggcagcaggaagaagagggtccaagcaaaagggggaaaagccccttataaaaccatcagatcttgtgagaactcactcactatcatgagaacagcatgagggtaaccacccccatgattcaataacctcccactagtcccttccatgacacgtggggattatgggaattacaattcaagatgagatttgggtgaagacacagccaaaccatatcaggtggaattcttcaagtcttacctataccatccccttgtttcactcactctctcactcactcatccattgttcatccagtcaagcagtatttcctgtagccctcccatgtaccatggaaacaccagctgtgtggctacagaggctataactcagtgccaacttagactgttggtgtctctctcacagaaattttacatatttattcacccattattgtaaacccctcattactgctacagtataattctgaagaaaggtaaatgcaagtctcccatacaagtataaaatagacatataacaaatatttcatttatagcttccaactgacaaggcacaaattttcttgagcagaacccaggggatcaaaaaggaactgctgcagattcaagtgcaggagctgccactgacagtgtggactgatggaaaggggtgaggccccaaggccttccttgctttctcaatggggaagctcctagcctggggcaaggtctgagtagggggcaggagtgctgtgggagtgaaactgatctcaccaactgcatgggagttgggtgagggctgtcactactggctatcccacactttgctggtgaacgatataaaacagagacacagccataattccctctgaaacataaccctgttggcctgagaaccacccccaaacccccacagcggctgcagcaagccccactcagggtaagtctgagcccagacccgcctaaccctgccccaacctgatggtatttcattacataacctggtagccaaacacaaaagacagaaagtcttgggagatttatggccctgctcatcacctgggaaaccaaaatacttaccctgggcaacttagagaaagcttagatccccctactactactgcaactggtgctctcttgaaagtgccacctcctgattggcagccaaccaactcaggccattacagcaactcaggatggaacaatcctgatcccaggaaggagaaaacaacaactaattctactacctgcaacatcccagctaaccagaggttctgagtgtgtccaacatataaccaacatttgagaaaacatatctacaaccaaggactctcattgagtctacttcactcccctgccacctccaccagagcaggtgctggcatccgtggctgggagacctgaagacaaattacatcacaggacgttttgtagacattccacagcaccagcccagaacctggtatccccattgggtgtctagatccagaagagtaataacaatcactgaaatccagctctcaaaaagccccatccctatgagaagggaggagagcaccacatcgagggatcaccccatgggacaaaagaatctgaacagcaggccttgagttccagacctttccactgaaatagtctacccaaatgagaaggaaccagaaaagtaattccgataatacgacaaaacagggttgtaaaacaccaccaaaagattacactggttccccagcaatgaattcaaaccatgaggaaatctcttaattgccaggtaaagaattcagaaggtggattattgaactactcaaggagatgctagagaaaggtgaaaaccaacttacagaaatttaaaaaacaatacagggtatgaataaaaaattctccagggagagagatatcataaagaaaaaacaattacaactgctggaaataaaagacacacttagagaactacaaaatgcactggaaagttttaaaaatagactagaacaaatagaaaccatgaaaccatttctctctcctagatatctgggcctgtgatgggaggggctgctacaaaagcctctgaaatgccctggggacattcttcccattgcctttgctattaacatttggttcctctttacttatgaaaatttatgcagctgtcttgaatttctccttagaacatgggtttttgtttttgaacacatgaacaggctgtacattttccaaacttttactttgcaagcaagcgtatgttaccatgttagagcaggagagggagtgaagggggaagtgctacatacttttaaacaaccaacttttgcttcccttttataagttctctttgcttatgcaaactagcataggcttttagaagcagctgggtcacatcttgaacactttacttcttataaatttcttctaccagataccctaaatcatctctctcaagttcaaagttccacagatccctagagcatgtgcagaatgtcaccagtcttctttgcttaagcatagcaaaagtgacctttgctccagttcccaataatttccttatctctgtctgagaccacttaagcctggaattcattgtccgtatcactcagcattttggtcaaaaccattcaacaagtctctatgaagttccaaaacattttcctcaacttcctatattcttctgagttctcaaaactgttacaacctctgcccattacccagtttcagagttgcttccaaattttcaggtgtctgtacagcaatgcccactccttgtaccaatttctgtatttgttcattctcacgctgctataaaaaactgcctgagactgggtaatttataaaggaaagaggtttaatcgactcattgttccacaggctgtacagaaaacgtggctgggaggtctcaggaaacttataatcatggcagaaggtaaaggggaagcaagcacatcttaccatgctggagtgggagagagagcaaagggggaaatgctacacactttcaaacaaccagatctcatgagagctcactcaccatcataaggacagcaaggtggaagtctgctctcatgattcaatcacctcccacctggcccctcccttaacatgtggagattagaattcagcatgagatttatgtgggaacacagagagaaagatcatatcaataacacaataagaaaagcagggtattaaggcaacaactagcataatgaataaaacagtacctcacatctcaatactaacattgaatgtaaatggcctaaatgctccacttaaaagatacaaaatggcaaaatgaataaaaatccaccaaccaagtaactgctgtcttcaagagactcacctaacacatgaggactcacataaacttaaggtaaaggggtggaaaaaaatatatttcatacaaatggaaatcaaaagcaagcaggtgtagctattcttatatcagacaaaacagactttaaagtgaaaacagttaaaaagagacaaggtgggacattatataatgataaaaggattagacttacagaaaaatattacaatcataaatatatgtgcacctaacactggagctcccaaatttataaaaccatcactactagacctaagaaatgagacagacggcaacacagtaatagagggggacttcagtgctccactgacagcaccagataggttgtcaagacagaaagtcaacaaagaaacaatggacttgaactatagaacaaatagtcttagcacatatttatagaacattctatcaaacaactgcagaatatacattcttttaatcagcacatgaaaaattctccaagatacaccatatgataggctatgaaacaagtctcaatacagtgaagaaaatcaaaattatatcaagtatcctctcagactacagtggaataaaactaaaaattaactctaaaaggaaccttcaaactatataaatacatggaaattgaataatctgctcttgaatgatctttgagtcaacaatgaaatcaagatggaaatttaaaaattctttgaactgaacaataatagttacacaacttatcaaaacctctgcaatacagcaaaagcagtgctaagagaaaagacataaaaaagtctgaaagggcacaaatagaaaatctaaggtcacacctcaaggaacaagagaaacagaacaaatccagcagaagacaagaaatactcaagattagagcagaattaaatgaaattgaaacaaggaaatacaaaggtaaatgaaataaaaagctgattctttgaaaagataaacaaaattaatagaccattaatgagattaaccaagaaaagaagagagaaaacccgaaaaaactcacttagaaagaaaataggagatattacaactgataccacagaaatacaaaagattattcaaggctattatgaacaccttttatgtgcaaaaactagaaaatctacaggagattgataaattcctggaaattacaaccctcttagattaaatcaggaagaaatagaaactctgaacagaccaataacaagtagcaagattgaaacagtaataaaaaaaatgccaataaaaaaagtccaggaccagatggaatcgcagctgaattctatcaggcgttcaaagaagaattggtaccaatactactgaaagtattccaaaaaacagaaaaagagaaaatcttctctaaataattctataaaaccagtatcaccctaataccaaaaccaggaaaggacataacaaaaaaaagaaaactatagaccaatattcctgaagaatatagatacaaaaatcctcaacaaaatactaactgaatccaacagcacattaaaaagataatacaccatgatgaagtatgtttcacactagggatgcagaaatgacttatcattcacaagtcaatacatgtgatacatcacataaacagaattagaaacaaatatcatatgatcatctcaatagacatagaaaaaacaaacactggacaaaatccagcatccctttgtaaataaaatcctcagcaaaattggcaatagaagggacatacctcaaggtgatacaagccatctatgacaaaccacagccaacattatactaaatggggatgatatggtttggctctgtgtccccacccaaatctcatcttgaattgtaattcccatgtattgagggagggacctagtgggaggtgagtggatcatggaggtgatttcccccatgctgttctcatgataacaagtaagttcccaggagatctgatggtttgaaagtggcactttttccttcatcctgtctctctcctgctcttctgtaagatgtgccttgcttctccttcaccttctgccatgattgtaagtttcctgaggcatccccagccatgaggaactgtgagtcaattaaacctctttcctttataaattacccagtctcagctagttctttatagcagtgtgaaaatagactaatacaggggaaaagttgaaggcattctccctgagaactggaacaagacaaggatgcccactttcaccacttctattcaacatagtactggaagtcctagacagagcaatcggagaagtgaaagaaataaagggcatccaaatcggtacagaggaagtaaaactgtcactgtttgctgattatatgatcgtatacctagaaaaccctaaaaatgaatccccaaaagcttctagatctgatagatgaattcagcaacgtttcaggatacaaaaatcaatgtacaaaaattagtgtgctagagaagttcctctgaacctgtagagcactggaaaaaaaattagtagcactactgtacaccaacagtgaccaaacggagaatcaaatcaagagctcaatctcttttacaatagctgtcaaaacaaacaaacaaaaacaaaacaaaacaaaatcttaggaatatacctaaccaaggaagtgaaagatctctacaaggaaaactacaaaacactgctgaaagaaatcattgatgacacaaacaaatggaaatatatttcatgtttatggatgggtataatcaatattgtgaaaatgaccatactgccaaaagcaatctacagattcaatgcaattcaaatcagagtactatcatcattcctcacagaactagataaaacaatcctaaaattcacatggaaccaaaaaggagcctacatagccaaggcaagcaaaaagaacaaatctggaggcatcacattacctgacttcccactgtactacaagggtatagttaccaaaacagcatggtactggtataaaataggcatatatactaatcgaacagaatagagaatgcagaaataaacccaaatacttacagccaacagatctttgacaaagcaaacaaaaacataaattggggaaaggacaccttattcatcaaatggtgctgggataattgacaagccacatgtagaagaatgaaactggatcctcatctctcaccatatataaaaatcaactcaatgtggataaaagacttaaagctaagacttaaagccctaaaaattctagaagataccaatggaagaactcttctaggcattggcttaggcaaagagttcataaccaagaacctaaaagcaaatgaaacaaaaacaaaaataagtagatgggacctaattaaactaaaaagcttcttcacagcaacagaaataatcagcaaacagacaacccaaagaatgggagaaaatatttgcaaaccatgcattcaacaaaggaataatatccagaatctacaaggaattcaaatctgcaagaaaaataaaataatcccatcaaaatgtaggcaaaggacatgaatagaaaattctcaaaagaagatatacaaatgaccaacaaacatatgaaaaaatgctcaacatcactaattatcagggaaatggaaattaataccacaatgggataccaccttactcctgcaagaaggccgtaatttaaaaataaaaaaaaatagatgttggtgtggatatggtaaaaaggggacagttttacactgctgatgggaatgtaaactagtatgaccactatggaaaacatggagattccttaaagaactaaaagtagaactaacatttgatccagcaatctcactactgggtatgtacccagaagaaaaataagtcattatataaaagtacacttgcacacatatgtttatagtggcacagttcgcaatagcaaaaatatggaaccagccaaaatgcccatcaaccaaggagcacataaagaaaatttggtttatatacagcatggaatactactcatccataaaaagaaacaaaataatagcatttgccacaacctggatggagtcggagaccattattcgaagtgaagtaactcacgaatggaaaaccaaatatcgtgtgttctcatgtataagtgggagataagctatgaggatgcaaaggcataagaatgacacaatgcactttgggactcagagggaagagtggaaagggattgagggatgaaagactatacactgggtacagtgtaaactgcttggttgatgggtacaccaaaatctcagaaagcaccactaaagaaattatccaagtaagcaaaaatcacctgttcccaaaaactattgaaataaaacaaaaaaaaatttttaagattccattcatgtgggttaatgacaggacccataaaaaagccagcacatttcaagtgctccctagccatgtgtggcttatagctttcatattggtgcagattaagagcagttccataattacagaaaattccactggacagtgctgctctagataatggtaggtactatagaaaacaagctggtaaaaatgttcagggtgcataaagtctgggcaggttggggagatttgtgtttacttagcaagaatggtgttgccatggtttctctaggaaggcagcatttgtactgaatgacaaagagtcatatttgcaacctaatgacagatttttttaggctgatagcttgtgttaaagttctaaggcaaaaagaactggagaattggaagaatagaaggcaggtagacacaaggacaaaaggaagattctagaactatagggtatttgcttgtcactctaaaattggaagccaagtttttcttcccctttttccggaagggatcgctttggtaaatcctcctgtcatgaacatgtaagtcaggggtctattctctcactttgtggtagccttgccttttgatgaggaaaccctaattcaaataccgcaaactagaatgtgatatttaatcatgtgaaaaggctgggagggcagacagagatagtagtttttctggttagggtggatttttctgtgcttagagatttgtgattgttaagatacttctattttttttttctccagaggtcaggcatagcgttttaagggccttgaccttgggaagaaactgtaaggcagaggactctgatttgaataatactgtagaccaagttctaaagacagacatgacccaaagaaaacctgtgagatggaacctggctaagaaatgttcagagaaatgaagtccaacaaccatctgaaagttttctgagttgtgatctattcccttacccaattctaaagtcttcagtgatacacagtatcagctttatgttagcactgcctttctgaataaagtgtaggataaggcaaactaaggaaggctaaagcattaggaagtgaagtaaggatgtgacccaaggtaatcaggaagaaatgtgggaaggacaatttataagaaaattcaaatgcagattcccctacagatactcaggaatcctgggaggagactagatttcctgaaagacagagggctactcagaaagctgtacaacatgaggatacttgagttacataaaaatcatcacaataattacaataactaatggaacacctactagatcccagacaccatatttacatacattgtctcacttaatcttcacaataaccctgtggaataaatactgaatctctaatttatagaaaaggaaattagccaccataataataataaaaaaaaaaactccacatctcagaggctttccaaaatagaactcagtttcctactcaggtaaaacagcaacaacaaaaaagggtgttcttcatcagcgtgtgtcaaaggcattagaaccagagtcagccacttcatcttgaacaggggctatgtacaaggagtctgaaatctgctgggctgcattttcaggaggtttaggcattcttaggcacaggatgaggtcagaggtcaggacaagatacaggtcacaaggaccccactgataaaacaggatgcggtgaaggagccagctgaaacctgccaaaaccaagatggcaatgaaagtgacctgtggttgtcctcactgctaactatatgccaattataatgcattagcatgctaaaaggcactcccaccaggagccatgacagttgacgaatgccatggcaatgcccagaagtatatggtctaaaaaggggaggaaccctcagttaagagaggggaatcctcacccctttctgaaaaaactcatgaataatccaaaacttgtttagcatataatcaggaaataacaataaaaatagccaaccagcagccctcagggttgctctgtatggagtagctattcttttgtttcttctctttttttttattacttcttttttcttttttttttaattattattatactttaagttttagggtacatgcgcacaatgtgcaggttagttacatatgtatacatgtgccatgctggtgtgctgtacccattaactcgtcatttagcattaggtatatctcctaatgctatctctcccccctccccccaccccacaacagtccccagagtgtgatgttccctttcctgtgtccatgtgttctcattgttcaattcccatctatgagtgagaacatgtggtgtttggttttttgtccttgcgatagtttactgagaatgatgatttccaatttcatccatgtccctacaaaggacatggactcatcattttttatggctgcatatatgtgtatatgcatgtgtatatcatatatgtgtatatgcatgtatatatgtgtatatccatggtgtatatgtgccacattttcttaatccagtctatcattgttggacatttgagttggttccaagtctttgctattgtgaatactgccgcgataaacatacgtgtgcatgtgtctttatagcagcatgatttatagtcctttgggtatatacccagtaatgggatggctgggtcaaatggtatttctagttctagatccctgaggaatcaccaaactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgacttgcgtttctctgatggccagtgatgatgaccattttttcatgtgtcttttggctccataaatgtcttcttttgagaattgtctgttcatatcctttgcccactttttgatggggttgtttgttttttttcttgtaaatttgagttcattgtagattctggatattagccctttgtcagatgagtagattgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttatagtatagtttggtaagtcaggtagtgtgatgcctccagctttgttcttttggcttaggattgacttggcgatgcgggctctttttttgttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcatcttttatttcattgagcagtggtttgtagttctccttgaagagatccttcacatcccttgtaagttggattcctaagcattttattttctttgaagcaattgtgaatgggagttccctcatgacttggctctctgtttgtctgttattggtgtataagaatgcttgtgatttttgtacattgattttgtatcctgagactttgctgaagttgcttatcagcttaaggagattttgggctgagacaatggggttttctagatatacaataactaaacttgttttcactttactcagtgaacttaccctgaattctttcctgtgtgaaatccaagaactttctcttggggtctggattgggacccctttgtggtaacacatggatttcaaagccagtgagaagccaagacccgggctccttctaccctgtggctccatcattctctatagattttggtgacaatgtgtgtctccctggaggaagaagaggaagcacagagtatgtccagggagggctttatgggacatctaattagctagaactcagtcacatggccacacctgcagcaagggaagctgggaaaggaaatttagctgtttcctgggagatacaggaaatgagtttggaaataggtagctagtctttgccttgtttggaattgtcctggtggctggtctaggaatgtcagaggagggatttaaaatgatttttttgtttgtttgtttctatagtccatgagacactgtttatgcacatagagtctagaatttgggaattgttagatttatcctccttgattcattgatttataaggcttggtttctaaactgcacctgtggtagaagtgggttaccaaatgacatctatgataataagcggatagcaaacactagctttggagtcaaacatatctggttttcctcatcactaaaatttagaaaatagtatgtgtcttagaatgtaattgttagaaataagtaatacatgcaaagtcccccaaaatatgcctggtacatagtacaagctcaatgaatagtagctctcttaatgtgatttgtctaatgagataaataagagtaaaatgaaatgaggtttgaccaacaagagaaaatcagagtatttaatgcacagctgtcttaaggtcttgaaaaaatggtaaggaagctgatacattaaattctgagcaatggaatggccccaaaagtggataatgtgatcatagctcacatacagaaaatgaaaacatatcaggtgtccagagaaacccagaatttcctgacactgaaacttgagagaaattttataaaagagacaatggtttaggaagtgagtcacattctcaaccaaagtaacctcaaatgagtaacaaattttctagaactgtctcttgttgtaatttccttcagcgacatacaaccaaaataaaatttgaaaaaagttcagttctataagggtcaacaaaatgaaggccaaataaccagctctctgattatttaacttgaccaaagaataacattcaaagatccacaggaatgaatgaacacatccttggtgcctgtgtcccccaagaagggaatcaaacaccccaagatatgtgcaaaataatccaggaaaaaaggggagacaatatttacaactttcagcaatatttatttttatttcatacttttgtgtttttacttggttcccaaatgtatgtattttcctagtcaacatacataaaatcaatttaaaaataagtatatccataaaaataaaatatactacaatatttatttaacttatatcagaaaacaggaatagccaaaaggtggaaggaacccaagtccatatacagatgaatagaaaagcgagatgtatatacaacatacaatggaatactatcagcctcaaaaaggaaagaatttctcatacctgctttaacatagatgaactttgaagacactatgctacatgaataattcagacccaaaagatcaagtattgtataattctacttatatgaggtacccagaagagtcaaattcatagagacaaaaaatagagtagtggttaccaggagctggtagaaggcagaaatggggagttatgtaatggatacatagactcactggggaagatgaaaaagttctggagatggatggaagtgatggttgtacaacaatctaaatatatttaatgccactggattacacacttaaaatagttaaaatgttaaattttatattatgtatattttaccacaataaacaaaatttaactttgagagacctctgctttagtttatcatccatgaatattgaattccttttttgtcacagttgaactttcagtgagaattgaagaacaggatactaaggtcatgtgctctgaccagagcctacgaagtttccatttttaaattttcttttgcctttgtgtgatactatgatacgtggaaaaggtacccatatgagaataaaatagacccatgtttgaatggtgatgccatcccagttctcttttcctcagggggtgggtgaccttgatattgatgtgggtaatgccctaatctgggtgcttgatgcctagtagctgcccaggtaggtactcacctcacctttagagctaaccttaaggaatcagctgctttgtctcagtgtctgagtctccagtttattcatctgtggggcagctccttcccagagaaatctaagttcagcgaaatttggttaatataattcatttaaggcaatcacatagtcattatatcagaactgtgctccaatccctaatttttatgtttttgagaagtatattcacattaagcaaaaattaaacacaatgataaggaaatacccaattgtcttcctcaccctggagtaaaattccctaacctactgaaaagaatgtagattgaacagcagctgtgtgactgcattagggctctaatatgcagtggaagtcactgaaatacagtggcttagtgaactacctctgatgtccagggcctgactgtcaaacctcaactctagcatatgtctatcatgtgaccttaggcaggtcaatttgccagtcttagtgtctcagtttcctcatctacagtgttcacgtcacagggttactatgagggtataatggcttcaactatatccagtgattagaatcagcacttattaaacactcaatagctattagctattattgatggttctgtcccatttcctatgtgcagcacttaagctgaagatgaatttctttttggttcaagatgctgctgtctcctcaaaagagagattccaaacccaaccagagcagtgagagcatcctcatcccatggtttggttcctatatcggaaacacctcccttcgctggtttcctactggatcataagccaaaactaccttcttatttttcagaattcttgaccaactaagttgccccctgaccacacagacatctgcttttcctagttcactcagtgcttctaaccctggtccctaccacatgtgctgttaagaatgacatgatgtagggggctctttccatacccagctctctggaccacaatctccaagccacagaaccaggctctcttcctttccaaagctcaccccaaactttccactttgctttgtataatgattgtggctcagctctgcacatgtggactctggatatgtttccagcttcttgacttttcttggaactgaattgaaagtttattttactttgctctttcataatttttatttttctgagtttgacagtatatagagtcacttattttttaaagcttctaaattcttgttgttgttgttgttttcctattggaaccagcattaggagatactttcatatgaaataagaattcaacttaatggttcactaactgctttggtgctggcttcacgaagcttctcaggttgggaatccactggtcattcacatccagccaagggccacaccacagtagctcagtgagatctctctaccctgcagaaatgttcaaatgttggaagagccttttaagagtatcacattttcttcaaagtagtaatagcacctcctacatttaagccttcatagtctgtattctcaaactctgggattctaagaagataattaataaagattaagaagttgtatgaaaggaactagaaattcaaatcccagttactagctgagaaacactaagtctttctccttcttctttatccatcatatatataaagtggggatagggatgtctgtgtcacaggaccataggaaagattaatgataatatgagcaaggtgcccacagccatgagtggtccataaaaggtgcttaatcaagaattataattattaatattttccatctttcaggtaggtgtaacttattttcctgtggtgagtctgcacttcctttgcttttgactggcaatttatgagctgagtatcctgacactggttagctcatgctgaccgagagctctgatcaacagttatagatgtctgtacttgaaatcaagaaaataaattatttcagggggtatggtggaccaaatatttcacaagatgaagcccacaggtgaaagattacacaagtgtgtgatgacaagtaggtattattaaagaggtggggtttggaggtcagtgtctgaccaccagtaagcctgtgaactgctctcagatttgggctcatcatctgagaaatgaagataatatattctgccttccccagagttattgtgatgacagacatttagataatacataaaattcctagcactagcccaagacacagtagggtcaccacaaatgatcattctcaactttccctttgtggtaaaatggtgggaagcacagttccacccccacacttgctcactaatgcacacacacatgggaaggagttttattcccgagaatgacggtgccatatatcactaatagcgggtgattaggttaggctgcaatcctgagtccaggggattcagtgcctgcttccagagatctaaatctcataactaaacaggaggccactcttcaaattacttcagaaagcatttttcatttttttcttctatgggcattattaacttttaaaatgtactttgttttagctgagtgcatcccagcctcctctgctagccaccacctcgcctcttgtactgatggtctcctcacatcctcacgaagctcgtttttttgtccatcagcattcaaaatctcccctttctgaccttgcaagaaaagtgcttctaagagctgggagaggagtgggctgggaaaaaaggctcagaattatcctggctgaatttggcatttgctacagtctttgatctcggatgcagtaacgtgtcagccagaccaaagtcattttatatagaggtctgcataagcgaagtggagggacttcatggttaattgattaaaatggtccaaagaaggtgtgagatcaaagggctgctcactggttttatgtttccctggggtcccgcaggccaagtgggtgacacaaatgaccttgggcgtgagggtattcaaatgctggtgtttgtttgttttattccaaaacacaatttgtgtttcccagggcttcctgatgacaggttgtattgtgggctccccatggccctcatctatgtttaggggggcctcaagtggaacagcaaccatgagcaggagggcatgaccctgtcatgctgccaccagtgcctctttctgccaaaccccaaggaaaaagactccattacattactggaaggcgaagaccacaattttctctttatcttttttttttcttatttccagtaagggtcaagaaaatgttgtcacagtgcaggatcagtgcctggacctgagacaaaagggaggctagaaaatgtttcattgttccaaactgtcctgataagagccagaggaatctgctgggcaaacgtgtctatcaaaaggctccagggattaaaaacgtagcacagaaggaagaagtaatagtaagagaggatctgctgcccagagaagcatcatcaactatcattggtgacactgagcattagcaatggaataactgttaccgtttatcaagttgctgcaatttatcaggcactagctagtgctaagtgtagcacatccctcgcaaattctcattaatcttacttcctaatagacagaactgaggccagagaccataaagatcccttcagatcacaacttgagcttggatttgaaatcgtgttggtctggctctgaagtacacacctccatcatcctgtgatgggcctaattgtgtccaccaaaaattcatgggttgaagcaccaatcccaagttcctcagaatgtgactgcaattacagggaaggctttaaagaggtaattaagttaggatgaggtccctagagtggtcctacttcattacaactggcatccttagaagaagagaaaatttggacacaaactggtacagaaggaagaccctgtgaaggcagagaggagacaaccatctacaagccaaggagagaagcctcagaagatatcgaccctgctgaaaccttgatcttagacttctagcctccagaactttgagaaagtaagtttcatcctccttcaaatggcttccagattgcgaggtggctgccatccactccatgtctgcatgccatggagcaacaagggagcaggaaaagggtgaagtgtgtttatttggtaaaagacactgtattcgtttcctattgctgccgtactgaattttcacaaaacttaaagcaaaacaacagcggctaaaaacaatgcacatttgttatcttactgttctggagacaggaagtgctttgttaggaggaatggactccctctggaggccttaggggagaatctggttccttgccttttccagctctagaagccaccctcatttgttggcttgtggaccttttttgtctttttttaatttatttattttttttttttagtattatactttaagttttagggtacatgtgcacaatgtgcaggttagttacatatgtatacatgtgccatgctggtgcgctgcacccactacctcatcatctagcatgaggtatatctcccaatgctatccctcacccctccccccaccccacaacagtccccagaatgtgatgttccccttcctgtgtccatatgttctcattgttcagttcccacctatgagtgagaatatgcggtgtttggttttttgttcttgagatagtttactgagaatgatgatttccaatttcatccatgtccctacaaaggacatgaactcatcattttttatggctgcatagtattccatggtgtatatgtgtcacattttcttaatccagtctatcattgttggacatttgggttggttccaagtcgttgctattgtgaatagtgccgcaataaacatacgtgtgcatgtgtctttatagcagcatgatttatagtctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatagtgagcattttttcatgggtcttttggctgcataaatgtcttattttgagaggtgtctgttcatgtccttcccccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtcttcaatccatcttgaattgatttttgtataaggtgtaaggaagggatccagtttcagctttctccatatggctagccagttttcccagcaccatttattaaatagggagtcctttccccattgcttgtttttctcaggtttgtcaaagatcagatagttgtagatacgtggcattatttctgagggctctgttctgttccattgatctatatctctgttttggtaccagtaccatgctgttttggttactgtagccttatagtatagtttggtaagtcaggtagcgtgatgcctccagctttgttcttttggcttaggattgacttggcgacgcggcctcttttttggttccatatgaacttgaaagcagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaggtccttcatgtcccttgtatggtggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatctattgagagtttttagcatgaagcattgttgaattttgtcaaaggccttttctgcatctattgagataatcatgtggtttttgtctttggttctgtttatatgctggattacatttattgatttgtgtatattgaaccagcctcgcatcccagggatgaagcccacttgatcatggtggataagctttttgatgtgcttctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctgttagaattcggctgtgaatccatctggtcctggactctttttggttggtaagctattgattattgccacaatttcagctcttgttattggtctattcagagattcaacttcttcctggtttagtcttgggagagtgtatgtgtcgaggaatttatccatttcttctagattttctagtttatttgcatagaggtgtgtgtagtaatctctgatggtagtttgtatttctgtgggatcggtggtgatattgtgcttgggacatcagagcagaagaaaagagtcttggttcctgatgagccaccagccctcagatgctcatccctgaacttcctgtcacacaaaacaaaggaaatgtgttgtgtttaagtcactatactaggattttgtgtagtaatgtgtcagagctgactctcatcaacttctgaaaggtaattgttaaatttttcagaactttatagtcaattgttaacacagacgttattaaaaattaagttgtggaatcttacaattaaattatatttaaaatgaaaaaaaaaaaagaaagtaagtttctgttgctaagccacccagtctgtggtcctttgttatggcagccctgagaaaagctaatgcatacccttaggctatgtctaatttcccagaggaatgacccaggaaggcaggtgcttaagaaatgcccttacatttccaacttgctgggtgtaagacacaaacaatgcagttatcaaagaattatgtttgtgcggtttttttggggggagtggtaatcgagtacatttcctgctgaaataatattgttttttctatgtgtgaaacatagtgagaattttacatccttttagaagccgtctataaccccacagcacccgaataatttagacgagtctttttttgctatctgaatatctgatgtgtctctcctccctaacacttagcaccgctctctatagttactaactctctgcatcctacactgtaaatactttgagatcttgaatttgtctttttcagctttatgttcccaggaacaagtaacaagctttattcaggagagttacatgaaacaatgaaggtagaaagacagacatatctgaatgaggacatacattaccatgattatctagtcagagccactgtcctgccagtcaactcaagatgacattcctagagttaagaacacaaagaaagggctcgggttactaaatgaatgagcatgtggattttttatcttgttggaagaaatgacaatctaggtacttaacactcagaaagcaggaaaaaaaaaaaaggcagtaagtaggcagaaaggagctgggagaagggaagccaggcaacatggctgccaagggccccagtccaaagtgggcaagatgtgggtgaggtgatgaccagggtgggtccctcagcctggcaaggctgacaccaaagcccatgctaacacccaccactctgtcatcttccagggcactgtaattttagagacttatatacacctcacacttttcccttttcttcttttctcttgtccttttctctcttttttcctccagttttgcctttttatatcccttagaatttagtgaacactctgttggaaacaccagccttcttcatttgtgctcagataaaactgtggactgtagctgtgttgatgtagagtctggcattttctacaaagagcaggcttcttgtacgggaagagagctatgaatccccaaagcaaaaggcccaccttgcttcttcaacagccacaccaaacttgtcctgctttgctaaaaactacagagagctatgtgttttgtcttaataaaagtgaccctgttcttctgtgtgaatcttaaagatcagtgttacaagttctcaacagttgtctgtgggtggggtgtcagctaaggaagggctatttttagattttagtcaggtaaatatatgaataaggttaccacatagcttctaggacccctttccttctcacttggctcttgttcctctgttacccaagctggaacatttggactgtggatttcactatgacagtctgtatctgtgatggttaatactgaacttgattggattgaagggtacaaagtattgattctgggtgtgtctctgaggatgttgccaaaggagattaacatttgagtcagtgggctgggaaaggcagacccacccttaaactgggtgggcaccatctaatcagctgccagcatggctataatataaagcaggcagaaaaacgtgaaaagactagactggcctagccttccagcctacatctttctcctgtgctggatgcttcctgcccttgaacattggactccaagttcttcagttttgggactcagactggctctccttgctcctcagcttgcagacggcatatggtgtgaccttgtgatcctgtgagttaatacttaatatactcatatatatatatacatatatatatatatcctattagtatatatattagtgtatatatatatcctatcatatatatatgtatgtatatattttattagttctttccctctagagaatccagactaatacagtatcttctcttttacagttttagaacctgccaaggaagggtatgcagaattttgcagtgccttttacaagctgtgctaaatccagtgtccatgccacattccttttcattgatataaaggcaactcgaagatgggatactattgacaaggggtcacaagtaccctccactcatttctctatgcggccatcccatgaacagtcactgcacaagaactccattggctctgttggatgccatgctaagaacaggatggacaccaaagagtaaagctcaacagatccagatccaaagtagcaaacaagccaggggtggagacttcaaatcctaaacagtaatgcaagggttccacagacataaaatatcacaaacataagtctttagacgcaacttttgattctgtaccaagaaaatgacatggacaagaaataaaacatttcatgatagagtcaggtttaaagctgctgtttgtgtggatcagcagaaggaacatttttaacaggggtaatagtaaatgggcaaaggaagtcccgcaagaaataattttttttttcttttgagatggagtcacccaggctggagtgcagtggtgccatctcagctcactgtaacctccgtctcctggattcaagagattctcctgctggctgggactacaggtgtgtgccaccacacttggctaatttttgtatttttagtggagatggggttcctccctgttggccaagctggtctcaaactcctgacctcaagtgatccacctgcctcagcctcccaaagtgctgggattacaggcatgagccaccatgtccagcccagcaagaaataattctgtcaggaaagaaggatgctcagatgagaggcttatcttagtctgtttgggctgctataacataacaccataaactgggtagcttgtaaacaacagacatttatttctgactgttctagacgctgggaagtccaagatcaaggaagacttcatgtctgatgagggcctgctctctggctcatagatggtgccttcttgctgcatctgcatggtaaaaggggtgagaattttctagtccttttaaataagagcattaatctcattcatgagggctctacttccatgtcctaatcatcctccaaaagccccaccccctattatcatcacactgggggttaagatttcaacatataaattttagggagacacaaatacagtaaaaatggaagaaaatgaggtgaaatggttcatgtagtgggctgaatagtgtgccctccaccaaactcattcaagtgaatctcagaaagtgaccttatttggaaaaaaaaggctttgcaaacttaagtagttaagatgaggtcataatggactatagtgggctctaaatccaatgaatgatattattgggggggaaaaaaagaagagaggatacataaagagacacaggtcagaaggccatgtgaagatggaggaagagatttgagcaaagctcaggagtgccaagagatgctgggagcccccaagagttaggaagactcaaggaaggattcttccctagagcctccagatggagcatggtcctgctgacacctcgattctagcctcaaaagctgtgaaaaatgaatttatcttgttttaagtcccgtgtttctaataatttgttatggaaaccttggtaaactaatgcagttaggatcatgcagattaagagtctcactctgtaattagatgcaccaggagttatatcacagctctgccacttcctagctgggagactttggacaggtcaacttctccacactttaacttccttagctataatatggatagataatacctatcacatgtggcttctgtgagaattaaatgaactaaaatatacaatgtgcttcacattgtacctgacacagagtaagcactccaaccatgtttcttataatctctactctcattatttttaataatatcacactgagttttctctgtatttgaagtactatgatggatgctacaggcaatataaaatttaataaaatatttcttacccttaaattactttcttagtcagctcaggctactataaaaaataccacagactaggtagattaacaacagatatttattgctcacagttttggaggctcaaagtccaagatcaaaatgctggcagatttggttcctggtggaggccagattcctggtttgtaaataaccaccttctcacttccagctcacatggctttttcaatgcttgggcatatggagagatagggagagagggagagaggagtgagaggagaaagaggagggagagagggagagaagagagggacagtggacaagagggagagaagaaggagagagggagacgagagaaagaaggagatacctctgtcttcgttatcttataagggcacaaatcctatcatgcaagtcacaccctcatgatctaatctaaacctaatcacctcccaaagtctccacctcccaataccatcccattggcgggtagggcttcgacatatgaatttagggggtggacacattcagcccataacaattgctaaaactaaaaagaattcgatcatccacacctccacagggcactacagtgaaaacttcaacagaatgttatctattgatcttttacgataaatgttagattttctaaaataaaacccataaaatgacatttccttttctctaacattctcacttctattttatgcaggaggctgcaagggtatgcagacacttgagggacctcttgtgttagaaaatgcaggaaatgtttggctctaagactagttttactggcaaagagcaagttgagacacagctgaatacatccagtgggggaacaaaaaaaaaaaaaaaaatgtctggcaggccagcatcacccagaccaggttggatcttgattggtttcttagggtcattgttcaactcttgccagactgtgcctttatggataaagtcaaactaaatattttaacaagtgattaaaaaactgaattttcaaacctgttaagtcattgcttcttcccatccggaagagactgggaggcagctctcctgtcaaagtctggctggtgaattcctcagggtcgctctcacagcgcgcagagctattcatcattttagcgagcatcctcagaggggagccgcagtgatttacatgctacagataaattatgatgcctctcatgatgttatcatcatttcagctcacggatttgaacactttctgggagaggacttttttcaccctttcttaaatgatgaacaacccccagacagattatattgtagttgtcaagttaaaagatataggtaggtatgttttcttaaagataaacagctcagccaccaccgctagtcagcctagcaacaggaaaacattgtctactgagagttaactgtttatcccacctggaaaagatcaaactttcctggtcttttattctatttaatgatacattttctcctgtagttttgcctggctattttgtttctaacaggatataagctagatcaagcaaaaagcctgcttctttattccagtaaatttgcaaagtagcactgctcagctttaacttcattttaacttgaatagttccagtctcccattctgtcccgtgccacaagccagtggatggaacaaagattttcctctcttcaacgctatcttgtaagattcacgtggcttctgtggatggtgcactctaccagggtcttgggtactagaacatgcatttctaaaaccagtatggtaggccaaataatacctccttctcaattatgctctaatccctggaacctgtggaatgtgctacctggcaggagggaattaaggtttcaggtggaattaagtttgctaatcacctgtccttgaagtgaaaagatgagcctggattatccaggtgggcccagtgtaatcacaggaatccttaaaagtggaagagagaggcaggactttccctttggagggatgtgatatgagaaaggttctactgaccattactgcctttgatgatgacaggacagccacaagccaaggaaagtgagcagcctctagtagctgcaaaaggaaggaaaatggatttttcctgagaacctccagaaaggaatgcagccctgccgacgccttgattgcagcccagtgagaaacatttcacgctactgacccccagaacagtaaaataatgaatgtgtgttgttttaagccacacgtttgtgataatttgttaaagcagaaataggaaacatagcagaaaaggaagcataagattttaattttctttcattttgaacaaccagcgtatctttgtttgtgctgctataactaaataccaatgactgggtaatgcataaagaacacaaatttattgtttacagttctggaggctgagaagtccaagatcgaggcactggcaggttcaattgtctcatgagggcagctcctccagaggggaggaacgctgtgtgttcacatggcagaagggcaagtgagtgaactgtgtgaagcttcctctataggggacttaataccattcacaagggaggagccctagcggcctcattacctcttaaagtccccattgcttagtactatcacattggcaatgcctgcagtttggctgaacgaaatgttgtgtgttggctgaatgaatgatttgtgtccaaatatcccaaggcaaactccctctcactgtcaaagtcaccgattcctcttcagtgccctggcttctgagttcccctctgtagggacttctcattctcccttcacttgcacaacagttcacgactaatatttcttaagctccattgagccaatctgctcactttgccagctcagcccctgctctgattttcttagttgatcctgcagtacttcaaaaggaagcagtaaggtatttcccacttccctagcctcattcctactctttgctttatacttggtgttcaaaccctcaaaaatgcttggggcttccaaatacatcatttgtttcatacagtcataacatgtgtgctgattggaggagggaggttgtttgcttttttaagtgtgtgctgggaatgttcctgttcttttggttcaggtgacaaactcatatttgtccttcaaaaattacaccatcggccgagggtggtggctcacacctgtaatcccagcactttgggaagccaaggtgggcagatcacctgaagtcaggagtttgagaccagcctggccaacatggtgaaaccccgtctctactaaaaatacaaaaattagccagatgcagtggggtgcacctgtagtcccagctacttgggaggctgaggctggagaattgcctgaacttgggaggtggaggttgcagtgagccgagatcgtgctactgcattccagcctgggtgacagagtgagaatccatctcagaaaaaaaaaaaaaaaaaaaaaaaaattaaaccatgtagtactcccaggaaaattctttgatttgttaatgttattcaaatcttctacttttaagcttctttactatgttattggcacacttattgctcactgtctgtataactgtgcttcctccttttctaccctcattttagtgtctacaacctcatgtctaaaaacaatgtgtattacagtaggcttgtatccactgtgtcatgagttagtgaataggtcatatttaagaattttgtctttggaattttaaagtaagaaggcacttgcacttcattaaggagaaaatacataattttcacataggagaaaagagacttctgtcatagtgccctgaaatataggaaggcaaaacatctgtattttttaatagtatatatttttcacgaacaaaggtatcagtatagtgttaggaaaaaaatgtgtctaagtgtttccagttgtgaggttggggctgaattacttagtgtctggtattcaattcagagtagatgttttatatgattaagattttataatgtgtgttctttagtataaagaaaagaggaaaaacaaaagaattcctaaagctagttaattacatttaatggaatcgcttaaattactgacttgttagacagtagattttgaggaaaacattactactattacttccccctacccacatatctgctaaaatctctttgaaatgaacataggttgagaggcagaggttaaggtcaagtttatataactgaatcatctgactagatgattattttggctgtcctcatgattgatttttctgtgtcattcagaattaatcaggagaaaactcaggtaatcagatcagctgagccaagcctggttcgatgaccatatgtgacatggctaaggagttatttcttcacatgccatgtccactgatcatcaaccaaaaggggaatcattgggttttcctctgggacctgtgattaagtggagagaggggaactcagttttagttgcattagagtctaaaggaaacagcaactatgcactttgcaaatggtcaagatcatggaacttgttttcaggatattctgggttgataatttgaaaccagagttcatgactgctttattttcagtgaggtaaatattcctagagattctaattattttgtgagtatctcttcattagagaagaacagtccatgaatcacaaagaaaatattcttgctaatattatttaaaagaaatcctgtattaaaagagtttgcaaagatgtaaaccttgacagacgagcactaggttgtcagatttagcaaataaaaatataggacattcagttaaacttgaatttcagataaaccacaagttttcaagtacaaagctttcccatatattgcatgagagatacttttgcttaaaaccatgtggtttatctgatatttaaatttagctggacatctccgtgttatctggcaaacttcacaggtatcctctgggacacactatctttaatgtctttaaacaactgcaattttagcagcaagtatgtgaaaccaactaaatgttcttttaatgaccatctttaattatttgattagaggagttataatttaaagatgatgaatatgggtgaaagctcaaatgtgtttactaaaaaagttagtaagtatagtttggaaagaagatgacactgagtagtgactctgggaattgtgccagaaaaatttataacagttgtatagtactttgtattccacttgatgtattagatgggattgctgccatacactgagaagaaaaatataccttgtggatattttggtagctaagatgatagaatgaacttgttcaaggaaatgtgggcgtagaagaggaagcttagggttggagttcatcagaatagcaattacccaagcaggtcaattttttaggaaaatatattttgataattgaagtccaggaggagatcacctggctcatccacaatgaccttcaaaatgtaaatacccaagtgatttatgtcatttttaaactctgtgtctccagttaatggctattctttggattatttgggagaaaaacagctggttcttataattattattaggggatttggatcaatagaaagaagacactctgttcttttaaacatttcttatgcaacatcatatacaacccactgcctgccctcacccctcccctggccctctggctatcatattgctctctgacttttaatcacagactctgtctgtataactctacaaaagtccagccaaagagccaaatatttagccagtcctccggatattctgttctcagcatttcaaatatcattttgttgaaaaacatctgggtccttggccatgacaaaaacagttgtatctttcttcatcaaggatacttggccttatatagccagagaaataaattaacaggaccaaaagatgcctaaaagtatcatctgaggaatctcttgtttctaaacagttaacatcgaaatcagggtttcttaatagcaacagcggcatggttgacattttggactggatgattcctggtcatggggggctgttctgcacatggatggacattttgcagcctccctgcaaaatagatgccagagggacatttgcctcctagtcgtgacgatgaaagtggtctccagacattgccggggataacagttgagaaccactaacctaaagtatccaatttcgatagtcttatccagtgccagctagcctagaaggtacctatagaagctgaatttagtttagagagagtaacagagtgccaagaatggacatgggataggacagcggagagcggaagcataaagccgtagaaataaccagagccagccgagcgcggtggctcccacctgtaatcccagcaatttgggaggctgaggtgggcggatcacgaggtcaagagatcaagaccattctggccaacatggtgaaaccctgtctctactaaaagtacaaaaattagccgagtgtggtggtgtgcgcctgtagtcccagctactcgggaggctgaggtaggagaatcgctccacccgggaggtggagattgcagtgagccgagatcatgccactgcactccagcctggtgacacagcaagactccatctaaaaaaaaaaaaaaaaccatttatttcatttgttcattctacacccattcattcattcatttgttcttttgacagatacatattgaaggcatacctaatagaagaaactgttctgaagtctgggtattcaacaagaaagaaaacacaaattttatgttctcatggagcttatattcaaatggagtgtgggggacttgaataagaaggcatctaaagtacctagtgttcgcagatgctaagatgagaagtagtgcgagaaaaagagaaaggctcatgagggagggtattcctcagggtctggttaggaaaacacccagcaattttaggagtagaatgttacagagggaatgggttaacaaggtataggaggaacacaaaggctgcaaaagtgaaaagagaatgcagagataatacagagatagtagcttcagaaagttgctgccactccctcccagggctgggggtacaaaggcaacaggatcaagttgttagagcctagaaacttagtaaagattctggtggcactgggatacagaccactgaggaggtggagatggccctgcctgccattgtttgcggctatggaactgaagttaaaagtcctggagcagctgggtggctgaccaactggggatggtatctctgaggaacacgctaagactgctgcagaaagtttggaacacatctgtttaccgtaaccacctgctgagctggcctgacaccagcaggaccagcaagccaacaaaaaggaagaaaatgttctcagaagctcacctacctcccagtctgcttccagcaccctattggcagagtttattagggagtcagcagcataggggaaatgctgtctacagagacccaggaccagcattacaaagtagagtgtgaaagggagggttgagactgagaaacagagcttcataaccagtgctgggaggctactcttttatataggaggcccttcaagcctaccccaccctgattgggagaatgtctgggtcattttgctctgtgcatgaaagtgcttcaggagaatcattccccacaccgtgaactccttcatggtgtgggggatattatttatcttatcacaaaatgtgtattaagtgaatgagtgaaatgatacctttgatataatgcttgtagcattagtgactttttcagcttgggtaattctgattgctagtgtgtgtatgtgtgtgtgtgtgtgtatgtgtgtgtgtgtgtacttgttcgacattcaatctgattttaataaatattaactaggtgcccactaagtgcagagctctgcatcagatgctacatgagacctaaaagaattaaaccttgtccctaaaggacttagaatatcgattcctgtgtgtgccatctggtgcatatcactattttaaaaaggtttttttttttaatttcttgaggtcttttgaatcctattcttctctgtttttaaagatattagcgatgcacgtctcctcctaccccactttagtccccagctttatctcttttatgaacaaaattaaatagatttcctcccagaaggaatcctttggtagaaattgtataaagagagaaattaactctttcagactcccagggtgctattgctaaatgttctataaaactccttcctcattactacctggagagagacttggcatccggaaaatagcatccaatatgtattcacttattttcctccttgttatgtgatgggggaacatgagtgcaacacactgaagataaagaaggctaagggatgcttgttcataaataagaataagataagggtataggctgggggattttagtctcccaacacactttgaaggtttggctccttagatagcccgagcatggattcctgccttctgctcctgcagaaggtgaagggggtggaggctgctgtgactagggctatgacactaactttggctgttaatggtggccttccttagcctatctccaagaatacggatgctagtacaagtcatgtgctgttaaccaagtattttgcccctttccttctgaagtggcactctattaaacagtaatattttcttcccttgttgcttaaaataaatgtttttaaggcctatgaatactttggtcaacattagtggtttttcatacttccttctctaggtttttagggagaaatgcctacactgttctttgaattgcttcgttattattattccccagattttctccatgtattaaagatcctaagaattctaagctcagacttttgcctctgtaaatatattttttaaatggctgcataatattacccatggacatgattcctagccatagctctactttgcagtcagtccatccccaaaagaccatcatagaccacacactgaatgttctacataggttgggaaaatctaatgttaaatataatacaaagagacaaccagtgataaagtttaaatcctgagtctccaagcacattttcttcgagggattcctttttctttagtttgaggtaaaagactccagcagaaacaacctctcttgacatccacaagcccttctagtagtgctcctgggtgtgggtgtcatgaaaatgcagagggtctcttacatgtggtcaaaaacgtttcaaagcagctcagcagatgtattaggctgtagtcattctcctctgcttagcatttggtcaagataagcatttccagtcaatgctgattgcatttagcctgaccatgtttttgtacgtttcaatgctgatcctattttctccttttaatcgtacaaatatataacaataaagaaaataattttgctagcagttgaattacaaaatgtgttcaacactccattaataaaatctctatcttgttcaacatctccagtaaatagcctttatatatttcctcttttctatttgccagctgacaatagaaaacattagctgagagttgaatgcgggaaagcaaaataagagatagttatccactgccatctagtggctaaaaacttaaaattcaaccaaagtttttggatctttttcttctaaaatagtggaaaaataaatattggagcatatttgcacattttaaaggtcttaattcttttaaatttttgaataagaatctgaacagataataaacacattaaaattaagtttattttaactccattactcacatctcaacaataagacaggtaaggtagttcatgtggagcaaaaaatgaaagcaagaattgacaagtattgggttatcttcccagggaagacagctaatgaggaaggttttaccctagcttagaccttaatcagaaaattatagatatcactgaaggagccaactcgttaatttaccttcattgtgctgtttggagctatcttattcccagcactaatctctttctttaaaccaacgtgggggccaaagaccaaagtcagccaatgcctcttagcagaaaacaagtattttagagattctagcattgaaagttagagtttgggaacacagattaacctttttacagagttttgatattgctattcaaggctgccctactggacaactagaatttaccccaaatacggagaaatcaagtgtactattctctagagaaacagaaccaattgtgtgtgtgtgtgtgggtgtgtgtgtgtgtatgtgtgtgtgtgtatgagagagatatttaagaaattggctcgtgtttatggagggtgccatgtccaaaatttgcagagcagagcctcagagccaatgctgcagttcaagtctgaacgctgtcagcagcagatttctctcttgcttcagggaaggtcattcgtttgttctattcagccttcaactgactgggtgaagattacccaccttatggagggcaatctgctttactcaaagtctactgatgtaaatgtaagtcccacaccaaagcagcctcacaaaaacatccagaataatgattaaccaagtatctaggcaccatggcccagccaagttgacacataaaattaaccatcacaccaggtgaaatgtacaaagtgtgaaatgaaagatttgggagaatttttgaaaagtttcaaaatgtgctttatcattcacctgaataaaatgattgctttatgtcagaggttctaaacagcacctctctttaccactgacacttcaaacaccatcagaggtacttgatcatatgacccaagtggtacagcagcttggacagcagtctggagctgttgtagagccttctcttgctctgggccccactcaaaactagtagcttttagggtctctcggtaaatgggctatgataacgcacccaagtgtcaagtatgttttctccaacatccaaagaggcctactaggtgttgtatctctttttttggttgtaagagaggacagatgcaatgtgtcttcacctatctcaacatgccctacaccactggatccctagaaatttgactgcggtggaggtacttcaattctggtcagatttattttccacattctgacatgtaaatgtcttctcaataaatatagagtagttgttacttcttgctcattaggtccaatcatcataatatcatcagtgcaaataaccagtgtaactcgttatggaaggaaaagactatctgactctccatcaattaaattatgatgtatggcaggagagctgatacacccctgaagtgggacagtaaaggtgtgttgctggctttgtcagatgaaagcaaactgcttcacctagtcttcacaaatgggtattgagcataaaagcatttgccagatcaatagttgcataccaggtaccagggaatgtgttaattttcccaagcaatgaaaccacacctggtacagtagctgtgactgaagtcaccacctagtttagctttatgaaaatccactgtgcttctcccagttttatcaattttctacactggtcaaataggtgagttgagtggaaatgggatggcagttaccacttccatataatttaagtgcttgttgttggcatttatcactgatacccttctaggcatgtgatgctgcttttgacctattattttcctaggtaaagattgttctagtggttttcccttggccttttctactactttttttgccctcacttcacaggccagggaatgaatgtgaaaattctgccagtttctgagaatgtctatttaaattatgcatcccagaaatggggaaataatcacagcatgggttcagggactcactggagccactgtgggatagatctgagctaaaactccattgatcacctgaccttcataagcccctataccaactggtagaccacagtgacattttggtctcctggacctagtgccaatgtttgccaactcctatgctaaaaaaaaaaaaaaatccagggtagacacatttgttcctttaaattatgattccttgttgcttaaaggctaacataaaattatacccatttatgccttcttttttataaactgtgtttgacagtcatctgtcttgccccatgacttgctctgaccagtgtggcattagcaaacatggcaaaagaagagcttgtgaagggctttaagacattggtgctcatcctcttggaacattccttcttggaaggaggctggactacccttagatcaccatgctgtaaggaaacccaagctcatcatgtgaagcatggaagggcactaagacaagtagctttcagctagatgcagccaagtgaaaatccctagccaacgctgtgtggaaagaaaccacatagcaagctcagcccaaattcctgacccatggatcatgaaaagtaataaatcgccattgctttaagccactaagttctagggtggtttactgtatgtaacaagtagatgaaacacgttttctttagagttttccatattagttttctaatcattagtttttcaactgctgtcttaatttttcttatcaattcattgtagattgtgggcaaattgtggatactttctgggcttcatttgtctgaactttgaaataagggatctctgctatttggcccctgagtatatctttcaactctaagagatgaagtatggaaggtaaatattatttttaatacacattgttttagaacatatcaagtaatttatttggatgatatgttttcttcatctttccctttataataactggctttgagaaaccatacaattaactttataaatttccaaatagttacaggctttctgtaattaggacttacaatggcatactcagttataagagaattcctttttaccatatgggataggataagataagaaatactcaaatggaaaatatctctgatcaacctcttgagtattttaaaacttaagctacatagtaaagtgctttaaaaccccaccataaaaaactaattaaaattcttctatctgaatacaaaacttcatgtttgtgttaaaaattaaaacaatgcagaagtatagaaagaataaaattaatctttcccctgctgtctattacactcttcagaagaaagcgctgttttaaacatttctctagactcctaggtagcactagataggttagatgcattcatagatagacaagtggggatggataggggcagacacatggatacttaggtaaatagatatgtctatatttgtatgtttatatataaaaatatacatctattttagtttagttttaatttgatttacaaatagaagtccaatccatatgcatcactctacaacttcctttttttctctcttatttatttatttatttatttatttatttatttatttattatttttttgagacagagtcttgctctgtcgcccaggctggagtgcagtggcgcaatctgggctcactgcaagctctgcctcccaggttcacgccattctcctgcctcagcctcctgagtagctgggactacaggcgcccaccaccatgcccagctaattttttgtatttttagtagagacagggtttcactgtgttagccaggatggtctcgatctcctgacctcttaatccacctgcctcggcctcccaaagtgctgggattacaggcgtgagccactgcaacgggccctttttttctctcttaaaacagatcgtggacatcaatgaaaccaatacattcatctctcatttattctttttaatagatgtgtaatgcttaataattatccaattattctccctctgatggacatgaaaattatttcctttattgcctgtcttagtgagccctaccaaaataacattgactgggtggcttacacaccagaaattcacattctcacagttctggaggctggaagtctaagatcagggggctagcatgaccaaatcttggtaagggggtctcttcctggcttatagaaggctaccttcctattgtgtcctcacttagcagagagagagagagagagagagagagagagaacgagagagcacacacacacaaactctagtatctttttgtataaaagcactaatcccatcatggaagcctcaccctcataacctaatctcaattatctcctaagatcccatcttcaaataacaacacatgaaaaagtttcgttgcacaacaatgagaaaatatttaacactactggactgtatacttcaaaatggatctcatttggtaaattttatgttatgtgtttgtgttttcttaccataatttaaaaaagaaaaagtatgcatttcaagcttgcctttatagaagattctcttctctagaactgaacctatggattgagttaggttcaaacctatggattgagttactggaaaataaatgactgaaatttaattaacttatttctttcacataacaagaagtcaggaagagaagtgcagtttagaagtggtttgacagcgacatgaagtccaagtgccccaggttcctcttgcatcgtcattagcatatggcttttgtgttttttgtccacatttactcgcgcattctaaaatggataaggaatgaagccacaagaaagtatagcacttgcattataagaaaaaaaaagcactttttcataaatctgcagcatacactcatttgtgatagatcatgtggccagacctgtgtcacactaacgacaatgggaagtatgttttttatttttacttttaatatgtatgtatatattttattgtgtttcatagctaagtcactgccctgaacaaattgggtttctgttaataaggaagaaaaggagaacatatgtaggcaactggctatatttgcatattgatgaaatgaaaaatgtttatttcaaagactcagatgattatcatagaattagcctcacataaacttcataatcatccatttttcctgtttttcctctactcttttattctactccatgctcttccttattctgcaggatcactttctcctccttaacagcatgcacttggcacaaagccctattgacaggagctcacacaaactgacactcattaatgttcttactggacacaaatctatgtctcttggttcaaattaatcaagtaaaaatctgactgggttgctgggaatgaattgtgtgcccaattctggcccaatcagctcaccgaatatccacttctgacacctcttgcagttagattggggcatgtgactagctctggtgaatgtctgggaggcggaagtgattttgtgtttctcctttaatttaccttggtatgcccagatggtttatgttggtttcttgactagaaagaattatattctttaaaaacaaacgcaagttgtctttataaatttcttattctaaaaaaaactatttaaatttatctatcatgttatttgatcactcactaattactcaaatatcaaaatctgaaatagaattaaattttagaaaaatttgattactttaaatttttgaaattaactgtttaaagttccatatactatattttttaataacaccaaccctgtgcataaaccacatatcaatgaagataatattttgagtgattcctttggtttttaaaaataaacttttgttttttgagactgagtcctgctctgtcaccaggttggagtgcagtggtgcgatcttggctcactgcaacctccgactccctggttcaagcgatgctcctgcctcagcctcctgattagctgggattacaggcacgcgcccccatgcccagcttatttttgtattttttttttttagtagagacaaggtttcaccgtgttagccaggatggtctccgtctcctgaccttgtgatctgcctgcctcggcctcccaaagtgctaggatcacaggcatgagccactgcatctggccccctaaaaataaactctttaacaaaacatgtatacctacagaaaagtccccaaatcatgtatgttcagctgttgtatttttacaatggagacacattcttgtaaccaacatccagattctcagaagccccttaatgccccttcctaggcactaactccactgaagatttgctctgatgttaaccataaaactattttccttagtgaaatcattatttcaacttcttcacttaacacaggaagagataaagccatcattagtccaatgtctgtgttgtccatgtgtggtaggcagaaaaacagtccctcaaaggtgttagcaccctagtccgcagctatatgttactttgtatggcaaaaaggattttgcaaatgcaattaatgctgaagtctttgaaatggaaagtctaccctggattatccagatgggcctaatctaatcacatgagtcttcagaagtgaatgaggaatatggtgtcctctggaatttgagaaaggccttcagcttacagctaacaagaagggggaatggcagaatcacaagcaggtgaaagtgaattctgccagcaacttgaacgagcctctttgagctcctagatagaaatgcagtgctaccaacaccttggttttagccctatggacccaagttgggcctccagaactgtaaaataataaatctgcattgtattaagccattaagtatgataatttgttaaagcagtcacagaaaacgaacacaacatggtcccaggacattatttcaattttctccacagaaaggccaaaactgccttctgctcaactagcttcaagaaatgatcccatagttaagacagcaatacttttattgtctttcccaatgaaactattaattagctaatccaacaatcatttactgggtacttaactgtgcactttgaatatacagtctgctttgaagaagaaatagcaaaaattattctgtgtttttcctggataataaaattcttatattctcacttgaaagcctgttatattttgaacatttttttcattatcttaaatctattttaacaaaaggctcacttttgcaaagtttagagtttttaataattcttgttgttatgttgatttttacatatattactctgaatcaaacctgcaatgctttgttatatttcatattcttataaattttgctcttttaacaatattttaaagattttctttgacaagtccacaagtccacacccccggtttagaataatgaaacttttagtgtgtcttttatgtataaactatttgaggtgttttctcaacatttctgggtgatggcaaagatttgctccctcatgtgagtaggaagaatgctaggaaaaaaaaaaaaaaagcagcggctccagatttccagctactcaataccatagtgagagttgttttttttatgactcccataatatgagaattaatgaaacaaaaagggaatctcagcaccccatgggattaattatacacatataatttcagaatgttctcaatataaacatgtttcagcaattgtatgactctcagattgcatggaagtctgcttaaggctcacacctgtaatcccagcactttgggaggccgaggccggtggatcacgaggtcaggagatcgagaccatcctggctaacacagtgaaaccccgtctctactaaagatacaaaaaattagtcaggcatggtggcaggcgcctgtagtcccagctgctccggaggcagaagcaggagaatggcgtgaacccaggaggcggagcttgcagtgagccaagattgttccactgcatgacagcctgggtgacagagcgagactctgcctcaaaaacaaacaaacaacaacagcaacaaaaaaaccaagatcatatgttcaaagtctgacatacttgtcaactaactgatgttttactcaaaagaaattatttctaggtttaatgtaacttttcaagaaaatacaatcataacatacattatgtaatggattaaaaggccctgaaaatttttcaagacttgtattagtttgctaggactgctataataaagtaccacaaactgggtggcttatacaataaaaatgtattgtcttacaattctggagaccagaagtctgatatgaaggagttggcaggcttggttccttttgaggatgagaaatctgttccatgtcactctcttagtgtctggtggcttgttggcaatatttggtgttccttggcttctgctgtatcaaccgatctcacatggtgttagctgcacacggcctccccactgtgtgcctaaatgtgtccacattttccctttttatgaagacacaagttatattgaatagggatcccatcctactccaatattacctcatcttagcttaactaattacatcaatgatgaccctatttccaacttaacaatacactctgaagtacatggggttaggacttcatatcaacttgggggtggcacaattcaatccataaacagaattcatgctcacaatatgttcttactctcagtgcaatctttgacttaatctctctcaaattattatgttatgccttaatagatgacattccccttcattctgatattatggtttctataataatttaacggtaatcattcactatcatcacaaattctccctcacacgtttaaatcagcacttcttaaactgtaaagcacatttcctcctctggtgaatcttggtagaatgcaaatttggattcagtggacctgaggtgagacctgagattctgcctttcttacaaactcccaggtggtgatcacaatgctgacccgagaagaaaattgcgagtagcaatgatgcagaggtctccctgcaagctacagttcagaaatttaagccttctagaaagagaatcttcagaacaaccaaaccattttcctcagcaaaggactgtaccaggtactcttaactatcaatttacagagaaggaaacttgaacaggtttttcactataacttgacattaccgtggagacttgtcaaatcaaggctttcatttttattttattttattttttggccctttggcaaatgacttagtgatagaagactcagtagcctgagatcagcagaacagaaattaattacttaacatttaaggaactgattgaacaatgtttgatgttttgctttttaatggacataggagaaatgccatgtctttcttatctacctctaactgtcaatttaattggttatactgagctaagtggaataaaatactcattaaacagtatcttattctgacttaacacctcagaatttttaaaaaatctacagttgggggatgaggaaaataaagagatctgggttaaaggttacaaagtttcatttaggctggagggataagtcctggagatatattgtacagcatagtactctagttgacaatgctgcattgtacgcttgaaatttggtaaaagagtagatcttaaatgttctcattatacacacaaaatggtaactatgtgaggttaccaataaatggtatctatgtgaggttaccattttgtggatatatataaataattaattatatattacatataataatatatattatataattaatatatattcacaaaatggtaacctcatatagttaccattaatatatccatatagtgaatatatatgtggatatattaattcacctgattgcagtcatcactttacaatgtatgtatagcaaaacctcatgttgtacaccttgattttttttttttttttttttttgagatggagtatctctctgtcaccaggctggagtgcagcggtgcgatgtcagctcactgcaacctccacctcctgagttcaagtgattctcatgcctcagcctcccaagtagctgggattacaggtacgcaccaccacacccagctaatttttgtatttttagtagagacggggtttcaccatgttggccaggatggtctcgatctcctgtccttgtgatccgcccacttcagcctcccaaagtgctgagattacaggcgtgagccaccgcacctggccatacaccttaaatatttacaatttttatttatcaattgtacttcaataaagttggcatcaattctataaaatattctaaaatagattataaactaatgtcataaaatatttcgtaaaaacaacatttcctgctaccccatgacattttttccatgcagactgtagctgaactattttatgcttactgcctcagggaggagttgtcatcataaaagttctcatgctaaaagttgaattcttgactttggactttcaaaagttaaggtcaagaccagccattatttggaagagctagaagaatatgtcatcagtcagagtcaaggtctagatctgagagcaaagagacagtatgctctgtccttcccatcctccatcctccccccagggcaataccccagagctaataagcccctagatacccctgaacctagggtataggatgagaagaaatggccttgtagtgtgtctagacaaaagactctacggcaacctcataggttcccatggtttctacaaggtagaaaccaacagctgaatttcttaggcttcagattggaagaatagattacctcctggatagttaagaggagattggaattagctctcaatgagaacctggaatgaaaaacacatgagcaatctacaagaatgaaggataaatgactgaggaccagaaagaccaaagtacgtatatcctagcagatgacaacagaggaccagatgccacactcctccaagcctcatcctctcaacacaattccaaggagagaaagggtaaagacatttgtaaaagaaattgaatactactatgaaccataaaggaagttgttaattgcactgactctgtagtctgaggttcatacccaattcatgacctttacatttggattgattctccaacatctaatagtttgttgtacaaacagtatgtactctctagctatttgacacatttattgacttcattctatgtttgcccaactgtcagtggccatagctttctgtactgtccaatacagtagccactagccatctgtggttattgaatatttgaaatgtggctagtatggatttaaatgtgctatacatgtaaaatacacaccaacttttgaagacttagcacaaataacaagaatgtaaaatatcacattaatagtgtttatatttattccaagttgaagtgataatattttggacatattgggttaataaaaatataccactaaaattactttcacatgattctttccacctttaaaaaatatgcctactaggcaatttaaaattgtattatgtgacttgcatcacttttctattggacaatgctaccttatatgctcactcatgttgatttcatttgctttcacctgaggagccattatcactgcttaatttgttccatgtgcaagcggacactcaatgactttataatgatgatgtctaacatttcctgacaaagtgtgctttgtcaaattgtacaaatttcttgtatcacatttctcaatgataggacttgggaataatcattgggaatgattgctttgtctgtaatttgtacaaaaaggcagagattttctttacaagaattaagacaatattttcttaaaaatgcttggtgacttaaatgtaagtaaataaataatgaataattttttcacaagtcaatgagaaccagcacaatgagaaaaaaaatcgtcctgagtggtttactttggttagatttattacctaactcataaggttatataatatggagtaacaaaaatagggcaatttgaagaaattttatttataaaggtacagggtaccacacagacagtgcagtaacctagagatagtagcctctgagattttgtgcctagaactgaagtttgccatttagaaagttttttagtctatttgggctgctatagtgaaataccgtacattgagtagcttataaacaacagaaattgatttctcatggttctggaggctggaaagtccacatcgaagtatcaacagattcagtgtctggtaagggactactttctggttcacagatgaaattgtttcactgtgtcctcacatagtggaaggagtgagtgttctctctcaggcctctattattagggcactaattccattcacgagtgttccaaccctatgacttcatcgccacccaaaagccccacctccaaataccatcaccttgggagttaaaatttcaatctatgaattttggaggaacagaaacaatcagactatagcagaaagatgtgatcttcacttatgggtatgaccagctttagggaaccccctaaggataggagcaggagaatgaatactctgacttcactctcctctaattctctaatctcctattagtgttcttcagtagccaaacccaatcagaaaccagagggcactggagcctgggtgatatagtttatgctgatcagcatcccagagcaaataacaggacaaagggaagagtgtacctatatgagagcaaacagaaaatatatggcatattctgtcttttcagaatcatttactatattgctaggcaaataggtcaccttttttccctcatcccattctctcttaaatagaaaattaaaccttaaaacctgaatagaagacaaaagtccacaatcagtgctctgtttctcacatattgtgagctttcctagaaggtattactcctatcgcccaactcagcgtctacatatgctgatggctcaaaaatccatagctatgcccagttctctttcctgccctctagatgagcagatccaacagcatgctagttagctccccctggatgcctcacaggcttgtcaaaccagtgtattcaagaaagcacccaccacttattgcataatatcctgatagagttgcaatgccaaggagcatgttttctgttcattttctaaaatgatgacagaaagtttagaagaggctgttttaactgtgattaggagaagcttatactaattgttattataaagatctgaaaaatccgtgtcatcgtccatggttcatacaccaacacatagcatgagacttttgccacttacgatgtcctccacgttagtcttaatttgctttcacctgaataattgcactagctaatacttattgagtacttcctatgtgtcaggtattcaattgtcctcttaaatttaagtctcgcaataacccaataatgaagaggaaattgaggcttgtaggagtcgtcatccacaaggactcatagctgataaggggtggtgagttttagatagcttaactccagaacacatatgcttgtcattcctctgcgatactgaatacaaatcattcttatagtccagggaggaggggttaaaaggtcacgaactaggagctctactgagtctgacactggagatgctaggagtaaggaaaatataataagtcttgaggaagctggagatgagagattataaagtaaaagtagctgaagatacaggatataagatttttttttttaaaaatttctttttccttttaaaaacgttagttaagcatgcattgcgctaggcattggggatagaaaagcaataaagacaatttcagtctagtgagaaagataggtaaatacattataataaattttaaaacttagatttgtatgcaaggttcacagaacattagagaaattagacatagacagaatttattaattcattttattcattcagaagacattagttgaatacccactgcattatgcttgaagctggagaaataaaaagggcaaagttaaaatccttatcctgaggaaactcacaatctaatgaagatgcttctggggtgctggtcaagtagcaaggatggagctacaggagcacagaaggattacacagcctcgagtgctcagacaatgccaatttagtgttacctaagcaaaaagttagggctttgggttggcaacagtagaggatgctaaagaggagtgcagtggacaggtccaaagggcttggacttaactatgacaacccaaattgttgctggtggaatgcaatacaagggaatatgcattttcctgcagcatcagttttgttatgatgtggagcataaaatcgtgcttttcactattaaatatttttactattaaaaataatgtagagcacaaaatcgtgctttttactatttaaatgcggatatactgtgaagaatgcaatagcatatgagattcataaaatacgacaggaaacgaatttccacagctaggcttatgatttagccagatagaacaggaaactacaagaaaatcccacagctgggcatgcagatggcttcggctctcacccctgaagactcggggggaggagttcacagtcttcagttctccgagtattgagggtaagatagctgaggaacaatgagtattaagtgtgcgagaaaagcgtttaggagttaagcacatggactgaagagaggctagggcgcaggcgactgggaacccgtcatcgtccctctgctctccggacctcttattcgaaaaacatcctccaccacgtgcccctttgtcgccagagacagcgcctgcagtgcgtgagctgccccctgaactcctggcgcctggttgcctgggcaaccctcttctggggcgcctccgcgacctcttaccattggtttagacgacgcagcgtgcgtctgacgtcattgcgcggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggtaaactcctccctcggcccctttaaaaaatctctgttttttctttattttttttctgtgtcttcctcttttgctgactttgatagcatcctggctctggactggtctttaagtatctagaagtgagtgtaggaggggtggctgggaaggtggaaaatagattctaagacccctaagcagattgtgcgaccctaatactggccctttgaatttactttctggtaaaaaagggactgggataagtgactattgggctctgggtcttttagaatttgacagagctttacaaatggaacatggtttctttagtggggctcttacttacacgtttggaactttctagacctggattagaaagcagggctctgctgactgagaattgttttagttcagtggtcttaaagctgagtacgggagaaagtacatacagggaaagaaataggctatatcagctgcccaaacaatgatagaaagtacactttcctaccattgacacagataccggcagtcccttgtagatagatgacctgtagcaaccaaggaagctttaaggggaatgtgtgggcttcatagggtggtttgtttgctttctgatattgtgacatagtttaggtgttcgaagttaagtggatttatggattctaatatctataattagaatgtttatcttgttttgtaaaagaatgagcggtgaccttgataatatttgtaacacaaaatagttcttacaggttcgcttctccccatcactgcccctttacaccatcctctacatgttatttaatgaaaaaccacttgaaagggttaccaaggataagatttttaaagcttgctttcacaaacaactcatgctccaggcttgtcagtggcatgcttccaggtggatattattttaaaaaattgactacatttcccgtcgtcccttggtgtccgtggagaattggctccaggactccctccctccccccagtctctttcagatacccaaatccacccatgccaaagtcctccagtctgctctccgtatccgtggttgggtcaaatctatagatgtggaacccgcatatacggagagccaactgtaatttgtcgttaaggtaaaggataaaaattttaagtgaaaaagcaattgttttggaaggaaattctctaatacaggattttgaaaggggatgtagacgtgtttgcattactgtatgtttaatgctgaaaattatatattgtacataaaagttgtcctgtatactcataaactgtagaagctcgattttctaccatgtttaaaactttttcaaatgagttttggtgactttttgaactcattcaaaatataatgcaacacctccccattagtttgttacaggaacaactttttgacgtgaaggaagatagaaatttagccataaaattccatccaaaacttccactgaattggtaggtagtattgaaaaatgtgcatcataatttgatatggctgcctgtgcccttgttatgtttgtgggtacgcgtctttgctgtgcatcgcttttatctgttgcagctgttaacaattgatgatcaagagaaattggacctcagctggtcttcaaattgatgtagcccaagatgttaagccagattttttaaaaatgacaaaacatgtggtttcactattagtaatagtaatactgaagaacactttgtaccattgtaaagaaaattataataatagctaagactcatgtggcccttactgcatgcctcccattatggaaatgttgttttacatatattcttactagtcttcatcaacacttaaagtagttcctgtaattatgcccaattatagagttgaggaaactgatgcattttttttttcaatagaaacttgtgttgttccccctccaggagcttctcaaaacagaagtcaggcacaatattaaatacttgttgaatgatcacagaagtacaatagtaggttaacatatttaaagcttctctcagcttattttagactattatctgacaactttaatgagattttaattaccgtagtattagaaaatggccctgggaatggaggtgaagtgtgatactgggaagtaagtcatctgctggtagtgggatgagataaatgagatcaatgtactaaatcaaggaaattgaaattattcagtgtgcagaagcaagcttacatttaggttatctttacatggtatcagactttaagctggtacatcatgtttgagatatctggctaaattttataacatggagctttgtcctccttttgaggatttctaacttgttaagtggattaaaagcatttcatgtgaggaatcattttaaaaagtatcagtgtttatcctgaagaagaaaaaatgaaggagttaagagttaatgccatcaaatatttgaaaaagtgtcatttggaggtggaagaggactttacctgtgttgtcctaagggaagatcttacactatacttgagaggcagtcattattaaaggcattaaaatgagacgtgtgctaatagaataactagattgtcgtggaagtgagggaacagagtaatcaagtagaaataaggacacaggatagaaatcaatgccatagaaatacacatttgagaaaccaagatgaggaaaggcttcatggaagttgggaatgaagcttggcctaaaaataccagtaggcacttgggtatatgagtgtgtgtgtgtgtgtgtgtgtgtgtgtgtgtgtttgtgtgtgtgtatttcttgctagagatacaattgtagaaattgattggattagctggaaaccttggggtatgaactagagtcctccattagcagaaaaaaagcaactgtgtaagggaaaagtgaaccagtattccctgggtgagtaacttgagagataatttcatttgcacctccagaaaaccttgacaggcttttatttccctctttaaacaggtcaggaagtcgaggtttagggaggttaaataatctgcctaaattcataaatttcataattggtagaactgagatgcagacccatatttgagcccaaagctctttctttctcatcacgtgtagcattgagtgtaggaaatgaaggaaaaggagacaatggtgattctaagtttttcagtctgaggaccagaaaactggtggtaccctgggttaacaaggggttcataataacttcagtgtgacaacctcagttttagttacattcagtttaaggagcttgtgatacattgggtaggagagttcattatgtcactggaaaagtagagcttgatgtgcacatgttaacatttggagctttggaaatacagaggccagagaagatggagaagatgacagggaatgtaccaaccactcctttcagaaatctagtctgtgttttctaatgtggtcagagaattggaagtgagtttctaacagtttattttgacaatttgaatggaaaaaaagttgacttttgtacatcatttcttggagatgattattttgctgttattgatactattgaagttgacataatttcatgttttctcattagtcttttccagtattttgctccatatcaacttttttgtgtgtcttttactgtattgtatactctgttctggttttgtctttttattgataacaaatgcccctccaaacaaattttgaaatcaacttttttttttttaaactgcaggagtgaaagggaagcaatgcagaaatcagagggctctggaggtacacagttgaaaaacagagcaacaggtacagagcttttgtttttaagtgaagaggtcaagtttgttcatggcactttctgtgctacagatggatgcagggtgaactttattgcttgtacctggtttctattgatgttctgtttttttccaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtaggtccaaaactattcctaactcagtagattttttaaaggcatttcgcacagtattgaacaatgctggatgctgtgttgagttttgtccctttgctagttttgagctaataatgagagaagggcatgtggttattatgatgaagaactgagataatcagtcacatgtgggagtgagtatggaggtaaggagacatagaagttaacctgtttgggatatcgcattgtagtgcatagaaaattgcactttagctttagattttatttgcagtgttgttttacttccccatatcaatgaataaactgtattcagttgccacagaatgcttttcgtgcttctatagttgcataaaggtctctgacctttcctgtgttctgtaaattagttccaccagaaatcctagttgtagtactaacctcctttgccctctcctaacaatttaatgagatttaataaacatgggatttatgcagtaaaaatattcagaagtgaacacacctgtgcaacaacaccaggtgttatttgccccatgcccaactttggtagggtgagatgttagtgatttcagccttcgaaggggattgtgagggtggctgaagctcctgactgactgtggtggtaggtaggggtatggcagttacttaaggaagcaaaggtatagtgagctctccaagacagaaggagtgtccgactggataaaagcaaagtgacaaatagtttgagcggctatgttcctttgcttttttctgtaatctacagtgtcaaggaaattgaatacctgaagaaggccctaataatcttgttgctctcacttcctttgcttatgtttagttgagggagtttacggtgacgcttcaattttcttcctctctttaaagaagtactttttgaattaataatatttagtgaccttagtcctaagttttagtaaaaatcgaggaaagttttgggaaatagttaaataatttgacccgagaaaagcatgtgtaaaagctaccaatataaaacaaatgagttggaagtcagaataatgttcacctttggggcgaaaggtgggcagggatttgggagaggcagtggaggcatctagtgtgctggaaactttcagatttttcaactctgttgataaacaggtgtgttcattttttgtgaattcactattgtgatttatgcacattaatattttaaatatttgagttaaaaaattttttgaaacgctaattcagtgtagtatagtatataacattaatacagagttgaaatatggtctgaaattgttaaaaattgaatgggataacatttttcactttagacttggtaaaatttggttaaaatcgataaaagtaatctattcataaaaaattctgattttgtggaacatggaagatgaaaccatgattatctctagaataaaattgaaaggcaaagaaaggaattgtttagcatttcaatcagaaatttagtctttgtgggtatattgaaattttagggattattttcatgacctgtaagggccaaaaagaaagatcatttgcttgtagatggtagaagtcaaatatgttgatagtatagtactaatttgtcttaattttttctccaatatgtgtagcactttttcaaacaactttcttatcggatatgcttgttacttgaaaataatttttaaaacttgtgtttcttttatagcagaaattataactagatgagtgaaacattcctcttgtgaattgttacacataacatggattgaattttggaaatgaatctttttttttttttgagacggaatctcgctccgtcgccaggctggagtgcagtggcacaatcttggttcactgcaaactccgcctcctgcattcaagccattctcctgcctcagcctcccgagtagctgggactacaggcacccgccaccatcctggctagttttttgtatttttagtagagatggggtttcaccgtgttagccaggatggtctcgatctcctgaccttgtgatccacccgcctcagcctcccaaagtgctgggattacaggcttgagccactgcgcctggccagatatgaatcttttattgtaatttaatttgaacgaattttctcctatgtgcttttactcaaaactcatgcttttccagaggaaaaaagagctgattctaaactttttaagcacattttaaaactaccactgtgtgtgacttaaaaaaaattatctagttatatctttaaaacaggtcaatttatattttgtaatttagacaactatttttcatttgattatatattaaaagtaccatgtgataaaatatttactttttgttcctaaatcctctgtaagtctcttatcaattatattgaaattatttatgctgtaattgtttaactgttgtgattgaccatcccttaaatcatctttaagagtaggtataaaatcaagctattcatatatagcaaaactgaaaggttatgaagttatatatctaagaaaatacatccaggcatatatttgtgagaatcttccccatcttcaattctctccctcctgcccagcgcaatcctttgttttttatagaagcctaaagccagtttggagaaatgtgactacctacgccatctgtatttggctgaagcacaaagtaggagatgtgcaggtggcaaaaaacaaatatactttttctgtacttaacaccccttctccatagagtcctcaccttgaaaggtcacagtggggaagaaggtagaaagaactatcattccatatgtggtttcagccgcgttcaagcatcctgaatcgttaggggaaaaagagatgtaccaagtgtggtcgtggtattctagtagagagaggattgacagtttttctcaactgtgttgctgagtagaaacggtgcgcttcgataccagcttggcggtttgaaaagcaaaatggctgtgtgcttctgacctcagaagtataggtgatagtaatattttcattttttattttagtttggtgaacagtcacgagtgccttctgcatttgcagctatttactctaaaggaggtattccttgcaggtaaaatcaatatgatttataactgaccaaattattcaaaatcattgagtaaaatgaatacaatatttagtttaaatgtattgtaagttttatttactagtgaggttgaaataaagatgactttattcacactttcttttggactggtatagattcctggatgttgttgaagaaaaccattctagttccaaaatacagttattgggatctatggataaaccatcagtttaagaactttacttgaaccctttttctaaaataatcaatttaagcatttgcaggcttgggcaagttgcaaattaaaaaatcctatcttgttggtaaaatgaaagttgtcaatttaatgaaattgtttatatttcataataaatacatatggctgtttttgcttcattttggatataattcttgccacctttctagacagatgtcagaactttaaaaaaaaaatactacagataatgtatcattttacaatttatttctataaagcatttatttcttcagagttcatccagttttagcctgttgtagatgatagaaaattttattttgattatggaaataatcacaacatttatttatttttgttccaaaattcaagaaatctagtttttaatggtattttcggatttggagtgaaaaataagctcaagaaatactcttcagtttattgttatttcatatttacattctgaattgaaaccctatttaaagtttcttaattctctactccccacccctccaaaacttattgttgcaaaaatgtaaaaacaatattagagagacgtcttactcttatgaaaataagcccaaaggagtcaagaagtcaagaacattacaaaggagttcaaagaagcatttaggttgatggattaagttcactgtcatgattgtgatgatagttccttgagtgtattcgtacataaaaacataccaaattgtatactgtaaatacatgcagtttattgcgtgttagttattcctcagtaaaggctgtaatcccagcactttgggaggccaaggcgggtggatcacctgaggtcaggagttcgagaccagcctgaccaacatggaggaaccccatctctacttaaaaaaaaaaaaaaaaatacaaaattagccgggtgtggtggtgcatgcctgtaatcccagctactggggaggcttaggcaggagaattgcttgaacctgggaggcggaggttgcggtgagccaagatcgcgccattacacttgagcctgggcaacaagagtgaaacttcgtctcaaaaaaaagcagttaaaagaagcagaaatcctaattcaggggccaccactttgtaaccctaaatgggccattttaccttcctggcctcagttttcttctctttaacagagatgaaacttggtttagccttcaggttattagtgttagggttacatgatctatatctgaaaaacaatgttccttgtgaaacatttttaataattactatgttttgtttgcattttttcatttctgtagattacctattgtgtcatatcactgaaagatatcacctggcatatctgtgttaagattcacagacagcaacatgcttaagcaccaaaactgtaaccttaacacatgtgggtcacttttgctgtaagactaggaatgtgtaggattattgacattactttgtaaaatgtccttgtactatcttataaagttatggtattcctacatgttacaaaataaatctgatatggttatactgtatgttagattatccctgcttaatatagaattatatttttcttgttgcattcactaacttttatattttagattggtacatggttcagtaaaacacagattacagtgggaatgtcctcctgaaagtctttcatttgatccacttcttattactttagctgaggtaaatatgccatctcttgaatatttatcagaaaataaacattaaaaattgcattaaatgctactttgtagcttgtcagtaaatttcattctatgcctttgaaaaacgaagcacacaataggcattgaaacaccacacacccttaggaatgaattatgattcttatatagttatttgaaattgattaatgagctttataaacatggaattagtctgcatagggatttgtagataactagatgaaatatttgtacttacttcaaaaaaaatatgtggactcataatgaggagagattttttggtactagtgaaataaggaaaacatcagggattaaactgaaaactgtcagatagtggtaagtggttctatgtacaaccaatcgtgttgacatgatgtgtttcttagggaattgatactacctacctaaatgttcttttggagaatactccagctctttgcttgtacatttccagtacaatatcatggaggtggttttatagactattttaaaaaaaacttttgatagcttcctttatataatttaacatttgtgtcaggaaaaatgttggtggagtcttagcttcaagtgaatcattgctatcttctatgaattttattcttagagttagaagtagagaaatgaattaaccagttgtcttgtatttaaacttttaattactttttaaaagttaaggatcgttttgttgtcattagtaagaaacaaatgattagagtttgggtgatattagtaataaagcacctgagttctttcactgatagttttatttagattagttactactgtgtaacttactctataaacatggcagtgcctttttaggttaatatcatttgcttttcctataaaaccagtggggaggaccaagtgggagcagaactgaaaaatgtaattttgccaattgagattccttaattaaaatgaaacatcaaaatctctggttcctcatttaattctccaaatatgtttactctcttaagagtaaactaaccagttactagcaaaaactataagtttttgtttttcttaatttattgccgagtattacaagcagtgtatttttataggtagcctattttgaaattcagttttgaggttggcattaaaggttaggctgggtgctgtggctcatgcttgtaatcccagcactttaggaggccaaggtaggaggatcacttgagcccaggagtttgagaccagcctgacctacatagggagaccctgtctctacaaaaaagaaaaaaaagaagatcacattagccaggcacagtagagtgagatgctatctcaaacacacacacacacaaaattagttatgtttccttattttttaaaccttaagccttttaaaccaggtagcaaaccatgtttttttttttagactagtcaaaactggtgatagctttgaaagtgtagtgaagctaatcatattgtacagggagtgctttaatttgggatatccttaaagggactctaacttctgcttaaagtcagccttttatatacctgttgtccaaatgtcaatgcttttctttctgtattgagtagatttttatctttctcctggcctcatttactaacagataagtagtgacagaagaaccactgctgaaatccacttcagcttttaatctgagagtttttatcttgaaaatgaacaggatacaggacactgctatttgatccaaaatgacgcccatgtgcttggcaggatggttttcaaaagcatgacagcttcaaggaaaggaaatgtttgattactatttggaagcagatatttaggtctgaaggacaaattatttgaaaattggtttttctaagcatgattttgcagctgattatatttcttcatagataattagtcaaactaaaggagtttactgttgattttgttttgctttatcatttcgaaaaaagtcagatggcccttttgactcactatgattggttaaatcataaaagagtactagctaattgtttctaatgcatttagggtgaaaggcatagtgagatatgatctacagttttttaaaatattttcatactgcatttcagtattacaaatgacatttaaaatcttaacatgcctttaaaatgcatatagtatgatacttgctttctaaatacgttaatataaaatacttaaatatgaaggaaatttattttaggaacttattaagtcataaaatcactaaatgtaggggatcttatagccatgcattcataaaggagtggttataaacatagactaatttgctctgctttcagaaagtgagtgtacataacaaaatctttttattatcctagcgagtttcccttctttttgtctatagtttcatttacctttccttttcctccttccatttcctgctttttccttccttcctattttattttctctttcttcttatattttttcttgcctcccctgttttccatttcttttcttttcctttttcttattttttttttcttctcccttccttcccttctgtgagtagagattactcctgtctcatgtacagttggcccttcccatccatgggttccacatctagggttttaactagctgcagatcgaaactattaaaaaaaaatacaatgcaaaaataaaaaatacaaataatacaatataaaaattattgatgaagcatttccattgtaataggcattataagtaatctagagattatttaaagtatatgggagtatgtgcacatactatgctcttttatatgaagaactttagtatccacgggttttggtatccattggagggggggccctggaaccagtttcccttgggataccaagggaccctttgtcccacagtttctcaatgtaattgaaattgtaactactgaaattataatcatgattaggaaaacaataatgaaatttttgatttttgtttaagcaagtaaagactcaatttttctgttattagcataatgaaatgggtagtaaatcatgtttcctcttggtctttgtcagggtctgagagagactaagcatccatacacttttgtgtcaaaggagggttttagagaattacttttggtcaaaggtgctcctgaaaaagctattcctttgctacctagactgattcctgtgctaaaggcagctctggtatgtcatttatttcattgtactttatatttgaaaacatgatagaaaagaaagctgtaatatatttagaatattgtatgcctttttccctccatattatatgcaaagtagtcctttatctgtgattctgacacatttacagaattaggcaactgttactcagggccagataactacatacttgaagacatctttagaggatgtactaaaggtaaaaagggacattttaagtaattagaggaagtaatgaacctcaaatcagcctttctgtatgctacatatattttagttaatgcttcagtcagatggaaaatttgttttttgcttctagatgtcctgtgttgaaggttatttttaaaattctaggttttgttgactatcttctgattgtagatgtttaatcttatccttttctctacttgcttgcccttttttctaacctatcttttctttccttttctcctctcttccctgatgtccatacatcccccaactaaccaaccttacaggtccattcggatgatgaagtgtttgaaagaggattgaatgctctagttcagctaagtgtcgttgttggtccttctctaaacgaccatctgaagcatctgcttacaagcgtaagtactgcaaagattagataatgattgactgtatgtatcatgcaccatccatatctcttcatgatttaacaatttcaaatcttcaactcaaaaccttaaaaatctccctctacacactgctttgaatgtgtcccagagattctggtatgttgtgtctttgttctcgttggtttcaaagaacatctttatttctgccttcatttcattatgtacccagtagtcattcaggaacaggttgttcagtttccatgtagctgagcggttttgagtgagtttcttaatcctgagttctagtttgattgcactgtggtctgagagacaagtttgttatgatttctgttcttttacatttgctgaggagagctttacttccaactatgtggtcaattttgggataggtgtggtgtggtgctgaaaaaaatgtatattctgttgatttggggtggagagttctgtagatgtctattaggtctgcttggtgcagaggtgagttcaattcctgggtatccttgttaactttctgtctcgttgatctgtctaatgttgacagtggggtgttaaagtctcccattattattgtgtgggagtcgaaatctctttgtaggtcactcaggacttgctttatgaatctgggtgctcctgtattgggtgcatatatatttaggatagttagctcttcttgttgaattgatccctctaccattatgtaatggccttctttgtctcttttgatctttgttggtttaaagtctgttttatccaagactagaactgcaacccctgcctttttttgttttccatttgcttggtagatcttcctccatccttttattttgagcctatgtgtgtctcttcatgtgagatggatttcctgaatacagcacactgatgggtcttgactctttatccaatatgccagtctgtgtcttttaattggagcattttagtccatttacatttaaagttaatattatgatgtgtgaatttgatcccgtcattatgatattagctggttattttgctcgttagttgatgcagtttcttcctagcctcagtggtctttacaatttggcatgattttgcagtggctggtacaggttgttcctttccatgtttagtgcttccttcaggagctcttttagggcaggcctggtggaaatgcaaatcaaaaccacaatgagataccatctcagaccaattagaatggcagtcattaaaaagtcaggaaacaacaggtgttggagaggatgtggagaaataggaacacttttacactgttggtggaactgtaaagtagttcaaccattgtggaagtcagtgtggcgattcctcagggatctagaactagaaataccatttgacccagccatcccattactgggtatatacccaaaggactataaatcatgctgctataaagacacatgcacacgtatgtttatcgtggcactactcaaaatagcaaagacttggaaccaacccaaatgtccaacaatggtagactggattaagaaaatgtggtacatacacaccatggaatactatgtagccataaaaaatgatgagttcattcctttgtagggacatggatgaaactggaaatcatcattctcagtaaactgtcacaaggacaaaaaaccaaacaccgcatgttctcactcataggtgggaattgaacaatgagaacacatggacacaggaagggtaacatcactctctggggactgttgtggggtgggagtagtggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaaaaaaccttaaaaatctcatcatccttagcaaaaaatatacagatcgttcataaaacattttactaatggacagtattactattttttttaaatggaaagcacctacatgagcagagttcagggttataataaaaagtaaaccacccgggcgtagtggctcacacctgtaatcctaacactttggaggctgaggtgggtggattgcctgagctcaggagtttgagaccagcctgggcaacatggtgaaaccccatctctactaaaatacaaaatactagccaagtgtggtggcatacacctgtagtcccagcttcaggaggctgagacaggagaattgcttgaaccttggaggtggaggttgtagtgggacaagattgtgacagtgcatgccagcctgggtaacagagcgagtctgcacttcaaaaaaaaaccaaaagtcgaatggataaaagctaatgaatggtaagatggtattatgctcatgttgattaactatgaatgtaagcagtgcccatacactgtcttgtgtaattatatgttaccaaacatgtttaagtatttttgtttttcattgcgatgttttagtgaatctgtaaattgcattcaggaagagaccttttcctgatatgtataactttaatctttaatataaatatttactaggaccctgtgcagctcatgaggttcccaagaccactcttaggtttgatgatttgccagaaggatccatggaactcaggaaagctgttactggctgttatggtttcttacaacacacaaaaaataaagattaaaatcagcaaaggtaagaggcacatagggcagggtccatgagagaccagtcatggagttttcagttttcttctcctagtgaagttattcatgcagtgttttttttttgtttgtttgtttgttttaattatactttaagttctagggtacatgtgcacaacgtgcaggtttgttacgtatgtatacgtgtgccatgttggtgtgttgaacccagtaactcatcatttacattaggtatatctcctaatggtatccctcccccgacaggccctggtgtgtgatgttccccttcctgtgtccaagtattctcattgttcaattcccacctatgagtgagaacatgccgtgtttggttttctgtccttgagctagtttgctgagaataatggtttccagcttcatccgtgtccctacaaaggacatgaactcatccttttttatggctgcatagtattccatggtgtatatgtgccacattttcttaatccagtctatcattgatggacatttgggttggttccaagtctttgctattgtgaatagtgccgcaataaacatacatgtgcatgtgtctttatagcaacatgttttataatcctttgggtatatacccagtaatgggatggctgggtcaaatggtatttctagttctagatccttgaggaatcgccacactgtcttacacaatggttgaactggtttacagtcccaccaacagtgtaaaagtgttcctattcctccacatcctctccagcacctgttgtttcctgactttttaatgattgccattctaactggtgtgagatggtatctcattgtggttttgatttgcatttcttaatggccagtgatgatgagcattttttcatgtgtctgttggctgcataaatgtcttcttttgagaagtgtctgttcgtatccttcacccactttttgatggggttgtttgtttttttcttgtaaatttgtttgagttctttgtggattctggatattagccctttgtcagatgagtagattgcaaaaattttttcccattctgtaggttgcctgttcactctgatggtagtttcttttgctgtgcagaagctctttagtttaattagacaccagttgtcaattttggcttttgttgccattgctttttgtgttttagacatgaagtccttgcccatgcctatgtcctgaatggtattgcctaggttttcttttagggtttttatggttttaggtctaacatttaagtctttaatccatcttgaattaatttttgtataaagtgtaaggaagggatccagtttcagctttctccatatggctagccagttttcccagcaccatttattaaatagggaatcctttccccattgcttgtttctgtcaggtttgtcaaagatcagatggttgtagatgtgtggtattatttctgaggcctctgttctgttccattggtcaatatctctgtttaggtaccagtaccatgctgttctggttactgtagccttgtagtatagtttgaagtcaggtagtgtgatgcctccagctttgttcttttggcttaggattgtcttggcaatgtgggctcttttttgtttccatatgaactttaaagtagttcttttccaattctgtgaagaaagtcattggtagctcgatggggatggcattgattctgtaaattaccttgggcagtatggccattttcaccatattgattcttcctatccatgagtatggaatcttcttccatttgtttgtgtcctcttttattttgttgagcagtggtttgtagttctccttgaagaggtccttcacatcccttgtaagttggattcctaggtattttattctctttgaggcagttgtgaatgggagttcactcatgatttggctctctgtctgttattggtgtataagaatgcttgtgatttttgcacattgattttgtatcctgagactttgctgagttgcttatcagcttaaggagattttgggctgagacgatggggttttctagatatacaatcatgtcatctgcaaacggggacaatttgacttcctcttttcgtaattgaataccctttatttctttctcctgcctgattgccctggccagaacttccaacactatgttgaataggagtggtgagagagggcatccctgtcttgtgccagttttcaaagggaatgcttccagtttctacccattcagtatgatattggttgtgggtgtgtcataaatagctcttattattttgagatacgtcccatcaatacctaatctattgagagtttttagcatgaagggttgctgattttgacaaagtccttttctgcatctatcgagataatcgtggtttttgtctttggttctgtttatatgctggattacatttattaatttgcatatgttgaaccagccttgcatcccagggatgaagcttattcacttggtcatggtggataagctttttgatgtgctgctggattcggtttgccagtaatttattgaggatttttgcattgatgttcatcagggatattggtcttaaattcttttttttgttgtgtctctgccaggttttggtatcagcatgatgctggcctcataaaatgagttagggaggattccctctttttctattgattggaatagtttcagaagaatggtacaagctcctccttgtacctctggtggaattcagctgtgaatccatctggtcctggactttttttggttggtaagctattaactattgcctcaatttccgagcctgttattggtctattcagagattcaccttcttcctggtttagtcttgggagggtgtatgtgtccaggaattcatccatttctgcaagattttctagtttatttgcatagaggtgtttatagtattctctgatggtagtttgtatttctgtgggattggtggtgatatcccttgtatcattttttattgcgtctatttgattcttctctctttactttattagtcttgctagcagtctatcaattttgttgatcttttcaaaaaaaccagctcctggagtcattgattttttgaagggtgttttgtgtctctatctccttcaattctgctctgatcttagttatttcttgacttctgctagcttttgaatgtgtttgctcttgcttctctagttcttttaattgtgatgttagggtatcagttttagatctttcctgcttttctcttgtgggcttttagtgctataaatttccctctacacactgctttaaatatgtcccagagattctggtacattgtgtctttgttctcattggtttcaaagaacatctttatttctgccttcatttcattatgtatccagcagtcattccggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagaggtgagttcaattcctgggtatccttgttaactttctgtctcgttgatctgtctaatgttgacagtggggtgttaaagtctcccattattattgtgtgggagtcgaaatctctttgtaggtcactcaggacttgctttatgaatctgggtgctcctgtattgggtgcatatatatttaggatagttagcccttcttgttgaattgatccctttaccattatgtaatggccttctttgtctcttttgatctttgttggtttaaagtcttttatcagagactaggattgcaacttctgccttttttttgttttccatttgcttggtagatcttcctccatccttttattttgagcctatgtgtgtctctgcacatgagatgggtctcctgaatacagcacactgatgggtctcgactctttatccaatctgccagtctgtgtcttttaattggagcatttagcccatttatatttaaggttagtattgttttgtgtgaatctgatcctgtcattatgatgttagctgattattttgctcattagttgatgcagtttcttcctagcctcgatggtctttacaatttggcttgtttttgcagtggctggtacaggttgttcctttccatgtttagtgtttccttcaggagctcttgtaaggcaggccttgtggtaacaaaatcagcatttgcttgtctgtaaaggattttatttgtccttcgcttatgaagcttagtttggctggatatgaaattttgggttgaaaattcttttctttaaggatgttgaatattggccccactctcttctggcttgtagagtgtctgccacgagttctgctgttagtctgatgggcttccctttgtgggtaacccagcctttccttctggctgcccttaatattttttccttcatttcaaccttggtgaatctgacaattatgtgtcttggagttgctcttctcaagaagtatcttggtggcattctctgtatttcctgaatttcaatgttggcctgccttgctaagttgggaaagttctcctggataatatcctgcagcgtgttttccaacttggttccattctccctgtcactttcaggtacaccaatcagacgtagatttggtcttttcacatagttccatatttcttggaggctttgttcctttctttttactcttttttctctaaacttcacttctcgcttcatttcattcatttgatcttcaatcactgataccctttcttccactcgattgagtcggctactgaagcttgtgcattcgtcatgtagttctcgtgccatggtgttcagctccatcaggtcatttaaggtcctctctacactggttattctagttagccattcatctaatcttttttcaatgtttttagcttctttgcaatgggttcaaacttcctccttttgctcgcaaaagtttgatcgtctgaagccttcttttgtcacctcgtcaaagtcattctccgtccagcttagttccgtttctggtgaggagttgtgttcctttggagggggagaggcgctttgatttttagaattttcaggttttctgctctgttttttccccatctttgtggttttatgtacctttggtctttgatgatggtgacgtacaagtggggttttggtgtggatgtcctttctgtttgttagttttccttctaacagttgggacgctcagctgcaggtctgttggagtttgctggaggtccactccagaccctgtttgcctgggtatcagcagtggaggctgcagaacagcgaatattgctgaacagcaaatgttgctgcctgatcgttcctctggaagtttcgtctcagaggggtactcggccgtgtgaggtgtcagtctgcccctactggggggtgcctctcagttaggctactcacgggtcagggacccacttgaggaggcagtctgtccgttctcagatctcaaactccgtgctgggagaaccactactctcttcaaagctgtcagacagggacatttaagtctgcagaggtttctgctgccttttgtttggctatgccctgcccccagaggtggagtctacagaggcaggcaggcctccttgagctgtggtgggctccacccagtttgagcttcccagctgctttgtttacctgctgaaacctcagcaatggcgggcgcccctctcccagccttgctgccgccttgcagttctatcccagactgctgtgctagcaatgagcgaggctccatgggcatgggactctctgagccaggcacaggatataatctcctggtgtgctgtttgctaagaccattggaaaagtgcagtattaagttgggagtgactcgatattccaggtgccatctgtcacagctttgcttggctaggaaagggaattccctgatcccttgcgcttcccgggtgaggcgatgcctcgccctgcttcggctcacacttggtgcgctatacccgctgtcctgcacccactgtccaacaagccccagtgagatgaacccggtacctcagttggaaatgcagaaatcacctgtgttttgcgtcactcacgctgggagctgtagactggagctcttcctattcggccatcttggaaccgcccccttcttcatgcagtgtttacttcttccagcaacaatgtgtggcaacgtgcatggagtattgccaactagagaagctcatgtgagccttagtgtccagggtttttattggtgtctgtcatgcaggcaagactgcctgcctgtgtggttgactttagtctacaccctctctagaaatcgagctaataccctgtgaaccaaagttcccatcataaatcacattgtatagactacctggtgtcacccgaaactcccatgttgacaaggataccctatccaggaggacattccaagagcttagaggttatcattcaagagctaggggcaagggccaaactttaggcaagggaagttctataccgcatactgatagaaaaattaaagagttagataggacctccctgtctgcattcttctgtatttcacagctgaggtatgattttgataatggttccactgttttttcttggatacatccatatgagagatcctagaactgtatttttaacttcctattccacaactaggaactacctgttccaatacaccctaggaactacctggttaatggtataagaagtaggtgcgatggtgactctatcaggataggtatgctcataggtggtagatgaaattccgtgaggtttcaggtgaggagaagacatagtgagaatagactttcaagccttgacatatgaggagtcttatgacagaagaaagagaatcttggcagatatttgtaagcttcatgtcagggggtgtggctgaccaactacaggaatttcacactagtatacaaagtgactcattcaaatattcagtcgtttaataataatctcttgcactctgccctcctgttttgtgccaggtatgccaagcagtgagaatataatctgagcagaaacaggcatgctctcagtccttgtggagattattggttttggttttgggttttttttgtttttttgtttttgtttttgcaggtgggtgggggatgtagaaataagcagcaaggacatctgctgagaaaattgggatggagtcaaagggatgtgatatgtagagaaaaggaatcacactggatccttcctcaaagtcagtcaagcaaggcttcctaaatagcctctaagtcccacctccgatggcagaaagaaaagaccagattaacagttgtatacatttgttttgttttctaatctttctgggtcagtggcgtttatctttggtcacttgcattcctcctcagagctctgcttttcctagacaaggactgactgaacgggtatctagctttcctgggctgccagcactttgggaagacctagacaccaccctgaccatcagatcctggtgttatataaagagttctagaaataggttgtgtgagggttagttcctggtctattaccactaactatgagacagacaccactgaggatgtcaatgaggtgctatcggatccccttcgtccctcacccccatcttccatacatttcagcctcaaagccttcatttttatggggtttatagacttctacattagaagtttattggaagaaagggtattattcttctagaaaaagtttttcaaaaccagttactgaacccctgtatacaactcattttttcctctatgcaaaataagctataccttttctgagctgcaaatgtatgggactttaaagagggaataaatcacctgaaaatcttgcttaaaaatgtagattctgggcttctgctctgggattctggttaagtatggcgtgagacccaagaatctgcatttttaaacagcatctcaagtgattctgaggctgatggcccatggatctgcatgtaaacctctgtgctatacagagtgtatacagattcagtagggtaatgcagtctgaagaaagcaactggaagactagagagggaccctgtccatccccagggcattcactcttataaattactcatgtaaatcctccatcctttgtcttctcttccctttttattgcaggaaaatgtgtgttttagaggcacagctttccatcatggtcctcaatgctcttgcaaattacagaatcacaaaatatgctattttatagaaaccttacttcagatagcatactgaagcagattttataggattggttttacctgaaataatgtaaattcattgttttttaaaacaaatacagaggtaccttatacatgtaaatttcaatgagatgcttcctaaaaaaagccttgaaatctaaaacaaggggtgctcctgaagatttacttatgcgtatggtgagcattgttaagtttaaagtcatttcgtttccccctaatcttactttaaaagctttccaagagattaatggacaagaaattcaaagagccaatcaccagcgcattacaaaagctagagcaacatggtggaagtgtaagtagaatattattccttaagtctttttttttaacttttaggtgtattactaaattgacatatatatatatttaacatatactatctcatttcagccacaggtaactatgtgaaattgatgctgttattttccttttagaactcaagagtttctgtctctaggtcacactgttctcaagccctgcgactcagaccagactcaggttgaataaatatagggcttgtgtacactttcacagtgcttaatgtggcactcagtgtggcgcagtggtacagtttttttcttaaaagtattttcagtggtttagttttgaccatcgaaaagttcagaaaaccgaacgattaacttagctctttgaggaaaaatacctttttctctttcatttgctgccttttctgactcagacgtccagatgattacactattctgtctgtaagtgcgtgcatacccccataggtgtacacacacacacacacacacacacggacacatatgcacacacagtgctggaatagtttaattggttattctaacttttcaaggtacaaaaatatggaggatttcataactgtatggtgtcagattactagactaattgaatttttagcatttgaaagaagcattcagataatctcgtcttagaaatatttccataaaagcagtccttgcttttggaaattttgtttaatcagatcttaatgatagaattgcatgtgaccatcttaacattgtataacttagttccattgtaggtacttctaaaggaattagttatgagaaaatttacctgatcatatacaattttaaaatggcagacataaagctttagcgaaatacctcatttgaccaatctcaatgagttgtttgattgattatattctttccatgatggatgcctagaatacagttgacaagaggaagtaagtgtctaagcctactagataatgaatttctttgttgtgtttgggtcctaggcagagtattaacattcagacaccttgttgaggagatgtgcagaactttcctctagctaatcccatgtctcctctgcagcaaggaaattcttgcttgctcttctgagaatttaaatgcaaaatatatttctcctttcttcttctgtggagtggaagtgaacaaatgctaaataatgatgccacagcttttcagtgggaaacgctccctaggtgattttccatatcctgtgggccggtatgggaaatgggacaagtagaaagggacaggccaagcatgttagattttgtggtgggagtggagggggtgtggaggaggagatagtatatgtgtaaataaagtttagaaacggcacattaagatttggaaggggaacacagagctgtagttgagtaatccaggatcccagaaatatcaaattctttttttactactccatcttactagctttgaatgttgctaatacagaattttaaaaaagattttgtagctacaagggctgttattatttattttcttctgactcctcttgtttcctccttcttatatcctacataatattttaataatgattgatgtaattggaatagaaaatttcctattgcaattacataccaaagactttctcttggcttattattgtgctaatttctgttacttcgtaatccttcatgaaactaatgaatgttcttctttctcttctaagaccttaaaagcttatatatctctttctttcttaaaatattagaaattaagtctttaaaaatgagtgttctcagttgtggtttctcatttcttgggacttgtgtatatcaatgatggaactattcaacttttggatacaggaaaatatctgttacagatagtcacagtgttactttcttagaactgatctgccttaaattgaaatcagttcattcttagcctgatttgattttttttctaagtgaaatgcacatttattttggaaaaggcacaatgcaaatcctgatctttattgattgtgtgggaacttattacatggcaggtactctgctgagtactttttagacatgaaacccatttactcttcctagtcatcagagggagattttgttgttatctccctctaaagatcacggaacttaggcacagaaaagtaattagtccaggtttgacgaataagtgactagtagatgctgaattcagatactggtagtctggcttctaactacttctctagttagatacttcaaaaaaagagaaagaaacagcctatattttatttaactcagcaaaaagtccttcttatttcatcattttgttcttacccctttttgtttgagttttagatactttctaggcatattcctgcaaatataatacctattaggggaactctgcatgatactaatgatgctcaatttttttctgttgacaggggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttattttttctttttgaaatacaaaatgtgcacattgagtttacacaaacacgtgatggcaaatttcagtgtacatgtattgtactactcttaatttctacactggtgatagcagggcagctttcaacatcctatctctacaccagaatagatacctgatttattgttgcaaagacagttgcaaatttcctccttctgtagcctcttggtctttgtgatatttctacaaaacagggacgatgtgtgtggctttagtaatgtggcaactttacagttttggctaagatgattaaaaataatctgaattatgatgagctaaatcatactgtaatctggattagttgttgagcacttattttctactaaatcttggtagtagttgtcaatgtaatggaaccactggtgctttcaaagtgaattttgcttgctaattttgcttgctgtttgttcttagtagacagtggggtagtcaaggtttctttctttgtccctgaatggcttgtaatataaataaacatgctgtaaggaagtcaggggaaagaggacagatttggcctttaatgctgttaggattacttgttattaagcattactatatactggaggatagatatcctgaccctttgcatatgtctgtaaacatccttgttttgtttgatgccttcttcaacttccacttaatgattgatactaatgattgatacaatagaaaacagcctgtaagaaagattgaacaaatccaaaattattatataggccttggctgtaacatattatggaaaattaaatgcttattaaaataagttttattaggcatatgctgatatctgataataaactaatttttaaatgtttaataatttttaaatgtttaaaaatgccagataaaactaatttctaacagaaggtgggaaggccatagaaactggaactatgtgtttttttaattgttgtaatcttgtttccttaaagtatataaatggaatttaaatggaattacagcattcaaacatgaaaattaatttaatttctggaaattaaatgcagatgtcactatattagaaaaccattcaaaatcctaggactgaatacatacaaatgagtagcaaaaaacactgatattttaaaatcactgatatgtgaaagcctcaataatcccatggctaaggaaccaataaaactatatgccagattctattacttttgaatattcacagagtatgaaatgagttagaccatcccctgaactcagtggcattatgaaaaggatgcaaatttataactgaaagctcaaatcttttggggattgctttatattaaaacaaagcttgtttgcataatatgcttcagtgtcaagctgagcaatctatgctaaaagtggtagctccaactttaagggtggtagaatagttcacatttgtctgttggattcaggatctatttgacaagttaaatcacattttcaaagagctgcatggagcgcattatgttttcatcctgtaagggagaaacacagagcgattaaattcagcatatctgcaaggaaaagtacactattttgcccctgagtattgcctcctcccatcaaccacctcaaccacctatgccaaaagctcaaatattaagtgtttgcaaatgtaaatgccattctattctatccattttccacatagatgactatgaaggacccattttatattttgtggagtctattgaccaggcattaaaccactttatttaaatctttacttggtattaatagaggatatttctcaaatcataatgccaaaatggaaactacagaggtgcagaggtgtgtcaaagcaaatgagaattttggcattctatgtagatcacaggccaaatcacacagacttttatacaggtacaaggaaaatttgtgtgtatgagccagcagttcatgaagattggaggctggcgcataggaggcagggtggtggattaagaggtaacatgtttgcagtaatcatctctctttctgtctgctagttatggctaaagctgcatggcctgaaggagcctttaaaaatgaatggtctctcaattacagagaaagaattggggagcagaaaccactgctcagtggctgtgttcagtttagcatattctttagaaatgagttaggggacagactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagtaagaacaacaatttaaaaataaagagaaaaactaaagaaacaacggatttctttgttttcaggattatttgaaaaattctttttttctttttttagttttgaggcagagtctatttctgttgcccatcattctggagtgcagtggcacaatcatggctcaacagggatcaagtgatcttcctgcctcagcctcccaagtagctgagacttcagccacgtgccaccgtgcccagctaacttaatttttttttgtagagatagatagggtcttgctatgttgcccacattggactcaaaatcctggccttaagttatcttcccgcctcagcctcccatagtgctgggattacagttgtgagctactgtaccaggccttaacaatttttaactgtggttctgcccacacatcaagtcaaataattctaagtaagctaacactggtttctttgataacaggctactacctggagttctcttcagagaaaattttccactgtttattttttgtgactgaagaccattagtgagttcagtcaaagagccatttcttgtccacatacactaaaacaatgacttttctcttagaaatcagatagaagcttggcctgttgtgatgccatacttggctatctaggaattctaatgctgtggagatatgatagataatatatgagtgatgctaagttttggcaaagagcaattcaaatctcatgtatgttttatcctccatgaatactctctaaggaatttgggaatcaacacagtacatgtacaacttttgtatccccagggtttcctccatagcctgactcagtgggcactctaaatgttgattatgtaattggtgcttgttttcagagtggtaggcttatgctgcatgttgtagaagtggtaaacttaggcatatgatctctatatttcgcccagttcatggtagctagctgctaatactcagtttagctgttatgatagctgaattgatagttattacactttcattacttactttttggcagctttcaatgaactcatctatggtaacaaccccatctttatttttgtccattttctgttcaggaagaaaacaaaaattgtatttagacttatcccttaataccctcacacctggaccaaatgagctgaagctgataaaaagaaaacctagctgcttatttatttcacgtggaggaactgtttcagagcaggaaccagcagttttttagagataaaaatgatagggccaaatgcttctggcttttcccttttcaatataatgtggtgaagatgtagagtcactctgtcctaggtaaaatcccaccttctagatgtgacagagcttgcgcaatttgctgaaactttcagagcttgctttttgtctcatctgtaaaatgagattaatgaggatttataggattcttgtaaaaactgaatgaaaacaaaacttgtgaaacatgagaactgtttagtgttgtatcttggatttagtgaatgttcaataaatgcagttatcagcattgtaaattcaaaaccaaagctattaaattaataggatgctaaatactgttttgtttcagtaaaaattattttcctttgctctcttttgaatcatcgtggtgcatggcaaacatcaggaaattttctcctaacttcatgccctcttgacttctgttttaattcctacctgaaaaaatgtttcaacgtgttgtctgggagcatcttctttgaggacaggatatgtacatttacccatcatatcgtatattgctttcattatatcaagcatttcctgaaaaataaaaggcactcacgtgaggctgcacacatgtatgaagaaaccagtctaagaagctctgacagatttttcctactcaattttaaatttttgactttttgtttgttggattctttgttagacgactgttggttgtcccaaaggaaaaggcaacaaacagctttctgccttaagagcagaagaatcagaatttaagaatgaattctgatctcttggtttcaaaaggaagcaaatttccatgtatctaccatagtcaggaaaagaatatgctggcttaatgtttggatttctatagactttaagtagactatgtttatttaattgcattatatatcttatgtgttgatcatcagtttccatctattgagaatcaaatatacggcacatcgtatattgagaaaaaacaccatttagaattagtgaaattaattggtaagtcttaaggttcattagggtttttgttgtatttttcctactgtggctttaacttaagtcacatgtgaagactagtcaaaaaattttgaccctgggaaacacctttaaattttgttattaactttttctctaaaacagtctaatttttgccttaccactttcattcttatgagagtaaaaataatctctaataacttaaacatttagatttattgttgcacatttgtttcacgtgaaagatctctcaattaggttaatacagagcgaatatatatttacttttaagagtattcaattataaatgatagagtaatttgtaaacaggtgaaaccttttaagatgttttaagcatagataagtagcaagtagtttgttagacacaggcagaattcttgagatgtgttaaacacagaggtaagaattgaagaacaagagatatttaaggtatcctaagtatctgggtaataaatattcatgatataaaaatatacaagaagcactatttaggatatgctccatatacatgaacacaatagccataaggtcttaatttggcacccactagtgatacctattctggccccaggtgtcctctgtgcaagaaacacaaatgaaacccattactacttatcaggctatactcgtgacctggcacacttgcacctgtgtctctccagtagcgcaagttcatgtcatttgctgttggccctgggcaccttttgtctgtggggcctcttgctcaaaactcaattctggggaagtctcgtgaggcaaagagagacaggacataggcacactgagaatgcccaggatttagggagtggtctttcaaccccatttgcagcctgtcctgcgtggttaacttactccatccctttctttacttctcgctgtgttttaaattggtttaataaactgtgtaatacgagtatcttaatttggtctgtgaaccttgtttcctggatagtctgcctcaacgtgcatttggagaccccaccattgcgtcaggtcattccacaatccccatgattgtaaaatttcatttccttatggatcacatgctgtggggaaaagaaaggcttcaggctaaatgttgaaacatgggttggatacattttctttctatctgattccaaccatgatctttattccattcacagtatttattaagatgccagcaggaaacaagggtgtaatctttatgtgttatatatttactttggagcttcaccataaactacttctatcccaagtttttaattgtacatctttcttccactacataaaatattttggaatttcctcaaaaaaacttttcaaattaataattgcaattaatattttaaagttaagaaatgaaaatggtccaaattactgtgatgttggtgaggcatcccttacctctttagtgatgtagccatctttatttatgtcatacagattaaatgcccaattgagtttttcttgtactgtcccccggagcaaaatggaaagacctttgatgaaatcctgaaaagaaataaaaattcaattttatatgacatttttaaaaaaacaaaaacaaaaaaaacaaatgatgtaagtaagggctacaaccctctggatcttgaacatttagcaaaatgattgatgtgttattggttgtctagttttcagacttctctgtgggcataaatcactccttagtcttaacattttcatattctaattggaaactgagttaaatcaatggtcatactggaaattgtaccagtgcgtacccacacagctagaggcttgagtataagtggtattggctttccactgcaagtgcacatgatttactaaaagaatctaataatagttttttcaaaaaaatacaagtgcacacataacacacttcaatgaaaaaccgtttgctaataagaaatgtggctgtccataaaagataaaccaattgtggtctttaattagaaatccagttataatttacatgtggacagtgggtaagagcatggaactggaaaggacagactgcctggattcaccctccagctatattactggatggctttgtgtcttcaggcaacttaacatccctttgcctcaattttcgtatctgtaaaatggagctaataatagtatctacctcttcacaattttatgaggattaaaaaagaggctgcttataacagtccttggcaatgacattggctatgtaagtttttgttaagtaaatggagccctcagtttgtatcctggttagattgcattgcagactggccagattaacttgattaaattcatttagtgtttttttttttgtttttttttttttttttgagatggaatctcgcactgttgcccaggctggagtgcagtggcacaatcttggctcactgcaacttccacctcccacctcccaggttcaagccattcttctgcctcagcctcccgagtagctgggactacaggcacccgccaccatgcctgactaatttttgtatttttggtagagatggggtttcaccatgttggccaggttggtgtcgaactcctgaccttgtgatctgcccaccgccgcctctcaaagtgctgggattacaggcgtgagccaccacgcctggccagatttcttgttgttatgtacagcagggttaacgttacaatgtgctgtattcagtttataatccacttttaggtaggaatgaaagcagaggggaaatccaaaagtcttctgggtgaatttgcattatatctccctttctcacattccttccttttatagctgtatttctatctgaatttctcaaaatgttttttcttttttaaataagtaacatccatatagttcaacatttaaaaattgtgtaagctgcctggtgaaaaatctttcttcccttcctggacccagccacctgttcctttcactcatagactactggcataaatagtttgtatttacttccaaggaatttttgtgcatacacaagtataagatatatttgttttactagctaacagacttctatacttttttttccacttaagcataaatcagggaaacaatttgagtttccattgtatatgtaaatacatcgtagtttatttaaccaaattgttcttttacattttttctcatcattatttctaggtattttaatatttctgttgctgttgtaaatgagatatttttttctatcatatattctaaactagttgtttgtatgtatgaaagccattgatttctgtatgataattttataccctgtcaatttgctgacatacgttggttttcttctgggttttcatgtgtgcaatattagctgcaaatggaattaattttacctttttttctaatttttatatgtttacttttttctaattatatggcctaatatatatagaacagtgttacataatgaaaatgataatagatattcttagttttttcttgaacttgagaatatttcaattcgcttttaagcatgatacttacttttatcatggtaaagaattatacaacccttccacttaagcaaatttatcaagaatggccacagaccttttttagcaaaaatgaaaaagacaaaaacagaaataattgtcaaattcatattgcaagggaccctgaatagcccagtcaattttaagaaagaaaaacaaacttggaggactcacactgcccaatatcaaaacttagtacaaagttacattaatcaaaacagtgtggtactggcataaagacagatatatagaacagtagaatagaattgagtctagatataaaccagctgtctgtggccaattgattttcgataatggtgccaagaccattcaatagctatggaaagaataatctcaatatatggtgctgtggcaactggatcaccatacttagtttgcttcccattggcatgaagggtagaatgtcaagtgagagaaaaacaagattccagagaaagccacaaggaattccaatatttggcaggtacagagaggagaagctggcaaagcatcttgaaaagaagttgctaaagaagtgagtcaggagaacagagcatttccctaggaaaggattgttcattttgctccaaggttggaaaaatgttcactggaccagcaacatggaggtcaccagcaagtgatagggaacggtccagtggagtaggagtgaagagtaatttttaatgaggagcactttgaatactgaagagaagaatctaaaaagagtaagagtcagaaatgggctgtgctcttgagaaggtggggaggatccagaacatgggtagatgggccgatctgagaagggagttgatacatgagacagaagaacatggtgtggatgccagcagctgctttgcaggtgggaagatgactgtgtttctgtccgatagctttagtgagtgtgagctgtttgagagtgaggagcctggtagaagaggtaagaatctgaggtttgaggagagaggcagaagctctgatactaagcagtaagatgacatgcaaattagagaaagggagacctccctcaaattatttccctgccatattttagaaaattatttatgacatagaatgtagtttagttaaaaggtaatgacagcccttggaggtatgagtgtacatcttgcacaaccagcaggctggggatcatggctcatgcctgtaatcccagcactttgggtggtggaggtgggaaggttgtttgagtccaagagtttgcaagcagcctgagcaacgcagccagatccaaattaacagcaagaaaaacaaattaactgggtatggtggtgcacacctgttgtcccagctacctgggaggctgagatgggaatcacttgagcccagaaggtcgaggctacagtgaactatgattgcaccactgtgcttcagcctggatgacagaccaagactctgtctcaaaaaaaaaaaaaaaatccttagctttttcagaaggcataaaatatacattgcagaacatagagccttattcaaggaagattgctgagcagttttgaaaggctagatgagattgattgttatcaatgtaaacgatatttttaaaaattcacagcgtagtaataatatgtcattaattgtaaggggagctggccacagggtctttgaaaacatgcttagagtattggttctcaaaatataatgtgcaacacagtcacctggggagtgtgccaaaagatttatgggacctactccaagaattatgattcattaggttgaagtgggaccccaaaatttacatgtctgacacattccaaggggaagcctgtactgcttccagggatcacactttgagaatcactggcctacagcactcatcactggcattgacctcaccaccacacaaaacagcagagaaacaatgaaagatttaaagatagcacttttggggaatccccccaagatggctacataggaacagctccagtctacagctcccagcatgagcaacgcagaagatgggtgatttctgcatttccaactgaggtaccaggttcatctaaactgggacttgttggacagtggatgcagcccacagagtgtgagccgaagcagggtggggcatcgcctcacccaggaagcgcaaggggttggggaattccctttcctagccaagggaagctgtgacagatggtacctggagaatcaggacacttcctgccaatattgtgcttttccaacagtcttagcaaacggcacaccaggagattatatactgcacctggctcagagtggcccacacccacagagccttgctcactgctatcacagaagtccgagatcgaactgcaaggcaacagtgaggctgagggaggggcgtccaccattgctgagacttgactaggtaaagcagccaggaagctcaaactaggtggagcccactgcagctcaaggaggcctgcctgcctctgtagatgccacctctgggggcaggtcatagctgaacaaaaggcagcagaaacttctgcagacttaaacatccctgtctgacagctttgaagagagtagttctcccagcatggagtttgagatctgagaacagacagactgcctcctcaagtgggtccctgacccccgagtagcataactgggaaacacctcctagtaggggcagactgacacctcatacagccaggtgcccctctaagacaaagcttccagaggaaggatcaggcagcaacatgtgctgttctgtagcctctgctggtgataaccaggcaaacagggtctggagtggacctccagcaaactccaacagacctgcagctgagggtcctgactgttagaaggaaaactgacaaacagaagggaatagcatcaacatcaacaaaaaggacatccacaccaaaaccccatctttaggtcaccatcatcaaagaccaaaggtagataaaaccagaaagatggagagaaaccagagcagaaaagctgaaaagtgtaaaaatcagagaacctcttctccaaaggaacgcacctcctcgccagcaatggaacaaagctggatggagaatgactttgatgagctgacagaagtaggcttcaaaagatcagtaataacaaacttctccgaactaaaggaagatgttcgaacccatcacaaagaagctaaaaaccttgagaaaagattagacgaatggctgactagaataaacagcgtagagaagaccttaaatgacctgacggagctgaaaaccatggcacaagaactatctgatgcattcacaagcttcagtagccattttgatcaagtggaagaaagggtatcagtgattgaagatcaagtgaatgaaatgaagcgagaagagaagtatagagaaaaatgagttaaacaaagcctccaggaaatatgggactatgtgaaaaggccaaatctacgtctgattggtgtacctgaaagtgacggggagaattgaaccaagttggaaaacacccttcaggatattatccaggagaacttgcgcaacctagcaagtcaggccaacattcaaattcaggaaatacagagaatgccaccaagatactccttaagagcaattccaagacacataaattgtcagattcaccaaagttgaaatgaaggaaagaaagttaagggcagccagggaggtcgggttacccacaaagggaagcccatcagactaacagcggaactctcggcagaaactttacaagccagaagagagtgggggccaatattcaacactcttacagaattttcaacccagaatttcataaccagccaaactaagcttcataagtgaaggagaaataaaatcctttacagacaagcaaatgctgagagattttgtcaccgccaggcctgccttacaagagcttctgaaggaagcactaaacatagaaaggaacaactgataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaacgcaccaattaaaagacacaaactggcaaataggattgtcaagatccatcagtgtgctgtattcaggagacccatctcgcctgcagagacaaacataggctcaaaataaagggatggaggaagatctaccaagcaaatggaaaacaaaaaaaaagcaggggttgcaatcctagtctctgataaaacagacattaaaccaacaaagatcaaaacagacaaagaaggctattacataatggtaaagggatcaattcaacaagaagagctaactatcctaaatatatatgcaccaatacaggagcacccagattcataaaacaagtccttagagatctacaaagagacttagactcccacacaataataatgggaggctttaacaccccactgtcagcattacacagatcaatgagacagaaagttaacaaggatatccaggacttgaactcagctctgcagcaagcggacctaatagacatctacagaactctccaccccaaatcaacagaatatagattcttctcagcactacgtcacacttattccaaaattgaccacatagttggaagtaaagcactcctcagcaaatgtaaaagaacagaaattataacaaactgtctctcagactacaatgcaatcaaattaaaactcaagattgaaactcactcaaaactgcacaactacttggaaactgaacaacctgctcctgaatgaccactgggtagataatgaaatgaaggcagaaataaagatgttctttgaaaccaatgagaacaaagacacaacgtaccagaatctctgggacacatttaaagcagtgtgtagagggaaatttatagcactcaaagcccacaagagaaagcaggaaagatctaaaatcaacaccctaacatcacaattaaaagaagtagagaagcaagagcaaacacattcaaaagctagcagaaggcaagaaataactaagagcagagcagaactgaaggagacagagacacaaaaaacccttcaaaaaatcaatgaatccaggagctggtgttttgaaaagatcaacaaaattgatagactgctagcaaggctaataaagaagaaaagagagaagaatcaaatagatgcaataaaaaatgataaaggggatatcaccactgatcccacagaaatacaaactaccatcagagaatacgatgaacacctctatgcgaataaactagaaaatctagaagaatggataaattcctggacacatacaccctcccaagactaaaccaggaagaagttgaatccctgaatagaccaataacaggctctgaaattgaggcaataattaatagcctgccaaccaaaaaaaagtccaggaccagatggattcacagctgaattctaccagaggtacaaagaggagctggtaccatttcttctgaaaatattccaatcaacagaaaaagagggaatcctccctaactcattttatgaggccagcatcatcctgataccaaagcctagcagagatacaacaaaaaagaattttagaccaatatccctgctgaacatcgatgcaaaaatcctcaataaaatattagcaaaccgaatccagcagcacatcaaaaagcttatccaccactatcattttggcttcatccctgggatgcaaggctggttcaacatacacaaatcaataaatgtaatccatcatataaacaaaaccaaagacaaaaaccacatgattatctcaacagacacagaagaggcctttgacaatattcagcagcccttcatgctaaaaactctcaataaactaggtattaatgggacgtatctcaaaataagagctatttatggcaaacccacagccaatatcatactgaatgggcaaaaactggactcattccctttgaaaactggcacaagacagggatgccctctctcaccactcctattcaacatagtgttggaagttctggccagggcaatcaggcaggagaaggaaataaagggtattcaattagggaaagaagaagtcaaattttccctgtttgcggatgacatgattgtatatttagaaaaccctgtcgtctcagcccaaaatctccttaaactgataagcaacttaagcgaagtctcagggtacaaaaatcaatgtgcaaaaatcacaggcattcctatacaccaataatagacaaacagagccaaatcatgagtgaactcccattcacaattgcttcaaagataataaaatacctaggaatccaacttatatgggatgtgaaggacccttataagggtgtgaaggacccttataagggtgtgaaggacccttataagttcacccttatgtgaactacgaaccactgctcaatgaaataaaagaggacacaaacaaatggaagaacattccatgttcatggataggaagaatccatatcgtgaacatggccatactgcccaaggtgtaatttatagattcagtgccatccccatcaagctaccaatgactttcttcacaaaattggaaaaaactactttaaagttcatatggaaccaaaacagagcccacattgccaagtcaatcctaagccaaaagaacaaagctggagacatcatgctgcctgacttcaaactatactacaaggctacagtaaccaaaacagcatggtactggtaccaaaacagagatatagaccaatggaacagaacagagccctcggaaataataccacacatctacaaccatctgatctttgacaaacctgacagaaacaagcaatggggaaaggattccctatttaataaatggtgctgggaaaactggctagccatatgtagaaagctgaaactggatcccttccttacactttatacaaaaattaattcaagatggattaaagacttaaacattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaggaacttctgcacagcaaaagaaactaccatcagagtgaacaggcaacctacaaaatgggagaaaattttcgcaacctactcatctgacaaagggctaatatccagaatctacaaagaaattaaatttacaagaaaaaaaaaaacccttcaaaaagtgggcaaaggatatgaacagactcttctcaaaagaagacatttatgcagccaccagacacatgaaaaaatgctcatcatcactggccatcagagaaatgcaaatcaaaaccacaatgagataccatctcacaccagttagaatgacaatcattaagaagtcaggaaacaacagatgctggagaggatgtggagaaataggaacacttttgcactgttggtgggactgtaaactagttcaaccattgtggaagactggtgactcctcaaggagctagaactagaaataccatttgacccagcaatcccattactgggtatacacccaaaggattataaatcatgctgctttaaagacacatgcacatgtatgtttattgcggcactattcacagtagcaaagacttggtaccaacccaaatgtccatcaatgatagactggattaagaaaatgtggcacatatactggattaagaaaatatggcactatacagccataaaaaggatgagttcatgtcctttgtagggacatggatgaagctggaaaccatcactctcagcaaactatcgcaaggacagaaaaccaaacaccgcatgttctcactcataggtgggaattgaaaaatgagaacacttggacataggatggagaacatcacacacgggggcctgatgaggggtcagggggatgggggagggatagcattaggagaaataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaattgaagtctcaagtaggaagtgacaaacttaacaacaactctcaatgagtactttgcacaattactttacttgtaaatgtgaaaggaggttatatctgttccctaaagtacaaaaaatgataaaggggtggagaggtctgtaccgaattctggtttccattctcttattatcaaggcaaaaggagaaagacatagagatttgactttataatagcctagacttgttcagttgtggattctgttcatctgccaaacctttaatgagtgcctcagtgctggccactatgctggggacaatcctcctgactcccctgactccctgccaatcaaagactgctatggcttagaatgatgcatttgcatgtagttgccttactgggtaatgagatgaccaatgtcattattaactggctttgttagaaaaattcccccaactagtgtaaattagttcaaccattgtggaagactgtggcgattcctcaaggatctagaactagaaataccatttgacacagccatcccattactgggtatatacctaaaggattataaatcattctactataaagacacatacacatgtatatgtattgcagcactattcacaatagcaaagacttggaaccaacccaaatgtccatcaataatacactggataaagaaaacgtggcacatatacaccatggaatactatgcagccataaaaaaggatgagttcatgtcctttgtggggaatgaagctggaaaccgtcattctcagcaaactatcatgagaacagtaaaccaaacattgcatgttctcactcatagctgggaattgaacaatgagaacacacggacataggaaggggaacatcacacaccagggcatgtcggagggtggggggctaggggagggataatattagcagaaatacctaatgtaggtgatgagttgatgggtgcagcaaaccaccatggcacgtgtatacctatgtgacaaaaatgcacactctgcacatgtatcccagaacttaaagtataattaaaaaaaaaatcccccaactgataactgctatagttaacatctaataactactgagcacatatttggtgccagacacagagccaagccctttactgacattatgactttttcatttttacattatcttattaagtagctttgattgctgatgttttagcagtatgaatgctaaggttaagaaggttaagtactcagcctagggtctcagagccgctgggtggcaaaatggagattagatcccatcataccaaatccagggcccctcctatcatatttcttctgcctttcaggtttaagcaaattaagtggaaaactcccattaccctttatcgtagaatcagatggtctctctactgtacctctcagtatgctattgctattattcaaaatgtgttcattccctaaccatttctattttctagagatttcccaggtagctaatcaatttagaaaagtaactgcaacagcctagttttaaatttgattttcattcaaactttattaatttagccattagttttcatttaaaaggaaaggcattttaccaacatgcatatcatatataatcattacaactaatttcccaaattataatcaacgttcattgcaattactggtattttacataaatattataaaagcaatgttatgcatggttccatatcattaacaccatactaaatttacatataaaattggatataatgtgccctaggaaattggtggtatatttctgacacataagtaatttcaagtaatggagtcactaatagtttttgccttactcatcctctggaagccagctataaaagtttatattaggtgaactatattaggtaaaacctttggcttctatattatagataaattaagactgtgctggaattaaacttgtttctaaagtgaagcaaacacaaacacaacattatcatgaaatgaccaaagttactatcatggagtgacctaagctgccattagcaaaagaaacattgtggagactggtacccaggatagtcttcccccaaccatctcctctccctccactaactgcttctacacccaggataaacctgcctgccccatcttgacttagttcattccctcaccttagttcattccttctccactctcagcttttatttttctcttctcagtgctatttctcacttaagttatgggagatgaccttttgggattcctggcccagaatcttcgcagttgtggtacccagtctgcatgagcatggagtatgtgtgaggaggctcttgcctgccctgttcatcctgcccctgtggtgactggctggatgacattgcagaaagctgcaccctatttttttcatcttgactccacaaagccatttcacccagatagctgcctacgcccatatgaacttttcttttaaacatgacagttctgttggaatacaattctaccaattttgttttaatttcttttgaatttgtttcatgcttcacctccaatacctttactggagttcaggcttttatcagaccctgtctgcactcttgcaatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctcttggctctccaattgtgtattctatcttcttgatgatttacacgtttcccttggttcccaggcctgatatactctgtccagcctctgccccactctccattgcttcccatcccattccaagcctttgttctcttaaggagctcctgactgtcctttagacagtccatcagttgcactgagcaggcttccctgctacagccccttttgtgccagtaccatttccttgctggcctcattcatcatctgcttccctttatcagagctctcatcaaaatttctgctcatatttaagatgcatccttcctcacttccaaaaataaatgcaccttccaaattttatatatatatatatatatatatatatatatatatatatatatattccataagtaaatataaatgtatatatggaaaagagaaactggaatcacaaagcaaaatatgtataatgctacttctgagaccaagcacaacccaatcagaatgtaacaaataaatgaggtatacatttctcacatattttccctaacaaaaataaaagccttcacagctgatcagagttcatgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgtatgagccgatataaagcattagaaaataaactgaatgtggcttgcaatttgtacatcttttgaaagataatttttggcaattacatgagagaaagggagtgtccttgggctttctttcccctgagcaaaaataatcatcaccaaactcacattttccccctaaaaagactaaactctaaatagtcaaatgatatgaaaataatccagagcttacctcgaaactcacagctccattgtggtctgtatcaaatgcattgaacagaaaatgtgcatatgttgtagagtctgaaatggtaaaaagggagtatcattaagtcagtgtttccatatcctacataagacttggatagcagtccaagcttcctttgatccagaagaattaactctgcctcctttagtttgtgctttcttcacaactgcttaccctctttctgtagaggactagagtttgagattcacaggaagaagcaacctacatagaggccattggtgacaaacattctctatgagtttctggctggcaatgctgtagtcttgggtgatgagattaacactgggacaagaaatggtcccataggtggatgtgaagattgagacttgtctggaatttgcttagtgtttggaagagaccatctctagaagtaaagtactaaaaatactaccaatgagacagagatgagttgctattattagtgtctctgtcattattagaactttcatcattgttacaactcagaaaatgatattgggaattagagaaggtgaaaaacatacccaaagtcacacagtgaagaaggagtaaatctgggacatgaacttaggtctttctgactctgagaaccaggctagccctcagccagtaccaggctagcccacaggcagtaaagttggctgatggattggggtcattggtgacttgggaagtttctgtggctgtgttggaaggggactgggtggtcctacatgttcctagttgtatgaagttgcatgaagtagggagcccctactctgtctgggtcctgggtgggattcaaggatctgggtaatgatggacaggtatgtcttctgaagtctaacaggtgttcttagtttgcttctattgggtattcttcccctctcatttttccttccttcctttcctgtttctccgttgtctccttaatctctgggctttctgccatttcatttaaaagtctgtattttttccttattgttttctgttctgagtgcctagctttcattccttagggtttctttgcttgacccttgataaaatttacattattattttcagtgttgcatctcatgggctttagccttttatcttaaccttttttgtcttttcaaaataaaatggtaaccttttagctcattggctctagccttttatcttctgttttaaatctcatctatttctattttataacttttaacctttattgggttttaacttatcattgatttaatttttactttatgaattgctttttataggctgtcaagaagctaagtcatagtaacaggagtacagaattgccctctgaggaggccatctaaatttctctcctggctctcagggctcacggcctccttacaggttgtttttcccgaatgcttcagtgtagtaattaacactactgaaggctatacatttcatgaggtagactgtacactcaatttctcaaaatgacagtggcatcttcgctcatctctcacctttttaatatgctatgaagaactacttatctttgaacacaggaattaccagcaccgttttcagtgaactaaccaag

SEQ ID NO: 113 - DNA, 54187 bp, Homo sapiens
ttttcttcagcagtcagttctaagacacctagtagaaaccatttgcattttctctacagtggaggagaccctaaccctctaatcatcaaggaaacacatataggctgaacagcaacctgctggtgggagatgcagcgggtgaaggtgagcagaggaatcagtctatgaaaacttgaagctctcagccccattcagctctcaaccactcagggaggcctgaggacactgaaaggacctgaagaggtaggacctgccgaggtaagccattaccacggcggatgaaaatatccctacgctgtggtggagaagagtcatttttcatctgtatcaggaatggggttctactaagcttgtatttgaaattacacaattgaatcccctgtaagtcatctctgttctctgagcaggccagtgatttctaaatgtagaccacataggatgtggccgaactgccaggatattttcggggacactgaaacagctccttgataaacccctgcatagcctggagcccaacaggagagagtttgagccctactcaaaatcatgttcagtttaagtaacagctaagagttgactgcctcttatggaccatgcactgttttaagcactttaattgatttagtgaatcctcccaacaagcctataaagaaataccattattacatccatttatcccactgagcaaaccgaagaaaatggggcttgagtaattttcccacggtcacggttatcgactgattatttatgtctctccaccaaattcacatgctgaaatcctaacccccagtgtgatggtattaggaggtggggcctttgggaggtgattgagacttaagggtgaagctctcgtgaatgcgattaatgcccttataaaagaggtcccagggaactttgttgctctttcacccatgtgaggataccttgagaaatcagccatctatagcccagaagagccctgtattagtcagggttctctagagggacagaaataataggagagagagagatacacacacacacacacacacacacacacacgtatatgtatgtgtatatatacatatgtgtgtatatgtatgtgtatatatacacatatgtgtgtatatgtatgtgtatatacacatatgtgtgtatgtgtatgtgtatatacacatatgtgtgtatgtgtatgtgtatatacacatatgtgtgtatgtgtatgtgtatatacacatatgtgtgtatgtgtatatatacacatatgtgtgtgtatgtatgtgtatatatacacatatgtgtgtgtatgtatgtgtatatacacaaatgtgtgtgtatgtatgtgtatatatacacgtgtgtgtatgtatgtgtatatacacacgtgtgtgtatgtatgtgtatatatacacacgtgtgtatatgtatgatacacacgtgtgtgtatgtatgtgtgtatacacacgtgtgtgtatgtgtgtgtatacacgtgtgtgtatgtgtgtgtatacacacgtgtgtgtatgtgtgtgtatatatttatatatttatttatatatataaattatatataatttaattatatattaattttatatgtatagttaagtattagctgatcacaaggtcccacaataggccatttgcaagctaaggagcaaggaaagccagcccaagtcccaaaactgaagaacttggagtgcgatgtttgagggaaggaagcatccagcgcaggagaaggatgtaggctgggaggctaggcctgtctctcctttcacgtttttcggcctgctttatattctagccaagctggcaactgattagatggtgcccacccagattaagactgggtttgcctttcccagcccactgattcaaatgttaatctcctttggcaacaccctcacacagacacacccaggatcaatactttgcatccttcaatcccaatcaagttgacactcagtattaaccatcacaaggcccctcaccagaaccagccatactggcactctgatctcagttttccagcctccagagctgtgaaaaataaatgtttgtcgtttaagccaccaggtctactgtattttgttatagtagccagaattgactaagacagtcacacagctaagaattagtgcagctgggatttgaacccaggtgacctcattcttaagagctacatcatactcaagtgaataatgtctctgcttttacaggtcttagttaaaattcacagaagcgttattttctgtgggggtatctaattaagaagtgaactcagaacttggcttgatgtttcagtacagtgtgtagccctgagtaagcaatgtgttatgaagaagcccacagaggaaattttgcaagacaatctatttctccttttacctttaacttggatagtttatttttaaatgaaaaatgctgcctgcccacctgagaaaataatttaggaaaacatttctaccattcttgtttcaatatactttatccaaaatgtgtgatatttatagactacttcaattggggtaagcagtattcctgggttgacttttatgtggggaaaatgtatgctcttaaggcatataaagataccggagcattcttattccattatcttttaattaaattgccctctattatcatcttgagaagtagaattgtgaacttgttgaagcatagaattgggcatccagtacttttgtcataatcactgcatcttcttcaattcatttgtccttcagagctttatctcttttgtgcctttaattaccatctacaactacacccagctttgaaacacagtgctccttccacagggcagcatccaacaggggcatccagtgacatccaaaatattttcagtgaatattctaagcaagaaacagaacagatacacttttctcaatattaataacacacactaagaactgttccatgtaatttaatataaactctcattttattgtgtatacaactgccttcatgtgaaaaatggggccaatgatagaatagtccctttaattcccacatatggttgtggtaaggattcaatgaattcatgacataaacttcatgaacggacttaacacacagcatgttctatcaagtgtcagctcttgctctttttctttgatctctctacttggaggcttcacaagaatatcaaaaataacatatctaaaactgaattcatcctgttccctaggactacttgccatgccactactcccctaacttctctaactcaggaataacatcatcatatcaaaaatctggttgtagggttgtcatctaattattcctttcttgcattgcccaattgcaagtctcagagtggctgcctcaaaaatatatcttgactattcattatcttcacccaaagaaccacctcctccaatttggactactgaaatgccttcctaagtgctctctccaatttcattcttaatcatctcttacctttctcttcatagcagccagagtaatttctacccatgcaatggatggaagttgtttcaatgatgtgtctttctcagatgttccagaacaatgtggaaagcatgtgtgaattgtacaaaagcatcctcatccatggagagcattgtaataaaaaaaaaaaagctccatttaatagttcttagaagcagctgtctttcaaggcatgataccaactctacctcctctagagggtgatggggaaacatagcagttttgagagacaatttaaacactaattacttcaacatgtgtctgttatagttactgctgcattaatagaggcaaataagttgacaggtgattgtaaaatacaagactattttaatataatatgtgttaggatattttacttcagtctacacataatcatcccccatgccaattgactgaggagattcatttaacacttcagagactccaggaaaaaaaaaattgcaggcaccacattttttaacctctttatgagagctttctaaatgaataacattattgtacaaaatgttttaggcaaatatgtgtagagcaaaatacattttcacctgccaccgtatattctgcagcctcaactttttttttcttctagagacagagtcttgccctgtcacccaggctggtgcactcatagctcactgcagcctctaactcctgggctcaagcgatcttccggcctcctgagtagctatgactaaatgtgcatgccaccacacacagcttacagtatattctttatgactaatcctttctacccaaagcagtaaaagaaaaaaataagacaaaaaatgcaaactgctcctcaaatgctcctacccttaccccatccatctgtagcaaagtggctaaaatcatgagctctggagataaatcctacctctactagttactacctgtccaaccataggcaaaattctccattcctctaatgttaaaagcgttatctgtaaagtgaggatgaaaaaaaaatcacaatatgtatttcattagattattgaatggattaaataagttgatatttgtaaagtacttagaacattgcttagcacatagtaaaaaatatatatatttgcttatttttattcctgttgctaaggtataaatgtttgtgtccctgaaattccatgtgttgaatactaacattcaagctgatggtgtcaggagatggggtctttaggaggtgactagataatgaagacggagcccccataaggggataagtgcccttattaaaaaaaaagggggggacactattcaccaactgcagagagctagctagccccttccaccatgttaggttacagcaagaagattggtcctcattggacatcaagtccagtttgatcttgaacttcccagcctctagaaactgtgagaagtaattttctgttatttataaggtaccaagcttatggtattttgttaaagaatcctgaatgaactaagacacctatggtctttattttttatgtgtcaatgcctctgtgctagatgaggtgattaattctataggttgtgtgtgtgtgtctgtgtgtgtttaccaccgtcaaatgctatatttagtatgagcatgcactgttaacagtgacttgatatgatttagtcataaataatattccctggagccaggttaaatgtaaatatgcatcaattttggtaatttgaaatgacttagtcctcaataatattcactcatctttttcttttctcgtttccttttccttctttgcttccttccttccttccgtccttccttttactttccttctttctctttcttttctttcagacagaatcagtctctatcacccaggttggagtgcaatagtacaatcatagcccactgacacctcaaactcttgagctcaagtgatcctcctgcctcagcctcatgagcatatgggactacaggtgtgtgccaccacacctgggtaatttttttattaatattttcagacaaggtcttgctaggttgtccaggctggtctcaaactcctggactcaagcgatcctcttacctcagcctcccaaagtgctaagattacaggtgtgagccactgtgcctggacttttttgctttttgacacctttacatggaggctttgaagtactcttttaatgatatattggataatgtatttcttccttaaaacattaatatggatttagaatatccaaaatgtatgatatttctgccatgtttctttgccaacattttttccatcctgtgaaggggctcaggtttggtatgagtctgagcctctctcctcctcctttattttctccactcttgaaagaatggagagacatagacatatctgggtggtagtgtgggaagaataagctggcatgctcttctctgctcactcctattttcacctgcctcactgtggtagcctttctttgctccagcccttcttatggatggttaacagtgtctatcattcttggggttagggtgtgagcccatttggctctcacactaaacagatgttttggcttccatgttttccctattatttccccatgtttgtccagaatcagataagaatgaggtgctatttattgtgtgtcccctagacattcccaaaaatgtttatgtgactgtaagctcttgcatctgatttttcctgaagtgttgtctcattgagcttctttctgacttatgcaatagccactatgacttttttttcttatgcttctttcaattctgtgaatatatccagttctttttcatttttggcttttacacctgctaatgttttgcctttttactcttcacttacttaacacttattcgttctttaggtttcattttaaatataaattcttcagggaaaccttctaagtcagtctcgtgttattcccttccataccatctaatctttttcttcctatcacttattttttgaaatattttctgtctatctccattatcagattgtaagggccatgaaagcaaagagtgctgtctgtttgcttgactagtgattttttttttattttttgcatcatgcgtagtgccttgcacataacaggaagtcaataaatatttgttgaatccatgaatgacttctgtcttaatttacttgaacaaccacaaattcaacatatactatgtgcaaagaagtcactttgctatgttagttatgtgctcctgccctctggaagactgttttccaatagagccagtagcagcccagcttgaagctatcagaaagtcatcttctccttctcctaacttggggaatttccatgctttatttgacaaataataaccagcaaagtgcacatcaataaagagccacttattaaaagaatgagcaatttaaccaaaaatatctcaaaaagagacttctatgttagattttataaccacatgtaaatcacaacagtatatggaaaaacacttagatcattatatttcatttattttgcatagtttatctttccaacaatatggaaaacttctaggaggcaatagtcctaatttcatctctgtattttttaaatgcttagtattagttggacaatttgtaggtattctgtaaacacatgttgactttactgttcagtactgaaaagtaaaataaggatgttctcattacttatgaactcaaatgtgaagaggagtagagaggcttacatttgaacttcaggcaaaatactcagccactttcccaacccccataaaaatatttaaaaaatgacagatgcctcacaaaataagtggtatcctaaataatttactcattggtatagcggcagctcatttcccagaatctgtaatgacatttgtttttttatttaaaggataagaatacagcagtgctcatgttatcactagggtaataattattgttgcaaaaagcagctcctattcttctggttgttttaaattggggattcagaggtgtaggaagaaattatagattattattctttgcttcttaagtgatgcactctttatatacaactgaaataattaatagaaattcaatcttcaagttattgtgacatattttaggaaatcagcagtaattatttcctatctaatttttataatcattagtaatcaggtaagagtttatcttgttttgaaaattaaattttattgagcttataaactacattacaacaaagaaaaataaggcaattttcttattactaaatcaaaaacattatccaattttttttaactggaagttttcttcgatgaatgaatatgcagatggcatatgaatggatgccatcatatgatgaaaggatccatcatgaaaggatggatatgtagacaaacatatgaataagcacctgatatgttttggatctgtgtccccacccaaatcacagcttgaattgtaataatccctacatgtcatgacatggaccctgtggtaggtaactgaatcatgcaggtaggtttttccagggctgatcttgtgatagtgaataagtctcataatatctgatggtttaataaaggggagttcctctgcacatgctccctcttgcctgccgccatgtaagatgtccctttgctcttccttcatcttctaccatgattttgaggcctctccagccatgtggaactgggaatccattaaacctctttctttataaattatgcagtctcgagtatgtcttgattagcagcatgggaacagactaatatagcatttaataatattctcatctgtatgtaacaaaattgaagttatgcacctttccttgattgattgatatgtatatcaatctattcatatatatagatttatatatatatagcttataactttaatttgtcttaataatcatgtatcacctattgttcttgatattgcaccacaaggaacacaagtgtgaaaaagaattctatgagatctaggggttcatattccagcacaatggaggccatatttacagagactaagttaaactccatacattttccacaaacaaaatttaacaatttttaaggaaatattattaaagaacgctgagagcactccaggttgtctatgcttctactcattgaaacaactcactcctccagtagcagatgagttttaatgaaatgcctgggcaatgtgaggaaatgctttttccttatcagatataacccacaacaaatcacaaaagggtactttttaatagtgttttcagggaacgggtctacccctacccttaggctgacaataatgctttaagcttttcctacatacatctgcacacttaagaggaaagaatttggcttataacattttaaaactcattaattaggatgccaccattacaagggttatggcattcagataatgcctaggctgccgtttccatttgagtaaagtaatggtagtaagtgaacatatactgtccaagataataatgaatatgatttgttgggttgttgattatattaaacataaatacaaaactgaataggacctcctaagggagaccctcagttattctgatattgttctactcattcccttaccttggctaatattttttttaaaacaagcaataagaaaaagatgaaagaatcaacaattcctaccacattgagacgtggaatccttggcctatattacttttacactcatggaagatgttgcaacataatggaaggggcatggacttgggccgcaggaaggacttggttcaaattctggtcctgacatttctagtggggttgccctattttttaatcagtaaaattggactaaaacctatctaaggattagtataaatgtgaaataaatgatggatgtaaagagcctaccacagtagttggcatataataggtgttcaaaaattgttaaatgactcttacattgtagctgttacagacgtaaaattcaatggatagaatagaaaccatttacaatgccttgaaaaactcaactacgtcagatttaaaaactgatttgtataatcacgaaaaggaaaagtaggacaatcacattaaatattgtataatcagactttgcaaattcaatctgaatttctttctaattagtcaaaattagtgaggtatggttgttgcatctcttaactactgtaccacagggtccggtcatcacctgcttctatttatgtttgctgttcccgtaaggaatcctcctaggtacaagtcccattaatagaagctggaacattgcctaaatgaaaaattttatgtattccttacttcctgaaggaactgccacggggtcggtcctaatcagcacttcattttaatacagtatcatcgagttctaaggattaattttataaacgattaatgaaagtacttaattgaatgtcactctctgctgccttcagctattacaggttgttgctctcactgattccagatcgatgcttttttaaacactcagctttgcagtactttaaactactttgcagtctctaaacttcatttagagactcacctgtggctcaaataaaacaatctgggatttgagttattgttgttgttgtttttggaatgattgtacaatgcttgaccagcgacagttcatgttgatttcctccaacagttcatgtttgctttcctccatagaaacagaaactcaaccgggcatggtggctcatgcctgtaatcccagcactttgggaggccgatgcgggtgtatcacgaggtcaggagtttgagagcagcctggccaatgtggtgaaaccctgtctctaccaaaaatacaaaaattagctgggtgtggtggcgggcgcctatagtcccagctactcaggaggttgagacaggacaatcacttaaacttgggaggtggaggttgcagtgagccaagaacgcgtcactgaactccagcctgggcgacagagggagactctgtctcataaaaaacaaagaaagaaagaaagaaagaaagaaagaaagaaagaaagaaagaaagaaagaaagaaagaaagaaagaaagaaagaaagaaagaaagaaagaaagaaagaaaggaagaaaggaagaaaggaagaaaggaaggaaggaaggaaggaaggaaggaaggaaggaaggaaggaaggaaggaaggaaggaaggaaggaagggaaattcaattttgggggttgtggcaaacactacagctaagctgcaagttcttgcacccttacaagtggtcatgtggcatggctttcggccaatgaaaagcctgcttaggatttctgcaaaagttttgctgtccttttacaggttttgccccttcctccatattgcttctgttctttcctcctgcccagagcatgaaggaagatacagtgcagcagctatttttgaattaggagaatgaagactaaggagactggaatagaatcaagattaattcagcagttaccataataggcagcagcatggatttggcccatagacattatttgctgacccctactatagacaaatggattaagttcagcccagaatcaagacagaataggaagggaaatgataatacaaactgtgcaactgcagaagaggagaaagggtgcaaaatacattaagaacacctgtgtccacagctcactcagtgacggaacatcaagtaccaaggatatgtacaagttccagacagtggttaaagcacacttcctcaggttaagataagttcaggaagtggaaaagttcacactacagctgagataattcagttttgagataacaggatgagttggagctgaaactaatggaatgtgccataaaattgtatagaaatcaatcttagttttttttatcttctttttcttcaaagagggtttgttataataaaatattctcagacctccttctatccttgttatactttttaagacaccctggatggtagtaaatccttggattccatttcaggatataagcagaaagagatgggaagagaccatgaaatctctcaagagagaatgtcaagagaggcattatcatcattatggtctctcttgcatgatctcaggtattatgagataaaatacaagtgtactattgctttgtgaatctgaggctatctggcctttcttaacatgaaatacatcatggcatgtcttgaaaacttaagctttgatcatgttcagtgaatagagaggattgaacgtttgatcaatctaatgaattgaaacacagttcgcgaggaactctgaagacttttcattctgtcatcattccactatgtggtaaataatagctagcacatattgatcacttattaggcatcaggcactttgtagtgcgctgtatacagtctacaattgagcgcatctaatcttccaaacagcagtataaggtgtcatgaccatgctaacttttcagacagtcttatagggaaagggcaagtttcttaacctcaatttgtatgaagcactaagatatttcaatgaatattccggatcaaatgtgtttctccttataatttttggtggcaaaaaaaatctgctgtcaaatacataatgtacttttgtttcctaggttatacagctctagctacagtcttgagccctacacaaccctgaaactgggagtaaacaaatgtcacaaacatgactgtattattctttaaaacattttatttacaattcagtttggtgagtagttgtctttaaagtttttattctttaaatatttgcttttctttctattttataatatatcaatacttaggaaaatacagtctgaataaatgtgtataacttttcaaaataatttttaagataccagcaaaaatttggtaaaaattgggcaaataattgttgatataatatattaatgcacaaggaaggcaacgcatagaccatgagagctctcagctctttgtaaatgtcttaaaagctacataggactcattgtttaagctaattctatatcattggataaggagttatcaaaagcttccaagtaccacaataaaataagtatattaatttatttgtttattcattcagtaaatatttattgataatttttaaggatcagactaaacaagatggaccaagtcctggctttctcagcacttgcacatcaacagacagctgtgtccacaatcagtaagttgaggatggcaggacagatcaccagagcataagcaaaggtatgagctacactcacagctaagacactgaactatctgccctgggtctaagcaaaggccacagggttggttttccagaagctccaagataggtgcatgtatatccagatccaatgttcacagcttggaactgtaatctttaaaagctaagttgagggctcaagtcaaaacatttctctcccaataaaaatcatgactacttgcagaaggaaaagcctggctatttggtttttagggagtcaggagcactaacctgctctttcagcttgcaagcttgcaattctaggcttccaagtgaaaaccaacctgcttatcttgcctcatctagaattagaggggtgacagaggaaattgggaagtagttttgaaagctgcagtgccttccttcctttccttctttctctctctctcttttcttccttccttccttcctccctccctcccttcccctccccctccctccctccctccctcccttccttccttcctttttctttctttcttgacagtctctctctgttgcccaggctggagtgcagtggcacagtcacagctcactgcaacctccacctcctgggtttaaacaattctcctgcctcaacctcctgagtagctggtattacaggtgctggccaccatgcctggctaatttttgtattttttagtagagatggggttttgccatgttggccaggctggtctggaactcctgacctcaaatgacccaaccacctgggcctcccaaagtgctgggattacaggcgtgagccaccgcacccggcctaaagctgcagtttctttaacttgttatttactataatgtcaggaaagggcaagaatcttgaatctgaaataataatgatgacaatggggttgaaaaaaagtaaaaagttattgcctggaggtaagattattttttttaacctagtattttaaatatattattttattctactttaggtgttaaatacatgaagtagttaattgtcagcaataatataatgtaaagtcaaagtacaagaaagtcttatgctttcaagccttgatgtaaaaaataattatatgaagtaagttaggaatgaggtgggtaggaaattgagggtgccttgctattttcagcaactgtcagagtgttcggtgcatgatacatattttctgaatattttcagaaaatcatttctgatgtgtcagtatactttgagtcttggaacacttaactgcaaaacgaagtcgctgtgatagagaaaaaggaatatgtatatataaatgcagagatataatgagatagatgcacatttacattttgaaaatcaggttttcttcactgcaaaaatatgtggggttcttctgaggttaataattattacataagaccaatgataaaactgcatttctttgttatgaagcctaagatattaggtgtgttttcatgcaattgcattttaaaaacaattcttgcaatcatcttattttgtagtgatgttcatgaacatacttaataatagatacattttttattacaacaaaatactactttaataaaaacaccaagttatttcgaaatgcacaggaaaagtttctctccattgttgtgcatgctgaaagaccacagtgggaagcacacaggcagagggaaatctcagaaatatgaactgtaacaccacacatagcagcattctggtctcacaagtcagtagatactttccccactaaaattttgtttcaataattaatataagcttttttcatctgaagtatctctaaatcagagaaggttaaaatcaatctgtatgtatgaacttgctgacaagctagtgtagccacttgcctttaggtttttattattttcccagtggctgatgggcaggcagcagtgttaagcctgctaactgaaacatattctaaattatatggatctctggaggggatgcattctacttaaccttggcgtttgttttaaattacaggaatctaccatattatattatccaagatttttaaaaatagcttttattccttttctaaattgcatctcaaggttgttagatttcctattaaaagctaattaattaaagagaaaatacatacatatgtgtgagtgtgtatatatatgtatatatacatatgtatatatatactcttctacacctgccagccagaaccaacaataatattgtcccaagctatatagtacctgcttccaaagaagtttaaaatccattttagagagccaattattgatgtttaaagtctgtaaatcatgaaggtagcaatacttctaagtatcaaaataaaagctatgaaatgccatatcatgaatatatgctctctcacttaaactgttagaattttcattttttaaataaattttattgtatgtatttcaggtatacaacacgatgctattcctgctctgtttgctattcaaaatctcccccttttgaaataatatcactaaaaggactaaaagcaaattgtttgcttaatgggttgactgatttttaaagactaaaagagtcaaatatagatgacaccaaaatgtggtccagaaccaatagcttgtctagcctgaagaccggatgaattattttaccccattttagaccatttccatctgttatttccaacacaaattaaataagtcacaagaaggtatcatgatcaaggatacctttctggagaatagccatgttgattttaaactaacagaaatttatttgtggggtaagtatggatacttaataaggaaaaacagaaaaaaacttttaatagtcccttatttatttcaggtactgtgttagctaggtattttacttattccttctcagcgaatactataaaacccatttattaagaaattgaggctagacgatgtaaaagaaatgaatctggaccaattcctgcaaatcatgttaggaagttacaagaaagtaaaaagattcatagtcaatcaagtgctgtgaatagccattgagctctggaaagccatagaagcagacacattagatacaggatagatggttcctgtagaaagctttacagaaactgaaaaagcctaaagctacttaaatgatggtaacagtagggtagagtagtacttaaccatatgacctttggctagactactgtatttgaattacggctctgtcacacactaaatatatgattattgataagttattcaccatctcagtgcctcagtttccttctttataaaattgcaataggacctactgtataaaacctgtgataatttggtgtcaaatgcacataaaacatagcatagcaatgtgtataaagtacacatatatcaaatgttagctctaattatttctgtgaagacaaatatattgcttgtggaacacatggggagatcgatgttgtctttacagacactgcagtgcactagaagagcatatcagtaatatcttgttctttaaataaattactagcattcatatggtatttatcctgaacagggaatatgataaagacttttatggattttattttcatttaattttaatgggattttgatgaatgtactattcccattttgcaggtgaggaaataaaggtaaagtgaatcttaagaagttgcttgagtccatagctgtagtgatagtgcccatattgaaaaccaaatcatctgataagtccagttcctgaccactacattatggtgcctttctaagggataatgtgacacaggtatagaatggtgacaattgtagccataagtgccctttccattttcagccctccagtgcttcatgaagtactgtgttcatgaggggctgctgaatgactgcctgtaggacacatcttcccagagcacacaccctggcagatcacagcccaggagaaccacgagcccatctgaaacctcagaaatagcccagtgcctgcaggggatggtgctgcagcttcagacaggacctccatgaggggcagaagtttggtgaagtatccctgatcacagtcagcttcacatcgtagggctttgaaacatgatgctgtcaattcatcttgaattgttcaaggtcaaactcaggcattcaatgctgtatcgttcctctccactcaattccatccctttccattccatctcattccattttttccattcgctccactgtattccattccattccactccactctactccattctgcgcaaacttattaactacttactacactacttagtctgtaagcaaaaagcagctgctgctctaaagatgaataaaattaggcttaacacaggcttaaattaggcttaaatcaggctgaccaagttccattcagtaggcaagtttaaagagccaaaatctataattttaatacttttagctctaaagctagaattggacacagtgttcttccaatgtatagaaaagtctactcagaaggctttatttttgaggacttggagagagttaaataaggtattttcgacatatgttttcaatgaagcatgaaaactagaaaggtgtgtttcactggctgaggatacttcccggtaagactcaaggtctaccatctcaaattagagttctctcaaaggtgctaaactctactgatttttttatgaatcgcatgtttctatattttttttgccaaactctcccttctgtaaagaaccatgatttaagctagcaacgacaaatgaagcatagttaccctcatttgatttgcggcatttcagactcaactatttttctgaaacatctattttatttcaatagagacaagaagcctgctagtttccttaatcctgcgttttaaaaacatacttctatatgaattggagaaatgaaatgtgctccatagtttatgttattccttacttttggaatgtatcctaatctcaggattcttcattactctgactacatattatatttatttccatcctaaggtttttcaaagataggcatgtggattatctagatcaacaatccctaaagggcttttaaaatgtcaattcctgggccctactccattcctgaaaatcaaaattttgaagcagaaatctgagtctccaaatcatctcccttggtatatctcaccttctatctccctttgcaatcacaagacagtgaccaggtccagtgatgatatcatgggctgtctgtcacctgcctgacagtgattcctggagactctcacccaaacaaactctcacagaaactaggcaacgtaagagacaggaaggttcagctggggaggcttcattgcgtcaggaatgccttatataattccagaaggtcaacaagagaaaaccaggccaacagagcataaatgtcaacatttatgggcccagctggtgtcctgctgaggctacgtatttgagattttgcaagccaggcaatattgcaagttaacatgctgtatagattctgattctgcaggaaaattctccttcagtgttgcatagttgcatttactaattctgctttcttagtattttgtgtatttgttttactttgtattttaagtttcagctaaacaaatgacaagtaaccaaaatacgaatgaaaggactatttcctatgcagctactgtgtttacatatattacctcatttaatatggttaacacgtcagggcacggtggctcaagcctgtaatctcagcactttgggaggccaaggcaggcagatcgcttgaggccaggacttcgagaacagtctggccaacattgcaaaaccctgtctttactaaaaatacaaaaaatatagctgggtgtggtggtgcgtatctgtaatctcagctactcagaaggctgagaaatgagaatcgcttgaactcaggaaacaagggttgcagtgagccgagatcacgccactgcactccagcctggctgacaggatgagactctgtttcaaaaaaaaaaaaagtaacactttgagaataggttcttattatctctatattaaaaaataaagcaaacaaaacgaacagtggataattacttacccaaagttaataaatcttagcattggatcttgagccctgtttctttcaaagccaaaatctatattttattctattacactctgctgtttccaaaacaggccaaataatttctacccctcaaacatttaccagtggcagaaaacaactatgaaatcacactgaggccataaagtaataagaggaaatttctataaagccacacaaccatctcatttccctgtggccacactttacattcattcaatgaagaatcaggatctacactgcaccacacattgggggctgaataagcacagacatacctggtaatctttgatttctcagactctacaggagatcaaggttctggcaaatgtagaagtacctcaaacctttctggtcattttcaaacttaaattctgtatacagtacaagcatactgttgagggtggctttaatgtgtaaaactgctgcttatggatagtggcgatgggtgatgttgccacacctcatcactgcatgccatttaataccttttatccattaaagttcaggccaccacatcagcactacaatattttaaatccttatatctgaaagtacaggaacctctccacttttctgtgtgtataatgtagcccttggcacattgcggaaaacaaaaacaaagaaaaaatacaaaaaaatatcaccatctgtactgggttgaatagtgttccttaaaatttcgtgtctacttggaatttgtgaatataaccttatttggaaatagagtctttgcaaatataatcaagtcaagattaagtcatactgtattagagagggccctgaacccaatctgacttgtgtccttatcatccttacaagaagagggaaattgacctggcgcagtagctcacgcctgtaatccctgaactttgggaggccaaggcggccggatcacgaggtcaggagatcgagaccatcctggtcaacatgatgaaaccccatctctactaaaaatacaagaattagctgggcttggtggcacatgcctgtaatcccagctactcgggaggctgagtcagaagaatagcttgaaccagggaggcggaggttgaagtaagccgagattgcaccactgtactccagcctaggtgacagagtgagattccgtctcaaaaaaaaaaaaaaaaaaaaaaaaaaaagacaagggaaatttggagatggagatacagataatgaaaagaagggcatgaacagatggaggcagagattggagcgatgcatttataagcctaagaatgctaaggattaccaccaaccatcagaagctagaagagataagaaaggagacttctacagcatgtttagaagtagtatgtcccaccaacaccttgatcttagacttctagtctccagaagtgtcagatagtaaatttctattgttttaaaccacacagtttgtgatactttgttatggtcaccctaggaaactaacacaccatccataaatatccatgtaccacatgcaaggtgctatgctcagcgttgagaatatggaacaatggagaggtatacctggaatctgggacacgtatcagtgtctatagacatagaggaggaaggtaaaagagtgttccacttcattttaactccagtgtgttgcttcttttctaaggagccacagacaatgacttctcatcctcctcttcctcattattccttggcttacaagctaatgcatacatcatggggttcccagtatttccttttccccccaatattttatgccccatgcttgtgtttatattgtgatataataaaatggcacgaagtagaaacacacccttcacatggagcacacattacccagtggttttattaagacttgtgtttcggcatctgagctatgtgaaatctcactcaaggctctgtaatgccggtatgttctctatatgaatgtggcacgactgaaaacataaaactgttatcacaaaactgttacatacattgtaaaacaaacagctctctgatgtggtttggctctgtgtccccacccaaatctcatctcaaattgtaatccctgtgtgtcaagggagagacctggtgggaagtgactggatcgtaggagtggattctccatgctgttctcctgacggtgaatgacttctcacaagatctgatggcttaaaagtggcagtttcccctttgctctctctcgctcctgccgccttgtgaagcaaggacttgcttctccttctgccatgattgtaagtttcctgaggcctctccagccatgcagaactgtgagtcaattaaatctcttttatttataaattacccagtctcaggcaattctttataacgtgtgaaaatgaactaatacactctcaaaatccatccaatgcataaaagcaccatttgaactgccacaaatgcaataaggcctctgaagttttctagttccaccctttccatcacctcagctaaagtatcttctcctaaactccaggacctccttttgtaagagtgagaattcctaaattaaaataaccaacagaaagtgccaaagaaggaagggagaaagggagggtgggatggaaacaaaattgatgagtgcagttgtaagtttcagggattctttacattcctaacattggtttatttggtattataaattaagaaaatttaaaaattatccataatgcccaatgactttgtttacagatttgtatcagatcttacaggaaatggatcactgaaatagtcatgtccagattgagctgacatttactgagttccccttccacttcaaactcagtgtcagataccattttatatgctgtgtaagaattcttttgtgaggccgggcacagtggctcacgtttgtaatcccagcactttgggaggcccaggcaggcggatcccgaggtcaggagtataagaccagcctggccaacacagtgaaaccccgtttctactaaaagtacacaaattagctgggcatggtggcgggcacctgtaatcccagctactcggaaggctgaagcaggagaatcgcttgaaccgggaggtggcagttgcagtgagctgagattgtgccattgcactccagcttgggcaacagagctagactccttctcaaaaacaaacaaacaaacagacaaaaaaaaaaaaaaagaattattttgtgcttatttacacaagctcaaataggagtgaacaaagttttattagcttgtatgtagtcacgcattattataaccaatattaatactgggtcttaaacttaattaggccttcagatttgaaaatctcaatatttctttctactaaaccatgtggcctcaccaaatatatttctgtatgaatcctagagcacatgttatcttgggaggagtctgttttttgcttttacaaaacagtcatattgccaaatatttaaaagaagaagttctacaatttatagtatacggtcacactgtcacctgacaacctttaataacaaaaatagacaaccttacatgtacatagataacatttcagcaacagttttctaacagtgagccacagctaaaattgtgagcatgggtacttcagcatgaaggctcaaatcaggagaatacgtacaagagagaggctcatgagaatttaaccttaccttgcatttcccctaaaaacaatggctctggattcaccaattcagtgttcaagatgactttataaaatataactaccctaaataatgatgattcactgtactttatcttactcttaaacatgtacaaattttagtagcttatgaaaggatcaaggtaactcctgtagaaagaaaaactagtttaatcttgtttgatccattatttaccaaacgtttttgactacagatctaacttataaagaatacatattatcacctcacaggacaggaatgcattgtttggaggccctgctgtaggtgttcagaggttttttcagtccttcttttgaggccacatgatctattatttagagtgttttaaagcatcactcatgaccataaatcaagagatgaggcctggcacggtggctcacgcctgtaatcccagcactttgggaggccgaggtgggtggatcacctgaggtcaggggtttgagaccagcctgtccaacatggtgaaacatcatctctactaaaaatacaaaaatttgccaggcatggtggcgcatgcctgtaatcccagctacttgggaggctgaggtgggagaattgcttgaatccaggagacagaggttgcagctggccgagactgtgccattgcactccagcctgagcaacagagtgagactccatcacaaaagaaaacaaaaaaaaaaaaaaaaagagagagagagagagatgaaaaaattacagagatcctaagacatctctcatccacttggctatcaatatcaacctgagttggtactgcagtctgataaaattcccaacttgttctttgattagtagtgcttcagccttatcccaatttattgacattcctatgctgataaacctactcttacccttttcctttccctgagggaatgtttattctagtcttaaacttgagccaggcagtcaggctctgggagtgagtggagagttcactgtataaaagaatgtcaaaggtaacctttaaggaacgctgtgccacctccagagtcagatttatagtgaagttaacgaagcttaggcttcagacccctccactgcacagtccagtatcctacccaataaattctagcaaaatgttcaagtcatatagtcttataagctttctatttatttcttttcttttcttttcaagacagggtctcactctgtcacccacactggagtgcagtggcataatcaccctcactgtagctttgacttcctgggctcaagtgatcctcctgtataagcctcctgggtagctaggaacacaggcacctgccaccaggctcagctacttttaaaatttttttgtagagatggagtctccttatgttgctcaggctcatcttcaactcctgggctcaagcaatcctccaacctcagcctccaaaaatgctaggattacaggcatgagccaccaagccccgcctaattttctaatatttagaaagtaagatagtttaactataattagttaatactgctccttttctgctacaagttttctatggcacgctttctttcatatcttttagacttgaaggcaactgtggacatttttagaatgcagctaagtaagagaacatgtagttttatttatgggttcatagctttttatgtacagtcaggttatggatgagtgtcctagggtaggaatggcttccacagatgtgtctaccacccaatgtgccaactcatctagtgtcataattcaaaggcgacccaaaagtgaaatgagcatcactggaagtccccaactctggaagaacaggaatagtggatggactgctcatttcaaagtcagttaagcctaataacttagagtcaaaaatattttaaggcttcaaaaatatatttttaaagacttgaaaaaataactcaaataaaatcgagcttgaaaatattcaaaagcttgagaaagctcaaatatatcattttaattacaatttataaacatgttttaaaatttcaataaaatagcgaaaaatataaagctcttgattaggacgttatgaaattacctttattgatatttataaagcaagttattaaagaagtgtggtagaatttagattaaagtaataatacaatgtaaaacaaaagtgatcaaaataaaaagtgaaattgtgaacttacgaattacgttgcatgaagaagaaagttgtaatagcatcaaatatatataaaaatatatatataaatatatggaacacaccaaaagaaacaatcattagtacaagagagagaaatttttacaagaagtaatgaagaagctcttggattcagaatagtgaatctaagtaacaaagaggaataaataatgaatcaaataattacattaaaaattaatttcatgttgaaatgaaacaaagtactaacatttattaaaataacaaaatgcaatacaccaccaaaatgagactatcagaagtaaactgttcaatgaatactgtcaattcaatgatgattttaaattaatgtacaacaaagcttaaaatgtcatgaaatattacaacttacgttactaaaggaaatcaatagacattcccaaatttgacaacaatcctaaaaatgtatataatattacaaataatgaattatgaagtaaaataaagctttcctattgacaataaaaaataaatgtttatcaactctgtgataagcctgaattatttttctatcttctatactaaaagtagtgcaaaatcattcaactttatgcaagcaagaaccaggaaaactatcacacagatctataaggcagctattttattttagaatgttactcttttaattttttcatatgtatatcatttgtcagttttctaaaaactgtaatttcaaaattgatcattcctaatcctaactattcatttttacacttagttttatattttaagcatgtatttttttttcataagagaatcctaaaactgtgtaatctctggaccccatgaaacctaaatttgctctacaatagaggtattagatgatgtaagtaaacttcaaagccaattcaaaaacagggacctaatactgtttatgttgtttgctttgttgtagctaatatgtcagctgtgaaaataagtaattcaaaatttaagctgctggaactttaaaatattttgagcttaaagggaatgtgaactaaatctcataagcagacagttgtaaagtcagcaggtgtaacctttgtttctccgattacagattagccttttccttacctacattgtcttgtaaaatgttgcaaatgactaaagggtgccagggaagaagacctttttccttttaagtgttgattttcattatagattaccttccatctttcttctctcacacatacttcatgactaccgcattgtctacgatggaatgttaaatatactcttaaattggaaaggaaataaaaataacctttatggataagaaaacgaaccataatttattaaattgttgtgactcctaaactagccttgtacaaaaaatgttataatactgttaaattgatttattttctgcctatataagcaagaccttaacttttaacatctgagtactgatcccatttctctggagttcatattttccggatggtctttcccagctttttgcatgaataaactcttcaaacctggattctggtcctttcaattatttcaggctgacatagcattgaaaaatagagtaccactgacctagagtcagcctatgagaaattctctctctgtctctttctctctctctctctctctctcacacacacacacaaacacatacataaaaaatttaagacattgtattaactttatagctccacataacaaattaccaaaaattgagtagtttaaaataagtatctatttattatctcacagttctgtaggttggacgtctggacacacttgactgggttctctgctgagaatctcacaggctgaaatccaagtatagctggctgggctcttatctggaagttccaaggactaatccactttcatgctcattctggttgttggcagaagccaattccttgacattgtaggtctgaggtcacaattgcattgctagctgtcaaaccgggtgctgctctctgcaaccagaggctgccctgcattccttctcacacagagcctccatcttcaaaccttcaagtgcatcaagtcctttgcaaaacccttagttctgggaattgcccacccttttcctggaaaactcatgaataattcacctcttgtttaatgtgtaatcaagaatcataaaaatgggcaaccagcagctgttggggctgttctgcccatggagtagccattcttttattcctttactttcataataaacttgcttcaaatctttctggcttgttcttctgccactggttggagaaagctttatacttttaagttgtcggaggcatttgaactagaacgactccatcttgaataggggctgggtaaaataaggctgagatctgctgggctgcattcccaggaggttaggcattctaagtcacaggatgaaataggaggtcagcacaagatatacatcaaaacccaccaaaagcaagatagcaaggagagtgacctctggtcgtcctcactgctcattatacgctaattataatggattagcatgttaaaagacactcccatgacagtttacaaatgtcatgacaatgtcaggaagttaccctacatggtctaaaaaggggaggaacactcagttctgggaattaaccacccctttcctggaaaactcattaataatccaccccttggataacatgtaatcaagaaccataaaaaagggcaatcagcagccctcggggctgctctgcccatggagtagccattcttttattcctttactttctttttttattattattacactttaagttctgggttacatgtgcagaacgtgcagttttattacatggctatacacgtgccatggtggtttgctgcacccatcaacctgtcacctacattaggtatttgtcctaatgctctccctcccctagcccccaaacccacgacaggcccggtgagagatattcccctccctgtgtccatgtgttctcattgttcaactcccacttatgagggagaacacgtagtgtttggttttctgttcctgtgttagtttgctgagaatgatggtttccagcttcatccatatccctgcaaaggacatgaactcatccttttttatggctgcatagtattccatggtgtatatgtgcccattttctttattcagtctatcactgatggacatttgggttggttccaagtctttgctattgtgaatagtgctgcaataaacatacgtgtgcgtgtgtctttatggtagaatgatttataatctctaaggtatatacccagtaatgggattgctgggtcaaatggtatttctagttctagatccttcaggaattgccacactgtcttccacaatggttgaactaatgtacactcccaccaacacttgctttcactttactctatggacttgccttgaattctttcttatgcgagacctaagaaccctttattggggttttgatcaggatctcttcttggataataaaggaattataggactagatttaatcacaagattagattagacccactcacataattttgctatttgaaggtcaatcattggggacctataatcatagcaatgacatttcaccatattcttaggttctacccacaattattttgcaagggtgaggggttattgggggccattcttagaattcttagaattctcacagactttctatcaggattacaagatttatattgaatgggtagtctaaactaaggaaaagcaaaaagttgactcttcacagggagtttgagccctagttcatataaagcaaagaaaataaatcagagatagcaagagaccaagacagatagatgtaattcgaagagagagaaacagaaactaacttgccatgaaccgaaagattgtatattctttttcctctctgattcactaatgtatgctttctaggagaagacataacatattctaaaatgtttgtttttcttaaaaggtatttgcatttcctaattggcatattatttcataattatactcatactaaatctgaatgtttgagccattcttatgtcttccttccatgataagttgtttatgttgtggaatgtctgagtctataattaaattattgtctctaacaagttaaccatatccatgcatacattaacatatcattataatgtgggaaaacatagatgtgtaccatagaacatcaagctgaatggggctctgcagatctgggttgacgtttctggtaactggtctccattctggaggtttcaaggggcagaactaaaaactccagaagaaagagaaaatttattcttatctgaaataaagagaaggtatgataataggaaatgttattttacaaatatctactccaatttctcttcctttctaccacggaaaaaaatatttcctcatcacattcatattgctgggtttggcttggctcttgtgctgtggtgatccactgtgatcaaaccatgcccctgagactgggcactaggacaaatgaatgtggagtagaaatgccaaaatctgctgttcaactgagtctcccagcagaacccagtctagatcagctgaaccaagtcacatacagacctgtgaatctgaagataaatacttggaattgcaagcccactgtgttttgggacagtttgttacacagcattgatgcagccatagctgactaatacaacaaagaaaagaaggaaaaaatcttcagatacagaattatgtttaaatttaattaaactaaatatatacatatttatgtctgtacatttatagattatatctatatatatgacacatgcactttttaaaaatagctcctttggcagagttttgtgttaatattttcattaaaagaggctcttatatgataatattgctcacaatgaaatgtaacaactgtgtagctggaagcattatctctcctctttgggcaacagtccctgtagtctcttggttattcagaattttaaagggaccatattaccctataaacttaagcatatgcacaaaactgcttttggggaaggctacgatttctaaacaatctcagatacataaggccgaatgtctgttatctgaaacgcttgagactacaagtgttttagatttcagattttttttggattttggaatatttgcatacgtatttgcagatagaagctattttatagcttggggatgagttccaagcctaaatctaaaatttgtttatgtttcatatataccttatacgtatagcctgaaggtgactttataaaatattttaataattttgcgcctgaaacaaagtttgtgtacactgaaccatcagaaagcaaaggtgtcccaatctcaaccacccatgtggacaatctgtggttgtttggcatcattatcattcctgactctgaatttatatgctattaataagcatttattttcttacatttattcacacataagtacttaacagtaaaatatatggcatattgttaatgcagtgaaaacataatatgttcagggtaaccaaggagcacagcagtgtcaccagaatacctgttatctgtttaaaaacaccagcaatcaaaaatggcaagtcttcacttattcaaaaatgtttatattctgcagcatttcggatcttaagttttcagattatggatattcaacttgtagtacatttaattttgtgatttcttttgttaaataaaaagaaaaatccttgcagattatatgaaggtcagaactgtctctttgcatcaataaaacatcaaaagaaaaagaggaccactgggatgggaagaacacttccaatgcactactgaaaacaatgtaaatggttgggaaagttggccacaaagtcttctatttcaatagttgtaataacacatcactgttgcatataaaatgtatctgcaaatatgtctataatgactgctgatcataagatttcttgttctattcactctgaagtctaaaaaaaaaaagcaaactatctacataatccaattgaatactcattacataaagtgctaataatgtataccttctcatatacaaaaaaaaaatggatggtttaaaattgcttagatcacaagagccaattacttgggcagaatggggaaggtgatatgaatgcataaatcttacatatatgccttaccatggagggatagcttatatgcatgtggttgaaatgaggaaaccctctctcacctataaattataatttaagcattctgtaaaaatttaaattcatacttaagattcaaattattttttccatacagagcagggtttctcaattgccacactactgatatttgggactgggtaattcttcactgtggggaatgacatactcatgataagatgcttagaagaatctctggcctccacctactagatgctagaagcagtcccctagtctggagttgggactatcaaaaatggagaccaggccaaatgtcccctggggccaaaagcactcctagttgagaagcaatggtctctagaaataccatgcagtacattccttcttccaataatagatgctaatcacaagcacacaagatagccacaattatatgatgtttactacttgccagacacatagtagctcattttaattttcacaaaagtcaaatgacctatataccataactacctgatacaatttggatgcttgtcccctccaaatctcatgttgaaatgtgatcccccatggtgaatgtggggcctggtgggaggggttttggtcatggggtggatccctcacgaatggctcaataacctccccatagtaatgagtgaattctcactctattacttactgtgacatctggttgtttaaaagagcctgacatttctcttgctccctctctcatcatatgacatgcctgctccccctttgctttaaataaaagcttccttaggcctcactagaagccaagcagatgctggtaccatgtctcccatacagcctgcagaactgtgacccaactaaacatttttattttttaaaataaattacccagccccagcaattcctttataacaatccaaaatgggctaatacactacttctatgttactaatgatgagactgagtcatagagaagtgacttgttcagacagtaaagggagcctggatttgaaaaagggcagtggggcatagaaggataaagtcctaaatgagattaactttgggacaattggattccagagagactggatacatgggtagtatatcctatagaaccctctgctcacatgttaaatctgggagctgagctagatttcagaagtcccttccactactaacaatctgtaagtctgtaaattgtagacaaatctatttggttagatttattccaataaaagcaagctgaccacatgtcagataaggtccagctacagcataatggcatgatggcagccttccatcttcactgatttaaattcgtgctgttttagtgcatataacccccttagatttgtctgctatgagaaaattctgcaaggaagagaaggctgcttacaaaacagtctttcaaatttctccatggatctcattggcaggtcttcaaggtcaggaccaatcacagacatggctggagaatgcccataaactcttcctcctctaatagccaatgggagaaagggattaactgctggtcagatgactgtgactattaacattggaagcaattctgtgcttgaaaacttgatcagtcaaagagggtaaactacattaataatgggcactggaaggagggagctctttttcaccgaagtccccatggtcacaacaaattagattagagtgcctgagaatatgctaaattcatagcctcatcgaaaatttctctttagtactttatctgtcgctagtctctcttctcttgcaatgggtcatttcagctgctgctaaaaccagctttctattacagtttctcctcatgtcatacaattccttaaaggctgatagcatcatcggtccctgattcttgtccatttaacctccctacccatagatacaatccaagactggtactcataaattccaaaggaaaaataaagctgcatattgctacctctatgacaggttacttttggggaatagaagattccaggacagctatttcctgtgtttattgattatgaatcttgaagaaagaaattttgtgtgagcataacatatacataaattttaaaatttcaaaaaaaccacagttctcaatcttttgaatctgccaaagccagcatgacacagtgccatgcctaatttcagagagtacctcctctctccccttccgtagtcagttgtattatcatcctttaaaacgctttagagggtcacttacggtcactcatggcatattcagatagtttgtaatccaattacattcttgaagatttaaagaaccagaaacaaacaaaaacatgcaaacatgagctacagtttttattgtatgtgtctatatataagagagaaaaatggagatagacgtagatatatgtgaataaattgctgcatataaaaacattagttaatataaaaaacagaaaataaatatctttttacttctttattttaaatgctaaaaacttccttataagggcatcattatatttggaaaacatataaacccatttagattattcaaaaggaatacagtgatacaaataataaaactgacaagatatctaattggaattcttttggttctttcagtttacagtgataaattttaccacactgaataactgtaatttctacctgtgccaaatctatagccagtctcatatcttcttgccactacaatactagaaactttccctgatgaattattaaatgatctttgaagttgctacagttcatagaaatgtgacagtccaatgtgtcttagtgctgtgaactgttaccaaaaagactaaacatccttgacagcctgataaaaaattaattattctccttccaatggaaagaatgcaactctgccaaaacctgttaaatgtggagcttttagagttctcaatttcttctctcttggagagggcacattataatttttcatgaggattaaatagcacatgtgaaatatctaaccttgcctagtatccactggatctttagaccttagttccttttcctaccttagaatttttgttcccctaaccgcactatactaaatgccaatgcatattagaatagaggtggcagtgcaaaatagaagaataaaagaaatattgtattattgcgagaaaggataccagtgaagagatgtttacttcagatacagtaaaatattcaaatactccaagcaagtttttccccagtgagcctctgtttctgcctatgtagacatcattcgacctgtccagttatatctaggttattgtgaagattgaaaaaacaagggagagctttttttaaaaaaaaaaaaaacaaaaaacaacaacaaaaaaaaacctttgtgttacaatatatagatcttattttcaacagcgattaggtaatggaattagtgcagtaaagttttattaatgaatgctgtaattagaaaatgttaattcaatatttgcttccccaggttacattcatttggaaaaaaatgcattaatcttaccatttagtgataactctttcagttcaacctacagacacaagatcttgaaatgaaactgttgattaatttatttactcagtaaagatgctactggatacaatagaaatacaagtcataaatgttttgcaaacaatgatagtaatgaaagatattagtctttttccttagaaattaacttagtggattgagacagtttaccagtcttgccttacaagaactattttaagcacctaaaaagtaatcatcccaagagaaaatatagagtgcaaagagcactttgctatttcctcctgttattacaaagcataataaatccctactctggactatttcttgcctgtatcctgattagatatacccataaagtttgaaaatgtctgcaactgagaatacttttatttataaagcgggatagaggttgaggaggatgtagagaacagattgttatctgtacttgtcacagcaaagcatatttttttaatacttagttttttaggcttctgttggcagattgacctttcttgagagtagcttatcttgctgtagagcaatattcccagacctcctggggttcacaaagttaagaagaaggagcatcaggaaataaagaagacaagaaagcaaaacagaaaagtaaaataaaatttctgctgagttaaagtagggtgtaaaagagccatggaaattccaaaggttgttttagaacctcctatttcacatcctactcagctgtccagaagagaaagcagcaaaaacactcagactcttggggaaacaagcattaggtggtggccagtgggggttgaggggggagtctctcttaaaagggtgaagaaagcacagatgaaaagggccaggcaatgcagactagttgtaaaagcctagaaaataacatctgaaagcttaaaggggggggtcataaaagagttggaataacaagttgtgagcacagatcagtgtagtctgagagttgtttattgcagaaagatcagaaacgttcaagtgaaccatagcaaacttcaaactgccattcacttctctcactaggtttgtgttaatctccgttccgtaaattgaaatcaatgacagcagcctggcagaggcgttgagagaattgaatgtgataatatgtataaaaataccggctgtaataattgcatatcttacactcccgatggaggtccacttcttttttctactactaatgccaatgctagaggcatagataaataagaagcatggagactgagatgggcctcacctgtctggaagccttttaagacgcacttttctggaagccttttaaaatgcacttgtcctacctgagattctccattctgcttggtgaggcaccctgatgaggcatttcacatgtgatcacaggagatgtcaccaggattattctgagttttaatttagtcggttgtaaatggggtcatgataattcatcatcttatgtggttgttagcatagttaaaggataaaatgaaacaaagttctttgtgtgtaaatattagctattgttattattacccccattgttagcataaatcaagagagtgtctgttctccacctttcccttctttaatggagacactggtcactagatttaggacttaccccaaaatgattttgtcctgaaatccttaccttaattatacctaaaaagttcatttttccaaatcaccttcacaggttttctcaggcttaagagagtgacatatctttcagtggggaaggggcacaattcaacccactatggggagttagaagttaagcatgtaaatggacatacattattatgtaatgccaagtagtgataaatgctctaaagtaaaaataaagccatataaggggataagggtgagtggaggatgctctttggagacagcagtcagtaaaggcctcctgaagaggtgacatctgagctaagatgtgactgagagagtgagacatgcaatatgggggacatgtgttagaggcagaaggagcagcaaatgcagagagctgagccaggaaagtcaagaaaaatcagagtggctggtggcacagcaagtgagcaggccagcagcagggaaagagagcagggggctgtgcttgtcacaagaggattttgcattttattctaggtttgatggggagccaagactgggctaagaacagcagagtcatattcaatttctaaggcagacattctattttaaaccaaactccagacgtggagctaaagatttaagtggtattataatatcctcgaataattgctctgataatgagaaaacaccaagagcaattctttgccaatattagaactaaattcagtttgtcctaccatgtcttttcattatcttgtgcttcactgaacatgtcacgagtttgcagaaacaattccttctgcctgcatgcccttccccagtgtgccccctcactctgctgtggcttgtccctggtttgtgtcacgtcccccagataaggtcactcacacttcctccatgctccaaggcgcttattgccctgggtgcctactttctcctatcattaccatctgtttacaagccttcctccttttctgactgtacagttctttatggtcacatgtaaatcttattaatcttcatattaccagaaactagcacactgcacactaggtactgaataaatgttaaatgaatgagtgaatcttggtcctattcaattttattttgcctgggtttatatattctccatcccactatttaaataaacatagacttttttcttctgttatttaatgaatagcctatagaaaggcattacattagcatcaggacacaatgaccatctaaacattttttaacagttcactagaactgtacacagttattagcctgttctttgcttgcaaatgcctcaagaagcgaaatagtggtacgtcctttcccctgtgttaaatttgagatcacagaggcagggcaagctgcattaacctgtctgaggtcaccctccaagtcactgcaatggagaagccaaatcatcaatgcagagagctgctttcttccgtaactgtgatgtactgagttcactgagccatgctgtatttgtcatgcacatgagttctgaaaatcaataaaatctgtgaaccatcccacaaaaataaaatgcagtgaaaagagtctgctttgctcccttcaattactccagcatgaatggacccaacagctgtggtcttcagtgggacttccagggcaataaagtttttagaaatattgattttcttgatttatcaaattttcttgtttgagctttgcctaataaaacatcaaagttgagcatgtgaagctgcattaaagcatgatcttcctggcaagaagaatatggaataaaattggttgcatctttggatatgaaatagaaaaaaaatacctgaatcattttcaacaaaacatatgctcaaatactggtggagataaaaaccagttcaggtagatttctttgtcatgcttgaaaaatacttttcttcaaatacatattaaatatattactatctagagcatctaaagtgagagtctcttgtcacacatctagacaaaattaggattcctgtgactcatgtccccagtcattctacattggttgtcagagttcatatctcaactccagattcaggtccagtttgctggtccatcagaggctggaagcatgctgtgccagctgtgtctgtagacacagctgtgcgctgtgaaaaatgcacactcggttaaccctggaatgattttagatcctaaatattgcaaaggaaagagtatcttttggttttttgtgcctcaatatcctattgacatgaatgaattttgcttgataaatttgtaaagccaacagcctttcgacaaaaggggtgagaaacatatgtgtgttttgtaattgagtaaaaatggattttgagaatactatggaatattcatagattattggctttcgagttggaagagcaatttagggataattataacaatcatgataattggtgaccatttttaaatatggttctgccattgtatgatgtgttttatcaacaaatatattaggtacatgattcagttaacactacatccaatttaaagaagaggacaatccattctagaggagttaaatgacttgccccattcccacagttgattacttttcagagatgaacaacaaagtcaatgcttctatcttcttggtttacaaaggaattgcaaaccaaatttatgagagtgattagccttctcaaggatgacatgggactttgtcttttaaccagatgattgcagaagtgattggccattattgcttcctcaaacttctagttaccttgaaataactctataggacaatttattgctaagaatcttctatggaatactacttcaaaaatacatcagaggccaggcattgtggctcatgcctgaaatcccagcactttgggaagctgaggcaggcagatcacctgaggtcaggagttccagacctgcctggccaacatggtgaaaccccatctttactaaaaattctaaaattagccaagcatagtggcaggtgcctgtaatcccagctactcaggaggctgaggcaggaaaatcacttgaacccgggagatagaggctgtagtgagctgagattacgccactgcactccagcctgatcaacaaagcaagactccatctcagaaaaaaaaaaaaaaaaaaaaaccagaaaacaaaaatgcatcagtagacgttacttaaagctatataaaaatgttgttaaagaaaatgctgagttaaactaaacatattactttactgtaggacttatcactaccatgtttaatataaatatatgcattgcatatcttccagtagtgggtaccatgtggagcacttactaaatgtgtttcgtcatgtgactgttttatctgttttctcttaaataaatattgagtgctttgcaacacaaagtttagtgctctacggagatgaactttcctagagttaatattcatcgctagtagactatactgtgacaaaaataatgtaattactttgactattttccaccgtggatattaccggaatcacattatttcacagtcattattaaaatggccagaaagattagaaaagtaaaatacaatattggaaaaaaatagaaaactgaaaattgccaccatatctacttagtctttgacatggctatgtaaaaaacattggtcctgtatatggatgaacctcatgacttctgtaatattttagtggtgattttatgaaaacattgtccttttctaaagtccctgaaaatcagttttgtatcttcaaattagaaagctggagagagcaatgcgtcatggggttatggaagagagagtaggaatctggtcccaagtgaattcaaatacaccacttgggtcccattcatctactctctggcccatggtaccaacctggtccttccatgaaggtgccttttggagacagcagaatatcctaggcatttgcttcaattttccaattttagacccaaagtcaaatgtttcccaaatgatttaaattgatacacataggccactggcactgggatttccatttccttcctgggctttgtaactatagaaaaacaacttacgaaggaagatgtggggattcttctaccacaggtagtcaggtagacctgtccccagagatgaagaaatgtacatgggatatacgaatgaagggtgatgggaagggaaattgaggttaatgctgaggtttctggctgagagtctgaatacagtctactgtgagcaaaagtggttatggtgctttttgatttttaaaagttagctgagaggtgtgccgtggccagcagtgttggtagccagaaacttcccgtaaaccagagagcacactgcatccaagggctgtgctacaaatcagctttggtatgaatttaggacatttgcaagtattatgcctgttaccttaaatgggatttaggacctggtgcagtggctcacgcctgtaatcccagcactttgggaggccaaggtaggtggatcacttgaggccaggagttcgagaccagcctggccaacatggtgaaaccctgtctctactaaaaatacaaaaatcagccaggtgtggtggcgtatgcctataatcccagctactcaggaggcttaggcaggataattgcttgaacctgggaggcagaggttacagtgagctgagctcacgccactacacttcagcctgggcggcagagtgagattctgtctcaaaaataaataaataaataaatatataaataaaacaaaataaatgagattcagtctgtgctttttcaggatttaaatttgccaaaagaaattgaaattatacattgctagtctcattagagagttctgtcatattaggtgacactaacaagaaaaaaaatccatgtccaaaggctaaggctatcaggagcatctagttacaatgatcaaagtgatgattaaagaaaaataactatttcttgcctgtttaaagccatgccattacaacagactaattgaaatgtgaagcaaagattatgtagattttgcttgctggatgttgtaatgttaagactttattgatcaaaaagaggcaagtagcttttgaactgtattagcagttcttctactggttggaaatttattttctgatagtgtaagttaccagagcttcatcatgctgtgaagtgtatttcaagtcaaaaaaattaaattgaacccataatgcataagggtctttgtgccttgtaacctagtgaataagaacataggctttggaatcagaaccaccttaatttacatataaacttagccattgttttgaaaaagacaatcaagttttctaagcctcagttttttcaactgtaaaagtgggatattaacagccacctgaataagtctatttatgaccaaatggaatgaataccaggccctagaccagtaagtaccacataatcatcagcaaataaattggggaaataattataataataattatcacctctctgtcgggctagagtggaacttgaggttcatttaatccaagtcttacaatttgaatgaggacactgagtcacaaagtggaaacagtttcaaagtgcttttattcattcgatgatatattgtagaccccccatttgtcaagctctgtggtaggtactggcaaatgaaagtataagcattcaccatatatgcattcaccatgtatgtattcatacccagacccattcaaggactaattgatggcatctgtcccttaaggagttcggagtatacagaaggacacacatggtgaattttgtgctataacagagggctcaacaggttgctgatggaagaacagaagacaccatgactctgccaggaaagccacttcagagaaaaggtggtaacttatggggtcttgaaggaagaaaatgattaatgtcaaccatacagaccttctagactatgcagagaaagtatcaaccatattttactaatgagaaaaccaagaatttgaaaaaatgtattattagtcgatggttccatgatattttaggggcagaaatggaactaaaactcagggcttatcatctgtatctcttactacttctattctttctcccattctctcacatgaataatatctaagtttgcagaaagaaattagttcagcagtttaattacactgtggataacttttaatttattcatttctcatggaattatttcctcttgcttgatttatgcccttacttgatctatttcattttactttgattttcccctttgtaatcagatgatgcatctttgataatatttcattctctttctgtatatagccatttgtttttctccccctggagaactaattcatatatattctaaaaataagcaaatagtgtaaatgcaaatgggcttcaaatgatactttacaagcgcctaaattgaactttgtttcacttgtatcctgatgcaaaatgttcctaactttaagatcatctcccatagggccattccaattgtaaaatgaactctgcatctgattttcagattattggatctacatatttaccataactctgattaaaggcctttgaagcaaatggaccatagctgtttttgcaattgagccttattaaaatttaaagtgtatccgtaaacatgtaagtgcctattatagatcaaagttcagaaaattaaatattcacaaatacagctcattttacaaaaactacagacttgaaattatctaagccaaataatcttagcacttaccacaaaatagccttagttatttcagcagcaagattttatttatgttaagcaactttttgtgacttgagcaaaggttttattttacctggaaaactcagcatatatagctcttactcatggaacactgttgtaatattaagatataaaaatgataaagtaccacctcacattatatcatttaatgcatcagcaatgaaaccatttggggtttatttattttgctgattgacttgattcccttcctttggagaggttaataaagttgggcatatttcatgattattcaaataagatagcaaactttaatttctgtaaccctctaggagggttcagccaacaagtacaatactgtgtgctgttttaggatgtttagattggtgcctccacaaatgaaaaatgaggccttgtatttgttgatagcaagtagattgtactgcagaattaaaaggaaagaaatcaatgctgccaaaataaaacaatacaattagaaccacattttgacttgtctcagaaacattttttggtattaaagttattgggctattaaattgcgtggggaaaaataatagagctcattacatggagtgttctgctttgccacagctggagtctggattgcacactttaatattacttacatgtactggagcaagctgaagaaatacagattattaagaaataaccttttccattaggggagcttcaaagtcctcaggaccttttgggggtattagtgggaatataaagaagaatgaagtatctttttgccacgcattttccaatgtgaacaataaaatctattaaaaagtttgtttctgtttcaatatatttccctgatagaaagaaaagaaagagggagtttaagggagaaccgattaaagactaaaaatagaagggatggaactacaatttccttagatagcattgagacagacaactctgtttgatcatttaaggccaaagattaaatggtaactcagaaatttttaattatttccctcaacaataatttcagaaacaactcataggacttgtctttttacttgtggccatttaaatgatggtgggcagcagcagttctattgtttttccttattttggggagtggaccggttttatgcatactgtcttccactaaaaaaatcagacaaaaaagttaaaaaaagctgttaaggcaattaaattacttaccatctttactaaggaaagaatgatagatgcatggtaattgaggatttacctagttgctagggatggcagtaagagtttcacatacattacatcctttaatcgttcataaatcacttattttttggataacagaacctatccttgctttttggaaaatcacattgccttccacattgttcatttatgagaaggaccctgtgccctggctcaaaaggtaaacgtatgacccagatctggttaatgaaaacactgtggcaataaggacagacaattaggatgtgattatagcttggtcagggtatagaattctgggacttttcctgaaactatccaattttgagaaaaatcctctggtcatctactgtggatctacaagtagcaaaatctttctcttcctttctgtctctccatttgccttcttctgccctttttagacattctagtaactagctcactcaccatgaaaacaactatgaaagagtcatttttgaatacaaaacaaataaaccaaaggtttaatttaaaaaaaaaattgctgaaccctgggatacataagactgccaaaatacttattaaaacatataagcaattctaaaggagtcagaatgaatgcttagagtttaagtgactatcatcaacatttaatttaccgaggtggatgtgccattgaccactgatattaaagagccattaccaagaatgcacatatgagcacattacatctaaatggtcccttcacctctttctggatagcttgtgggaatcacttttaactatgctaattgtttatgccgagtaaacattcatgcttaaatgcctccaacaaaataacatgtaacatttgggaatttcgtggtaacttgatgacttttattatcagaaccaaataaagaacacatgtttattgcatattaaatagaaatgaggaaaatttcttaaccaaaacaaaaactttttttaaaaactgtagtaaactgcatattttctagaaggccaacaacaaaagcaaacctctctttaataagtattttatgttataaaattggaaaatttgtccacacgcagggatttaaaattgagttatcaaattccagattttaaactaaatatgaaaaagtgttgtgacctaaaaattatttcaagcttaagataccaaagtgaacaaaaatactttcacatttatattccacctctcaacactcgcgtaaatacacagaacccaaaatatcttttgcaattatcttaattactgttacctttgatttatcttacaagggtaatgcatttaaaattgtaatttctcattaatgtcagttaggttttaaaggattttaaaaacattacttctctgttggttggtctgatgttttaaatatgtttgattcaaataatacagatgttataactaaaggatcagtttccatagggccataattttgcaatgctaataactactagattttttttaaagataggtatttcccacaagcacatttgtatatattggcagaaggaatggatatgttaaaaaatgattcaaacacaaatggtttccttcaacttaatgttttaaactttctgtgtgtttgaagcatttctccaaaaacatgatgatggaacatgcattggaagaagaatcagaaaagtcaaatttttacataaagtctgttaactcctttgctgtgtgaatattgacacattgcttaacattgcttaatctttctgtgtgttactatattcaaattgggaattgcattacttgcattacatatctttccacaatttatatgaaaatcaaatgggataacagatatgataggcaacgaaaattccaaaatgctaaattaatgaatgggtgctctgttcatcacttaccaatctaatatttaatgagctactactcaatatatagataatttagaaaaagtactcaaatatgacagtaggagagacacataaaatatgttaagtcctataagaaaggtttagttcaaatgctaagagaattcagagacagggaaagataattttgactgagagagaggactaggagggaaagtagaagtgacgctatttgaactgggtcttgggaaacactaggacctggatctcagatgagaaaacatgttttaagtaggggaggagataatggatttgaaggtttagggttatctattgcctgttttgagtgcatgatataatgcatttcacttcttcagttaactaaaagaatcacgtaaattgtttaaaaggagtagaagatcttgaataatcatatacctttttactaagcaattaatatatctaagacattgtttttatctactatctcagtgttgtgatatgagtattattgctattatatccattgatagattagaaaattgaaattacaacaaaaattacttgactccaaaaccacggatctcccctacatcctgctctattattctcttgtaaaatagattgtggttctttttatttctgtaacttaaaacatttttccattgatgtcattctttcaactacacgttgagtgcaaagatgaggtgcttgctctcaaatgggaagtaggaagttgaacagagttgtccttcttccatggatttaatgaggaattaagattcagaaatgagctctcatgtgcacctatccagccctccaacacccactcctcaatggactaaatatttaacctaggtggaaaagaactcacacattggaggaggactaacatgtgacttcctttgcacatgacccaggatcataagtgggggaccttctatttgctctttacattcagtcttctgctcattgtcacatatgcccatgatcttaaaagcaagccactagagtgtgtttctaagagcatagctataattcagataaatgtggagaaaatttgtaattccgtgtcttagtctgtttagtgttactatgaagagatacctgaggctgggtaatgtataaagaaaagttaatttggctcaccctcccacaggctgtaaaagaagcacagcaccagcatctgcttatggtgagggcttcaggatgcttccactcatggtggaagggaaaaaggagctagtgtgtgcagaggtgacgcagtgagagaggaagcaagagagagagtggagatgccaggttctgttttaacaaatagctcttaagggaactagcagagggagaactccctcattaccacaaggacaacaccaagcttttcaggagggatctaacccccttgagtcaaacatctcccccaattaggccacacttctaacagtgaggatcaaatttcaacatgaggtttgggttgggggctaatatgcaaaccatagctttcccttactagcagagtgacccaaggcaagttgcatacaatggagataaaaatcctgtgttaatcagcttgggctaccataacaaaataccatagacctgttggatcaaacagcagacattggtttctcacagtttcagaggctgagtagtctaagaccaaggggctggctaatgccattctgcgtcagggccctcttcctggcttgcagatggccgctttcttattatatcttcacatggtagagaaaaagtgatctctggtctcccttcttttactttcgaaagtgctaatctcatcatgggagccctaccttcatgatttcacccaaatctaattacctccaaggagccccacctgtaaaaatgatcacattgggtgttaaggcttcaacatacaaattttgagacacaattcagtccatggcaaatactgtagggtagtttcaaactttcataaacataaatatgtgaactatttagcctcaaacctggcatataggtacattgaaatggcaactatttgtgtcatacggctattcatgttttacatccacatagtaccatctcctacaacattcacctaaagcaactgattggcaatgacattcattacagatttatagctattcaataatcatttacagaatactctgtgtctggcactgtgttgggtgaggagaggagaaagtatataaaaagttgagtaatttaaagctcttatttttgaaaaactcatagaaaaatgaggagtgcagagagctctaaagagattgctgaaatataaaatgggattagaccatggggaaaactggtgactgattctgccagaccaaatcaaagaaagctttaaagagaagtgatgtttcaagcagctctggatatccaagtagaatttatctgccagatagcacaaaaaaagaaggatgctctaagtagaaacaatagtatctgataagcagggaagcatgagcaagcaaagaactgtagggaaactaatgggagacaggaattgttggagcaacagtcacatacaggaacaggtaaagaaacacagtcaatgtcactgagaactggattgtgagatccctctgattccacaatcaagagacagggcggagccgaaagtatttttaatttaatgttggcaatagtgtgaagaatgagttggtctgggatgagacaggtggcaagaggccagtcaggacaccagtgtcacagtctctagacaacaggtgaatagacctattgatatggtttggatttgtatccctacccaaatctcatgtcaaattgtaattcccagtgttggaagaggggcctattgggaagtgattagatcatgggagtgggcttcccccttgctattcttgtgcggtgagtgagttctcaggagatctggttgtttaaaagtttatagcacctcccccttcgctctcttcctcctgctccacccatgtaagacatgtctgcttccccattcgccatccaccatgattgtaagtttcctgagtcctccccagccaagcttcctgtacagtttatggaactgtcagccaattaaaccttctttctttataaattacccagtatcagatagttcttcatatcaatgtgagaacagactaatacacttatacaaggcagtagaggtagaaaggaagagacaatacttagagacatttgggagtaagaagacttagagcttccatttcaggtggattgagagatttactcctgatgagaggtcaaaggattcctattgaaccagacatcagttgctggggaacagtcatatgtgactgcaacatcaaggaacccacaaatgcagcctcgcacacatacaggacataaagccaaactgcaaaaggtaacacatcaaaatacctctatattgtgtaatgccagatttgtgtaaatcagaaaagaactgccaggctcaccaacaacctcatttatattacggtaactatcaataccgaaaactgttatttcctattatatttttaaaaagtcaaattaataaacttcaattatgaacaaccagcatttattaattatctcctataatcactatgacaaagatagttaattccctgcccggtatatatgcttgcttctactttaagaacaaatccacaattttattaagattagcaagtacccaatttaataaatatatatgtgtagatctatatattatatagatatgtgtacatttgtgtatatatacacatacctatattttttccttctctcatgaagctaggggtggccaatgagatatgaatggaagccactggctgatgtatctgaggacctctttataggggtctagacttatatggaagggggcccattgtcctccctgccaccccctctttcttgcttcttggatgaatttgtaaaggccagaactcatgaatagacacaagcaccaatcttagtagaataaaacaaaacaaaacaaaaaaccttagtatacataataaaaatttaacactaagttgtatcagctaacactatttggattttctgatgtgtacaatgcaacctaattaacatgtcatatagccagcatcatgcttagagccagggaaagcaaagataactaaaatacataaaccatctgaaataccacaggatagggaatataactttaaaaacaatacctttccattccccacccaaatagtctaatataaactgaaaactggatgaggatggaagttactttgtagtcacgacaatattgagtatcctgaggaatcagttctctatcaagtagcgtgagtgataactcatacctcatctcaaagcttaacatttttctaggtaccagtggggcagaaacacatgattcctagtcccaaacagttcacaacgcagaaggggagccagaacagtacttgataataagtagcatatatttatggccatagtcagcgctgctatgtagtttttaattcaacaaatattccccatgataacttgccctgagggagagagtcatgagtgtgcaacaatattgccctgttttcaaaactaggttttgagggggaggataaatagaattcaaatcgtattataatatggtagacttgtgtgaacttaataagtgacaatcctggtggaccccaaattcatgtgttgagtttctaatccctaccacctcagaatgtcaccttatttgaaaataagatcattgcaaaagcaatttctagttatgatgaggtcatagtggagtaaagtgggcccctaaaccaatatgactgatgtccttatgaaaaggagatatttggacatagacatatacacagggacaaggctgtgtgaacctgatggttgatattgagtgtcaacttgattgaattgaaggatgcacagtattgttcctgtgtgtatctgtaagggtgttgccagaggagattcacatttgagtcagtgggctgggagatgcagacccaccctcaatctgggtgggcaccatctaatcagctgccagcataaaagcaggcatggaaagagcagacttgctgagtcttccagccaccatctttctcctgtgctggatgcttcctaagttcaaacatcagactctaagttcttcagctgttggactcttggacttaccccagtgctttgccaggggctctctgtggcctttggccacagactgaagactgcactatgggcttcccaacttttgagttgttgggattcggactggcttcctggctcctcagcttgcagacagccttttgtggcacttcaccttgtgactgtgtgagtcaattctaataaaatcctcttcatatattcatctatcctgttagttgtgtccctttagagaacactgactaatacagtgaagatgaaggaaaaactctgggtaatgcttcttcttcatggcaaggaatgtcaaaaatggtcaataaaccaccagatactagggaagaggcatgggtaagatcactctcaccgcattcagagcgaatcaaccctgctgatgccttgatctcagattttgagcctccaaacctgtgagacaatatattcctattgtttaagccacccactcaattagcaatactttgttcaggctgctctaacaaactaagacaagctttaatggagtctacaagtttgttgagacatgtttaagtcccatgcactaggacactgatattctaaaaaaaaaaaaaaaaaaaaaaaaaaaaaaagcttgattgacaagtaaacccagattttgttgaatatttcaacataataacacttgaaagaaaataatagaaaaactttgcttcttgaggaggaaacagccctgttctaaaactgcttaccatgagtgctagtgaaagaattataaagaaagtacagaactttagtaatttgatagtagaatattatgaatttgaggattcatgacattcttgggatacattttagaaaaactgagaaagggcttcctcacatagcaaaggaggtaaaattcaaaaatgatataaaaataagcactatgagaggataaaagagaaaaagaatacattgtgggatcagaaaaggaggtggcatttgagaagaaacttgaaggatgttctattaatcagagtctggtgttttagacaaagtctatttaatactgaccattggttactcgggtgattaaagactgaagcttctggggatgttgatgtaacccagagctcaacagctttaggaagttgctaccattcttcaggccagcaggggagaaaaaaagaaagaatgaacgaatctgaaaggagaagctccctgcagttggtagttggacctcttagggaaaaaaagccattgtttcacacatactagaccactgagggggcctggctgtttttttacacatctcagaggggctctgctgtgtgttgggagaatgggggtgggctatgtggtactccccccactcaggtaaagtgacatcagggctagaagtgtcaaggaagttggaggctgaagccatcgttgtctgcctcaaatggagagggagacccaacctggaagtcagaaaagaatccttcttccaacttccacctcctgtccacatttcctactggcaaaatctacccagagatggctgaaaatgggagtctggaaaatgtaatttttggaaccttaatcctaacttctcagaaaagagtaggtggtggatagcggtaggacttggaactaatagccaacaggtaaaagaggcagagatgtagaggttttaatgtaaagaaacagggtgaaaaggaggtatttcccgtttcctgaaggccctgagcattggtaaagagtctggaatggaaaaggacagtttggtcaataatggtgattccctgatgtaggtcagaaatgggtctaggtgatagaaatgttaacgtgaacaaaatatacaatagctgtttgtagactatttaatttaaccttagcatcaagcatgtaatataggaagaagtagaaaataagtctaaaaagggaggacaggagcctagaactgcattctggataacttgtggcatccatatgggagaaggatatataactcaataaatcatgtttaatatcagtggcttttgaaaatgagtctgaagcatgtcaatggattaggaacattaattcagagggtttatagaatagattcacttttcctaatagtcaaagttattattttatcattttcatcattatcattgtcatcattatcataattacaatgtttatccagtactcaatatatagcagaaattgagcactttcctatatcacatcgaaccctccaaacaacactatacagcagctgttattttccctattttatatgggaagtaactgaagatcaaatagagtacatcttttggtcaaagtcatattggttcgacgtggttgaacctggattcaaactcaagtctgaccctagatttctttctcttaagcattacatgcttctccgtttgagaaaaggacatctagactcacatctcctttcaaaatattgtcatccatgaggtcacctcaagactcaagtgccacctggcagcttgagccatttctctaagttcttcgttcagttcatttataatcccctctgagtgttacttctccgccttctcacttctttaggtttgtcacagtcctctgagatgacaggctgagcaatggtgatgagaattatggtaatataaattccataaacagaagagtctaccaggagtggacacaaagaagttcacagagggcgcatctgggtgagaacagccccagctgttatagcatatgtgcaaaataatgatgtgcctgcacatccatgcagacctgatcctagctgtttataagaaaggatagttaaatgcagaaatgcaaatctgtaggctggagttgctctgtttcctaagtcttaagagtttggctccttatcttacacacaaaaatgcaatagacaaaacctccacataaataagcagcaggtgaactagcattttcttgccaaggtattatgcaagtgttaactgagctgatcagcagaagcacatatccatcagtttcactgcagaaagcaggaagaggaaggtgaagatgagcaggcaagttaaatgaaaactcatctggcttgcagaagagacacttattgctcagaggaggaaggtgcccaggggtcatgagatgtgacagtactaacagaaaatcctgagcttgcaaactctgataaatgtttaagatttaatggggagtgtccacacaaatgcaaaatgatttagaaaaaggtaaatgatcataacaatgttaataacatctatcaagcactttgctgagtattttgcttacattaataccccattatctaatcaaactcataggatatgtatggcacactatttcattgaagaaacagattcttagagatgtaaagtaactttccaaaagtataggtattttagatatatatattatagacctagcaaataagatgcaaaaatagaatttaaacttagaactgcctaacttagaaattactataaccaaatgctctacttcacatcctgattgctggggattccatttgaaatagccagatcatatataagtacatatctgtacacagaagtacatctatttctaaaagagactgctacttgtcaaatagtcaggcaagtatgtgttttggctctgtgatgtgataggaccagttttgaatctcctattttaacaaaatgtgttgcttatttttgttattttacatcatggaaacttagtttgttcagcctgaagagtttatgatggcctcctgtattcttcctgtaacgtgttcaaattctagggtaaaataaatttaaaacacaaacccaggatgtgtccttttaagctcttataaaggatatcatgtagataagccaataaaaaccacaaaactcccaatttggtcaaaagggaccttactgtattaatatatgcatcc

SEQ ID NO: 114 - DNA, 80952 bp, Homo sapiens
tctgcagtgctatgtttttgaaaagtttaaagggaaaagcacaaagttattaataggtggtaggattacaagtgatttaataagattttcttgcaagctttctacagtttcttattatttatatgatttaaacaaatagacaatttgtaactttgtagtcttgaaatctaaattccatctctgcctgtagctctcctcatccaatcggtcaggtgccccgaataatcctttagatttttgcttgaatttaataatctaggacagtgactgagggacatgtcctgtagagacaaagagattgggggttaaagtctttttctgactgtgtgctgacatggtgatttccagccggttattttctctcttcaatttccttgtctgtgaaataattttcatacggttttgttgcaaattgataccagtaatgttcataaagcaatgaacacagtatgaggggttttgttcttattcttgatgccaccttaatttaaggcttttgccatcccatgcttggaccactgcattgaaatgcagaccattcaccttgactctatattctcctgacctcaggccattctgttagaccttgactgaaaacccttcgggaagttgatggctcaaatcacttgaagttttccctgccagccattgttgcctatagtgccttatttttaaagactctataggatgcttaccaatatattgaatatttattgaaatacagtcatgtattccttaaatgtggggatccattcatgcgttgttaggcaatttcatcattgcatgaacatcatacagtgtacttacacaaacttagatggtattgcctactacacacctagactatgtgttgtagcctattgctcctgggcttcagacctgtacaagatgttactgtattgaatgctgtaggtaaatgtaagaagatggtaagtacttgtgtatcttaaacatatctaaagatagaaaaggtatggtaaaaatatggtgttataatcttctgggactacaatggtatatgtggtccgttgtttactgaaacattgttctgcaacacatgactatatataaagggcgaccttggagatatcacagattcagtttcagaccactgcaatgaagcaaatatctcagttcagagagtcacgtggtttttttgtttcccagtgcatataaattatatttatactatattatagtctaataaggtacaatagcattatgtctaaaaacaatgagcctaccataattaaaaatactgctaaaatatgctaacaatcatctgagccttcagtgagtcttagtctttttgctggtggagggtcttgctttgaggctgatggctgctgactgatcagtgtggtggttgctgaaagctggtgtggctgtgatgatttcttaaaataagacaacaatgaaatttgctgcattgattgatttttcttttcatgaaagatttctctgtagcatgtgatgctgtttaataccatttgatgcacagtaaaacttctttcaaaattggagtcaatcttctcaaattgtgcccatgctttatcaattaagtttatgtttgctgtcattgtccttttttatcattttgataatgttcaaagtatcttcaccaggagtagattctgcctcaagaaactactttctttgctcatccataagaagcagctcctcattaaagttttttatgaggttgcagcaatttggtcacatcttcacttctaattctagactttttgctatttctgctacatctccagttactccactgcagtcttgaacccttcaaagttattcatgaggattggaatcatccttccttttaatgttgatattttgacctcttcctatgaatcagaaaggttcttaatggcatttagaatggtaaatcctgaatcttttgcagaatatttaaatttacattgcccagatacatcagaggaatcaccatctatggcagctagagccttacaaaaatgtatttctttctttcctttttttttttttagatcgagtttcactcttgttgcccaggctggagtgcaatagcacaatctcagcttactgcaacctctgcctcccgggttcaagcgattctcctgcctcagtctcccaagtatctgggatcacaggcatgcaccaccacgcccagctaattttgtatttttagtagagccagggtttcaccatgttggtcaggctggtcttgaactcctgacctcaggtgatccacccccacctcaggcttccaaagtgctgggattacaggtgtgagccaccacacctggcctaaaatgtatttcttaagtaaaaaaaaaaaaaaagctgaaagtcaaaattaccccttgatgcatgggctgcagaatgggtgttgtgtaagcagggatgaaaacaacattcatctccttgtacatctccatcagagctctagggataccaagagctttgtcaatgaggagaatactttgaaagaaatctttttttctgagcagtagatctcaacagtgggctgaaaatattcaataaaccatgctatatacagatgtgttgtcatccaggctttgttgttccatttacagagtacaggaagcatagattttgcctcattattaagggctctagaactttttaagtgctcagtgaccactggcttcaacttagagtcaccagctgcgttagcccctaacaagagagtcagcctgtcttttgaaacttcaaagccaagcattgaattatcctcagtagctttagcagcccagtgtcctcttccaatagaaggctgtttattctacattaaaaatctgttgtttactgtagccactttcatcatttatcttaggtagatcttctggaaaatttgctgcagcttctccatcagcacttgctgcctcaccttgcactttaatttatggagatggtttctttccatacatctcacaaatcaacctctactagcttcacacttttcttctgaagcttcctcacctctctcagccttcacagaattgaagacagttagggccttcctctggattaggctttggcttgagagaatgttgtggctggtttgatcttctatccagaccactcaaactttttccgtatcagcaataagcctgtttcactttctcattattcatgtgttcactgggatagcactttttatttccttcaagaacttttcctttgcattcacaacttggctaactatttggtacaagaggtcttccagcctgtcctggtgtccaatatgccttcttcactgagcttaattatttctagcttttgattcagaggaagagatgtgtgactcttcccttcattcgaacacttaggagccatgtagagttattaattggactcatttcaatattgttctgtctcgggaaatagggaggcctgaggaagggagagagataggggaatggccaattggtggagcagttagaacacaaacatttatggattaaatttgttgccttatatgagagttgtttgtggtactcccccaaaatcacaatagtaacattgaagattactgatcacaggtcaccataacagatataataatgatgaaaaattgaaatagtaccaggattaccaaaacatgatgcagagacatgaagtgagccgatgctgttggaaaaatggcactgatagtcttacacaatgctaggttgccacagaccttcaatttactaaataaacacaatatctgtgaagcacaataaaccaaagtgcaataaaatgaatgtctctacgtatccgtaacaaataagactcatatcttttctgactatcatgatcataatatattgttaaattcttaaattgttatattgttataacttattataatcattttacttggtattatgagctcatttttgctatcattgagacacctatcttctattacaatacaattttcttattgtaataattttgtaagcattgtcctggtcatttggtgaccttgagtattgtaaaatttctgatgtagtgaagcaattacagttggcaaatgaggcagatactgaattacagaacttctcactcaggagcctacgctgaaggtaaccgatttaccattcctgagactaacagtccagtcctgacagaactcaagtcaacaggtcttgcccacccgtttataacaatggcgttttcatgaatcagaatttcagattgaacctgatgaaaacaagtaatcaatatctttgcatcctattgtttcagtgttctagtgggttggctaaatgggccaattagaataacacaatgcaaatttcctgcttgatataaaagtcttttttaaacagcttcagtttatgctaaataataaaaatagtgaaaaggaaattttcaaactatatgatgaagacttcaagagccttacattccttccttattattattagttttgtgaccatatgatggacactgtgatctaagtcctaaatccattatgccacattccgtaaatgtaggcatataaagtattctgtcatctgtagttatttcaaactgcattcaatatcttggttcccaagtgcattggattttattaaaagcattctgctgtaacatccattcttcccaattggtttacagattgcccctaccattcaggcaaaccctaattgcattttcccacaaatctcgtttgatttatggtctcttgtttgctttatattatttataataaattgaggtaaaattcttaaaacatgaaataaaatttataatattttctcttctacaaatatggaacttacctaaggattttcagagtcgttttgcttgttttaaaagttgtttagacaagctacaaccatctgcatggtttccaataataagttctttattaccatcccagaattaattatatttcgcttgattttttttatgtacagatgtttaggattatatggaataaattatgtatagaatataaaaatggtatgtccttctataaagcttaggtggttacacatgtcatatgtacctggaacagaaaaaaatattatttcagcagtagtgacaaagcatctgcataaaattcagtgccactgatgcaccgagacagctaattgagaacattcttgcttctgttacaagttccggcttttgagatgccaagagttagtttagaatggatctatagcagatcccaaaaagtataaagtgtttaaaaataagtaaatagcagaaatataaagacagaggataccagagacttaagaagagaatttctcactgtcaagtgattacatatcaccatggattattttgtaaagttctcttctaaataaaggctttccatggaagtgcaggcatggaatcatttctgtagggtacatgaaaatttattgaaaggaagaagtataagttatctatatcgatttatgaatagccttctaagctttgttagaaatgtgtctattcagtcaaaagtttgaacattaagaattttgagctgagaatcagaaagattggagtatattcagtataagagacaaaaagaaaagagaaattgattttttgagaagtgcaaagacaaaagggggaaagatggatgatctcaacaaattttagaccaactcagtaagtgggaggcttattatcaacagtaaaaataactatgtgacttctagaaaaactcagaaagggtggttagtggatgattagcaaacaaaatatctaaataatggttgtagttgagtttcttaaatggggctttgggactttcctcttcactagaatagtaaagaggccccaacatctgcagtgccagtggagacctcacgaggagcttgggcttgttccccacttagtgacgaaagagttgtctccttcccattggagttaagtcagaggactgcctagagagtcaggaatttcaccactgcccagggtaatgaggccacactgtttatgatgtcagtgtggacaatgggggagcagtaatgagtcactcctgccccttccagccaggagggcatcagtggaggcctagtgggttctggaatctccatccccacccagtattaataaggcactccctcctctggggtcacccagtattaatgaagcattctctcctctggggtcagcagacgccaagtagagtaatgagacctctaccccaacttggcagtaataaggtagcacccttcccccaacctttgccagagaaatgtcagaataagcaagctaaaacggaagctttaagatctcataatataatgtatcaaacatactggtttcacaagaaaatcagtaatgacaccaagaatcaggaagatctcagagtgaatgtaaaaatataatcaacaggtgccaacaacaagataacagaaatgttagaaatgtctagggaagaattttaaattagttacttccaaaaatgcttttatgaatattatgacacccttgagacaatgaaagagtggaaagtctcagaaaagaaatagacgatataaagatgaaccaaatagaaattgtagaactgaaaatacaactcaaattaaataaaagcatatttgggctcaacagcagaatgcagtaggcagaaggaagaatccacaaacttgaagatagagcagtagaagttacccaatatgaacgacagagaaaacaggctggaaaaagaaaaagtttcagggatctgtggcactgtaacaaaagatctaacattaatgtcattggagtctacaaggaaaggaaaaagaagccaggccaaagaagtactcaaagaaataatgactgaaaactttctaaatttggcaagagacatgaacctacagattcacaaagttgaacaaacttcaaacaggataaaaagcaaagaaatgcatgcaaaggcacatcgtaattaaacttctgaaaattaaagacagagaaaaatcgtggcataactaaaaaaaagtggcaccttataaataagggaaagcaatgtgaatgagagtggatttatcatccaaagccttgaagggtagatggaagtggcacactatttttcaagtgctaaaagatagaaccatgaaccttaaatcctacatccagttaaaatgtagttttggaaatgcagaagaaatcaataaaattggccaacttctagtaagacagacaaaggagaaaccgaagacacaaattaccaaatatcagaaatgaagaatggatatcttgagagaccctccagacatcagaaggataatacagaaaaaacacaagcaattctacacttgtaagtttaactacttaaataaaacgggccaattcctcagaaaatacatgttactgcaagtcatccaataggaagcagattctttgagtagctctataactttaaaggctattacatttgtaatagaaaactccatatcaaaaggtgacagaataaaaatcacagaagcatattgactgacgcagaaaaaaattgaaaaaattgaacatttagttataatgaaaaactatcagaaaaataagaatagagggggaaaggtcatcaacttgttaaagagcatctacaaaaaattttgcaactttattcataatagccaaacccaggaagtaatccatatgacctttaaaggtggatgggtagacaaactgatgtatccatgccatggaataccattcaccattaaacagcaatgaactgttgatataggttgacaaccccttatctgaaatgcttgggattcaaagtgttttggatttttgattttttcagctccaataagcatttcctgtgaacaaccatgtcagcgctcaaaaagtttcagattttggagcttttcagattttgatactcaatctgtacacacaacaacttatatgattctacagagatttatgtggagtgaaaaaggccaattccaaagggttacatgttgtatgattcttgaaataacaaaattatagaaatgaagaggacatagttgttgctaggggacgaaggttaaggggaagaaagagtgtggctgtataagggcaaattgagggaactttgtggtggtagaaatgttcttgtctgtatcaatgtcaataacctattgtgatatagtatcacagtttgtaggatattcccattcgggaaagcaactaaaggctatgtgtgttctctgtgtgttatttcttacaactgcatatggatctatgattatcttaacaaaaagttaaacaagaaaaataaaataaaataaatgaggcttttgctgaccagtaatcagtgttctacaataacaatacacacacacatgcacatacatatttgcactatacactggcactattgcacataatttactataaatatttgttcacacatttatgctcatttaacttggtcaaattttctttctttagattgtattatatcacttttttgagggtgttaaaatggtgccatattggtagatgttaccatctaccttttctaaaaaaaaataactttttggcaacataaaaatttgtcaatcatttatcatttccaaaaaatgtgattcaagatttactcctccatgaatttcagaagtccaggaatcacagttctacagtttccatgatagtaatatagctaaaactgttctttttatgtagcctccagcttaaagagctgaacaaaatagttgttaaatacatgtggttatttgataattgaatgaatttgactgaaaatggtggctattaattctaattccagaacaaattcctaatcttcaataagtaaaaggaaatcttccttcctactggtaatacccaatgctgcctcaattactcatataatcatatactgggagtaatgtgctatgtagtggagtaaattctaaactctaataaatgtgtgttacctcactcttcaactccacttcagcatttaatcattgtaataaggtatttcttaataccacacttaatttcaaatataatccttttatatatgtattagatacaatgtatttttcatatctaatatgtgtattgtatgtttatttattgtatgttatttagatatgttaatatattcattaaaattggagtttttaacaaaaatattacaaattaacatataaaataactaaaaatattaggttatattattttgtctatagttagtattagcaaagtaataatgaatttattaagctaatatataaaatgactagtatttaccttttttcagtaagcagggaaaaataatcgtgtttagactatatgtaaggaacagaatagtacatttattttctaaatagtttacttactactttcaattttgtaatctaatgaattagttccaatgtaaatacagatttaaaagatgtattcattgtaaataactctatagggaatatttcttcttcaatgaaaatttcagttttggagatggaagtttctcatcagttctaatttctcacctattctaatgttactttcttgtgaattcatgttaccaaatgtatgctgtacacacacatagtaggccacctttttctctttctacactaatttattattagttttatatcattttagtagttttattgttaatattcataatgtgagaacatattccactattttccatatatatagaaagattgaaatgttttaaattacttcagtattccataaagtatatcagacccaagattagaatttataagtatttgaaattgtaaaagttttaacattctaagcgtaagacacctctattaaaatgtttttcacaaacataatatcagttttctcttccctctaaagtgatattttaagagacattttctaggaatgctttctaaagtagcttgaaataaagtagacttttaatagtgattataaaataattttctttcccaggtgtttgtattaacagatttctgttgtcccttatttgataatgtgtttttatcttccaacatatttatacaaactgaaatctttaaaaacagaaagttcttttattatgaatttttttagtatgtcttaaaacctgatccctatttttttttttccaattaaggtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtaagtcagggcacagctgtgccggccagctgcacccgctgaagtgacatctcccaatgccaaacacacttggctgcttaagtaaataaactggagtcatttctcagcacatggaagatggtgggaaagctcttagagaaagcccccctgtgtcagccatccaccttgactaacaattaaattatagcctgcaaagaagaaaatgacagagttgctttgccttagagagttgtctgctgcccaattcatctctatttttatgagaacctggcagcccggcctgtttcaggcagtccatcaaatgatggaactggtggctggatacggagagcaacagccatttatctcccccagatttcaccttcctgcaggacacttccaaatggaagctttaattacctaaatggataggtcaagattgtctgctccctggaaatgcagagtagaatacaaaagcaggccgatcccaatcctggctctcctctccgtccccgcctgtgtcagcaagcgcgatggctgtcacacgtgccctgttagaggctgacctccaccgccaaagccattacagcacggacatttttctgacaaaaggttaattggcttcaaaataaatgtattgcctaatgactccattctaatgtggttgtgttcctttgtaaaaggctcactgatgttatttgtaaaaacttgccaatctcttaaccggagaaggcttttacatttaatctgagaaaaataaatgctggtctctaaccagcttctgctatttaattattgttgttatcaaagactttgcttttggtgatatttatcaactaaaagggcttctctgcctacagacagcaaagcagttgtgcacacttatgagtatcacatcaggttaaggacaagaaaaggttttggccaactattagttaaattaagcaattgacacatttaactgggaagtccagcagtcgtgaccaaaagcaaatcaggaattgtttttaattagtaacaaataaatttatgttaaaaataaaagtacaaatcagagaaatcaaagtaaatagcttaaaaaggtgcattaaaattaaatttttccttcctgtatagacacattgaaaggattattgcattatatctagtatgtcttttgaaatattttcatattgttatcaaacatttctaattcttgagcagtcatccaatatcagttattgaacttagaattattccaacttatattacaagaggaacttggtagtatccttattaggaaaccttactataaaattttgggggggtgggaaagaggtgagtaacattattatctcctttataatagtgtctgttagaatgtgaacttgttatgtgaaaatgtacgtatgatgagaaaaaatttatagcgtgtataactaactttcatactttagtcttaatataagcatatatttccaaagttttgtttggatttttggattcatatatttgattggttgcatggattttgtgtttgcctgtctatgtactggctcatagatatgtactggctccaagataatacaatggagtttcttcaaaacctgattcctgttgagtaaaataatatgtcataattctttataaaaagggagtggcttttggtgttttaggtaattataacctacacataaattgtattaatgaaaataaattatatagatttactatgattcaaataattttatgagcaacctttagaagtgtagagactagaaaaaatcattttgaaaataaattattaataaaaatatgagatgaatcattttctttatctttgataatccaacagtcagcagggatataaaatgcttttcttttttatggatatattaattctcttaagctactattgattatagtactgattcagcaagctaaaaagtaataaaaagaagaaacaatttctttgctgtcactggtagtataatagcataaatttaggaaaacatcttattccggaagctgtggacttcttttagacagtagctactacattttaattgcattactgtaacactgaagataagacattaagattattttttattttatttatttattttttgagacggagtctcgctctgtcccccaggctagagcgcagtgacacgatcttggctcactgcaacctccgcctcctgggttcacgccattctcctgcctcagcctcccgagtagctgggactacaggctcccgccaccacgcccggctaattttttgtatttttagtagagacggggtttcactgtgttagccaggatggtctcgatctcctgacctcgtgatccgcctgtctcagcttcccaaagtgctgggattacaggcgtgagccaccgcgcccagccaagacattaagattgttaaacataggcttgggaaccatctgtccatagtttcatatttatttcgtggcacatttgatgaaaggacaatctggtgctaagtaggaggagggacttgttttaggatgccattcttaaggaagaactcttgagtgttgaaggaagcagggcgatccgtcccccacaaaaaactaaaagcaagaggccaagaccctgcactcttctcttgtgtgtgggcagagcaccggtttctggtcatgcaaacctctggtctcaatgtcatagctcatccctcactgaggactgctgaggagcagtgcttccctccgaggataccggccctctctcaactctcctcagacaccctagagactccaagtggacttgtgagcacctgaaatgatgcacataactaagtgagaagcaggtctgttgcttttatcagtgtttccagagcctgtggctccgaaggacttaggatgcactggctgtaaaccccggcacaggctgccccagcctctcacggtcattccagtctgtgaatgtgctggtctggggatccctccccaggtcctcagactcctcttctatttgttctggattagctgacctgatcttcaccaggttaggaaccattgtgtgttcttgaaataacaaaggcactctatggtaacatcagaaagtagaagcaagagttagagacagacagatgtctttgcatgcttaggtttctcagcccacgccctgctctcagtaccagtttcatgcacatggaagtggtcattagttccagatgccaaaacaacgtggcaggctgcgtgtcatcgtctctgcagcttcgtctctttcttgtggcatctctgaagattgcagcagtgtctgatccaacagtctgcagtggtggaaatgttctacatctgcaccgtctaatatggtacaattggccatatgtggtgattaagcacttgaaatgtgcctacggagactgaggaactcaatttttaattttatttaattttaattaattttaatttaaatagccacgtggttaccatattagaccatgcagctacagattaagataatggcagtcaaaaataaatgcctgaatctgctacccagatagatagaaggctatcactgtgttagaatttttattattaaagtgaaaaaacgggactcatctgtggattttttgtcatggttttctatgcatatcataaatttattagtaaatgtgagaaacgttttgcaaaatgtttgtagtgaaaatttctatatacttatcaatggcaagttcatgagctatgaaagttgaataaatctcatctcgaatatgaaatctaccggcaagcccaggaatagctttttttttaatttttaaatatgcattttctaaatatcactaaagaattcttgattatcaatggttgtagttataaaaaagcataaggaatacttaaacaaaaaaaatgttaatctgtttcttttgctacattttccttgacccctctaacatttgggaaatacgactgttgattcttttgctgtcttcaatatccacattattggcaacaagtgagaaaagagctaagctgtctggataagttacaaagcagataatcagatgaacgatggaattttaaaaattgtgtttgagttttctcatcttaaattgccatcctttaattttctgtccttctgtaatataaatcgcacacttctaatgatggtgatcggggtggggacggggctctttgtaaaggttttccatatgggcacctggggagggaagaaatgctatatgaattggtaaaatacatggcccattgtctctacctctgctgtgtaaataaagagcgaagagaagcatacaagtggttttgaaacggtctcttcaatagagacctcgagagaaagagatgaagataaatacctgaggcactgttaatttttagaaataactatatcatattataaaccattcatttattttgaagatggaaacagctacacctacataaaggtgtctctaaaatctttcactttctaggcattttgatgtagtagatattgatacaggtcatctttctccatgataacgtgctacgtgacagaatatgacatgcactaagacggtcttgttttccactaaatttctaataaccaggcgtaagaatgtcccaggtatcagagatatttgaataggacgtagataaacctgtaatcctctaggaaaatcaggatagaataccacccttttatgcatgcaacaaaatcacaaacctctcaaatttgaaagggagaaactcaaaatggacttgtattttgtccaaaatccttccccactgcccgcacagcacccgatcaacccacacccggcaatgtcatgatggtccttgtccagagtagcagacatgccagaggcctttctgcgttcttgttttttcttctttgacacgtaaatgatattccatagccacctatattgaaatgaataaaaccagaactgatacatatgagcaggtatatgtgagaatggacttaggtggcctctactcactgccaaaaatgtatcttcctcactgccctattagagaatatgaaatctcaccatggaggcaaatttccccttaggttaatatagtaattttacctgttgattaaaatttagatctccagactttgttttgtattaaaaaatgacttattaatcaggtaactatacacatttaatactttttataaataaatgttgacatacatatgtcatttatatatttataccccacattatttcaaaacggatttaaattgtcttacaaaaaaactataaagtcagcaaaaataagagatgagagaaatgaaaaccatagggacccaaaatggatccagtaacaatgttagtaaaaacaggcatatcctgaaatcctataaggcgagatctttgtctgtatttctggtttattcactcactttcctggtacctagaacagtactgtcacagggcaggtgcccagggatatttgttgaatgcaagtaaagcatacaggagctgattgtttttaagttttatttctcttgcttcgtaggcctcactttccttatctgtaagtgacaacaatataccaggtgatttctatggcccttttaaattatgagcattcaaataagttttgtttcataattattaaaataattgtattttgatatgttggtggaatacttcaaagaacaaatattgagtacaaatttgccacagagatcaattcttctggtagcaaaatggaaatattagcagcagcacatttaatttgaatccatagcactttaggttccagaatgatatgcaacggtcttgagggggttgaacttttaccaggaggatgctctttaggttatacacgaatgctttccaatgactactcatcccttaaagtttgctttcaaaatgacaaattcgcttccctttctaaaggactgaaaatatatgttgcacttgaacacccaagtaaaggaaatgctgtgaataaattaattagatgcataaatcagcctttataatttccactgatggtgtctcagacaacacctttaattatgtgttgactgacaattccattcagtatttcttctctggcattttctcctttttttctagttctttttatttctcagcagcattggtattcaggaactataaaaatctctgtcaatgtgactgttttcattgacataactgataatttcctagtaggaaaaacagttattgcatataattattataaaaatatgcacacattttcttacaattaaaatcagcccaactgaggatagctcattatctgtaaatattactgcattttaaagtaaatcacactgtgatgtgatactcgatccatttgctatcagaatattcacaagattccgtaattttgagttataatttagtcccttggtaccttcaatttcttaatgtttcaatttcttaaggattttaaaaaaataatgctatatctgttgcccctaaggtaaaactgatattgacttttgaaatcttgtaggcaaatttatttgagctgaataatttgtttcacatcaaggagaatgaatgttctcttggaattgtcctgggtttctatttcttttgataactgccaaagcttgagtttggataataggacttagtagaatttgcaaggcaaattttacaagagaagtgacaatttacctgatttttgtacaagagatctgccacgttcccacaattatttcctttgtgattaattaatagacagagcttattccagaagttttgaaaaaaaaaatcctctggcaatgagtgtactattcttaatgccattcttttatttgatgtaaattgttacatcttaaaagtgtatagcatgaaaatacagccatgtattagaaataacttttatttaaattggttagatgacctctgaaaaccagatgaaagattttctgctgaatgggctggtgctccctgctgcctatataatttatgtgagaaattagtgcaaatggttcacttttatgtagcagagctgcttgtagcaagcctgcagaaacaattttcccccaagcctccatctgttcttcaaactagggcatacgccatctcatcgagcttgaaagtcaactgatttataactcctggaaagtgtatagattgaaaagaaaggtcgactgctgctctgtgacagtgatttgtttggcattggctaaagacaattcacattaccagggacccaagggaaacaagaaatgttgtaagtttcagatctcagtagactgacaactagaagaaaaacaaatcactcctgctttttaagtcagacgaccaccagggttgaaaagtaggtcttggtagtgttaagggtgccaaagctaagctgccacccatattgtcacttagcacctcatgaagaaatgtgtcactgcccaccctctcagtggtaaatgttgacgttgtagaagtatcaatactctaatttttaaacacaaaatatgtgtcactgcttgtcagaatgttctgtttggagacacaaattggtctttgatgaattttctgtatctacccaaggataatctccagttgtattccaattagtaatttaatgaacagttcgctcctgtcttatcactcgtcacacgtctcttctctttactgaagcactattgagatcaaaagtcctttgacagatgacaaatggaatcagattggcagtatgcttgtaaacaacaacaagaaaatcattctttgtttgatgttttcctttgagtagtcaaagtatcatcctcccagataacaacttttagtctattgaagtttttgttgtcttttttctacatgtatgtatgttttttattttgtcgaaactgtgtttcacatgataatttttaaggaactcaaaggaacattcatggtcctaattaagacaggagattgatagtggacatactgccacaggaattctaatagttttttccagtttaatgacaacgaaaaagacaatcatcttttaatgtgcaggtttaagttttcagcggtcattactaagacctttggaaaggagatacccaaacatgtttctatgcaaagctccatgttagcagggatgcacatacatggcttttcctgtagtaattctcatggtatggtgcccaaccacgtaagcaggcttgcctttgtgagcatgtcattaccatgtttttgaagagcagagtaactactattttcacaaagttcattatgtatgaagcacatttcttgctattgggaaaagtatagaaatggacagagttgacagaatcattttaaagccaacctctgcccctactctaagagactgtctttacaacaaatactcctacagaatttccaagattgggttctaatctgagtaaaagaaaacccatcaacctttgtagccataaattctcaaattttgagttcttatttagattgatctctctctgttcattcatagttttaagcacttaaaaaaaacaggtatatggtttgaatatttctgaattcttgaatatcttgaaaatataaaatttcaactttcatgtacataaaacacaatttaattgaaattagcattcttaaattacaattgcttcccttcatatctctttagaagataacatctttgtattctattaatgacatatgttatgttaggtatattataacacatgtattataacatgtattataacatatatgtatatgtataacatataacatatgttattatgttatgtatatccaattccattgatctcattttctgtagaaattccctttattttctgcctgcacatttgttattatactgatttgccgttgcatgttacattttcctttttctgtatcttcacagataattttgtggtatgtggagagatactgtgtcagagatttgtgtcaagatgctatgtatatatgctgaaaaattaagactagcctgattttattcctttaatgtcaatgtattgtttgtttgtttgttttgtttaacagccttggtaaatgcactatttttgtgtaattaaaaattgcttccatgtatttttcttttccttttgtgtattcttccattagtacagtaagcttattgtctacttacttgaaactttctcaactgaggaaagttttcttttgtaatattacttattgttactctgtcccaattttctgttttctttcttagaacaaatattacatgtagattatacatttatattctgttctattatttctatcattatctccctcaatatttttatctctttatccttgttttaacttctggcagagctttcttttctcttctttttttttttttgagacagagtcttgctctgttgcccaggctggagtgcagtggtgcaatctcggctcactgcaagctccacctcctgggttcaagcgattctcctgcctcagcctcccgagtagctgggactacaggcgcccgccaccacacccggctaattttttctatttttttagtagagatgggatttcaccgtgttagccaagatggtctcgatctcctgacctcgtgatccgcctgcctaggcctcccaaagtgctgggattacaggcctgaaccaccgcgcctggccagagctttcttatgttttctatttttgttggtatggatctatccattactgccaccagttcaaattttagctgtgcttaggtaaactgccctgcacctggccaatacccagtgtctagcatgagcatgtttcacctggtcttattctgttggcctaaaaggggactttgtaacttctgacactgagatagctggagtacacaaacacctataatccctaaaaggcacaggtacccagctctgtctttgcctgcctttacctatagcattttgcttgtgggacacactgctttctaggacagaatgcaatgtggtaccagaaatctctgtccctacagagatttgttgttgtttcttgagttgactgtgaatggatgtaggaagggtgaatggaagtggatagtgctttgtcttgaaaggcaactacttcaaggtagcaggctggtggcctagtccctcccgcccccaccatcacccttttattctagaccttatgtttctgaccgggccaggaagggggatcagaaagtgtgggagagatgaaaaagctgactacctacctttggattggtgcctctggttgcaaaacataagttgactatgaattgtggttttccaatccaattccattgatctcattttctgtagaaattccttttattttctgcctgcacatttgttattatacagatttgccgttgcattttcctctttttctgtatcttcatagataattttgtggtatgttgggagatactgtgtcagagattcgtgtcaagatgctatttaaaaacactgagtccaattcatttttgtgcattaatggactatattcctttgcagagaagtaatgtgatctcattaacaggctacagtgacttgtctattcataaaggaattgagtacttataatgggaaagacatggtgctgagctctgtaacctgcataatatgagttctggtcttaagaagcttattgactagaatagatcactattcaaggaagaaaccgaaagtcctttcaaagagtatatatcaagtcttaagacagattgcttccgcttgcatagatcataattcttaatcctttatgcagtatgtgttaaacatttgctgcttcagtgatctggttcaaataatttctgtagacaaacttttcaaattgagagtctctataaaacttttgccagttcataaatggttatctatttcagggagtgcagcttgctgacacttttgtttttcttgtatttcagtttttttaattgccatattaagaaataataaattttacctttaaaatgacctttaggtagtcaatccacatacctatgtatctacatattgtggcaatcccaagtatcaataagatattactgacttcagtgttctactctgtactttgaaataaacactttgaaaaaaattatgtttttacctatttgtgaattttaaaggtttatcgtgcttgggattcagtctgatttaagtctgaagacttctggagtcatgattaaatacgagctgggctttctcattccagctttcacatctctgcatctccgttctcttattttctatctttttaaatcaccgtgtttcattcactttttaattcactgtgtgttgtaggtgatttcctcaactctgtcttccaacttaataatttactagtttaatctactgtataatttgttgaaattttttcaaatttactttcagtgaatatcaattctggaatttatatttgtttcttaaaaagatctgcctactcttatatttttctcactttatggtttctcttactatctttattagattgtatttttaagtcactcatttgaggttctttttcacactcatctattatcttgagctcctggggtgtgacttggaatctgccttctgtgggaggccctcgcggcctgggttgtgaaggcacccgtgtgctgtgctttcaggttcgtctctgcaggacacacattctgaacctcttttgatgtgaatcagccttcacgtttcctcactgggctcctgctcactgctctagatttgagtttccctttcatttctggggacttagtatttgcctatcttacttttgagaatggctatgcatttatttattttattttattttattttatttttcttcccgtatttatagttttggccatattgaccagaggtctattaattctgtaaaattgttttctcaattaactgaatatcttcgcttacatgcagattaaagtaccatcttgagatgtaatctttcctcaatgtcagaccaattctaatacttcctcaagtacaaaaaaaatcaatagaataaaatatgttttgtatttcccatggaagtccctttatgtaagcaagttacctttatgtaagctaatgtgtattgcatgattgtgtatgtgtgtgtgtaatcaaacacacataaattaaaactctgttgaacatagcaaaacttgggtttggaaaaatcacaaggaaaagacataaaaattttgtgccaacccacaactctcatttttgtatgtatatagtacgtgcatgtgtatgtgtgtatttacatgtatatgcaaatatgtgtagacattttgttcctatttcagtactggagtaaagatttttcttttttcttttttcttttttttttttttgagatggagtttcactcttgttgcccaggctggagtgcaatggtgcaatctcggctcatcgcaacctctatcacctgggttcaagctattctcctgcctcagcctcccaagtagctggaattacaggcatgcgccaccacacccagctaattttgtatttttagtagagacggggtttctccacgttggtcaggctggtctcgaactcctgacctcaggtgatctgcctgcctcagcctcccaaagtgctgggattagcgacgtgagccaccgcacccagccaagattttaattgtcatactgtaaaattaaggtgggtggggttatcctaaggagacctttatcttctcaatattcatatctattactatgaatctcttgagaagcattaacccttccaatggaaaacatctttcaaatgctttccatttgcagtaagttgcataacattttactaaacatcattcaatactttttaaaaatcaacaaattatagcattggattggaggtaatttagtgtttagaaatcatcttcatagaaataatcactgtagacttgttattaatttttatttttgaagagttgcttgggtaatgattaagtaatttatatatgcacaaaaagacttcatttacataaatttttatttatatattttaaatgcattatgagaagtgctagtgtattagattggtaatattaaaaccacaagtcaaaaaatacaaaagttaagatttttataattctatttgggaatctctagctttttctgttggtgtgggctataatttcaacactgcattattctaacttattacatttaataaactaacaattgggactagcttcaaatctcaagcagcaatttagtagatggttcatttcatgagaaagaaatatggactatggtgactatgactgtactattgcagaaatggaagaaagtgaaagtaaaatgtattggttagttgcaatattaccagtaatattttgtctggccaataatattagaatgtagatcaatttgcacaaataatgagctccacgaccaaatgaataatcctctatggaatatactagtattgcagaaaacctttttggtaagaaattttgcatgctattactgtaaagcatcattatttggcttcttaaataatcactttgttcttctcatcacttgatgtcttgtactttatacatcagacatctctgtgcatgtagattaccaaccatgctgcctccctttttgtctctgaacctgtaccatgctggcctctcttgaatgcctccattgcctccatatccacctcctctgctcagcctctaactgctcatctgcttgcacctggctcagctcttacagtctcctaaaagtctttcctgactttcccaggccagattgagtacccttcttggggaaaccagcatatgctattactggtctcatcactgagtaagatagtgatctgttttcacatctcccctcaagatgggggactgcagaagaactggagcagggttatttaactttgacctgccttagcccctgatacaacatgagtaaatattttaaggctgatgtttcaaatgattcattaaaatacatttttatacttttcatatatttttgtttgttgaatacagtagcaatttgaattttcatctacttgcaaaccaagaatgagggtggttatctgtgacttttaaattttctttacaggtcccatagatcttttggtagctctatttatttttgttttcttatagaatgtagtttgcagtacttttaaaacctgtatagtatcagctcactgaatattgctgattgctgaagaaaagtgtttgttcatttaaaccccagtgatctgatcatatttaaattgcattcttatctatgtgttgtctttaaatatgtgctgtccaattggtgctcatgtaacttgtaagaagcatcattcatttgctaggcattacctgagtacttactgggtgtcagaccctgctctgctctggaaatacagcagtgaatgaagcagcgaaattctcagggctcatggagcttccactacagtaggaaaactgaaacaaccaaacaaataaatatagagactgataaatggtaatagtatgaagcaaaataaagcagggtgaaagagagagttgtgagaggatatagcacccttttgtggggtggtcagaggaaattttccaaataaggtgacattaatgtgtaggctatttggtaatattgtctaaattatttttaaaaataagagtcctaacttaataatttgccctgtttaaaatgcagtgatatcaaaaagaataaagtgttaaagagaatgcaatgaaaataatctagtaaattgtgcaatttcaggacctagtactaaaaatcagtgtaagagttataacccgacactaatgaattaacaaattatattttaattaaatttttattccactaaaaccctaattgaggaatcatgaatgactgtgttttgtacatttcaacataaatattttgtgagtttatgcaaatatatatttcctttgtgaaaagtacttttcacatttcaaaaataagaaaaacctaaatagccaagcaaatccattttttgtgtcccctttctctcttcttttgaaagtaaaatcgttactagtgagcagatttagaaaaacaaacaggaaatgatgagacacatgtgagcagataaagtgtcatatctagattgtctttagagagggcacacgaaagcaagccccaaatgcaggcaaggcctggcctgcagggaagacacattcagatggagtcacagctcatgaacttttttgggatacaaatatataaaagtttctgctatggcagttgtataacaggatgtatctgagaaattaatggaattaaatgaaaagagatgaaactgagtattaaagacgtgcactattcatttgtttgttctgagcattctttcatccatcacacatttcagaaggttgcaatttattaagtgcagtgaaaatcactggtgatataggcctttgtgcagtgtatacaattagtcataagtacagtcatgagctgcataatgtggttttggtgaacgatgaactgcatattcgatggtgggaccgtaagattataacagatctgaaaaattcatattacctagcaatgacatagccattggaacgttcagcaacatatgttgccttttctcttcagagataaggatgttctttttctccgggtataggaagggcacccctcacatatgagggtcttatgaccggctttaggaaaacaaggtgggagaatgtgtgagagaacttcctgcttcttccatttttaaagatgtggcatatttggggatcgctgtcctgaccctgtcatcactcaatccctactttggactttagattatcttgcaatgccttctcattattatttattcaaatgggaccctaacacaaaaccaatgtggtatagaaagttaacagcaagaagggctagtgtctctgaggctgcagtaaacaggaggaagggcgtggtccactctcagaatgctgtcatggttcagagctgagggatttaatattgtttgggtatttttttctcttctctcaccctcttgccccattcctcactttatagcaacaccgatgtatttaccaacctcaagtgtactaacttgagcagtttggggaatcggggattaagatcttgtgcttcttggggccctggggacaatggttgaactgtgtcaggcagccagactggaatcaggtggagtcactggcaggttagaagcccttaattttgtcatgcctctcacttcctgtgaccctgacctgcccctacccactcacccacatggctccagccatactggcttccttgattttccaagaaaacaaaactcccaggtctcccgctggccttcatcaggaatgagtttctccaactcttggccaacttcccctcttcagggctgtgctccgatatatcaaacagccatccttggcacccattctcatccccctctccccagggacacagtgatgtttctccagagctcaataccatgcctgtcccaggcaaaacactgggataagaaagacattttgtctgtggctctcgctaccatccagtaatagctccaaatgattttagacagcaaggattaaaggatggtgatctagttgaaagtgtgcaggcatggtggggggtagacgtcttacattaaaacgatgtttacttatcaagcatttagttatttgggcggctttggtggagggctcagttgaaggagacgaagttggggagagaggactgagacatcctgagacatcccttctagctgctgctggaaccttcttacttttcttactttcaacaaacacgttctcagctctcctttatttagtcatgaatttactcatttattcaagaaacatgcgttgagcatctttgttactgccattagttccaataatatcttctatttctaatctgcttcattttgtcctattctgcctgctattaaaacccacctcttctgtgagaatcccatagattattgttattcttctaacataccgttcattctttaaacccagaagagtgcaactttcatgatggtatttggagcacggaggcaggcaggtagggtttagagggtaagagggagacaagcagagctgaagggttttgaaactgccttcaaagccaacgcatacaccaccacttattcattctaagataggtctttgtgattaaaatttagtgatgttcaatttatatttattgcttttcattgttttattaaatatttcattcgacaagtacttattgagcatttatgataagccagacattgattagatgctgtacatacagcatctaaattcttgccctggtagtgcttgagatcttgaataaggtgaaatcataagaatgccatattatttcttggcattagtgaaacttgatacatttattttgtttctttgattaaacttccttttgtaagttccaggatacatggcaggatgtgcagatttgttacataggtaaatgtgtgccatggtggtttgcggcacctatcaacccagcacctaggaattcagcccagcaagcattagttatttatcctgatgctctccctccccatgcacctccaccccacaagaggccccagtgtgtgttgtttccctccctgtgtccacgtgttctcattgttcagctccaacttgtaagtgagaatatacggtgtttaggttttctgttcctgagttagttttccaaggttaatggcttccagctccatccatgttcctgcaaaggacgtaatcttgctcctttttatggctgcatagtattccttggtatatatgtaccacattttctttatcaagtttatcattgatgggcatttgggttgattccatgtctttgctatcatgaatagcactgaagtgaatgtacacatgcatgtatctttataatagaatgatttatattcctttgtgtatatacccaggaatgggattgctgggtcaaatgtatgtctggctctaggtctttgaggaatcaccacactgtcttccacaatggttgaactaaattacattcccataaacagtgtaaaagcgttcctatttctccatagcctctccagaatctattgcttcttgacttttcaatactcgtcattctgacttgtgtgagatgatatctcattgtggttttgatttgcatttctctaatgatcgtgatgatgatgatgttgagcttttttcatgtttcttggccacataaatgtcttcttttgagaaatgtctgttcatgtcttttgcccacttcttaatggggttgtttgtttttttaagaaaagacattttttaatcaattatttttcatgaaatctaaatatgccttatcagtgctccaatctgtgtgggctggttgtttctaaattttatttttaataattgagtgatattaaataaaattcttgctatatttggtttaaaatggttttgatgtttagcttttgttagtggcatttacaaattctaaacaacttgtaccacatctattatattctttagcttctgctgggatttgctgtgtaaaagagagtgggaacaatgtagctcacattattctgataattaacatctgtgaaggacaagcttctgcataaatttttcccataatgggaggaagtgaatagaaacagaatgagcattgtgagctatggttttaatatttaaaatatttttctcttaggaactgaacctctagcttctgcacataaaagcagtctttttttttttttcatttttttgcccaaataaagatgattccaaataaactattatattttgtttgatgtcttcctttctactcaacaaaaccaatgatttgcaatttgaataacttttcaagcaatttctctttgttttttaaaaatcttttttatataatttatgaaatgaagatttaatcaacatttgaaaggagtgatgccatctcgatatttttacttaaatttcttttactagacctttcacagtggattcaggcataagtgcagggttttaaactttttcccctatcaactaataatgaggtgagttatgaaaaataataatttgtcataatttccaaaagaaattattacagccttcctattactagtgtcaaaagatgaattaactttcttttgttacctaaccatagccatgttgctaacttgatctcagctctcttggaaaaatgagaatacttccatatttaggcaatattccttctagctgttaagatgacttcagtttaatttggttgtctttcttctagtaactgcctcattcagagaagatattaccaacactttttgtcacttttgattcccctctggagctcttttattccccttgccttgataacttgtttgtgcagacttttctggaattggagcattgtttgtatcttttaaaaaacaatatgctaattattttgaaaaaacaatatgttgtttcttgactttttagtaattgccattctgactggcatgagatggtatttcattgtggttttcatttgcatttctgtaatcatcagtgatgttgaaccttttttcatatgtttgttggctgcataagtgtcttcttttgagaattgtttgttcatgtcttttgcccactttttaatgggactgcaattaaaaaaatatgtacttaaaaaaaccaatatgttaattaatttgaatttttaggacttttttcagtataacagttttacttttactgatgatatttttataagtattgatgcaatcttatttcttttctttcctaaaattgtggtaaaggcccatgatgtaaagtttaacatcataaccatttgtaactgtacagttcaagttgtggtaagtggtaagtgcattaacgttgtgcaaccaattttccaaacgttttttcatcttgcaagactgaaactctatgcccattaaacagctcctcactccctgctccccacatcccctgctaaccaccgctttactttctgtctctctgaaatggacataatgaatttcataagagatttttcatgtacgttaggtgcacagtgaagtgtatttgtttttgtatagattattggcaatatggcctccaaatgttaaaaaagagaagaaagttaagtcagttatgttttctacttggaatgtttagcagccacagagagttaagtaagaaaactgtacctgtactaaaaaattatcacaacatatgaaatacatataatttaattagacattaaaatatcagggtaaaaaggtgtttttaaaccctgtctaaaacattatatacattgtataacattgcatacattgtataatgaatgcatacataaaaggttataaaacctttaaaaatgatataagttgttttaggccagttgaattagctacatgccatttcccaaatatgctgtttaatatcccttaaaccaatgggcacatgtacgtgtgtatttttgtattcaattcacttttacctgcaaagaccctgattctgacatccttattaaaacttggaattgtttgatttttttaaaagatttgataattgcaaagggtatctagttatgcctcaagatcactggcctctctctatagcattttgccaaaaatactccttaaagcaactgtcctgtatctgaatgtagattctattatatttccatccaagcatttttgctaatatcatttgtatgttactttgatgtaatgaaacccagaaggtgcaatttcatgttaaagagcataatcagggcttatcatgtcctaatgccaaaccaaaatttggttctaatgtaaaacttgataataaaatttgaaaccaaaggggttttcctgatttacgtaaactattaaatcccctttattttggcatattaagttaaaataaactataagagtaacttaaacgaatatgcttacttacatttttattattctacttggcctcattgagccctgtttcaaggacttaactcaatgctcatttggttactctttttcattttcccatttccttccattgtttgaagcttggaataaattatacaagctaaactatattattttttcattatcttagtctttcttttctgatgatgaatatgctttagaaatggcttcttcagtaaaacattgtttcatcagtcattgctatctgatttaatatgcaaagtatacatgaagtattacaaaggagaatctttacattaaattttattctgtttgccatttgtcatcctttgagaattatttataaagcaaattccatttctaaaaagaagatataatatgatctggtccttctccctactctttttattgctatttgtaattaatagtgagggaagcactgtcttgagtcattggaacatgctaggaaatcattctgtgatgcacaccttcaagtataagaagataaatcacaaacagtaaattggatatcatgttaaaatatctgcaaacaattttttagccataaatgcattttataaatatgtatttaattatacatcttaaaatataggtttgatcatgcatctcgacaatgaaaaaccgaagggtttgtgaaattctatcctaagcagagaaaatctgtggttttttttgttgtgtggtgttatatattacacaagtagcatgtgctttttaattacctgccgtcatctatatgaacttgttgaggaaatgaaaattagcttaggtcttacaatctaccattggacacatttcaacaaaaagtaataactcactccaacttttcaactcttttaaggtcttctgttacaaattgtaatgaaaagaatcatacgatttgtgtgaaattcataagtaaaattgttctttccagtaggaaaaaagtggttaaaaataccctacttttttcttcctctcttttcctttgttttggtcagttttccgtcccacatcctgttctgtcttcttttgctttattgttattaaatactttcctgtcctaaatcttgaattctgacatatttttgcatggctttaaggttatatttgactttaacatgatttttatatattttttacttatttttggtaatacttcatacattcattgtgcagcattttgaatgggaaaaagagataatcactttttctcttctttattccttcgaattttcattatttccctcaatttataaatctttataacttaggctttctcccctttctttttcgcaattgggttatgttttcacatcctgggtctagcttggtacaggggtagtcagagggctgtgacttcagggaagcagaagcctcctcctcttcgcattctcctcaatatccataactgttgcttggcgcgttggcccagaggggtgaggtaggaacacctatctgaacacttccctttctttcctcttctgccttccatgatcgctcaagctgagggattcagctttcaggtttccaccacttttacatcataccgtcctttctgctactcaaaagtaccaaagagtggaggtggagggaagagccctatgtcatttagaaagaagttccattatcttttgcttctctctgcttcatttccctcgatttgattattttttataccttcaatcttgctcttttagtcacatcccttcttgttttttgtatttttcatttgatttaaaagagtgttttcttagcatattcttacaacttgtgctgtaaaattttattcaaagattatcatgaatattaggaagaaaaccagataaattctaaaccatttttctgtcttcaagtataaaactaatattcagatattagtttggggatttttcacaatgttacaaagctagtgagtagccctaatggagctagaacctaggtctgctatatccagtcctttctttctattatagcactaaaactcttgcagctgaatgttagagaagactcatatgcttctttacagaaaatttaagtatttttttttaacaatggttgacctgattcagagatggaaatgtaaataattggatgtaataagtagggaataatgtgggataagattaagtggaaaggcggaagctggattgtgaggggccctgaatgacaatctgaggtagcgcattgtcctgcgtagatagtgggggagatgataaagaaggaaattagtgttattaaagtctatgtttcaggcactaactattgtgaatcaagtattttattaaagaacaccgagtatatatgtaacacgcggtgctgataaagagtatttgggttgtcaccagcatgcatgttgaattggactctagcagctgtttcaacagtccacacattaaatgataaggagttggagtggaaagatggtggaagaggagatagaattggcaaataatagaatactagtgatcaagaggagggagacataaagggtgaattcacaatgttagcagcagaggatgagatgcaagtaatctatttcttttaagcaagagcaaaataaaaatctcataatttttagttggatttgacagaataatcctcacaacttatctggaaaaattaacaagcaaggaaatcaaatgacattttccaataagttaataaaaggtagacttatctcaattaagtttcaacaaattttagaaaggaaatagaactgagacaaccttaaattatctctgaaggagtacatacacaccgaccagtcatacacctcagcacatgttttaaaaactagaggggcctcacacaacagcaaggaaaggtaaacagtcatcaaaggcatctggaaacaggattaatgacttggaaggaaacaagaaattgttagcattcctgttgccatatatttaaataaattataggtgattttgaaaataaatacaaagaatcaaggtagagaaaataaagagcatttccttattgaaatgatacatcatatttattttagaaaaattagataatatagaaaaatgtaggcaaggaggaaaaaaagtttctaccagaaggaaccagtgttaatgttttggcagattttcttccatattattctttcctatcttagttgacttattattacatatcattttatattcaacgtaagtattttttcaggtataggagtttatgccaactgccgtagaaaataatcctctgaatctccgtggcttgacatagtaaggccatctgtcactcatctgtcagtccagtgggtcatggacaggcctctgctccaggcagtcactcagggacctaagttactttgattcttttcctgaatcctctcctgtatccttttcccatacatgtgggaggagaacatgtaggctaatcattatgagggacgtttatggtcccagactagaggttccattcttcactttcatctactttttgttgatcggaaatcagccaatcacatagccatgaataacttcaaagaaggctgggaaatacagtccagctgtgtacctcaaaggaaaagggaaatggtctgaacagtgagtctttcccacactagttattagaacccccttattaacatcatttttttttattattatactttaagttttagggtacatgtgcacattgtgcaggttagttacatatgtatacatatgccatgctggtgtgctgcacccactaactggtcatctagcattacgtatatctcccaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatgatttgcaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgcgatggctgggtcaaatggtatttctagttctagatccctgaggaatcgccacactgacttccacaatggttgaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcttgttcactctgatggtagtttcttttgctgtgcagaagctcttgagttgaattagatcccatttgtcaattttgtcttttgttgccattgcttttggtgttttagacatgaagtccttgcccatgcctatgtcctgaatggtattgcctaggttttcttctagggtttttatggtttgaggtctagcatttaagtctttaatccatcttgaattgatttttgtataaggtataaggaagggatccagtttcagctttctacatatggctagccagctttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcatgatattgattcttcctacctatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctagcctcataaaatgagttagggaggattccctctttttctgttgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattatctagtttatttgcatagaggtgtttgtagtattctctgatggtagtttgtatttctgtgggatcggtggtgatatcccctttatcatattttattgcatctattagatttttctctctttttttctttattagtcttgctagcagtctatcaattttgttgaacctttcaaaaaaccagctcctggattcattaattttttgaaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtatctttgttctcgttggtttcaaagaacatctttatttctgccttcatttcgttatgtatccagtagtcattcaggagcaggttgttcagtttccatgtagttgagcggttttgagtgagattcttaattctgagttctagtttgattgcactgtggtctgagagatagtttgttataatctctgttcttttacatttgctgaggagagctttacttccaagtatgtggtcaattttagaataggtgtggtgtggtgctgaaaaaaatgtatattctgttgatttggggtggagagttctgtagatgtctattaggtccgcttggtgcagagctgagttcaattcctgggtatccttgttgactttctatctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcagcccctgcctttttttgttttccatttgcttggtagatcttcctccatccttttattttgagcctgtgtgtgtctctggacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccagttgttcctttccatgtttagtgcttccttcaggagctcttttagggcagtcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttggctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttctagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgcgttttagagtttcccgtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaaccagcgagactccgtgggcgtaggaccctccgagccaggtgcgggatataatctcatggtgcgccgttttttaagccggtccgaaaagcgcaatattcgggtgggagtgaccccattttccaggtgagtccgtcacccctctctgactccgaaggggaactccctgaccccttgcgcttcccaagtgaggcaatgcctcgccctgcttcggctcgcgcatggtgcgcgcacccactgacctgtgcccactttctggcactccctagtgagatgaacccggtacctccgatggaaatgcagaaatcacccgtcttctgcgtcgctcacgctgggagctgtagaccggagctgttcctattgcgccatcttggctcctcccttaacatcatttttgaggctacataacattcagtgacctgggtgaatcttcaattacataagcattcccttttgttgaatgtaatatttttataagctgtcaccattacaaattagtggttttcatttcttattgatcacaatccttcattgtctgctgttaaacatcttaaaatggttatttcttatattttctccagtattatagttatttatataacatgaaggctagttctgtaccagttactccatcatggctagaagcagaagtccactatgcttttattattattttttagggtactgttttacctcatccttgtgtaagtagttttgtttattaatccaatgtgagtctgcctagtattagagagtcataaagctgatgtgctttttgtcaaataatctcgtatcttaggttctagaggaaatgatgtaaataaaggtaaactatgtgaaaagtttcatttttataatgaaatgtcgaaagcagcccaaatagccacaataggtaatagttaattaaataataataaattcacttgatgagatataattttgcagactagcaatgcagtaaaaatacttcagacaaaatactaggttaaaaaacaaacaaacaaaaccccactgaccccattgtatatgcaacggtacgttccaaaattaaacctaaataaaacatactcacatgtccaaaccgtgagcaagaatcccccaggcttgcaaaattcattgcagtgtggcaacaagtatcatcaatttttttttcttttttttttttggtgggaaggattttcataccttttggtaaagtttgttgtatatataattaaaactcgtgtttactggacagataaaatatttgctaaaaaatttcaagtatacacagttttagacatttcttgtatatattggtcattagaacctcctgtgatcaatgtccatttagctaaactttgacttttcttcattgtctcaagaaaatgttgcttgctgtcacctttaatatttctaacaccacatcactgcagacgtcatgccagttctcctgctcagaagcttaggactttagcctatatgatctgcttagcttcattaaaagtattttcttgaatcacatgtttacagtttcatagaaatgttttaatttacctccagctgttaaaattaattgccagtttgcatcattcaatctctgaattttcatttgtatgttatcatacactacctaatgttttgtatcctgtgttttactaaatatcaccttatgatcatttcccagcatcattagagagttgctgtgtttaacattagtgttctcagggtagcaaatgccaagacaagattaaacatgcaggaaaagtaggagggtaaggcggagaggaggaagggagccagtgacagggtgggggagccggcagacctaggtgcgggtctgaccccagcgaaggggagggaaggaaggaagctggacggaaacactgtggcctgcactgcgtctctaaggggagctgggcagggctgtcaggggcccttagagccacagtggcctgtcagaggatcctgcatctccaggagggggcctgctttcctagccctgccagactcagtcaccgctgggagcagccccagggagcacaacttcacaggaacacggtagattttacagtgcagagcttggtccagggtcagttacattccctgcagtcagagatacgggaagtgcattctcatagcccccacactttgtaaaaatctttagtgcacctatgcacctaccattctatcttaaagctataccatattacaagtaattcttctgagtaagccagaaactcagaatcttccttgacaacattctgtctctcttacctccatagccaaaccatcaccaggccaaatgaatttggtctctcccatctctcttagctctgacactttatattcatctttagtaggagactctaataatcacccatccccacatcgtatcctgcctttttagatcacccgtgccaccctccagtggctgttttatcatattgccagagtaatttaggacagaaggcaccaccatatttatccctacccctttcatccacttttggctttttgtagccttttgggtggtgtgaaataatcttggcaattcctgtagtgcttcagttcacattatgctccccactgttgtctgtgctccgcacactgtccactgtgctccccacactgtgatgctccccatgctgaccgctgctctccacactgaccactgtgctccccacactgtccactgtgctccccacattgctgtgctccccacactgactgccgtgctcctcatgctgactgccatgctccccacactgcccactgtgctccccacactgtgatgccccccacactgccgtgctcctcacgctgactgccgtgctcctcatgctgactgccatgctccccacactgcccactgtgctccccacactgtccactgtgctccccacactgtgatgctccccacactgactccagagcttcacacactgaccaccttacgggtccacactagccagctatatcctcccacttcagccatactttcaacacacttccttcttcctagactggtccttcacaccctcttcatcaaagtcatttacacacagctttaaggccacagcttgagagaactttattcaaggatccttccttgacactctgttgaagtcatattccttgcatgtgacctcttgcaggcccacatttctcatcttttagtgtttattgtaacttcagtttccccttttttgggatttttatgttactatagtttgtaatactcgatactttgctatgaggacagtgccttctgtttatttttgctcagcaataacatctagtatgtgtgtattgttgaatggataaggggcctcagtataaaggtgtaagctgagatacaggtatgggaacagttacagttggaggtatacgaatggacgtggtccccaaggtaaaaagggcaggaaggaagcatcacccgaggtgaacacatgtgtcctgcattcacttagggaagatagagcatgtttgaaggcacaaaggggccaacagcagcatgcattgcaagattcacagtagttctgaataacctgaacaaggagctactaggggcagggctcaggaggaggatagaagtggaaagaaacctgaccatcaagtattttatatacatgttgagtgatctggactttatatcaaaggctagtgagaagccctgaaaggttttaaggaggaagaggcctgagcagatttgcctttcagaaagatcattccatcaggaatagggaagagaaattggagggggcagaccagagccaagaagcccccaagttgctccttagtgaccccggcaggagtgaggacagcgggagctacagtgtcgggaaagggaagctctagagggtgcagcggcagagttatcaccgagctggaggctgcggcccaggagaggacagaacgcaggaggcacagctccaagggatggagcccaagaggggcctctggatttggcaagcattcaaatctcaactttctctgtgagcaacagacaaacttcaccttcttcaaaatagcaccagcaaggaaacacaatgacttctttaccttttaccgaaatgtgtccttcagctttaggagcagcagtcaggaaaggaaaagagaacatctatctgactagctggccaggaaaacacagcctctgatcagtgcaccatggtgggcacagacaatagactcatgttcaaaatatcacacgaggtcttgcacactccttctagatgaacagatgaaatcggatccagaaatctactatgggcttagaataagcactttgccctgtgacaagatatcaagtaaagctttatcaaactacatagaattctttccagttttgaaattaaggtagctacctttattctttcaaagacttccttaagcccatttttatgaagaagagggaacttttgaaacaccttatttccattctttgtgattttacttaggattcatggatggtagttctgttgccttagtataatttaaggcttatttcatgtgaaatcaattggataataatcacttactgagtgatctgaatatacactatatgccaggcactggcctagatgacagaaatgcagatacttcatacaaaattgtctttgccttctgaatttcagtgatttggggaaaagaatgcacatgtgaggtctgtgtatataaaatacacaatcagagcagatctagaaatccaagtgctatggaaacacaaaggagagagcaactttaggggaaagcgagagatttgcaacagagatgttgaaaactgaattgatgccaaatggtaactaaaggtttaccagagaaacacaagagaagggctgggggcagaggaagcagggtttcaggcaagagaaacagtgtttaccgtaacacgaaaagaccaaagaagttgacattattggggaacaagtgagcaatttagtacattggcgtgcaaaaagagtgaagggatggttaaaaagaaaaaaggaccctttaagacagtcgttaagctttaattaatcacacacatgtaaaggagtggggaatatcacacaagcagacaagtccgtgtgcaataagacgagcacggagacaggggagagagaaaagaacaggaaaggtgaaagcatcttgagcttctgcagctatagtcagctccctgtttgctccactgatgtgaagaatgcatgccccattcccagtgcctgctgctgagaaagtcacgtgcagtgcagtgagcaggctgaccaattgccaaacagtgcaccccccaggggaatgctgcagagccctaaatgataaccagctgatatgggtgatctgctcaggctttttgtgcttgtctgagattggaggacttataacagaatagttcctgtctgtatccattttgaggcttactcttcttgaattgctgtatttactttttatatctttctaaaagtacagagattattgaaaactacaatttagtatttgcaattattaaaatcatagtggcaaattagactataacttgtaagttttcgatttttgaaatatctaaatattaagatagatttaaaatatctcaaagagaaaaggcatgctgtttgccatttgacagtaaatagtcgctaatcaatattctcacattttaatgctcagcagattctgacaacttgactagtaatgagttaatatattgttttttataacttcattaataagaagtttgtagggtagcatatttctatctcaactatccccaaaatgctgtttctaaggtcatgctcagttctaagaatccataaatgtgcatgtgaatagaatcacaaagcagcagcatgaaaacttatatttaggggaaatgtttgctgattccaactttcaatgagttttatttgggaattttacagataatatctttaatcaagtgcatggtctatgatctgtcaatctcatgtgtgtaagtaaaatcaaagttcatcagatctgtattaaacaacttatttgtgttcataaaatatgtgtagctttatagtgagtcttgttggctttctaatgtgatagagtaggcatgcatagattaaaactatgatatagtgaaatatataattggtcttcagcccatttcctggcatagggctcctaaaatccttagaatctccaaaatgatatccttttttatgcaaataaatcaacagatggcagaggtagcttcagaaaggagctggtcactagaaagaccaaagcatgactagagtgttggaactttcagccctacccctgaacccagggaggggagaggggctgagggttaagttgatggccaatgcacaatggtttaatcaatcatgactatgtaatgaagccttcataaacccacaaaaggacagggctcagggagctcggaatagctcagcatgtgtaggttcctggagggtggatcacctggagagggcggggaagctccacaccctttcccccatatcttgccctatccatctcttcatctgtattttgtgtaatatccttgataataaaccagtaaacttaagtgtttcccttagtgctgtgagctactctagcaaattaaccaaactaaagagggagttgaggaaactccagcttgaagctggttggtcagaaattctggaggccgagacttgcaaatggtgtctgggggagggaggagacagtcttgcgggcctgagcccccagcccaagggatcggatgccatctccaggtgaacagtgtcaggactgaatcctaggacacccagctggcatttactacagaattgattgttgcctattggtggggaaatcccccacacatttggccacagcattttctgtgttgactgcggcggcagtggggtgagagcggaggaaaatgctttgatttttccctaacaaggaccaatctgatagatccccacctgccactgaacctcctggtgagcacgtgtccagctgcggctggtagattgtgattcacagggaggtccacttaataaatgcccagctctctctcctgtcctctcctgtctccttgcctcccttctgcaccctggccacagcttccccagctcggctcctgctgtctcttcacccacactatgatctccttcattcccacacacgttctcttctctagaggactgaccttcaaaataactcattcacatttatcccaaaagaattctgaaaaatggtagtctcttagagatctttattctggcatctaaaatgcatgtttatcatagttgcaagcaatgtaatttctagtgaaatacaaatattgacatttaaaaataaaattatttttttcactctgttaattgtatccagccagttcttagtaccattagggatctgattctcaccatcagtcattttaaaaatacatgaatttgcttttctttaattgccagatttttatgttgttcttttatcccccttgaaactgtattttcatttcactctcctctcagaatgttttcctaatgtaactttttattctgaaaattattattgattattatatgatatgtaaattaatttaaacattaaaaaatttcccataaccatgtgtccaagaatttaaatatatttaaaatgtgtatttatacatagacaccactttgaaatggtgtccatctacctatcttatgtaagagagtgaaaagtatagaaggaaaaagaaagaaaagagaaaagaaaagaaaggaagggagaaaggaagggaggaaggaaggaagggaaaagagaaaagaaaagggagggagggagggagggaggaaggaaggaaggaaggaaggaaggaaggaaagatggaaagctccatcctggataaattttgtcattagaagtattactaatgcataactttcagaacacctgttgttaaccagcaggcttgtccacaagtaaatctgaaccatgatgactctagaacccagggcttgatccttctccgtctcagaggggctacaattcaatccagtttttttgtgatcagcttcccccagaactggtgattgcctccatctgactagagtagggtggggtttaagtattcctatgcgtccagggtcctcaattctgggcatctttctcagacaactcccagaaggaactggcaccagcactactgacccccgggggccagggtgctgccagcagcagaacccccagcgcaggctgagaggctaagacgcgcttctgtgggatggggagcctccttctcctgcgggactgtggaatttgtcctgaaccctggcaggtagagaccacaaagggacctaccttgcatgaaaaacatagatgtattacaaattgtgataggtgatttttaagcataaaagtaacattttgtatgaaattcatctcttgatagtccaggcttttgttttcaattggtccatacatgtggctgaatactaatttattgttagataaaatgaggcccagcattaatttcgagcctatgttttattttatagaaggaagcacaagaaagccctgttataataaagcagatgtgaatgaaaggaattttaacaatgtgactcaattctttgaacttatcctgagaattatatgccaacaatcacatagcaattcattaatcaataattctttttagtgatctcatcactgataaactgtcgggtctgccttcaattttcttgaaagccaaaaactagaaactgcctgacttacaacaggatttgctgcccagccgtcaaagccattccccttctcaacaccgtcaccaacatgatttcaaacggagcctgtggcctggtgacctggggccttgcagccagagacagtgaactgtcaggtttgggatggatgagagatttccttcttttgtaaagcggcagaactattgtgaaaggggagtagagaaaagagaacaccaggggctttcctgagcagatcatcactttcagaaaagagtacactgaacgtttaaaatctggaaattgaactccttaaaattatttgcatttgggtgctccttggaaagcctttgtatgccaaagctttgtgtacccagtataaaaatctctgctccagaatggcttgatctccttggagatcaggcagaaaattctgtcttttgcttttctttgcaatacctggttgaaccactgacttaccgtacgttttaactttcctgatatcctaccattatgtgttactatcagcctcgaatcatcctttcttattattttattcacagaactgtggtgttctcagtccttgtagccaatcttcttgtttttatcacagccttaataagacagaaagaaatatgcatacaaagctatactaccagataacacaggaacagaaaaccaaataccacatgttctcccttataagtgggagctaaatgataagaacttatgatcacaaaggcggaaacaacacacactgaacttagcatctgggggatgtaacagtatgtacaacaaacgcccatgatgcgtgtttgtctatgtaacaaaccttcacatgtacccctaaacctaaaataaacattttttaaaaagctatactaccagatatgaaaccttgggcaaagtacttaacctctttctaagtcttggtttccttgtttgtatctatgtatctacctcatagggttgtcatttattataaagatgaaataagaccatatattcttgaacttagaatattgttgggtccatgctaggtataaatattaactattattattaatatcattagtatcattatacatttaaaatctctaacatattctatggtcaacagttgaaggaaatatattactaatctatgtccataaattttacttcccacatattttgacttaaactatagtttttattttgtatttgccttatatatttagttctcattaacctgctagttctgggagaaggagaccattttctttctgttttttttttttttaattgaatgattttgttttattcatctttattttcttgactatatatagtatcctgcgcatagtaagcattcagtaatgtttgtggaattaaattttgtcaaagcacacattttttatttgtgaaagtccatgagtagctaatgatctattaaactgggaacagaaacttctacctgcatagttccacaaaagaaaaccatctgtgtgtttgtttaaccagtagaattgaaagatgttttgactttgctccaggaattagagttccatgtgacctccagataatgctgtctgacacataatcaggcctcatagagaaggaattaaaaagcaagcattacagatcctacattattattattattttttggtttgagactgactttatttctctccaaaaagaaattaaagcaaatatttgtgtatgcagttttaaaacctatatttgttttgatagatggtgtaactgacattcattggtatgtacgcatgagagtatgactaaaaaggcctctgtacggctagttataaacctttcagtttagtctgtggctgtaccagctaggcctactatgaattgtgtttgattctgacttcacctaaatgagcctgatgacacgtgtgaaaagccccacttcgctggttttagcacagctgtcccttcagcagaccgtgacttgccattgaatttcacatgggtagtccctttggaggtgcacagagtccgaaaagcgtttcttccgcccttcctcttatcaccgtatccttgcgctcttcctagagcagccgctgcagcagcatcgcttctacgctgtgccctgcgagcgcgcctggcttggtcgctgctgaagtggctgaatcttaggagcagaggactccccacgcagtctcatgtgaaccatgattccttcgttcactcccagccctgctgttaactagctgtgtgatcttgagcaagctgttgctgccttctcagactcggcgtaagctggagataatgcccagcgctgacacctggtagagctgttgtaaggattaggtggaggagtgcctgtaaaacacttagcaccctatctggcacacaaaaagaacacagtacatgatgatcgtgttataattgtgatttatgacactgatgaaattagtaggaaaagtggtctctgtcagcccttcaggacttcagtttagactaattcctaatcttatagacactcttcttttttgcgtatcagagatgtaagtattgtaaatgtgtcttaaattatatcttattatctgatgaaggaattattatagccatctgtcttaaactgttattctaagaaaaaaaaatggagaaagaagaaatacagagtgagggacttaaaaatattgaaatggctttcaaaataaaataatcccaaaatatggtacgagacaacagagagatcagagaagcaaatagccaggaagaagctctcctgtcaatttgaatgtaacttatgacaagggacatgggaatagatacccccaatcgtcccagcggtgtgtgttcccaccccagcttcccagcgccccaactccctgcttctgggacgtttagtcatgttttctccactggagatgcctccatagggcgtagcagttcctggagcacagtggacactgggtgggagacaggtgatttaactggccttccttgggcaccagtgaacagatgttgttgctagtcagttatggccccttctcacggagtccgggttcaggttctgcccctcatttctcagacagcgtcccaggccacctccacccatgccggactttatgccttccttgaccgggagggccacttatccttgttcaggtccaaagctgcgagttttggttttgttgttgttgttgttattgttgtgtttagagacttggtctggctctgtcacccaggctggagtgcagtggtgtgattacagctcaatgcggcctcgaacttctaggatcaaaagagatcctcccacctcagcctcccgagtagctgggactacagtagtgtgccaccatgcctggtaattttttaaattttttgtagagatagggtctcactcttttgtccagtctggtcttgaactcctggcctcaagctatcttcccacttcggcctcccaaagtgctgggattataggcatgagccaccgcacctggcctaaaactgcattgtgcatatagccgtggaagtgctgaattgtattgttatcgggtactttaatagtgatacattcaaccggctgtgtggccttgggagagtcatttcaacatgatgaaggtccaagcccaggagatgatcagagaatcatcccgagtctcctgcagccctggagcatcttctggtagcaaataatctaaacaggtatcttaataggtgagcggcacgtctcgaagaaaaaaatctctccacacaaatggtaaaggtcttgaaggagcaccagatctgtagcgtgtgcagcaccacacttttcatatatgatgtgattagtgtaaataagtagttgattttgcttcataagtcaaatgatgattcttttacaaatagccgtttgaataattctttacacctgctacttagccatagttttgctggaaggattgagttttcttctgaagacacagcactactctgaagcttatttccccctgaattttgtttttcccatttttggctgagaaggcatctggagtgactccagcgggtttacctaggttttccctgaagaggtttaggtgattagacaataacagaaggaaaagtagagttgccagtaggtggctcactatgaatgtgcttgggacgggatcagacatgtcacccctcctccacttagcctttgttttcaatccctgctgctttgagcctttttctataatgtctgagtcatttgcagcggggtgggtaaagaggggagaaagaagaaagcaagcaagcaacagcctttgagctccggaatagcaaaggcccccatcttgctccgagagttcacagagtatagcccagtccgagttctcttttccacgcacacttgcttgttcttttgttccttgtgtccttggcaaagactgaaagaactaagcctggaatacttgggccctcccgtgtcacttaagaaataataagccattgtcctcattaagccacccttgttttagcaaatagaatccagataccggagagggaacattttgaagggaggcagaattagagtagagatgctttacaaaattccctagagaaactgctttgtttctcctattttattgctccttactgagaagattcatattcaaatgggttggggttgtgaatagcggcttgcacattctcatgcacccaggaaggctatgattatggctaattacaatgaagaatgaagctctaacaagagtgttccatcagattgtcattcatgcatgaagtaacttaggctggccaatggaggtgtgattttggtaattacaaacaatgtggctatttgaaaaatgcttagtaaatctgttcaagacaaaataaggtctaattaatcactttagctctgaattctccagatgatccatttgctctgtttttttttttttaatttaaggtctctttaataaactagatctaagatataaaatatgttctcgttgcccacacttaaatgcaactgtgttacctgtttcaaaggcttcttaattctgccaatcatgttgcaacctgcttttaatgcaacttgacagaaggcttttaaaaataaatgtgtgtatattcttgttgttacctgacaagaaaatggtttatgaaaagttactgtaaaacattaactattaatttagaagccatattggtatcatcattgtgctgacatatattaactcttgaatattcggtgaatgttgtgtttagcacttaagtaatgtctaactatatgtattagtttgttttcacactgctataaagaactacctgagactgcataatttctaaacaaaagagttttaatttactcacagttccacatggcgggggaggcctcaggaaacttaacaatcacggtggaaggcaaaggggaagcaaggcatatcttacatggcagcaggagagagatagagaaggcggaagtgccacacttttaaaccatcagatctcatgagaactcactcgctattatgagaacagcatgggggagctgcccccatgatccagtcatctcccaccaagtccctcctttgacccatgggtataacaattcaagatgagatttgggtggggacacagagccaaaccaatcactatattataggggagaaaaagtaatatattttccttacctatcacaaggttcgtggctgagaaccttagagcaaaggacagagtaacaagagaaaaacatcacatttatttaatagaggttatgtgacatgggagccttcagaaatggagacccaaagaaacagagatgtgtgtacttttatggacaggcatgcagaagtaagactggaggatgaaatggcatgctccaatcggtacaaactgggggcaactcagggagacctgattgcccagtttcttctccgtgttcctgagtgacattccttccctcctggtatagggcagtactcctgtcacatgaggtcttcagggaagaagtgaggccgcaggtcaaagagtggccttccctgcggtcatggcctgtttcagggaagaaggggtggagggaattctagtttccatgcctacttcaggagacagaggacaggaaaagtcacagagaccctcctgcttctgcggcgttttccattttcttgagcttaaaacagtacacaaaggtgctatattttggagtatcatgttctgaaccccaaaaatattctaccttaaataattggaggcctccatgaaggcacaatgatgacataggaacttatgcctctctatcattttttttttcagtagatgattgaagcgaagctgttttatgcttgtctcttttcccgtttgccatttttgtacctttgttctctcacctaaaaatagactaataaatggccagagttgttgcaagaaatgtacaatgataaaaacatctaattattggttttaaatgcatcaatcttcaatttcttttaaatgtctactagaatgaaatctgcccaactatctgaggagctttgttatttttaacttatttggtttctatacatgaacccaaaggaactaccttttcctaattgaattagcagggctagaaattcaactcagcacacgtttaactgaggagtatcagggttcagaacacgctaccccaaaatgtgacacctcggaggtcactctctcaccttctccctccctcctttccttcatcttcctttctcccctgaggaggttcatagaaaccaaaatttctctttgccaaagcaaaccataaaacctagaaaggccactttctgaccttctcctttctcccctgaagaccctcaagtgataggtgtcttgccctgaacagaaaggccaagaagaagctaaacaaataagccttgcagagtcccctcagtttagtacattaggtcgtaccccctttttgtccagtcacatttctatacaactgtacatttttcctggaacctatgcaaaaaaattacatagtttttcctgggtctttgggtcttaatttcagaaggcaccttcctgtgtcacagaaaacttttgttacataaatttttttatgcttttctcttgttaatccgccttctgttatagtagtctccgccatgactcttgtagctggtgaggaaaaggtattattttttctcccctacaagagtaatggattttacaactttgactgttatactttctaaaaaatgggtttagcagggaggtgggggtgggggagagagaaggaagacacaaaaaaagactagtttttatacagatattttcttattttaactaatttatatcatctataaagggaagcaaatattaacgttattagtttcctcaagaggataactaaagaaaacattcttgtaacaggggaagaagtaattccatacctattgtatctatagagctgtgcatttcatgtctctaaaatggagtaatttaaagttaaaaggcctcttctagtagttttcaccaaatgaattttatatatactgaagacagataaaataaaaatggtacagaaaaacgggagttttagagtcttgtttcaattctttagaaagtaagttgtctagcagaacatgccaacttggttgcctaagagcaatgtaaacttgagtcccactcgccatgttgaattattcttgtttctatttagcaagtggtctggagtctttgatctgcaatgtgtgtagttaaaatcattgtggctattattttatctgcccaaaatacagattttctaggatttgacagtataaagcatttgctttaataagttgagatttaatatttaatggtttctctcaaattcctgattggtcaatgtattgttgccaatttgtaaatttttatcaaaggtacaaatttgaaatgttttgctgtatatcatggaagagaagccatgattatgttccctaagcaagttacggaggcttagagtggataattattctctccttgtcctggtactgcctttgaagaatttccatgttgagggtaagagaagatggtttaaaaacctgatgaatttaggtagttgcttgagagaatgagtaaagtccattttttccctgattaaaattaagtctgttagttgcttttttgctcaccaaacacatcaatacagatgcagataaggtgaggcctcttcctgtaaatcagctgtcaaggcctatcggggagaaaaacaatggacaaggaggcaaactgcttctcatgaaggctgtgcgcttcttgtttgcaagaagaatatttatgggcttcacagctggcagcaaagaacatttaaatatataacttcatacacatgcaaagcattttgtagattaaatcagctcgaagtgtagaacctgagagggttaatagaatttcttggtaaccatttaataaaattaatgtgctattagtctgatgtcttaattcaattggctgatatatattcccagttttcactcataggtgagccttagaaaaagttagtaaagattgttttaagattgccaattttctaagaatgggaatacaataaaatgtaggtaatcaaaatattgaatctttgatctaggatctgttaggatagcaataataggtgcatatataatgtcttgtatattcctcaaatttttattatttcctttaacttccaaaattaagaaactgccagaaaagtatggcaggtgttcttagctacctatcaaagcgaaagcaactgagaccctgagtgaagtcgtcaacacaaggagcaccacagagggaacgtggaagctctaagcaaaacccacctccctctgcctcaccacccacctctcattatacacatctatttccatcgcatcgtggagatgcagaggtgctggcagaaagtcttgggtacttaactgttggataaatcttttactgaatctcttaaagttatgctcactataattgttggtgaaatcactttagatctctgttgtaaagctctctaaatttcctcttccattggtgttcatagtttatgacctgtcccactgagatgctactaagggagtctgcacagagtgggatttctgtatctgctacggtctgggtatttctgtatccactagggtctgggtatttctgtgtctgctaaggtctcagcatttttgtatccactaaggtcttggcatttctgtgtcagctgagatctttggttttaggcgacagaactcctctctgtctggcttgaccacacgttggtcagaaagaggctgtactgtgctccctctaggacagtccacgggaactcagaggactgaggaggtgactcaaaagtttggaaggtgtttcaagatttagaaggcaggattcaggtagccccagagagtcttgggaatgaattccaattcccccttgtaccacctttcacgagactccggattataggggcgaaggagaaagacgggcaaagcttctgtcatgtcattacactgggaagtgagagggaagtgctggctgaacctcttgggaccccctgtatactctgtggtgggggagaggggaagcgtctttgtttaccccctcaatactttatacagcagaagaaaggagatgcctgaaaaggcaacggggatgcatttaggaagaagcaattgatgctaggcacacaagaaatgctgcaacatctaagttgtacctgaagcagaatttcaatttaatgtgccatgtcaaggtggccacagagccatctttataaactgggagtatccacatattccagactcagagagcaaagatccaggactagtacagaaagtcactccgtataactggaaaagcttgcttgtctgctttcagatacgtttctcaaccctcatccataacacgatgctgtaaaccctagagtaagacagagataaagcatgtgctgggatgaagagagccactttggggaagtgccaccacatcccaggctgcaaggcatctctctctgctgcttgtgcagactggctggggtgagctttggagctggtctcatctcgaaggcaggcgctgctgaggcctctgtgcccttttgcctgggttagatttggcttcaaaattaatttgaaatcatttaatcttgctactctcagcaggtcagtgattaacaggaaattcagtgcccatgttggtcctgtttatgagcccaagtctatgtcataagtaaaaacaggcttaaacacatcaggaaactactcagtatagagtggaaaaagcctgggctgggcttccactcaagggccctgcacacactgcatccacaggccctgagggcagcccctgggcttcagccgtctgcgtgcactcttgtctagtaccgtgcctgatgtgggctatgtgctctactggtatttgttgagcacatcatcaagttactacgtgaataaacatcacttatctgggtcttggtttcccccatttgtaaaaccagagagttgggctaggaaacttttgagtccctccagcgcagtgattgatgtataacataatcagcaatgttgaactttgaagagaatacaagccttatgttgtcactgatatatttcagaacaccttgttactatttgtaaggatgtttgagaacatgtgggcaaatgcatctattttttcttccctaaaaggtaaacttgtctcctttacaaccaaacaaaagaggatggcactgcatagcagaggctaagctacaggctgggtaccactgagcagtggagtaacccaagtttaaacttgaaaccacatttgtgcaataagcaaaagcttcacatttatagaacatcgatgctgcggcacagcaggctactttcatatgtgttatttcattaaatccttaaaacttcaatgtcgtatgtatgtattatttaataaataaggaaccacagactcagagagtttacttaatttgcctaaggtcacagaggtaataaatggataaaaccaagatttgaatataggtctgaataaattattcatgctctcatacctacctatttaatgttatggagttgtctacctttctgcttcatttttctttatatttttactctacatgatccttattttgaggccttccattgcttgttctccttctcttgattcctgcattatttcctttccaacatgtgctttgatgcatctgttttctctatggagccaaggaattttccatcctctcagttttatgggaagatacagaaattctctactcattgagtcccaatgacaatctaattatttctaaatctcaccgtccaataattatctttttaagctcttcctctccctctgaattgtgtggtgtgttccctgttgacatttgattaaggctttgcccatgctgcttgaataaaaatatttatatttcaaaatttctgactgccaattatccatattttgatgcttaatgtccataatatcacaatttgacatgaaagatattcttaaaaatcattttattatagccacagagtagagttggaaaaataactctaggataaacaaatacatacttattcattccatacctgcttgatgacctactatgtgccaggccttattctaggtgctcacacatagcacctagaattctgttgatcctgggagtttaacgataggcaaatagaagtacaatgagacagatgacagatgttctttcttcctgcctgtctacctacttgtccatccatcaatcttcatgagaaaatggactcaagattttgaaaacctcaaaatgcttccttttgttctagcccttgctttcacgtttaaatgaactctcagtgttgtatatatattttagaaagtttaattttcactaaaataaactttcagtctctacaagtgttgacatttaactccaagaatactttagttggttggaaaatcatttctggtaaagacttcattgtagagaggagacttctccacctctgattactcctacaccttgactgagtactgactacatgtactagacgtttgttgtgagcaagtttcatatactattttattgtgttcccactactgacctataaagtatgtgctattatattttgtttcatttcctgtccaaagaatatttttttaaccaaagaatccagtagaaatgcctttagacttacatagtgattgttaggagaatgatctatagctgttcggagtttgcagaacctcgagtgaatctttcaccaattactaaatgttaaccgaacatttgtgaacatgtgtaatatactccctctaggacgggataaaacctcaagaaacctaggaaaatggccaaattcttgctctggactgcggctctcaatgataattggcatatactggttatttaagacctcacagctgctctggtctgaatgctatttgagatataaaattgtgggctatgtatgcaatctgccttggctcccataaaattaagaagtttaattattaatgtatatgagtatgttgagaaaatgatatagttccactgactatgatagtcttgctgtattacctgctgttttaggatatagggatacagcatcttaatataattgacagtaagccttctcattgtaaattaatctgagtgcttcacattgaaacatgattcttttttaatgtatatattaagtttcgactacatggatgccttttaaactttctaaagaagattttaaaaagcttagactgtagctattcagatttataattccactcaactctgctatatgatcctgaaaatgtttaagtacattacatataacttaaattatttaaaagtttattttacacttcttgaagactaagaactccttgaatttatttcacaaaaggcttatcttctccagaataaatttaacttgcctcatgtaattagcattcagaaaggctcgaattaactggaacatagctaaatagaacctttaatttactagattttttttttctttttgctctacttttagagcttgaaatcattggaaaacaaacaaaatagcaaagatttgttttaaaaatcagcctccaaggttagtgctagggtcagtaaatagctagccaagttttcatattacaaacctatatagttatgatttatttaaaatgatgaaccagagatacccatgttttctaatgcatgaaagaaatattacagaaatattaaatatgttatttgctggggtgaaaaaataagctaatagatgttgagaatattttcagcaatgaaagattgaagcagaattgatttcctagttatcactctgaaaaccaagaaattaaatgaacccaaactcatttttaccagagcattctaattaatcaaatggattaacaaatgcatgagtgagggatgaaaaatacttgtgggagaaaaacagaggtgatacttttggtgagagaaattgctcatgtaaaataattttaaaggaagttacacatttattgaatgcagcatatagagtcctgtgcttccggtctttaccaactaatctcccctaggccctaccgtcacccatcccttttccagaaatcttctaaaaacatctccttcttctccaattactctttattataatatttatgattaaagtctggcaacatttatgtgccaggtactatccttactgacatagaaaccctatgagccatagagctcgctcttttgctataacttcttagagttttctgcacttcagatttcgccacttcagatatttcattattccatgtttatttcaagagaggtttaccaaatacacagaagaaaaaaaaaaatctctaaactagaatgctgatttccaattcccctgtttcaactagttactgactttcctacttccaaaacagtttgagggaacttaaaagacacagttacaataaaagcctaaacagaaaagaaagcaggatggagaaagagaattctatcagagtaatcatgctaagaaaagcaaagtgcacccaaccgaaccaaaagataccagagatactcatgacaggaaacttgacaagctccactgtgcatgtttgattaaaggaagtaaatcagtgcatcaggaaagccaaacattttctcttgactaaacttcaagaggtgtttcctctgtggttctttgtctcagagtttgtccatgataggcatggagaaatatttgttgcatggtaaataataaatataagtgatacttagctgataaccagggtccacagcgggaaagactgggcaataggtctccactccttgtcctgcttccactgtgaagttacctttgccagcggctcagtaccaaatgctcaattgcccctgagaagtgtcacctgaatgctccccagtcttctagcccactgaccttggcacccaattaaaacagcttgatccctcctctcacatactatcagaagcctcaggaccctaccttgtgttttgttattttgggttttgttttattctatttttgtttttattccaaactcttgctgtgggaccttcttggatatctctccatccctgttgccatttctccctccacatctctggtaacagatgtgagacttcttggacatcactgtgggaaacacagtggccttcatcccctgcaccctggcttcctgaagggctgtgctggcttctcctccagggtccctaccttgaagccgcttcaggttcctctgtattatgcagagcaaggggactctcctctctccgctcccagactattcaaaaggcccgccatctttgccttattaaaatgtgcattgagatattttccaaacgaaaagaactatccgcaagaaaaatgtatttctcctccagcaactggcccgaactgaaatgagattttaaaatattttctccctgtgacacagacacaccttgatgaaccaggtggctaccctctagggtcctgggaacatctcccagtcagaacaggcccggttttctccagcaagagaagatggttctctaaggagccctcgtcctagaaggcagcgtcgtagagggaaagaaccaggcctggagccaggccgacgttggtttaattcttttctctataacccattactttgctgctggctcttggacgattctcagaacttttcagagcctcacttttctcatcaataaaagggagagaagaaagcttagctttgtattgcaggcgccatttacccttcagggtgacttctcttatgacttttcttattccagacccttttgcattttaagctggatctctcactgaataaggagagggttgcttcaaaggattttcagacacctttgaacaggcagcagagatgcctttgcacatggccttggtgactaggataggatacacggtgttcctagatccagcctggaactagaggcgataggccgccctgaaaggccaatgggctttcaaggtggacagccgtggttttaaatcctggccttttccccgctattactagagcgaccatcagacttttttgacctcagttttgtctctttaaaatggaacaagaattatctaacagacagaattacatcttttagattgtcgtgaggaaagcgcttcccatagtgctgggtagactgggagcgctgggagctgtggcaggccagccgccgcagcacagtggtgagatgcgcggtccacagtcgttcccccttgggagttgttctcccctgaggaacagaggatagggactctgtctgagtgcctggagaggaccccttgctctggcattgagtttcttccagccccgccccatgcaggtgagatccctactcacagcctagggcgcacccgagccgccagagcacagcctcctttccggctcatcacctgcttcctgcgggaggagaatacgcaactccttcgccatgcacatgcgcacagggtctgccgcgggatgccctgtctttcctgtagatggggaattgtttgggattgttacacaatcacaaaccaacactgaatcctactgaaaaaggacacaggctctttgaactctgcactagaacctaaaaccaaattccttttagacctgttctaggaggactacgttaacctgatagctgctgacacagggcagcatgcctaaagctcctaagttagactggtaggtaccgttaattattcctcgttacatcacgcaggtacacagagggacgatgacatgtgcatcctctgctcagaattgcttctgtgctgctggtgacgatggcttcatgggtctttacagaatgtagaggaagagaacagcaaagatttgctggggtttgccactgaatagcagcaaaggcaaatcccaaataacagtggatgtatttcattatcagtaaaatgaaggggctgggctagggcggctccaagatccctctggctcagaacgttccttgatactttgattccatctatgtaacatagcctgaaagtcttagcatgttttctgagattatcccagtagaataccttgtctgcaaaaggctgaaatttattatttgggaataataaatcagaacaaaaaaagatgtagagtccacggtatattattagttttgagtgtactaatccttattttatgagatttaatttttgaaatgtttacctttccattcagactattgtcaggaaaaaaagcgtgatttttgtgttcagggaagaggtaggcaagggactaatgaatatgtgctttgcccttgctctgataaatgctgtagttataaaaagtcgtggcaggttatgggggcccttttgtttaccatgataaaattaataccttacaagttttcaaaggagtttgtaagacgttacagatttatttttaatataatttcagagttggaaagctagacagttggaagtagtgcttggaaagcctgattcttgataaattcattatcaataataccatgtgcagaataaaattacaatttcagcaaagaatattcttccataacattttattattactgtgaaactaattaaacattgtaatctgcaagtaattaaaaatttacctgaaaatatactatgagccctgttgacagtacatggagcattttgtgcgattatttaatgtctgctattttttcttggttgctctattaggaaattgtagtctatatggttttataaaaaggaggcaaattatagactaatggagctagaagactcattaaaagatgatctgcccctgggagattgggtgtcctctttgaaaggcttctgagatggaatggagacattcctgggagcccctcctgggtttggtaccgtggaaatccaggtgactgtcactctattcactattatgtgtccctgcgttccttaagcacattttcacagatgtatttttcacatgcagggaatgcatacaaagcaactagcacactgcttaatgattaccaagcgttcaatgaagagaatcattctactagtattattctttgtgcatggattattacaatactctaacttttttaacttttcactcagagggatattccaatgagactttttattataactcctcattcacttaccagtgtgatttcttgctaccacacgtacatttcttcttttttaaaattcttatttccataggtttttggggaacaggtggtgtttggctacatgagtaaggtctttagtggtgatttgtgagattttggtgcacccatcacccaagcagtacacactgaacccagttcgtagtctgttattcctgacccccttcccatgctttcctcctgagtccccaaagtccactgtggcattcttatgcctttgcgtcctcatagcttagctcccacttatgaatgagaacatatacatttcttctaaatgtgctctggtttatccatatattattggaaataaagccaccacaactgatatcttactttatgagtgtttcttatggggtagaaatttctgatataataaaggccaaagttgtaacatatttattacctttacttcagccagactcacaaaaatagctgcgttgatagctctctcctgatctctaatctcttccttcctccctccttctcttgtttcttttctttcatgcattgaaaattgactggggcaccattttcaatgctggaatatgactgtgaacaaaagtaaaggcctgtggtatcatagaatgttaagttttgggagtgggaaatgacaattagttatttaatcaaggaaaggcataattccaaaaaatgtcaattgctatgagaaaattaaaacgaggtgatgtgggggtggtaacatactctagatgggttagtcagaaaaggctttgtaaacattgtaactgtgctccttttaggaatttcttaatatttatcaataaaagtatgcaatcatacttttgtattttatttttattaagtttgataaataggtgatgtttatataaggcacatatattttatgaagttatagtttgaatgtgattaccattttaaatagcaaagatctgttagttctggtacaaggtatttccccaaggtcttacagaaatgtaaagggttgatactattctgagtgcatataaaacttttaaaactgaagaacattgtttagcactatacaaactatagcaataatttaagatctgccatagtggccttcttctgtgcctcagagaacttggaaatcatcagtagcttatgctaacataaaaatacattaaccatgagttacacattctcatatatatgttttcaaataccagcaatcatttcattaaaaataaaacaagcacttccacttatcttaaagactacttctcggctgggcgcggtggctcacgcctgtaatcccagcactttgggaggccgaggcgggcggatcacgaggtcaggaaatcgagaccatcctggctaacatggtgaaaccctgtctctactaaaaatacaaaaaattagctgggcgtggtagcaggcgcctgtagtcccagctactcgggaggctgaggcaggagaatggcgtgaacctgggaggcggagcttgcagtgagctgagatgtgccactgcactccagcctgggtgacagagccagactccgtctcaaaaaaaaacaaaaacaaaaacaaaacaaaacaaaaaaaaacaaaagactactttctcaatagaatattttaaattcttccaaacactgtaagatatgttttaagattaactaccattttttagctgaattaattttgattctaacaataactacaaaatgtgacattatgttttccatcttatagataaggaggctcaagaacagagagggaagttcagagcttgccaaaaccacagtcatgagagattttaaggaggtggactcatagccagggcttctaactccagatgccctaagttctctatgagagctcagtgctcagtgtcattggaagacagtagacagcggtattgttaggttgactaaaatctggaggaaattggtcacttgataaatgtaattttaaaatatcttcattctgtaaatagattaatacttctaaataaatcttatctctagcagttgagtattagaatgctgtattataaacttacgccaacaaaaattaatgatgttgaattgagaaacaagaaagaagatatttaaatgtatcattaccccacttacttttgtctataagaaattgctcatttccagatttttctttcctactcaagccagccttttggctttctaaaaaataaatacataattagaaaattagaaattagaaacttccctaaaaattgtaataaaacttgtacagattatagaaaacgttcacaggaaagaagagggagggagggaggtaatttctataattggattatttttgtaaaaccttttcaagaaaaattgcaggtccagacacccacattgtcctagcaactaccttggttcccaccatcccaccgctgctcaaggcacccccacctttattctgaactgagtgatttccaagcacagtttgcataaagagacatgaatagagtttcagggaatgagcgctcataggtagtgcaatactttattatctcttataattatactgattttagcttcaaggcctgactgatatcactaggtatcagaatctcaattttattagtacattaaaaaaattactcagttaagaagtaaaagttacaaaaaccagtttaatgtgtaatacagccatttacagtgcacatgtaagcctaacccagatgccagagatgaacgcttagcttgggctttctgcctaatatgtttttccctggaactacaggtattatttatacgtatgagatgtggttatcaagaaataaataagaatactaaattccaagagtagtttggtttttctgtttgtgtgtgtgtgtgtgtgtgtttaggtaactggggtacgtttctggcttgccacatcttcctcagtacctacaatagtgccctgtccatcatagattcctaataaaatacagattgactcattaatggtaggtcacatgtcattattttctcaattttagtggtaggagttatttctttctaaacctttactttcatttactcaacacatatgtgtctgtcttagcactgaatctattgctgtaggtcagcaagacattttaaaattgttcttgaaagaatgctatgaaattatgtaatctggtcaaagtaggaaagcataaaattggcaaaatgtccaaagcaaagcccatactgtaaaaatcatgtcctgatgtcactggaagttgttttgggcatgaaaccagcaatgaagcaaaccaggatgaccctcttagagcccaactagatcctaaatgtcattaaagtcactaaagcactttaccactaaatgtggtaaagattcctttggaaactagctagcttgaaaaaccaattcggcaccaaaactttcagtgactcacatcttatcatcaggccagcttaaaattaatttgatatgctaccctgacactaggcatgaaaagaaaataagattagccagtacatttttgcctaccattcagcaacaaatggaagagccaaataactgcgcattcactcttagattccttgtaactcaagttatcttcttttcaataaacgaaaccaagctacaaacagattttattgcttacaagtgagcagcgcttctgattgtgcacttccatgtcagacctcacattaacaatagtgattatttcagaaatgtgcataaactcaatattggaatgaattgttttacaattgttttgtattccaaaccagacagatcaggcaaaaacatgagggagttaaaaaaaaaaaaatatatatatatatatgtatatatatgctcagatgaaggctagggtatcaaatagttgagtttttttgtaactttacttcctcccctccaaattctgagatggcttaaagaacttttattaataagacaaactattttaatctttcccttcaaactttagctgccgatttgcctaccagtttgtgacttggaatgtccttattttttttatatcatttagggttttgggctagggcttaggtgcctggatccacactcatccatcttccttcttagagtgatagccaggggtctgttcacaggagggcaagaaaccagtggcaaacagaatgccagccaattcaccagactgggaaatgcctagtcagcttcaaagccagatctcctgggaggtcgcagatggaagcacgtgacctgcaccacaaggctgtttgcctctttccctcaaatctctgcctgatggacaccccccaatgtggcgattagattttatcacatcagtgtggggggaggccagtcagaatcatccacaagtaccagggcacagagagaggaaatgaggcatggctcctacatgcatagacacacatgcattcacacacttacatatacattcacacactcgcacacacttattcccacatcacacacaaagtcacattcatacgactcgcacacattcacactcacattcacatcattcacacagattctcacactcacacacccattaacacacttacataaacattcacacagttacacattcatatacacacacacatacactcacacagtcacatgcctccggtcacacacatttacacacattcatacgcccacatacattcatacacatgtatgtattcacacatatgtatattcacacatgctttcacactcacacatgcattcacaccctcacacattcattcatgtgctcacacacatttgcacactcacacatacatagtcatgcacattcacacgcagacattcacacacagatgcacacacagacattcatacacattcacacacacatccacgcacattcacacacacacatgcacacacagacatgcacagacattcacacacagacatgcacacacagtcatccacacacattcacacacacacatgcacacacagacatgcacagacattcacacacagacatgcacacacagtcatgcacacacattcacacacattcatacacagacattcacacacagaaattcacacacagacattcccacacagtcatgcacacacattcacacacaggcattcatacacagacattcacacacacatgcttccttcacctgcaccatctgtgtagtatggtgtttagacatcctccatcttttctcgttaaacattttaaaaactcttagccaaaagtggctgaaagaaatatcatctttattattctgtaagtttttgtttcacataggttgtacattaaccacttgtccttttcctctaagtaacatacagtctatgtccaaggctggttttcccccaaaaattctgctgcaataattgtgtccttgacttggggtcacattacaacattaaatgcatggagttatcaacctggcattccactaatgctccaagttttatgtttaaatagtcttcattagttgtatttccagggaggtcttcttcctccagtatgatcttctaaatgcttactgaccattcagtcttggaaataatttttctttctatttccctggagcttgaactcatgtgtctatctccagttgttctacatcatgcttgtctgaagtgaacagagatgagaaggaaaatgtttatacatttccttccctagatagagccgaagattacaaaaggcctcccagctctgttccttcaccaccccctcctccatgctaaaaccatgcatgcttcccgggtatcactgttctcatgtgggtgcagccatctggagggtagcgtttcaatattcatggtcaccatcatagggggttcctctccaaagaaagcaatgacaagtggaacctcattgtaggtggatttgagggagactttacactactgtgaagctttcttctgacaaggaggaggtcaagagtgggaagggaggccaaggccacaagattccactggaaaccatcactctcttcctgctgtcctctaataatacaggagagaatatggcatcagcaactgccagcaggatccctgggagatcttttctctctttattgtttacatgatatcactttaatattcaggaggctttgatttgcatttctctaattaccagtgatgatgagcttttcttcatgtttgatggccgcataaatgccttcttttgagaagtgtctgttcatatcttttgcccactttttgttggggttgtttgtttcttcttgtaaatttgtttaagtaccttgtagattctggatattagtcctttgtcagatggatagattgcaaaaattttctcccattctgtaggttgcctgttcactctgatgatagtttcttttgctgtgcagaagctctttagtttaattaaatcccatttgtcaactttggcttttgttgccattgcttttggtgttttagtcatgaagtctttgcccacacctttgtcctgaatggtattgcctaggttttcctctagggattttatggttttaagtcttacatttaagtctttaatccatcttgagttaatttttgtataaggtgtaaggaaggggtccacgccagttagaataaagtcaggaaacaacagaggctggagaggatgtggagaaataggaacacttttacactgttggtgggagtgtaaattagttcaactgtggtgaaagacagtgtggcgattcctcaaggatctagaaccagaaataccatttgacccagcaatcccattactggatatatacacaagaattataaatcattctactataaagacacatgcacacgtaagtttattgcagcactatttacaatagcaaagacttggaaccaacccaactgcccatcagcgatagactagataaagaaaatgtggcacatatacactgtggaatactatgcagccataaaaaagaatgagttcatgtcctttgcagggacatggatgaagccagaaaccatcattctcagcaaactaacacaggaacagaaaaccaagcaccacatgttctcactcagaagtgggagttgaacaatgagaacaaatggatacagggagaagaacatcacacaccagggcctgttgggaggttgggggctaggggagggatagcattgggagaaatacctaatgtagatgatgggttgatgggtgcagcaaaccaccatgacacatgtatacctatgtaacaaacctgcacgttctgcacatgtatcccagaacttaaaatataataataaaaaaaagaaaaaaaaaaggaaaatattttccaaaataaaaaaatgtttaagaagaggaaaaaaaattcaggaggcttcagtcagatgtggacttactgggaccaaatatataagacatgttttatatctgatagaaatgttttagggaagacatagtgcaacgttccttggttcagaaatggcatccctcttcttgtcctgcccagaagagtcaatatgcctataacatatcagaagggattttgctttccattaaaaaagtagattcatggtctttccctttatagaattatagttaccaatgaacaagttcctatccccaaactattagatagcaacggtcaccatggtaactaagttgagtgctatgaattatttcttacaacattatttttggagctttacctaaggttatagatagtttcacttaactgggtaaatactaaatttagaatatacctgtgaattataaatagtatgagcaaaaagcataataatattagtagattaaaattctgagacttttttatattaggggaattggaataataactttaaatgtttgtaagatgcaagtgtaagtgtgagatgcaagtgtaaagtgtaagatgcaatatcacaattcacatttttacaacataattaaaaattgacattatgacacagaaatgagatattaaattataacaacagtttttaaaagtcatgtatgtgaataagaaaattattttaaacttaatttttaatgtttcttcactaagtaaaaaaacacaccaatgtagctgtcttgataatgaattcttttttgaataaagtaataatgagaaacattttaacaaataaaatctattttacttttttagagtgtttgatgctgttacaaatattgaatagactgaatctttttctcatctgtgcctgcctatctctgtgtataatgagattgttacttggattcaaagagtgacatcagcaagatggccaactagagccacctgatgctcattcccccaacaaaaggagaccaaaacaacagatggttacccatgttatacattaagcttttaaaaaatagtactagggaaatttgagattgttctaggcctttgagtttggaaatagagctgacacataagggacaaatttaaaaatcctctgatttccccaatatgttgtttctagcggtagtttaccgtgatttgtagtatgttaagatgaatgtatatgcataagccccatgttattctaaatctgaatggagtgaataactatggtgacaagtttaaagatgtcttgcttttcttagtttatcttctagaaatattattgctattatagaatggctctttgtatgtaataatacaatttcagtactacttaaatttttattcactaaatattaccttttctgtaatatgtattgtaattgcatacaaaggaggaatctcatggtgtttcaatacagtctaaatgccttccttgcctttaaaaagcttctcagtttatatgatggtcctcaaaaattaaccccccatgtaattctctatcaaatcacaagaacaatatcaagcttcatgtaaaatatattataaaatccatactttattgccaattgtgcacgaagagacatagcccactttaaccttcattaacagtctatagttctctgttctatagaaatcgtcctttaatgaagggaaaaaatagcacaaaaggtaacacagtaaaactatccatgtaactccccttcttgctcaagaaattcagttttaaaagttaattatctattgggcaaaaagtaacattgccaccatgtgatttttggcccagttggcctggtattcatgactctgtctagacacccagactcttatgtttaggaatcattgaggggggcaggggacagttggtgctaaaactgatctattctgttcatctacactgatatagatgtaccatatacagatttttaaatcaatccaatgtaggacataagaagttaatctagcaaaggttttactcagtggttagggtaaataggaggcttcattcattaattcattccttcaacaagtatttattgaacacctgctgtgggccaggccccgagctggccgtgcagataggacagtgagtaagacagagagcaggtttcagtcttccaggagatgaggctgactgtgggtgcccaagcagccttccagggctgtccagtgaattcaagagggcagggaacgtgagggagttactccttcttcaaggagaagtagctggtatatctataaggatttcctgatatatctacaaaacacctctctcaaaaagcatctgtgagaatgtgtgaggggatatattttttaggtacttagcagagcacctggcatgtggtaagtaccgggcagtctccttttacttctgtgtcgaggtcaaaccacaccttggaaccagagagaggctgagcacaggggagaaaacagacatgtaaatgggggtcctccaacacccccttctgtggaaatgaatttcagccagcaggcctgtactggaaagaggaaaggtctgatcttctgccctttagttgcagctcggtttgttgtccctgtataaaatgtagcaacggtaagaaatgtcggatttcaatacagtatggcaaacatttatttaacatctgtcacataaaagactgttgcttacttgggaatttgtggatgatgttgccaggcccctcactggaatctacatgagagaatgatcacttacgtggcattggtttttgatagattcacttaggacctttgttagatgtattgcaactctagcatgtatttctgcttattatagaaagagcaaaggaacaacaacaacaaaacagggcctatcacaaaatatactgcagaagaatgagttccttgtagtgttttgaatatctgaggtagatggtggcatgcagtcaaggttctgtgtatttgtgaacaaaaatagaaaaatataacgcttcatatctttcaggcaacactaagttatatatagtaagatcagccatgactattaaacaagaatgctttagaaaagataaaatgaaaatttatattccttttagaataaaacatatcttaaatttctataaactgttgtgcctcatacgtattacaaaaataagcagtaaaaaataaattgcacctacctgaaatcatcttccgagataccctaaaactacacatcgctttcatctgactgtggctgcacgtgggcaaggctacattgcacaccagccagatccaccttgtgtagcaaagcatgcgccaggggtgcatcgttcagggcgtggcagctgcactgcattagatgtgctggatgtgtgcacagagccacgctctgtctgtacatttacatctacagaaagacacagatcgtcacgatcttctgtagatgtgcatgtcattgtcctggtcttggtagttgctaacagtgatgctggcaatggtatcagggaataaaactggactgaatgagcctgtgtatggaccacaggctcagccagcctcagtgcatatacttcattctttggattttgcctattggaagtgtttataaactttaaacgacctggcagttttggctgagagccttactccaggggctgcctgatggttgtcttcaaaatgagcaaactttcaatgatgactgctccttaatgaacctgttttcctttggggctgtaaatgaggcctagctttcatgtctaagtcctacatgcacccacgcaaaaggtagatgtttatttttttaaaactgtattaatgtccccaatccggtgggaaatttaaattagaagggcagagagatgagtgtcaatgctccagcaactacatgtgaataaggtattaaagtgtgtttccaatcatcatgttcaagagatttgcaaagaggtgcacttgtggatgttcacatggctgaagaaacacagggagcactcttcaccaaactggagacccgggggcactctccaccaagaccagagacccaggggtgctctccaccaagaccagagacctgggggaattcttcaccaagaccagagacccagggacactctccaacaataccagagactgggggtgggggggtgcactctccaccaagaccagagacagtggggtgctctccacaaagaacagagatccgggaggctctccccaccaaggttagagaccctggggtgctttccaccaagaccagagactggggcagggtgcgctctccaccaagaccagagaccagggggcgctctccaccaagaacagagatctgaggcctctctccaccaagatcggagaccacagggtcctctccaccaagaccagagatgggtgggggggggcactcttccactaaggacagagaccctggggcactctccaccaagaacagagaccaaggggtgatctctaccaagaccagagacccgggggcgctctccaccaagaccagagactcggggtgggggggcgcactctccaccaagaacagagaccaaggggtgatctctaccaagaccagagacccgggggcgctctccaccaagaccagagactgggggtgggggggcgcactctccaccaagaccagagacagtggggtgctttccaccaagaatacagatccagggggctctctccaccaaggttggagaccctggggtgctctccaccaagaccagagacccgggggccctctccaccatgaccagagacccggaggcactgtccaccaataccagagacctggggcaccgtccaccaagatcagtgacccaagggtgctctccaccaagaacagagacccaggggctctctctaccaagactatagatggatggagtcagtggcaagtctgtggtaaattcttggatgtaagaattacaaaatgccttggacatgtgggaaaattataagaggaagagtgtgtagacctcaggggctctttacatttgtcaccttgagtgaacaaagctcacctcctgggtatggaccctgaggagtaggcaagctgggttctgatgagactcgactctgaacatcacacctggagaaaaccattctctgcatccagggccttgtccaggtcatttctatgcatcccccaactccatcccaccaacatgtctttggatttcaaactaacccgactgtccaggaagccttttctgaccttcgtgaattatttccattgtgctcactcgcgtcttccccactttagcaggcttaccctgaagtgttatttcccaaaccttcagaaaccctgactagatcattttgaagatggggcattagcatttgtgtgaatgcttagcaaacaatggaaaccctcagccaggcttgagctgtgctctctgcgctctgaccctcactggcaggggcacctcgagttccactccctgttgcatcatcagccttggagcagtgtctgacaatatgtattcagttattatttactaaatgaaactaatttttaaatgattaaaaatcagaattaaagtctatgtttcattctgtcactaccaggtttttttttttagctgactaccaatttgttagatttttttaaaaatgtgatttcacataattataaaggcatatttactgatgttacgtaaactgtctggcacatgaaatatccaggaaagagttttcctttcagctctcatgacacagcttgttggggcccgctgcctatttagctggcctctaattaatttattagatttttaaagtgtgatttcacataattacaaagacatatttgctgatgacgtaccaaatatctggtacattacaaatgtccaataaatgtaagttcccctttcattcctctcatggcatggatcattcagtctgcttatttacatagtgttcacaatgttaacaagtttagacagtggttttatatttattaccctctttttaatcacatctttaattttatcggtttttaaaatattttccagtctcagggcaagtccagtacatatgatttatattcagcaggagcaaacatcaagtggttcagaaggcatcaaacgatttttcaaaaactgtgtgtgtgtgtgtgtgtgtgtgtgtgtgtatgtatgtatatatctgcatacacacatacagttgactcttgaacaatgcaggggttaggggcacacagtcagaaatccacattccacatagaacttttgagtcccccaaaatttaactactaataccctactgttgcctgaaagtttcaccaataacataggcaggtgattgacacatagactgctctctacatatatgcattcataacatatttaacttttgttttgtttcgttattttgagacagggtctcactctgtcacccaagctggagtgtaatgtgcaatcgtagcttaccgaagccttgacctcctgggctcaagcgatcctcccacctcaacctcccgcctaagtcccccaagtagctgagactacgggcctgccaccacacctggctaatttttgtagagatggtgtttcaccacgttgcccagactgtccttgaaatcctgggctcaagtgatctgcctgccttggcctcccaaagtgctgggatgacaggagtgagccattgcaccctgcactttttgttatttttttccccaatatttctaggctagaaggttcatctataagttttttcaaactgtaacaaatcaccaagaaattttccagtatgtttattgaaaaaaatccttgtataagtggaccagggcagttcaaatttgtgttgttcaagggtccactgtctgcataaaaatacatatatacatgcacacaagtgtaaatgatagatatagacagtaaattacaaagcaaattgggtaaaatgttaacagtaggtaaatctgggtaaagggtgaatgggatatggatattatctcaactatttttgtaaatatgaaattatttcctaacaaatttttttaaaaaaattaagcaacttatgactacttcatgaattttagttacaagcagtatgtggagtaaatgctttgtactaaatttgaacacaatggtgtttatggtgaacctgaaatataaaataacagtgttaacatgtcaccgtctcttctgtggagtgatacatgtatgcctgtgtatggtggttggcatttatgtgtattttcccagctccccaatgataaacctaaaaacctctaaacctaaaagtctcagcgctaaaaatccagcaaggtcaaacaaagatttcaggggcccaagctcatctattagcataatatgaacccagcccgtgtaacgtactgaaattgtgccatgccacttacacttaaacagacagaagttctctgctctgggtctctcaatatacattttttcagcaccctgcttcactttagaggtgaagttgtgggctcaatgttacccacatcacttgcccatta

SEQ ID NO: 115 - DNA, 3289 bp, Homo sapiens
aaaacctgcaatactttttacatatgaatagcaatttacttatgtctgaaaccttagcaataactgcacagagagcatccaacagtcttaattggagttatctgattattactcacaggataccacaagctctaagaacatttactttacactgctggtgttctggtcacctcctcggtgaattcactgctccctttgcccaagtcgaacagtttctattatttgtaactttttctttgtagtgtttactgtgaagatagctgaatgtttcagccaggcttttttcttcttttacagaataatattgttcatgatcaacacagattctacagagtgtattaaaaaaatagtcatcaaaagcttgattgctcccagcagccttagatcaggcctgtgtagagaaggattgaccatgaagccgaaaggatcactgattgccaccacaccttcctcagccctgagaggggcctaggcagggtggtcacatggccatgtgttcttgtaaaattcacaaacgtgagatcgtttggccacagtcctttgttactgctgcctctttctaccctgacttcactccagcacattctcctgctgtttagaggaattggagtggggcttggcagcttcgggatctagctgggggaacattgatttggaaagacattgagtatgagtttagaatgacacattttgtggttcacgcttactgcggactgtgctgacttaccaggagttattatgtgaaggtccagggataatttctccgtaagaacgcatcccacggtgctggcagcagacccacgagggtggtagaggagaaacaagattggaaatgtctggagtcacaggcaaatccgtggtaaaatcttggatgtgtaagaattataaaatgtataggctacctgggaaaactatgataggaaggttgtgttctcatcaataatgcagggtatattataaacgtatccatgtgttcatttattttttcatgtgaattatatgaaacatgtatcagaattttttcctttgtatgacacaatctgtagcaatttagtaagcaagcggtctgtgtgtgaaggtgaatgtcttatgccttttaatatattggaacaggtcttagtatatttgattattttgtttcaaagccatctggcaggtccaaacagcacatgtgtcattccaaaaccaataatttattatgagaaggaaatacattttaaatagaagtaatgaataggctctcaggttattagacaacttaattaatgaagagaagtggtgcatacgaacccattgggaaaatacttgaatttcttgcttccttgacaaaagttctgacatcaatgaatataatctgatctaatctgccaatgagcccctacaacaaggaactaacgataaacttgttaatgagtgtcagcaattcaaagagagtttaagattagttcctgggcaacaaaacttgaaaaacctagtattcttattgcttgcatgtgagagaaatttggaattccccaaaaaatgtgcatgatataaccaacaacaagtcatgaagctgaaagtaactttttcaaacttcagtactaaaagagaaatttagatcaactatgctgctggaaagactggattatctttctgcttttttctttataaaatgatagtcatagtttcgtattcttttttcaaagagcacccccaattgtgcaagcctcaagcctgaggaatttgcactcatcaagtacctgtgcctgatgcgttctttccagaactgaagtctcattgataggtgaggtaatgcgatcccagctggtatagagatttattcctccagggagtagacagtgaatttatccagaaatgaatgtgtatacgtaagaaaagctgttcataccaagatttacacacctatgttccattaaatgcaaaggatgtggtttcatttgataatcgcttctggttgccatcttggtaacgttacactgaggtgctggagaggtctgtagccatttagggtcttaccttcaactattctgtgtatctgttatcagggaatttcttcatttcacgctgagcaccagtgctgtattagtgagtggggtgtatagtttgttggcatgcacggacttctggtcctataagcttcaggctgcagaaagggtttagccctggaccattctgggatgcgtcgtcaaggctggtgcttctgcgggaggcagggcactcagggctttcatgctgcaatgggggagtcccatggaagccagaacgaggtggtcaccctgatgtgaaggaatctgcagaggcaggaagagccctgaagctagctccacgttcccctgtccatgtctacattcacagacactttcccaactctccaggagaagcagtgcagaacgttctggaaagagagtgaagttttgccctcctaagactaggtttctgatgaaagtaggaccactgaactgtaggcagctacaggatagggcctgtctgttcttcaccagtgtagcctcagccgcgagcacagtgtggagctgctcacagataatgaagacagatggtgctaagcggaatctcctctctgctgagtgggttgctgtagtggaagaagcactgaagagtcccaagcgtaggttgaactccttgagtatgtcctgagagactggggcagcctgagtctctgcgcgcaccagcctttacactgaagtgagattctatgtaagaatataccttgtctaccggaatgcaccacaggactggatattgttatggtaaaatattttagtaaaggaaaaataatgcctaaatacatatagcctttcagaaattttcacacaatggaagtgctgtggtgattatgaacacaggctctggagcgatattccctgagttcaatcctggatctatctgttatcagctgtgtgaccttgggcaagttgcttaatctctctgtgtctattttttcatctgcaagtgaggataatcatagaacctacctcacagggatattgtaagaattaaatgagttcacacaaatacaggacttaaagagtgtctgtcacttaggaagcacacaataaatattagctattatcgttatggtcttcgttttactttattgatgcctaaagtaattttgaactaaaaattgtgattaaaattttgttttgtttcagagatttggaattactgtctaaatccaccaaatcttgataaaatattacagggaaaatagaagtttgggtaatgtccctatttcattatttagtatctagacacattatttaac

SEQ ID NO: 116 - DNA, 2812 bp, Homo sapiens
aggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagaga

SEQ ID NO: 117 - DNA, 2366 bp, Homo sapiens
cctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaa

SEQ ID NO: 118 - DNA, 85963 bp, Homo sapiens
aaaaatatgttttcccaataaatcccagaaattaagaaaatataagcctgtggctcaccatattcctctccacccaccctggtggggagggggctcagcatctacatggatgatgtagccagcactgcctctcagttccgtataacctgagctaccacacccaggacgctgtcactacctagaattgccccttctttgaaatcatacatttcagttatctatgaccacaatcttctaccattttcagcttttccccctccaaatactctcaagaaatctgaataaactctggaacccctaacagttcctttcatctacttctcttcctctccagcttggatttcaaggtccaataccaataccaaggtcaactgccaatatctgcaattcctttgctaacatccttccacttgtcaagacttcaccctgggtgaccccaaatgtctgccttctctgtacttatatccaaattgatctacaccaggtgttggcaaactttctttaaaagtcagatggtaaatattttaggctttcaggaccaactactcatctctgtcactgcagtgttaaagcagtcatagacaacaaatgaacatattgtaactgctcaccaggttcttcctgcctgctgcacaaacaaaatcaattcacaaaaaccatggcattgtagtaaagagtttaactgatgcaaggctggccaggccaagtgcgagatgggatttattaatattactctaatcaacctccttgaagtcttgtaggtttggggtttttcaaaggtagtttgggggaaggggtgggagtggttagatgatgaatagatgcttgctattgattggttgggggtgcaatcataagggtgtggggaatggtcctcttgtgcactaagccacttctgggtggggccacaggggcagttggcaggtccaggtggagcccctggtgtcagacatgaaaaaatcctgaaaagatatctcaaaaggccaatctcaggttctacagttgtgatgttatatgcaggagtaattggggaagttatatatcttgtgcctccggaataatggctggcaatcatttatgtctctttatttatttatttatgagaccaggttatgagactggctaatttttgtatttttggtagagatggggttttgccatgttgcccaggctggtctcgaactcctgagctcaagcaatccaccctccttggcttcccaaagtgttgggattacaggtgtgagccactgctgggcctatgttttagcagaattcaggcttgtctcctcctcctagtctggtggtctctcattagctttacaaaggtggttgagttttggagaagggctattatcatttaaactataaatggctgggggcagtggctcacccctgtaatcccagtactttgggaggccgaggcaggcggatcacttgaggtcaggagtttgagacaagcctggccaacatggtgaaactccgtctctacttaaaatataaaaattagctgggcgtggtggcaggcgcctgtaatcccagctatatgagaggctgaggcaggagaatcgcttgaacccgggaggcagaggttgcagtgagctaagatcacgccactacactacagcctgggcaacggagcaaaactctgtctcaaaaataaataaataaataaataaataaataaacaaatacatacataaaataaaaaaaatagagtattaactaaatgtcttccaaagttagcttggccaaagcccagcaataattaaggcagcttgaaggctaaaggcaagagggggtggtggctagatcagatctcccctactgccacagttttctcactgatataagttttgcaaaggcagtttcaatatttgtgtccaaaacctactttatttacaaaaaaaggccatgagccagacttgcccatgagcccagacttagccaatcccttgctctcctcaggtaaaaaatcttataattagggcagtgtgacatcaccataaaagattattcatttcctctggatttcagtaatgactgccagtcccactatatttcacttgtattcttctctgcagtattcctcagctatttcaaatcttctccacaaatataccaactcagtcacaacaggtaatttgatcttttatttcaaggagaaaataggaggcagtcaatcagaatttccttaatgtcttaccaacaaacctacaaacacatttgcttccacttatcctttttccttcttcactcctgttatcatagaaacatgattctttttttttttttttttgagatggagtcgctctgttgcccaggctggtgtgcagtggcacgatcttggctcactgcaacctccgcctcccgggttcaagcgattctcctgtgtcagcctcccgagtagctgggactacaggtgcccgccaccatgcccggctaatttttgtatttttagtagagatgaggtttcaccatattggccaggctggtcttgagattcctccccatttttaatgtcaatccccctacttgtgttcagattcccttcagcactgtcagaaatctcaccctatagattatcttctgggtatctataacctctgtccccactggctcattcccaacagcactacaagtgaaagtctttttcatcttaacaccgcttccctaagacaaaaaaaacaaagagcattttcgccctacattctccctaatctttcctcctcttcaaatccaaactttggctatctctaattccttatctcccacgtatttctcaactaattgcaatcttatttttatcgcactactgtaaatcacactattcttccaatattaccaatatgttcctcatctgatttaatctgtcagtagcattcaacacaattgattactcccatcctctttaaagcaatcttttacaggcttccattgtatcatatattcctgattttcctctttctctccttggctacatcttttcatcacctttagcagactttgctttcatttttctgtcctatttatctttgtcttcatggtcttgttctatgtactcctttcaaatgccacttgtatgttatgggttaagtatcccttatccaaagtaactgggaccagaaatgtttcagagttcagatttttttttttttggtttggaaggtttgcattatacttacaaggttgagcattacaaatctagaactcaaaaaatttcaaattttgaacttctggattagggacactcagtacatagtgaggcacaaatctgtatattcagtgtagacctcactcctgaattctgggtatgtatagatcgattcctggattatcttcatttggatttcctgtaaatccctcaaactcaacaaatcgaaaattgaactcatcattccaacccttccccatcttactaaataacaaaataacaatataatccacccaattgtcaagccagagaacctgggggtcattcatataaatacatatatatatatatatatattttttttttaaataatggctttgtcaagatacaattcacattatcatacaccttggaacccatacgaagtgtcactagtgatgctgcaagtggtaccaagaagcagagaaaagtcatgacattataaaaaaaggctgaattgcttgacatgtaccatagactgaagtgtgcagctgtggttgcccaccatttcaagataaatgagtccagcataagaaccattatgaaaaaagaaaatttgtgatgctgtcactgcagctacgccagcaggtgtgaaaaccttgtatgttttgtgaaatacctttgacctcttattgaaaatccatcttttatgtgggtgcaggattgttaacagaaaggcgtatctatatgtagactctaatatgacttttaaaaagcaaagtcagtatagtcattatatgacaatgtgaagccaaaggaaggtgaaggatctaaagctggagaattgaatgccagataaagatggtttgataatttttggaaagttttggctttaaaaaagtcaagataataggatgagaagcttctgcccaccaaaaggcagcagatgagtttccagataccattaagaaaatcatcgaggacaaaggatatctgcctgaacaagttttaaatgcagacaaaaatgccctattctgaaaaaaaaaaaaaaaaaaaaaaaaaaaaaaaaaaagccacaaaggactcttatgacatggacccttcaatgatatgggctctgaaactaaagcaaatagtggaagaaggttcagtactgtaatagaaacatttttagagaaatacagcagaacacacaaaaattacgatgtatttccatagttataccaagtgtggctgcctctccttccaaatcttacaccttttgctaccctagagacagcaaggtcaactcctcctcctcctgctccttctcctcagcctactcaatgtgaagatgatgaggataaagacctttatgatgatccacttccactgacttagtagtaaatatatttctcttcctcatgattttcttaataacattttcttttctctagcttactttattgtaacaacgcagtatataggccgggcatggtggctcacgcctgtaatcccaacactttgagaggccgaggtgggtggatcaacggaggtcaggagttccagaccagcctggccaacatggcgaaaccctgtctctactaaaaatacaaaaattagccaggcatggtgacacacgcctgtagtcccagatactcgggaggctgaggcaggagaatcacttgaactcaggacggggaggttgcagtgagctgagattgcgccactggccactgcactccagcatgggtgacagagcgagactccgtctagaaaaaaaaaaaaataataataataaaagaatacagtatgtattacatataacatacaaagttgtgttaattgactgtttatgtaatccagaaggctaccaattaacactaggctattagtagttaagcttttggggtaatcaaaaattatacatagattttcaactgtgatgggggtcagcttccctaacctccacactattcaagggttacctgtattatcataaatcaaattaatgtcatcaacgggtacatttcttgattatccagttccactgtatggtgtttttcttttttacttaccaatatcacattgccttcactagtataactttatagcaagtcttgatatctgatagtgaagtcttccaacttcactcttttgtttcaagagtgccctgctgttttgcatttccatatgaacattagaattagctagtcaattttcaaaaaaagaaatcttctaagagtctgatagaaaatgcattgattctatagatcagtttgggtagaactgatatttttatcacactgaaccttttaattcttgaacatggaataccccacatttatttaggtcttaatttctctcaataatgttctaaagttctctgtgtattcggaatagtcttgtatatttttcattaaatatattactaggtatatgatgatttttgatgctatggtaaacaatgttggttttgaaatttcattttataatcgcttgtgtttggaattcagaaatataatttaccttgtatccagcaaatttgctaaatttacttatattaattctaataatttggctatagattcttttgaattttctacgttcataatcatgtcttctgtgaatgacagtttaaatgcttcctgtccagttcctatcccttttatttcctttgctttattgcactgactaggacattcagtacaatgttgaacagaggaaataatgaggataatgcaaagggaaagctttcaacattttaccaccaaataaaatggttgctttagttttttaaaaaaatagatactttgtatcaaattaaggaatttctcttctattcctagtatgcagagaattttatttttatttttatatattttttaattatacttttaagttctagggtacatgtgacaacgtgcaggtttgttacataggtatatatgtgccatgttggtttgctgcacccattaactcatcatttacattaggtatttctcctaatgctatccctccccctacttctccacattctccccctatttctccacatactctccagcatctgttgtgtcctgactttttaataatcgccatcctaactggtgtgagatggtatcacactgtggttttgatttgcatttctctgatgacgagtgatgacgagattttttcatgtgtctgttggctgcataaatgtcttctttgagaagtgtctcttcatatgctttgcctactttttgatgggtttttttttttcttgtaaatttgtttaagttctttgtagactctggatattagccctttgtcagatgggtagattgcaaaaattttctcccattctgtaggttgcatgttcacttaatggtagtttcttttgctgtgcagaagctctttagtttaattagatcccacttgtcaattttgacttttgttgccattgcttttggtgttttagacatgaagtccttgcccatacctatgtcctgaatggtactgcctaggttttcttctggggtttttatggttttaggtctaacatttaagtctttaatccatcttgaattaatttttgtataaggtgttaaggaagggatccagtttcagctttctacatatggctagccagttttcccagcaccatttattaaatagggaatcctttccccatttcttgtttttgtcaggtttgtcaaagattggatggttgtagatgtgtggtgttatttctgaggcctctgttctgttccataggtctatatctctgttttggtaccagtaccatgctgttttgtttactgtagcctggtagtacagtttgaagtcaggtagcgtgatgcctccagctttgttcttttggcttaggattgtcttggtaatgcgggctcttttttggtttcatatgaactttaaagtagttttttccaattctgtgaagaaagtcattggtagcttaatggggatggtattcaatctataaattaccttgggcagtatggccattttcacgatattgattcttcctatccataagcatggaatgttcttccatttgtttgtgtcctcttttatttcattgagcagtggtttgtagatctccttgaagaggtccttcacatcccttgtaagttggacttctaggtatttcattctctttgtagcaattgagaatgtagtttactcatgatttgggtctctgtttgtctgttattggtatataggaatgcttgtgatttttgcatgttgattttgtatcctgagactttgctgaagttgcttatcagcttaaagagattttgggctcagacgatggggttttctagatatagaatcatgtcatctgcaaacagggagaacttgacttcctcttttcctaattgaataccctttatctctttctcttgcctgattgccctggccagaacttccaacgctatgttaaataggagtggtgagagagggcatccctgtcttgtgccagttttcaaagggaatgcttccagtttttgcccattcagtatgatattggctgtgggtttgtcataaatagcccttattattttgagatacattctatcaatacctagtttattgagagtttttggcatgaagggctgttgcattttgtcaaaggccttttctgcatctattgagataatcatgcggtttttgtcattggttctgtttatgtgatggattacgtgtattgatttgcctatattgaaccagccttgcatcccagggatgaagcccacttgatcatggtggataagctttttgatgtgctgttggattcagtctgccagtattttattgaggattttcggatcgatgttcatttgggatattggtgtaaatttctctttttttgttgtgtctctgccaggctttgttatcaggatgatgctggcctcataaaatgagttagggaggattccttctttttctattgattggaatagtttcagaaagaatggtaccagctcctctttgtacctctggtagaattcggttgtgaatccgtctggtcctggactttttttggttggtaggctattaattattgcctctatttcagaacctgttattggtctattcagagattcaacttcttcctggtttagtcttgggagggtgtgtgtgtcgaggaatttatccatttcttctagattttctagctgatttgcatagaggtgtttattgtattctctgatggtagtttgtatttctgtgggattggtggtgatattccctttatcattttttattgcgtctatttgattctcctctcttttcttcttcattagtcttgctagcagtctatcagttttgtggaccttttcaaaaaacctgctcctggattcattgattttttgaagggtttttggtgactctacttccttcagttctactctgatcttagttatttcttggcttctgctaacttttgaatttgtttgctcttgcttctctagttcttttaattgggatgttagggtgtcgattttagatctttcctgctttctcttctgggcatttagtgctataaatttccctctatatactgctttaaatgtgtcccagagattctggtacattgtgtcattgttctcattggtttcaaagaacatctttatttctgccttcatttcgttatgtacccagtagttattcaggagcaggttgttcagttcccacgcagttgtgtggttttgagttagtttcttaatcctgagttctaatttgatttcactgtggtctgagagagtttgttgtgatttgtgttcttttacatttgctgaggagtgctttacttccaactatgtggtcaattctggaataagtgcaatgtggtgctgggaagaatgtatattctgttgatttggggtggagagttctgtagatgtctattaggtctgcttagttcagagctgacttcaagtcctggatatccttgttaaccttcagtctcattgatctgtctaatgttgagagtggggtgttaaagtctcccattattattgtgtgggagtctaagtctccttgtaggtctgtatggacttgcttatgaatctgggtgctcctctattgggtgcatatatatttaggataggtagctcttcttgttgtgatccctttaccattatgtaatggccttctttgtctcttttgatctttgttggtttaaagtctgttttatcagagaccaggattgcaacccctgctttttttttgctttccatttgcttggtagatcttcctccatacttttattttgagcctatgtgtgtcagtatgcagagaatttttaaaaatgaggatgggcacagtggctcatgcttgtaatcccaacactttcagaggccaaggtgggaggatcatttgaggccagattttgacaccagcctgggcaagacagagagacactgcctctacaaaaagttaaaaaattagccggagatggtggtgcacacctgtagccttcactactttggagcctgagctgagaatcccttgagcccggagtttgaggttatagtgagttataattgcgccactgcactctagcttggggaacagggcaagactcttgtctcttaaaaaaaaaaaaaaaaaaaaggatattgacttttatttcaaaatgttcgtatctattgagatgactaatatgtagttttcccccttcattctattaacatgatgaattacattagttgatttatagatgttaaaacaaccttttttgtccactcatgatatattattctttttgtatgttgctagattctacatattaatagttgatttaggatttttgttatttatatttgtaagagacactggcttgtaattttccatataatgtccttgtaaattttgaaatcatggatatgctggccccataaaaaaagtttacaaaagttcctttttttcctcttgaagcatttgtataagattggtattatctcttttttaagtgtttagaataacttactcgtaaaggcacctaggcctggagatgtcagtcttcttctattgtctgtttttactcctaagctcatttgttggtaagcttggaagtttctgttttgagtgctagaaattatatagaaaaaattgggagagattctgcgttatgttatcctcctctagagaagatccaatctctcttttgcaggtaggagagggaagatcatatcaattcaaacataaagcttgtctgctattgtagagttctgtaataattttctactgatgcagtaaggaaagtacttactgtacttagtaagtaccacatacttagtaatttataacacaaatttattatctgtaataaatctgttctacaagttaaaattctcacataggtctcaatggattataatcaaggtgttgacaggctgcattcctttttggaggctctaggagagaatactttctccatcttccagagaccacccacatttcttggcttgtgatccccttaatccatcttcaaagctagcaattttacatttctctggccattctcccagtcaaatttaccccgtctccttctgcctcccacttccattttttaagattcttatgattacattgggcccactaggataattcagtattatctccctgtcttgaggtcaggtgattggcaaccttaattccccttcgtatgttctagagattagtacatagacatctgggagcgggacatgatgctgcctaccacaggctccatctacctcctatttgtacccattattagagtattcccctctaggtgccctaagagcctgggtgttttcctaggcccccttctacttagcaagtactgcactgcaattcttctctccagtaccatgtgactggggaaaattgctgttcttcaaatgtcttctgcttcatttcttaagtctatggtctcgcatagcttggtcagcaaatatctcaaagaaaaaaccagtgcaagatgttaggctgatttctctgcatctctcttctttctgtgatcttgaccctttaatttctggctgtcttggcagcccacattccaatttctgtctctctagctttatgaaattgactaaagtcccactcatttatctgcctcttagaagctatccaatgcctgtcttctcagtctcttgccttactttaatgacaaatgtccaaagagaaaaagagtgtgtggaaagttgaatgcatttctgtaagtgttcccctctctaggatctgattctcaattcctagatttcttggcagctttataaaaccctcaactagatgcctgtttatgctttatctagcttttctcaatggaggtgctggtttggctacaagatattccattatagtcagaagtgaaaggtcatgacattcatttaattgttaaaatatactctcattttcaatgacatgtattttaaataaatatactttattataaaaataaatctgaaataataggactattctaatgtagcaaggtcaaaaaaacacatctatttagtttgaattattagaagtatattaaatttacatttatatacacaacactgttttgttttgctcactagaatcataatatacttcatgattttattactttttagtatgtggccagttacatacattgttagtcatccctaaagcatttactcagcagttactgtacatagcactgaatttagtaatgtataagacatagtactttctttggggaagtaacaatctagaacaacaaataagacaaacaagtatgaaaatgatattataaagtagtatgagaatgtattgaaataggaatacagaaaatagtgctataaagtaaaataatggttaatatttactccagaagctgaaatcactaaactgcatgatagaactaaaagggaccttagacaccatctagtctgacactttaattttatagctgaagagacctttgctaacaaattaaatgacttatctaaagcaacaaatctcataagtggcagaatggaactagaactctggcatctacagtcttggctcaatgtaattgtaaaaaaagatgtgaccttaggagaagggaagagttgcaagggaaagggacttgaggtagggaatacaacagattcaaaacacgatcagtttagttgcagcaaagcatttgtgttgaaaactggtagaacataggattgaaggaacaagggttgatgtcatggagaacttggaatgccaggctgagtttagacaatgggaatccctagagggtttgggtagtgacatgatgaaactgctttataataagattaattctggggtagaacttagtgtagaaaatgtagaaggtaaggcagtgattttagtagtccagatgtgcagtaaaggcaaggtaaatagaaaagagaggtatgagagagtttgaagaaaggattgctaagattttatgactaaatttaatgagatgtgatcatgttcagttgggaccatgttaagtttgaagggatgacactacatttaagtatagaggtactgtagaaaagtagagacatatcagagtagagctcagagaaaagattagcactcggaatgtaaatttgaccaaatgtcatacaaactattatccattgcttgtctttactaagctacagtattaacagctttctccttcaagtttttagatcaatcaaagataaatccaattttctactttagattactagatcatagtatttttcacaaagggataataatattagctaacagtttttgagcatttactatatgctatgtactgtactaggtactttacatattttggctcatttaatcctcacaaccatactataatcattattcccatttacagatgagaaagacacacagaggtttggacatttgcccaatgtcatacagctgtcagcagcacagccaggatatgaactcaagtagtctagctcttcttaaccactgtactgctttcacatctaacatatatgacatctcagcaaataatcatactaaaatggtttaggattaaattctcctttatcctacaaagcaatctgcaaatgttttaatgtacttacttgtaatgtatttgtatcccatactttcagagttttatcaaatgagcttgatgtgaacatgccagtgtcatgaggataccactgtacagtctccacactgtatctgtgaacatcaggatgatctctacaaaacagcaatcaaaatttacattaactgacttatgtgagtttcaaaactggtactatattaagaacaagtagtagtctcaggtaggatgatatgaatggccaaaccgagatcacatgcctgtgtccaagctgtgtagaaggcgagaaagaatgtccaggcatctctagattcaggctcccactgtgtgatgtagagacatacctcctactaagggtcacaatgtgaaagattctctgtttttgtactatatacagcctggaggcatcagccaactacactggtcttctttcatcttgaaagagtgatttggtcttactggaagagacagctgttttggttttggatttgcttttccaaagtctcattctattagcactactattcttagaattattgaatgcctcacacacctccatggtattctatacaatattgcttcttatcaaggaacttattctatgaccaaagaatgcaactggtgtaggcccatgagattcacatcttatgtaacccaccatccataaaaacataacatgttgaagactctatgacgtcagctacaatacaccaccttgtgagggtggtatgctgtcctgaaggatgcagtatatgctctgaaccagtgaccaacatagtgtgttacctaactggatcttgattcaaacaaactggcttttaagagagatttatgagacgaagagggaaatttgaacacagactggatatttaatatagataatttttgtgtatttaagatagtggtactgtagttatgctcataaagtctttatcttttagagatataaataattatgaataaacgataggttgttcgagatttgcttcaacataattatgagggtggatgggtgggaggtagagatgaaacaagattggttatgatggttggtgaagctgggtgattgatacacaggtcattatacaactctccaatcttgtatatgtttgaaatttcccatagaaaacaaaagttaacagaagacttctgcaaccctatgcagatacaaccgtgatgcttttggattccttaagatgaaggtttgggaccttaaaacatttgtggtgctatctgaaggaatgagaacacaaagaaggaaagtcttaagtgccagctctggcattaaaacagctgcaaaaatacaagaactatagtgcctactcatatttcctttttttctctgtaaatattcatatattttaactaattttctctttcctctcttacctttattatttttataggttaactatatcattgagtccacaaattgtataatactgatataggataaattaaactagtggaaaaatgaacatgaccttgaaatggagccaggtgtggtaactaaatcaacttaggatcatcaccctttggggaagaggatgatcacctttttggctgtatagtgaagatttgcattaggttaggctggaacatttttttaaaaaacagtaattatgggaagaaaggtgtatacgcatgctggacagccaaatgggtggattgtagggaacatgtgcctttttttcttggctgatgagcattcaaactcctatttagaggaaatgccctttgttttactgaaaataagagctctacctcttcttacagaaagcaagggactctagacattctcttttcctaggagagttagccattattcaaagctgaggagttgagagtctgcgttggtgacatatagcaaaacccaaactaatgttcctgtggtgtgaccctgactgtgttctctatcctgacttcttttgttttctgctcattttctaagtctgattctcccatcttcctgacagttatgtgagatactaaatattcttccaataaatttcgcttaagataagcagattgatttccttttgctcctaagaatattgacttctacagagatttttccagtgatactacttttaaatgaaacaaatttttaatgtagtgataacaaataaaagctcacttatattttaagtttaaattttaaaataggatattttattatgttactatatatgttctgttattttcatttatatttaataagaattttggtagaggaaaggaatctttttagtgctcaaggacaaacacattaagtatactaatagtaagcatcagaaaatagtctaagtcacattaacttaataatagtctttattgaaattatttttaaattggattgtaaatccttcagatgtataaaatgttattataactcattttgtaaagatgcatactatatgtccattttcaaattcaaagtcacacttttaaatatagaatctgaatccaagaataaaatcacagtaaaacaagactgacacattacgcatttacttatgtcacaaaccaaaacaaagcaaatcacagttcctcacggaatattatgtagcacgtagaataggtgaaaatactattttgctatgtaacaaaataaatttaatgttaaaatgttagctaggataaaaataagataaaaatgaatttaattaattaacatgactttttttgttattgagggtgggaagagagtatatatggcctaagtctctaagttctagagtatttgaggcgatatcttgttttgtactaagtattcctgtaagtacattgcttttcacttatgcagtggtttcggttttcaacacgcttttaaaaagatagtatttcatttaattctcatagaaacgtataagaaccacagggcatgtatactgatttctaaaataaaataatgtgaagctgagattaactgattttcccaaatttgtatttctaatgcgaaacaccagagccaacaaacaatagcaaatctcctccgaaatattccatagcatatattctaatgctttgggaagagctgtaatagatagttgatgttaatgtttacaaagttttccctcttgaaagcattttctcagtgcccattctccctgttaattcaaaggtctgctcattatcagattgaatgtaggtgaagagaaaggattaaatgaccacaatggaaaaattacaatgtcacaaaacattttattagagacttaaaaaaaattatcacaagattggtaagccagtagagaacagtcagagaagacaagtattacagatgtatgtttttaagttagacatctttgagtaagtagagagacaagacaggggtgagtgggtatatgtgtatgtgtgtgtttggtgagggaataccaatatgtttagtatatctaaacctttttcttccattagtatcaggtgaaaatctaatttgtgtttataattagctgaaggactataaatgaatcttacactaagtggtactaaaaactctaattagttactgagatgtgctatgtaggtaaagaaaaagaaggacataatcacaagttttttaaaaataaaatactaatgaaaattgatactgaagttgctttggggaagacacatgttaaaaaactatacctgaatgtcagttactattttcaagaaagtgtcaaggaacagccatgcaaatgtgttatgtgaaccattcgcttgacccattcacttgactgcaattttcatgttttgcattcgatgcaaaaaatactcaactatttacaaattcataaatttttacattttaaatacatacctgccaatggaacacactgctttacatgtgtaataagattgtctgctggagttctcaaggtcataaagtacaatcacaccatctgaaccacctgataacatgctgataataaaaaagttcacattaatttatcattttatttattatttagtccatttatttatgattgcaaatttctaaaaactgatttgcaaacactcaaatgtattaaggatacattaatttataataagttaatcctcaataacacagacttcataaactaaaatttcttaatatttaatacaagaatgaatataaaaaaattcattctgtgatcatttcaagtttacttccataacttcaaaaagaaagggtgacagaaacaagacggcaaaagagatttcttaagaaagtaaaatattacaaagttattttaaatgtcctaattatgactatgctaaataaaaaaggaattagacaaaccaactattactgacacttgctatttggctctgggcaagttataccacctgtctaagactcaacatttgtaaaggagggggacatttttacctgaatcacagtgttgataataaaagtgcaaaattctttttatagtacctggcaaaaaataggggctcaataaatgttagattccttccttctcttatgaatgcattcactcaattcattcaactttaagttcctacaatgttagacactctgctaaaacaactgtcaacaaggcaggcatggttcctgtcttcgcagagtttacaatccaatagggaaaacaagtagtatgcataatcacacaaattattagttatgattgggatcactgtgacaataacttatttttattctagtttggaaattcaggagcagtttccctgattgcaatatttaagctggtatgtgaaggatgattcaaagttagccagaaaggtgtgaaagtaacaatccaagcccattctaggaaccaaaagaagggatttgttgctggagcagtgtggaagggaaagagtggtgagagatgagaggcaggagccaaaccactgaagccttacttttgggagtaaaagagggtgctaaaaaattagcagtatctttttttggaaacaattattgactcactctcaagctggtctattatattggtagaacctacaaaattattctattcaaaaactttgcaaaaatatttctaaaaagtaaaagtaacaagcatatatactaaagctatatacattgattgaacttaataatttgtaaaatcattcttggtacttcatatactttaatcagtttcttaaccatatttgtctctaatactgttactgtgtttttttaaatgggatttttcaatatgatcttattagtttttttggcataaaattgtctaaaaatcatctttaaatctggagttgttgacacctttaactgacttccctaaaagccataatgtttaatttaggaaataacaatagttgatgaggtatatgataagttcagagaaaattctgcaaaatggaggatattcttgaaatgtgcaaatatttcaggttattttcactgtttttaccttaattcaaagtacctttctttagtatacttatttttttacaagacaaaattctccttgaacaaattctttatgtctcttttggaagttacaccaaatttaaatattataaaatcttagacattgtgaatgttattccattacaaaatatacatttatcccaattacaaatatacatttatcccaatcaaaaataggggaaccatcaaaaattcttcacagagatccaaacaatgcaatctctctacatcatcactctttccttttcacctcaaagtaactcattatcatgatttttatcgtagtcactgtctttctcttctgtatagttcatagttcatcaccttagagtgtacacatgaatattagctttgctttttaaaaaaattttaatgtcttttaactttaagctataggtctcctctacctttcttcctccctcctgtacttttcccctctcttgtaatttatttgttgcaaaaaccagatcatttgtcctgtaatttccagcctggactttggtgactgcattcatgtgctataatttaaaataatttctatttcccattgctctttgttgtgatgtgatattagcagacaaaccaatatctagatccatcaatttatacatttatataaagtgttgctatctgctaatattattgctcaccgtcaatccttaagttgctgtctctcttgtcattctggttgaatgatttcattctctggttgattcctaaggaatggctaatgagaacaacagtctctgaattcttgtgttgttgacaatttatccgtcctttttgtatctgaaatcagtttggctggatataaaatccttgactcacattttatttccttgagcatcttggataagaagcttcatttcttctgccagaaagcccaaagtcaaagtctagtgacaatataaatccccccctcttatataaagttccagatcttatttatcctagaaaagctttcttgaattattgttttaatatttattctgctcttttgccttggtttcttttttgggaacttctatcatatgttatgctggatcttctttgcctatgttctatatatacacctcttgaattattttcctctgttcatttctttttggcttttaaaattttcctcctttctagtttctatttctaaggcattacctcttccatttatttgtgttctttaagttttagtcagtcttcatttctgaaatatttttatttctaattttctgagtttgagcatctcatttctgaggttttctaataacttaacattattctctcatttattatatgtttataaaacaacttttacctagttttgaaatattaggttagagttctcatctgttttatagatacttctttccggtgtgacttcactatctgtagcagctttagtccacttcttattctctttgtttttataatgattttgtaggaactttgaccttaatcctattcctttgctcatttttatgtaaaattaattttcttaaccttttagaatggaggcttgacttacaataatgtttaaattttatatattaaaacatcctcttcttcccttaaaaattttttttggggggtaagatttcaaaatatggaagcttactttcagagatttcctgtttctgttcacctttccaattttatcggggacatctttttcctttgtttctattgtctctgtactgctcaatttggattctatttccagcagttttcctcagtatatagttctgtactgggggcgcactttgactggttagctctttggaaagatattagagtccagactgctatagctccttctggtcttaccatgggccactcaaacatatctacaattagagtatgccatcttctcccagtttgagctgctgtagtcaaatttgcttgctaagttttcaaccaacctgttggttactttggacttatccaggtatatcagatgccttatcgctttttactgcctcctctagcaaaaatgctggtagtgcacagatcttttagttgtcagtggtttgttcccacttattcacagtttggggtttgtagggatacttcatgacctagtttggttgtaagtgttaatctggtttttcctatttgccatttttagtctctttatgtgttttaatggagaactagaggaacattaaaaactgcattgacattgtcatctttctttctttttttctgagaagaagtctcgctctgtagcccagactggagtacagtggcatgatctcggctcactgcaacctctgcctcccaggttcaagtgattctcctgcctcagcctccagagtagctgggattacgggcacgcgccactgcacctggctaattttttctatttttagtagagacggggtttcaccacgttggccaggctggtcttgaactcctgacctcaggtaatccgcccgcctcggcctcccaaagtgctaggattacaggtgtgagccactgcacccggcctgtcatctttcaagaatggcacccaaactacagtttttggcactacattcactgagtattttgattgaaagattttcatctgattttgaacaaaatacaattaaatgtagaggcagtgctatttaactctccaagataaggagcttgtaccagaaacaaacacacgtctttcttcactgagaatgtcttgttacaaacatgtcttagctcctttaaatggtgtgtgtaatgatgtagtagatttatgttttagcacaagatccttatcttgtgacccagtcacaaatagttcatgaactagtagcatgtattgatttatagacttgtttttaagataaattcaataccaatttataaaacaatagggttaatttaaaagtagttatttgaaggctcaaaaatccaattgatgggcagtaaagaaagactgctaataatgccctacttagttattttaaaaaatattccacattagctttattacattttgtagttcagttactctaattgtgtacatagagaaatatttgtaaattttaacaactacaacttttatttagattgataaaatgtttggacacagttgtgagttacatgtatactacaaccaattcccaaaacacttttgcttcgtaattaatcttcatgaaacgttgcttttcttgccatacagatgtattatcaatataaaacaaaattatgttaaaagttgaaattttaatcttaattgatatggtatttacaataatgtcagatgttttgactctgttaaaatggcttccaaaagcttttctctgattccattaactttctatttgaagtatctgatggcactgacattaactatgagatactttttgctgatagagtatgaagagatatggtttcatgtttttatatagacaagaaaacttagtattaaagatgaatgaaattaacttagaagaatttaaaaggtataaaagaaaattcaagcttcacagagtgatacgcaaatgcaccctctgcagttgcacctgttaaactgtaattttcagatactttttgtaaaataacaccttactttgaaaatctctgccagatttgtgtattctgtctggtttccaatctgattttcagtgacacctttacagctctcatggtggatggtaaatattaacaggtgttttgaacaagttatatacacatcgatttttttagttttccacagaatgtacgctttccttttaatatctcttgttgctatcaaaaggggttaatgcaaaatacaagtcttagcaaacaatgaaatagttgtagacttttaccgtgcaataaagcggaaaatcactgtagcaagagtcttcagacttttctctatgtgctgtattaaaagatgcctcatctgcatttctcaaatatatttcatgcacatataatctgtaacttcccatatttctcaccaactctgccaactggtagtctactggcttctcatacatcacaggccacacaactgattactacaccaagtggctggctggagtaacagtattgattactttcctgaccagcatccaaacccaaaagtcagctatctcctgctgctcatgtctgcatgtttcataagtgagtgcccccccagctgtccttgaatagaaggtgttacactgagcctggaaaaggtcaggaaaaagaaaagaattattactcatcttttagatttaaccacatgctaaagtaagatgtttctcatatactagtagatgagaccatggtggaagctggaagtaaaaagtggaagtttatcaaatctgttctgacttgacttaatgtattaataataatatttcagtataaaataaaaattctgggggaaatgctaaacataccataacaccaaaaactgtttcctttagttaatgctatatgtggcctaattataggccacatgaaacataccataacacaaactgcttcctttagttaatgctatatgtggcctaattgtaggccacatgaaaggttttgtacggtcttttaagagtaatgcagtgttatgacgaattgtaagtaggagaatatgttcagaattgagtttttcaaagcattttggctgctgtgtagagactgggctgaaaggagtaaaagtatatgtaatactgcttttgattaatagtggcagcagtggtggcaactgtttatgacgtgccaggtcttacgttaatcatgttgtgcatattatctcaatcttcaaaacaagcttgttaggtaggtactattgttcccattgtatagctaaggcaactgataattcgaaaggttaggtaagggtaaagccaggaagaactcaaatataattcttatttgtttctaatctaattcttcaaaagagtctttcactttttatatttattttaccattagacttttttgagagtagcaactatgttttaaaatagcacctaaagacacattctagcacctaaaagccctctgcatccaaaagaagttcaatgtttgttaatttaacaataagtaaatatttatattaaagtagcttggaaatgtttatttgacaacatttggtaggttcgatgttttgtatttacttgaaattaataatgccagattcaaaaatgctacaatttaggattttcattaattttaatgaaacttctacatcattaatttgaaaaagcaggttttactgcatttcacttagaaagaaaaatgattatacaagtataataaacttactatctcccttcaacaggttcaatgtcaagggtgttaattccaccgccgtggattctttcaacatctctgtctttatttaattccagtcccaaaactcttaaaaataaaagggggagaaagaaattaacaagtaatttaacatttaaaaatttcttatttaaccaagattacttatggtacaaaaatcacaagaaatgtctaaatcttctaccacacatcctaacgtatttatagatttttagacatcttgtataaatgtttaaaatatcagcagtagtaacaattacatgcaaacttttaaaggtatttaaagacggaaatttgtacgaaaaaagttaaattctgataaatgtagctgaggacatctaatggacaaaagcataaattacaggattaaaaaaattccttgaaatgtttcttaaagacggacagaaataaaaaatgagtatgggctgggtgcagtggctcatgcctgtaatcctagcgctttgggaggctgaggtgagaagactccctgagaccaggagttggaaagcaccccaggcaacatagcgagaccccatctctacaaaaaataaaataaaaataagctgggcatggtggtgggctcctatgcaggagactgaggcaggaggattgcttgagcccaggagttcaaggatgcagtgagccataatcacttcattgcactccagcctgggtgacagagtgagatcctgtcttaaaagaaaagagactatgttcaacttaacatttatgtgtatttaaataaagccacttaaatatcaatacaaataattaacaagtactctcacaaactaagacaaatgacatttctgatattttataactgtaaaccatcattatcctggtgagcatattattaagattaaatgagtttgtatataaaaggtgctaattacaatgcctagtacattgtaagtatctagcgaatattaactatttgaatctctcttaatctgttggctgttattagcatctacactaatttaaccagaattatttctaaattcattattgattaaaataatgctagtttaaatatcaaattataaatttttggcctataaaattatcagttttttaaaaagataacaatgcacaatgctggaaaggcataaactgatactttcattcattgacattagtacaagtaattataagcattttggaaatcattttagcagtataaagtatctgatttgaagatatacatggccctttgtcttctagacattacatatagtacaacaatgacaagcaggccaggcgcagtggctcatgcctgtaatcctagcactctgggaggctgaggtgggcggatcacctaaggtgaggagttcgagaccagcctggccaacatggctaaaccctgtctctactaaaaatacaaaaattaggctaggtgcggcggctcatgcctgttattccaggactttgggaggccgaggatcacaaggttacaagattgagaccattctggccaacatggtgaaaccccgtctctactaaaaatacaaaaattagctgggcgtggtggcctgtgcctgtaatcccagctacttgggaggctgaggtaggagaatcacttcaacctgggaggcggaggttgcagtaagccgagatcacaccactgcactccagcctgggtgataagagcaagactccgtctaaaaacaaaaacaaaaacaaactaaaaaatgagccaggcctagtggcgtatgcctgtaatcccagaggctgaggcaggagaatcgcttgaacccaggaggcagaggttgcagtgagccgagatcgcgccactgcactccagcctgggtgacatttattgcaatacatctatatacattgcaatttagccttaggtttaaatatccagacaaacagtaatgagttatctgactttgatcaataacaataacagctaatataaaaagccaggccgggcatggtggctcatgcctgtaatcccagcactttgggaggccaaggaggccggatcacttgaggtcagcgattcaagatcagcctggccaacatggtgaaaccccgtctctactaaaaatacaaaaaaattagccaggtgtggtggggcatgcctataatcccagctactcaggaggctgaggtgagaaaattgcttgaactcaggggacggaggttgcagtgagctgagatcatgccactgcactctatactccaacctgggtgacaaagcaagcaagactccgtctcaaaaaaaaaaaaagcctactactcattgtaataggtagtaataagaagtgtaataagtggtagtcccaggagtggtgattattattaaatgcatctcctgattataagattaatagaagagtaatttgcccaaggtcacacagctaatatttggctgagccgcatttgaactttaacattaaatttttttttaaatttacttttagagacagggtcttcctctgtcacccaggctggagtgcaatggcaaaatcatagttcactatagcctcaaactcctgggcttaagggatcctcttgcctcagcctcccaaatagctaggactacaattgcatgttaccacacctggctaagttttggtatttttttgcagagatgaagtattgctatgttgcccaggctggtttggaactcctggcctcaagcaatcctctcaccttcacctcccaaagtactgggattacaggtgtgagccaccacattcagccctgaactttgacattctttccccagaccactatgctgttctgtcatttctgaacttcaatatttcatcaaaactttttttttcatatttttccattgaaattgccatttttctgaaaatatttttccatatgatcatttttcaaattacaacagaatatatgctctttgtaacaagtaaaaacagtatcattcaaacatgtataaaggtaatcatcttttccttcagctccctcttcctaacagtaagaagcatggctcccagtaagaagcatggctcccattactaccaatatatttatcaatcccctgtatgtaaccaatctcccatctccactaccatcccctcccccaacagcttgggctctgatttctgtctcctctaaaatccttatcacctaaatttgtatgtccccacaattaaactacttcctcaacctgctcaggctctgaaattccactctaggaaacctaatcccatactaagtgagaaagcttacctctgcccaacataatgacttcaggactgaattgtctgtgaactagaaggagagtttaagatgaagggaaaagggcaataatactataaagggaaagagaggtggggagtggcaggagacaaggtgtacaaaacataggttaacatagcaggcctgagacggctacccttaaaaagttctgcttgcaagattggctcttggttacagtctgggatttcaggagggtgcccaccatgactggataagaatggctcactgtgcctaaactatttgagaaaataatgtgctttatgatgaatacctgctctacttttgggagtctggaattttggtacatgctagatagagggtgcctttatgaacggtacccagtaaaaaccttcaacattgagtctctaatgagcttccctgatagacatttcacatatgttgtcacaatttgttgctaaaggaatagagtgtgtcctgtgtgactccactaggaaaggattcttggaagcctgtgcctggtttcctccacactttgcccatgcacctattccctttgctgagtttatcttgtatcttttcactgtaataaatcacagtcatgagtaattgagtcataattaaatgctgagttctcagcccttctagaaaatcataaaacctggggatggtcttgaggacttcccccaacacaatggcataggagtagagggaaaagagaagggaaaatgggcaaggagagaggaaagagtagacacataaaggagggagggtaaaaagggaaagagaagagggaaggcagaagagcctggggtagaagggtaaggacaaaaagcaagccctggtgtcttttaaaatcacctttccaatctcttttttatataaaagcattgcttactggttattaatagctagcattcacttggcttagttcgtttccatgccaaactgattgttaaatattttatcagtctcttgcttcttctatggcacatgcttgcccaaatttcctatttaatttcagtttttaccttttatttttgttttaatgttttaaatggcttttataggatgtatattatatgtatgtatatctatgtatgcattttttccttttttttcttttttttttttttttttttgagacggagtctcactctgtcacccaggctggagtgctgtggtgcaatctcggctcactgcaacctccaactcccaggttcaagtgattctcctgcctcagccacctgagtagctgggattataggcatctgccaccacacctggctaatttttgtatttttagtagagatggggtttcaccatgttggccaggctggtctcaaactcctgactgcaggtgattcacctccttggcctcccaaagtgctgggattacaggtgtgagccaccatgcccagcccctgtattttctatctactatatattacttagtttttgttttacttttttgaatttttagaattttttatttatcaataggttttggggggaacaggtggtgtttggttacataagttcttcagtggtgatttctgagattttggggtacccatcacccaagcagtacatactgtacccaatgtgcagtcttttaaccttcaccccacttccaccctttcccccgagtccccaaagtccactgtatcattcttatgcctttgtgtcctccatagctcagctcccacttatgagtgagaacatacaatatttggttttccattcctgagtttcttcacttacaatatggtctccaattccacccaggtcactgtaaaagccatgatttcattcctttttatggctgagtagtattccatgatacacacacacacacacacaaccacattttctttatccacttgttgattgatatgcatttgggctggttctatatttttgcacttgcgaattgtgctgttataaacatgcatgtgtgagtatcttttttgtataatgacttctcttctactaggtggatacccgggagtgggaatgctggatcaaatggtagtactacttttagttctttaaggaatctccacactgttttccatagtggtggtactagttgacattcccactggcagtggaaaagtgttcccttttcaccatatccatgccaacatctactatattttgattttttgattatggtcattcttgcaggactaaggtaatatcacattgtggttttgatttgcacatctctaatcactagtgatgttgagcattttgtcatatttgttggccatttgtatatcttcttttgagaactgtctatccatgtcagcccactttttgttgggattgtttatctttttcttgatttgagttccttgaatattctggatattagtcctctgttggatgtataggttgtgaagattttcttccactctgtgggttgtctgtttactctgctgattatttcttttgctgtgcagtttaattaagacctatctatttatctttgtttttgtcgtgtttgcttttcggttcttggtcatgaagtctttgcctaggccaatgtctagaagggttttatcaatgttatcttctagaatttttatggcttcaggtcttagatttaagtctctgatccatcttgagttgatttttgtagaaggtgagagatgaagatccattttcattttcctccatgtggcttgccaattgtcccaggactatttgttgaatagggtgtcctttccccactttaggtttttgtttgctttgctgaagatcagctagctgtaagtatttggctctacttgtgggttctccactctgttccgttggtctatatgcctatttttattaccactagcatgctgttttggtgactatggccttatagtatagtttgaagaagggtaaggtgatgcctccagatttgttctttttgcttagtcttgttttggctatgcaggctcttttttcctagttctgtgaagaatgatggtggtatttgatggaagttgcattgaatttgtagattgtttttggcagtatggttattttcgcaatattgattctacccatccaaatgtagaatttagctgtgtttccatttgtttgtgtcatccatgatttctttcagcagtgttttgtcttgtagaggtcttttacctccctggctaggtatattcctaagtattttatttttcttttttgaagctattataaaaggggttgagtttttgatttgatcctcagcttggtcactgttggtgtatagcagagctactgacttgtgtatgttaattttgtatcctgaaacttcgctgaattcatttaccagttctaggagctttttggatgagtctttagggttttctaggtatacaatcatgttatcagtaaacagcaacagttttacttcctctttactgatttgggtgtccttgatttctttctcttgtctgattgctctggctgggacttccagcactatgttgaatagaagtggtgaaagtgggcatccttgtcttgtttcagttctcagggggaatgcttcccaacttttcccctttcagtataatgttggctgtgggtttgctatagatggcttttattaccttaaggtatgtcacttctatgctgattttgctgagggttttaatcataatgggatgctggattttgtcagatgctttttctgcatctattgagataatcatctgatttttgtttttaattctgtttgtgtggtgtatcacctttatggacttgcatatgttaaaccatccctgcattcctggtatgaaacccacttgatcatggtggattatattttttatatgctgctggatttggttagcaagtattttgttgggggtttttgcatctatgttcatcagggatgttggtctgcggttgtctttgttctttcctggttttggtattagcatgatattggcttcacaggaggatttagggaggaatccctctttatcttttggaacagtgtcaataggattgatacaaattcttctttgaatgtctgatataattcagctgtgagtctgtacctaaactttttttggtaacttttttattaccatttcaatctcattgcttgttgctggtctgtccagggtttctattttttcctggtttaatctaggagggttgcgtatttccaggaatttattcatctcctctaagttttctagtttatgtgcataaagatgttgatagtagccttgaatgatcttttgtatttctgtagtaagggttgtaatatctcccattttgtttctaattgaatttaccagatcttctctcttcttttgttggttaatctagctaatggtctatcaattttatttatcttttgaaagaaccagctttttgttgcatttatcttttgtgttttgttgttgttgtcctttcaatttcatttatttctgctctgatcttggttattttttttcttctgttgggtttgggtttggtttgctgtttctccagttccttgaggtatgcccttagattgtctgtctgtgctgtttcagacttcctgaggtatgcatttaatgatatgaactttcatcttagcaccacttttgctgtatcccagaggttttgacaggttgtgtcactattatcattcagttcaaagaattttttaatttccatcttgatgtcaggtattctatgtcaattttttgtatttatgtgaatccttttcccctaaggtgtgtgatcctttgggggtgttaaacaaccttgttttatcatattaccagaattgtttttctgattacttctcatttgggtagactatgtcagagggaagatctgggactcaagggctgctctgcagattcttttgtcccacgaggtgctcccttgatttggtgctctcctccttcccctaaggttggggcttcctgagagccaaactgcagtgattgttatttctcttttggatctagccaaccagcagagctactggggtctggttggtacagggcagtttctgcaaagagtcctgtgatgtgatctgtcttcaggtctctcagccgtggataccagcaccggcaaccgtagaggcagcaggggagtgaagtggcctctatgagggcccttggttgtatttttgttaaatgtactggttttgtgttggttggcctccagccaggaggtggcactttcaagagggcatcagctgcagtagtatagaaaggatacatgcttgccctagggttaggtggtgggcaggccgatagagctcccaggagattatgtcttttgtcttcagctaccagggcaggtagagaaaaaccatcaggtgggagcagggttaggcatgtctgagctcagatctccttgggtgaggcttgccgctgctgctgtggtagatgggggcatggttcccaggccaatggagttatgttcccagggggattatggctgcctctgctgtgtcacacaggtcaccaaggaagttggggaaggccggcagccaaaggcttcacccagctcccatgcaacctacagcctaaagggctggtttcactcccactgcgcccctacaacagctctgagtttatttccagcagggctgaggacttgccccaggctttaagccacccagctgagaaagccagccaactcacagttccttggctgtcccacagtgcctgcagcggcaatccacttccttcaaagggtctgtggatcctctccgctttcctggagcgttcctgtggtagttcttatagcaaaagttcacgatatgcatctccatacactgctctgtccatctgagtgggagctgccaagttagtcctgcctcctatacaccatttcctctcattctcctctgttttagtgtcttaagatggctacatattctttttgttcaatgagttaatatgtatgcgtgtgtgtgtgtgtgtatacatacatacatacatacatacatatatatatatatatatatatatatatatatatatattttattttttttttttttaggttacgaagtttcattgaatataagtttctctgggtcccctaagttgtagaagtggttattctccttttccttgatttccaacttgtaacttcaattttcatttcatctttgattctggagttttctgaaatgtaattatgaatttccaaaacatgaggtggtggtgatgttaccatgaattatttccagtttctataccttatgatcaaagaatgtggcctgtaagatagctacctttttgaattttttttttttttttttttttgagacggagtctcgctctgtcgccaggctggagtgcagtgacactatgtcggctcactgcaacctctgtctccagagttcaagcgattctcctgcctcagccccccgagtagctgggattacaggcgtgtgccaccacacccggctaatttttgtatttttagtagagacggggtttcaccatgttggccacgctggtctcgaactcctgacctcaggtgatccacctgtctcggcctcccaaagtgctgggattacaggcgtgagccacagcgcccggctgaatttgttaaagtttgcttagtggccaagaacaattttggtaaatgtaccactgacttacaaaaagtatgtacgttctccacttaagggatgtaaagtcatgtatctactaaatctagtttgttgtttcttcatttcctccatatatatgtagctttatataatgtccttctttaaaatgtttggtgcttttaaccttaaatcttaccttacctaatattcgtagtgatgtccacattttgtttacagttgtctgatctctctttatcctttaactttttaactattcaagaattttgtaaagtattttaaaatattttaacttaatgtatttatgagaaacagcttttagctttatttgttttaaaaattaatctgataatatatgcttcttaatggaagaaatcagcctgttcacctttgttatgacatctgatatacttggtattattccttctttacttaatgtcatggtttcttcttttacctttacttttgctagtttaatgaagttgctattcatttccatcttgtcaattgagaagtgtctaaaaaaaatttcgcagccatattatatatttccagcttgtttattattatatatttacatttaatcatacacatactgcaaggttcataggtttcctctcctcttcatctttaatgttccttcggatttcattcaaatacatttggtttttgattaacgttctttcctaatttttttcctgaagggaaattgggtaaaatatttctatggaccttagcacaaagatatttcttctgatagactggtttgtttggattccccggttgcaatacttcttttttttaatttttagataacttttagttgctttttgagacagagtctcgctctgtcacccaggctggagggtggcacagtctcagttcactgcaacctccaccaagagatcctcgtgcctcagccacgtgagtagctgggattacaggcacctgccaccgcacccggagcacgcccggctgatttttggatttttagtagagatggggttttgccatgttgcccaggctggtctcgaacacctgagctcaagtgatccacctgccttggcctcccaaagtgctgggattacaggctgcaatacttctttcttgttagtaggtatcattccagtgttttctagtctctagaactactgatgagatgttttacctttatgaatggtaaattctttaccattagaagcttttaataatattttcttcattgctagataaatttactaggtatacatacttttatgtcttttttatcaatcttgtctggacttcagtgagccctttgagtctatgaatccagatcttttgcaattctttttctttattactatttgttttgttctccctctggaactattattgtctgctagatcttttgaatctaccctcctaatctcttatcattttcattactggtcttttaattcttgttttatgagttgtgatatttaatttgataatttcattcattattcaatacttcagttctgggtaatactactataaaaactaaacaaaatgcagagacagctacttgaggactctgaaaagtaaacagccacagacaatcccatgacagaaatggctatggctacgcatagtggcctgcagaagccagaactctgaggaagggaaattgttttctctgttcatcagagtcccgatcccaagagggtagggacaatccctgttgtttattgcctctcttctcacttctgagcccagacttgggcctaaacttggaagcgtatggcagaacagggtaactgaaccctaaagtttctggctagatggccaaaacagggagtcccagagaactgggaagcatccaggagatcacagagaagaaggagctcaggaaagtgatcccataaagttgtttataaactccagaactcatccctgagtgaggcatgcatagatctaaccctgagtcgtatacaaaggattttgaaaattgagctaatcactcaggtcacagtctgaccattgaatggcatacacctggggaagatctgaagagactttgaaaactgagctaacattaaaactacagtccataagtaggtaggttcttgtagcctgaacctaatcttgctaattaaatgttaaaacaaaaatatcaacattcttcataggatcaaaacaagacccagagtattcaaaatgtccaggatgcaaatccaaaatttccctgcatataaagaaccgtgaaaatttcaacttgcatgggaaaagacaaacaaaacaagccaaagctgagatgacacaagtgttgagattatctgataaagacttcaaggcaaccattgtaaaatgcttgaacttgagcaacactggcatggtggcccgagcctgtaatcccagtgactcttgtgaagctgaggcagggggactgcttcagcctaggagttcaggaccagcctgggcaaaacagtgaggcctcatctctaaaaataaaaaaaaagcttgagtaagccattgtgcacacacttgaaacagatgttaaaacagaaagtctcagcaaagaaatagaagacataaataaaagccaaatggaaattttagttttcaatataaaattattttaacttaatgtattcactaacagattggagatggcagaggaaaaaatctgtgaacttgaagatagatccattaaaattatacaatctaacaatatagaggaaaaaagatcgaagggaaaaagaacaaagccttagggatcagaggaacaattataaaaggactaacatttttgtcattggaggtctagaaggagaagagaaagagtgtagtgttgaaaaaacattggaaaaaatggctggaaagttcccaagtttatggaaagatataagtctacaagttcaagaagcagaatgaaccctaactaggataaatccaaagagatctgcaaccagacacatcataattaaactgctgaaaactaaagacgaagtcttcaaagcaaccagagaaaaatgataaattacctataggaaaacaatgatttgaatggctgcagattccttttcagaaaccattagacctactctaaaaaaattgataaactatattcttcagagacaagaaaaagatataagaaggaaatttgaggcatcaggaataaagagacagcaacagaaataactatctggttaaatataatggctacttttttccttaaaatatgattgatggttggaaaaaattataatgtctgatagagtatataatgtatgtaaatataaaatataagacaacaatatatatatggtgcaggggaaagggtgataaggtttctatatgccaaatgaagcagtaaaacaatgaaatgatccgaagtagacaacgaaaagtaagtattttataattcctagagcagccactaaagaattatacaaaaagatatagtcaaaaccatagtatataaaatagaatactaaataatgttcaaacagtcaaatgaaagcaggaaaggggaaacataaatatggagcagctagcactctcacctattagtggtgggactggaaaatgcttttggaaaactgtcagtttcttaaaaagtaaaggatttatctagtagctccactgttatgcattaacttcagagaaataaaagcatatgttcatacaatgactcatacatgaattttcagagcagctgtaaatgtattagtcctgaactggaaacaactcagatgtccatcgacaagtgactagataaactgtggtatatctgcacagtgggatactccacagcaaaaaaaaggaattgatacatgcaataacatggagaaatttcaaaataatgtaattatgctgagtgaaagaagccagacaaaaaagattccatttatataaaatactagatatgcaaactaatctatagtgacctaaagcagattagtagtttctagagaaggaagagggtaaagcagagaaagaagggagacagggattataaatgaccgtcaaaaattttttagggttatggatgttctcttgattatggtaatggtttcaaaagtaaatatatgtcaaaattcatcaaattgtatattctcatttaatgtgcagggtattgcatgtcaattatacctcaataaagttgtaaaatgtttttttagagggtgtaaactgtgaacactgcatatcagtgttcatccttttgctcttacatgatgacaaggaagaacagtagacatctcctatgaataaaatggaactatataattgtttaagcaaaaacatcacttaatgatggaaatatttttaaaaaaattttaggctgtgtggtagctcgcacatataatcccggcactttaggaggcaaaggcaggaggatcacttcagcccaggagttcaagaccagaatgggaaacatagggagaccccatctctacgaaaaatttaaaaattagctaggtgtgtgggcacatgtctgtggtcccagctacttaggaggatgagatgggaggatcatttgagcctggaaagtcgaggctgcagtgagctgtaactgcaccactgcattccagcctgggtgacagagcaagaccctgcctcaaaaaaaaaatatttttttaatttttaaatactttatttgtcttaaacgtataagcaatcctcacttggcacagtctgatatgaatttcagttaccacagtttattaaccgtgagaaatagcataaaagtttgctactagcttttcagttcacaaatcattacataaataacatatgaatcaaaattgaccaatttgcaattttacttctttcaaagtctatgggtgattggtcactgtgcatctgttattcagttcacacacaggctgcaaagcatggaggtttgttattaatatttctgtgcccttgagataaacccacatggaattttacagattaaaagaggaaattggccaaaagaatgaaagtgcactaaagaagagtgataatactagaagtgaaacttgcattaaacataaatggagcaaatgaaaaaaaagctgcctgtgggaacatgctgattgtggcaacaatgacactgccgccatttgagacattctagatatgcagactgaggaaatcagtgaaggtgaacttatagacataaatgaggaaaagtgattgtgatgaaaggctgatgatgtgtcagaggaagtgacactggcaaaaaaaacacattaaaggaactctcagagatatttcacaacattgaaaacgtaatggataaaatgttggaaactaatatttaaatttctccagaacgcagaactcataagcaactgtgttctccaagtaaatatcttcacaggttcctcaattaatgtgggcaaaattaaaagtacaacttgcttcttccctttggaaaaccctctctcagagtatattaccaacattcaacttcttatacaaggcatagatctgggaatcattattcattcttctctttttgtcattcacgtatccactcaatttccatggcctgttgattctatttctcagacgttgttcaaatctctccactatctttattctacttggcaactctgtggcccaggcttccaacaactctctcccggacaagtgtaatcacaacagttacctaacttggctcccactcttgttctcagttgcaacccattctccaagcagaaaacaaaatgcaatagctgttaccttattctcatcttcacacctctactcaagtacacaaggctcttcctcatctagtttctgtctacttcatctcttgtcaatggtccctaccccaattctccgctctagtcattctgaactttgttcaattcctggcctgtgtcctctgcctttaataggctgcctggcacactgtaggaattcactaaatatgcagactgaatgaatgaacgagtccgtggagggcagttattctttggagtaacttaagagagaaggaatacagtacaacgaagtattcttatttaggtttatagtgtcttcacctgagcccgcgggggaaccccccccccacccccggggaaccccccccacccccgccgccccccgcctgcaagttgttaccagtaaataaaagggatcctattttagcaagccacacagcattagagggcaaataatagtttggtggcaggagagcgatgagacgggaaagtgtggggcaaagcttacagtcattggtccagattctaactggcctgttagccaaaaagtaaggttttctttacctccgtgttgactctgctctccgaaggcgaagagggtcctccaaacccgtttggcgtgcggacaaaaaccccagcatatcgtgtcctcacaccggctggagcactggacgtcgccatgacagagctcaggggcgggactggaacagcagagtctcccattggtcagtcggtgatatatccggccaatggtgagcgccgttactagaagggctccaggatggaggccgacctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaggagcacgtgggcacggaccaattcgggaacaaatactactacatcccgcagtacaagaactggagaggtgaggtggcggcgtgggcagcgattgcgtggtcagtgattgcgaggtcagtaaaggagggaaaagtgagagcccctagtcaactaacgcatcatgcgacacttagggtgtcaccggagagaatttcccgagttcgttctcccctgtcgaccccttcactctggcatcggagccctacccggcccggctctgggcgccttggcccggcctcgtgcgtccgcggtccctactacccagcgccttcccccggcgtgccccgggctgcttgcgctgttaaggcgcaccaccactttcctcccagccacgcctgtagaggagcctcagttttagccctggactggcgacggaggcagggaaaagtccacggaaatctttcaccaaaggggctagaagggccaggggaggggtttttcgtacgctgttccccgccttgtgacccagagctgagtggtgtaattgaagaggagtatcttcagcgcctcggctgtcttctttcttggtgtttacccttttcggtggcaccctggctccggcgctggccccatgcgccttccttactaccaagacttgtcagaagtaggtccatatccccacaaggctcgctgattcctttctcgggagttgacattccaagaccccgttgagctcaatttaagaaacgtggcaataatcatggtgttactgtgtaggattcgtgccaagtagttgagcgggttgtttggggagtaaggaggcgttgctgtccattgaaatcacactgtgtagccgccgtcgtaacctcttctgtgttgttccatcgccgcatgcagaaaatgtcaggttttgggcgaagaggcgtgggttagaatctcagctttgacacctgatagctcgggaatcacggaaaaagtacttgtcctctccaagtctcaacatcctcacttgaaagttagagataatataagatcagcaatgttgagaagcactaagacctttccaagattatgtgccattcatttcccacacatataaaatgtattctgtgatttatcactcaattaatttatttttgcctggcctttttctgtaacttattttaatatttagacttgtttccctaatgagctcctctgtcaggcagggaatatgtctcacaaaaaaagaaaaaagcctgcaaagaacatagcatggtgttaagtatttcttgacaggttgcaagcagagagatgtttcttttccataagttgtcagtaaaattaaaaatatgcaaactgtcagactgagtttttttaaattgaaatataatttacatacagtaacattcaccctttatggtgtacagttttattgtttttgacaaatgagtagagtaacctcactggattcaagtaatagaataattccatcaccatcagaatttcctccaactccttagtagttcattcccacaccctttggcaactactgatgtgttttatgggcctatagttttgtcttttctagaatatcatataaatggaattatacaggatttagacttttgagtctggcttgcttcacatagcataatgtagctgagattcatccatgtgtcagtagttgttcctttttattgctcagtagtattccattgtatgggtttgccagtttatctgttcacaagctgaaggacattaggatgtttccagtttctgtgattgtgacaaaagctctacaaacattcccatacaggatttgtgtgaacgtaagttttcatatctcttgggtaaatatctagtagtgggattactaagttgtgtgatcaatgtgtgtttaactttatgagaaactaccaaactgtttttcaaagtggctgtaccattttgtattcctgccagcaatgcattaaaattctagttgtttccacaccctcaccagcacttagtattatctgatttttgggtgtgtttttatttttattttagccattttgataggtatatagtggtatctcattgtgattttaagtttcattttcctaatgcctgaggatgttgacagtcttttcatgtgcttatttactatctacagatcttcggtgaagtattgttcaaaccttttgcccattaaaaaatccatttatggctgggtccggtggctcatgcctgtaatcccaccactttgggaggccgaggtgggtggatcacctgagatcaggagttccagaccagcctggccaacatggtgaaaccccatctctactaaaaatacaaaaattagctgggcatggtggcacgcgcctgtaatcccagctagtcgggaggctaaggcaggaaaatcacttgaacctgggaggcggatgttgcagtgagccgagatcacaccactgcactccagcctgggtgacagagtgagactccacctcaaaaaaaaaaaaaaaaaacaagcccaaaaaacaacaaacaaatatatttataccagtttttgtatcattcatttatatagagatacaataccattaaagtttcaaattaacagtcatgtctattctacaataacatgaatattttatttttacatattctcactaatttgtatattttcttacataattgtaattgcattttgagagttttattgaagtataattgacaaaaaaaattgcccatgcttaaaatgtataatttggtaagttttgacatatgtatatatctgtgaaaccatcaacacagtcaagaaaattaacatattcaatatccacaacaatttgttgtgctcctttctagtcttgccttatgcttctgcttccatggataggcactcatctgatttctgacactatacattagtttgtattttttataatttttatttagttatttttatttgtttattttgagatggagtctcgccctgtcgcccaggctggagtgcagtggcgctatctcggcttactgcaacctctgcctcccaggttcaagtgattctcctgcgtcagcctcccaagtaactgagatgtgtgccaccctgcccagttaactttttgtatctttagtagagacggggtttcaccatgttggttaggctggtcttgaactcctggctttgtgatctgcctgcctcggcctcccaaagtgctgggattacagatgtgagacagtgcgcctggctagaattttatttaagtggaagcatacagcacatattctgcttttttttttttttgttttttaggttcttcactcagcataattattttgagattcatccatgtttttgtgtttatcagtagtttatttctttttaatgctgagtaatattccattgtatgtatataccataatttgtttatccattcacctgttcatagatatttgggttgtttctagttaggggttattacaaataaattatgaacattcatgtgtaagtctttgtatggacttatgtttttatttctcttgatgtaatatttagaaatggaatggctgagtcaacttgttaggtgtatgtttaacttcttaagaaactgcctaagtggtggtaccgttttaccttcccaccaggagtgtatgagatttccagttgtcctatatccttatcaacacttggtatggtcagtctttttaattttagctcttctagtaggtgtgttgtggtatctcattttttttctttagttttctgtttgctattagttggtttttttagattctatttttaaaatacagtaaaattaacttttaaaattggtgtatagttctataaatttgaacacatgtgattcatgtaaccaacaccaaaatcaggatacagaacagttccgtcaccctgaataactccctcatgctacctttttgtagttacaatctctcctcatccctaacctcagcaaccactgatttgttctctgccattatacttttttccatttgagactgtcccacatgtatacttataccatatgtaaccttttgaacctggcttcttctattcagcataatgcctttgagattcattacgtatatcagtagtttgctcctttttactgctgattagtattccatgttaatggatgtaccagtttgttcatttactcattaaagggcatttgagtttagttacttgcagtttttggtgattatgaatacagctgcaagaaacattcacatatgggtttcgtgtgaacataagttttcattttccatgagtacatacctaagagtgtgagtgcttggccatagcagctccagcttactctgtaaaacggaaataacagtacctacttagcctcacaaagtatttttgctactcaagagagacaaattggataacgtagcatttaagagaatgggatttaatgtcgaaatcagtttgacttaattcacagagaccttttacttggtcatttttaaaaatttatcactgatttgtagttttcagcatagagatcatgatatgttttgttaaatttattataaagtatattatattgtattgttattataaatgatgctttaaaaaacgtaatttctaattctttgttactattatattgaagtacaatagatttttccatgttgagcatgtatcttgcaacctgttttactcacctactagttcttgaatgaagccttttgcagatcctttggacattctctgtaggtaattatatcaactgtggatagagacagttttgtttttatcctttctaacttatttgcattctatttccttctcttgcctggctgcactagatgagcctccagtataatgttgaataagagtggtgagcataggtatctttttcttgttccatatcttagaagaaaaacatttaatctttcattttttttttccccaaaggtggaatttcgctctcgttgcccaggctggagtgcaatagcgtgatcttggctcattgcaacctccacctcctggtttcaagcgatttttctgcctcagcctcctgagtatctgggattacaggcatgtgccactatgcctggctaattttttatttttaggagagatggggttcgccatgttggacaggctggtctcgaactcctgacctcagatgatctgcccaccttggcctcctaaagtgctgggattacaggcatgagccaccacgcctggccactactctttcattgttaagtgtggtgttagctataattttttagataccttttattaaattaacaaagttccctgtctgtacctcgtttgctgagcgctttctcttatgaatcgatgttgaattttgtcaattttgtcacatgcttgcttgctgggttttttttttttttttggttctgttggaatgatcatgtggtgaatttatactgattgacttttaaaaattaatagactttattttttagagcaattttaggtttacagaaaaattgaatggaaactactcagatattcctgctcccccaatgcagtttctcccattgttaatatcttgcattaatgtgtcctcacttcctcccttcctgctaccaaacccctagcaaccactgatctttttactgtctctgtagttttgccttttccagaatgtcatgtagttgctgtcatatagtatgtgatcttttcagactggcttctttcacttagtaatatgcacttaagtttcctccatgtttttttgtggcataatagctcctttctttttatttatttatttatttttgagacagagtctcactctgtcgcccaggctggagtgcagtagtgcgatattggctcggtgcaacctctgcctctcaggttcaagtgattctcctgcctcagcctctcgagtagctgggattacaggtgcccaccaccatgcccagctaatttttgtaattttagtaagagacagggtttcgccatattggccaggatggttttgaactccttacctcagatgatctgcctgcctcagcgtcccaaagtgctgggattacaggagtaaaccagatgcctggccatctactttctttttattgctaaataatattctgttgtatggttagaaccactgtttattcgtttgcatattgaaggacatcttggttgcttccaagttttggcgattatgaataaagctgctataaatattcctgtgcagttttttgagtggacataagcttttaactcatttggcattgattgattgttgaatgtcttgaatattgcatttgtcaggtaaactccacttggtcatgatgcattatcctttttatatattattggattgatgtgctttcattttattgaagaattttgttttctgttcttcaggatcttaatttcttccttttaatgtgttttctaggtttgtttttaggttaatgctggccttataaagtgagttaaattttgtttccttcttttgaattttctggaagcgtttgtgaagaatttgtattacttatttcttacatgttggatataaattgcctgtgaagccatctggtcctggagttttccttgttggaaggctggaattaaaaattcaaagataataaatttttaacctacaaatttaatatctttggcaggtataagactactcaggctatctattttgtcttaggtgagttttggtagtttttatcttttgagtagtttgccctttttatctagtatgttgaatttacagtcataaagttgtaatacctcttcattatctttttaatgtttgtacaatttgtagtgatatcctctctttcctgaattgataatttgtggctattgttttcttggcctatctgatgagtggtttgttaattttattgatcattttagagaattagctttgagtttcactgatttttctctgtaagttttttccattggtttcagaacttatcgctttctcttatatcgtcatcgttttcttctgctttcaattggttttatatgttcttctagtttcttaaggtggccactgagatcataatttgatctgtttattttttaatatacatttttaatgttaaaatttcttgtaggcactgttttggccacatttcacaaatttttatcttaaaattttcatgtaacgaatatattttcttatttattttttcctatatgacctatgtatttatttagaagtatgttctttacaaatatttggagattttctagatggagattttcattgacttctagtttaattctattatattcagagaacatattttatatgatttcagttattttaaatgtattgtaaattgttttatggcctagagtatggtgcaatttggtaaatcttctgtttgtgcttgagaaaaatgtattatctattttgctatttggggttgaatgttctgtaaatgtcagttagcccaagctggttgatagagttgttcaagctttgtatattcacactgattttttttgtacttattctatcaattattgaaaaaagtatgttacagtctctgaatacaagtttacatttgtcttttactctttccagttctatcagtttttgcttcatgtattttcaatacctattgttaggtccttacacatttataattgaaagataataatacaaattacccaaaataaaacacagagagaaaaaagaccagaaaaaaaagagcaattagcaagctgtgggatacccccaagtggcctaatatatgtaattggataccatgaggggtaaaggtcattttgcaggtcaaaaatatttgaagaaataatggccaaaaatattccaaatttgatgaaaactataaacccacagaccccaaatcatcaacaaattccaaaaacaaaaagtgtagaaaaccacaccaaggcatattattatcaaattgctcaaagccattgataaagagaaaatctttatagagctagagaaaaagatacattacttacagaggaagaaagacgaaaatgagttcagggttttttttaaaacaaacaatataagctggaagacagtggaacaatatctttaaagtaccaaaagagaaagtctgccaacctataattttgtacacaacaaaaataccttgttaaaacaaaggcaaatgaaggttttttcagacatactgtacctgaaagaattcattacacagagaccataattccctttcctcttccctctactggatatcttattccctggattctgggcctttcaccacagttttgtagcatatatgcttcagtagcctcctgagaagaggttcaaggcggataaagtttttgagtctttgaatgtctgaaaagatttttattctgtcctcatttggttgatgtatttgttgggtgtagtttctactgcagtcatagtgagtaaatgtctagagaaaagcaagcagtaaattctatacgagcttaaaaggagtagcctatgaattgaggaagagtatatgcataatgtaggctttggtaaatgtttttaatgtaacctaatgctatggtttactgtatttatgaatatatattttaaaatgcatgattacattgaataacagtgttttggctttaatagtaaagctttttttcaaatttagtcggtataaaattatttgagatagtcacacatactttgtatgtgccctattgacaacaaccaaaggaatttctcctttccatgcaaatgaggaacacatagacacagatgtaaatgttctaaatcattatttctagtgatataagttaggattgttttactggaagattgtggtgctttttgagtgttggctgtgtattttagacaaagtagctggtaactaggactagttccagctttacaggtcaccatgatacccatatccatgtctctggtcccaagtcattagctgtaagatagccaaagacctatgatgtggctaggtgtgagaattctgccccatataggcattctgtataggttggtaacagaccaaacatggtcaaatttttttctgttgaaatttgaactcatagatatatagagagaggaaaatatgagaataattagggatcagtagatgtccatttctaagaagttagggtggcaagcatgttgaaaggttcctattagagcacaataggtattgttgtgtcctaaatcacattccagttgtctctattttgcaaatgttgagtttttcgtctttcttcctgtatctttacagtattccctggttacctgagataacttgagcgtaactgttctttgaaatctgagactagctaacatatatactatgtactagattttagaaaattttaggtatctgaaaatacaactttttcctttcatgtgttaattttgtctcttagaaattcttcctgttaaatatcaaggaactcatgacctcaagtgatctgcccgcctcagcctcccaaagtgctaggattacaggcatgagccaccgtgctctgctgtccttttttttttttttaaatagtagccatcctaacaagtataaggtgatagcttattgtggttttaacttgatttccttgttggctagtgatattgagaaccttttcatatacttgttggctattttgtatgttttctttggagaaatgcctgttagttcctttgcccattttaaaatcaatttatttggttttttgctattaagtcatagaagtcactgatacattttggtttttaatcatttatgagatatggtttgcaaatatttgtcctattccataggttgcctttgtatcctttgctttgcagaagtattttggtttgacgtaatcagacttatctatttttgcttttgttgttttgtgcttttggtgtcatatccaagaaatcattgccaaagccaatgtcaagaagctttttccctgttttcttctaagagttttgtagtttaaggacttacattgaaatctttaattcatattgagttgatttttatatacagtgtgagataagcgtccaatttcattcctctgcatgtggatatctagttttcccaataccatttatttgaagagattatcttttcttcactgtgtgttcttggcataattgtcaaaactcacttgtcctcatgtgtgggtttattactaggttctgtcttctgttccaatagtttatatgtctggttttatactggtaccatactgttttgattactgtagcttttaaacgtattttgaaatcagacagtgtgatgcgtccagatttgttcttcctgcttaaaattgttttggctactcagtgtcttcttgtaattccatatgaattttaggattgttgtttctatttctggaaaaaaaaagtcattggagttttgttagagattgtgttgaatctgtagattgctttgggtagtatgagcactttaacaatattaattcttccagtccatgaacatatcagatgtcattgcatttattcctgtctgcttgaaagcatttctttcatccatgttttatagttttcagtgaataagtctttcacttccttagtttgttgctaaatattttactttattgatgttattgtaagtaggttgttttcttaatttccttttcagataatttgttgatagtacctagacatgcaatagatttttgtatgttgactttgtttttttttttttgagatagagtctcgctctgtcactcaggctggagggcactggcgcgatctcagctcactgcaacctctgcccctggggcctaagtgatcctcctaagtactgggactacagatatgtgccaccatgcccagctaatttttgtattttttgtagagatgagatttcaccatgttgcccaggctggttttaaactcctgggctcaagtgatccacctgcctcggcctcccaaagtgttgggattataggcatgagccaccatgcctggcctctatgttgactttgtatcctgcaactttgctgaattcattcattagtctgaacagctttttttgtgtgtggaatctttggggatttctatatgtaaggtcatcatctgtggcttcttccgctctaatttggatgccatttatttgtttttcttgcctagttgctcttgctagaacttctgtttttgaataggagtggtgagagtaggcatccttgtctcattcctaaccttagaggaaaagctgtctgtttttcactcttgaatataatattaactgtggatttgtcatatatggccttcattatgttgaggtgcatcccttctatacctgacactaagaatttttatcttaaaaaggactgaattttgttaaatgcgtttcctgcatctattgagatggtcatacagtttttgtccttcattttgttgatttggtatatcacattgatttgtatatgttatctcaattttttgaagtgttacttatacgtttataaaagttgtgagccaagaaaaatttgtgctgaggtttttatgaaaacatttactgccaaactatattttctatactttctgtatttctgtgtgagtatatttagacacacgtatatttggattatcagtgtgccaaacattatttataatatcatctcctgaattttatattttattttttttagttaaaaagaaaatactgccttttgaatatgaagttctcaaacacttttgagaaaccagatcaaaagaggtattaaccaaactttgagaaaccggatcaaaagaggtattaaccaattttaaagttgataatttaaaattgaggtttgctaatcagaaatagaattttgcttataactgaagggtgttttataccttttgtgcttcctttttaagaatattagttggattttaccttttgttctaacttgagaatcactgttttatttatttttaattattgaattaaaatatagtagagagaatgagaaagcaaacctccacatacctgaagcttactttttacagttatacttgtggttaaatataattttcttcctaacccccagttatctttcctattttattttgaagcaggtaacaaacatcttgtcaatttacctataaacatttcagtatgtatcttttaaacacaagcactcctgtttttaaatgtaacaataacaccatcatcatatatagaaataaatcccttaatatcatcagatatccagccattcacattttcttggttatcgtataatgttataatgttcttgtttattggctgatctgtttactttttttttttttaacagtttatgtctctatagattctccctttatctttttaaaagctgttcttctgattcctgattaccctccttagatgtcttttgcagcatagccctcaatttacttgaaattagctgtctgcacccagacagaccccagtgaatattacaggccagtagctcctcattgtgctctggtagaattactttggtagaactgtattcaatacagagttccttcactttcagcccctgctagtgggaatctgaagactgtcagtatcaggtgaaagttgtagttgcctgtgagaaatagggaaggggctcattgggacactgaccatgtgttattgtttgggtttgttcttttggtgttttctttttgctgttttttgaaaaacctgtattttgtgtataacctgtattagtgataaccaggactccctgtagtagcactagtggcatttttgaattttttggacttgactgttaacatttgccacttgctcttagccttgctcctccaattttggggttttctcagaacctatttttggaaaactatattgattctttctaagcaagtctgttcacttgtgctaattcacaggccagtcagcactgctaagtttgcttttcatctcatcctgtgtcatttgttaattttctcatgtgacagatagttattgactactgctctaagcaaaacatctgttttatgtatttcagaacttttggccttagtgtctgaccttttaatggtacctttgttttctagcatagctgtatctcctctcatatattctttaataaattcaattgggttttgggagataaaggaagtaaacatgaatcataggctattttaatctgaagttttcatatttaatttgtaacaaattgaaaacacatttttttcattcattttgttctcagctacttataatcttccaatctttttagtgatacttaaagtaatgataactattatttattaggtgctaactctgattacttaacatttttataacaaccatgtaaccagggattattatcctcattttaaatatgaagtgattgttatgtttctgaatacttaaatgtactttatatgcatgtgcctggatataaagtagatgctgaaaaagcagctattcagtgaattcagatgtttacggacccagaggcataaagacaaaaacaaaacaaaatataagaaaaccacagaaaatggtttttctgttaactagttttacaaaatcttgagacagatgcttaagatatacttttctttttattatggtaaattggccaaattattcttcagggactaaaatattctcattagaaataggagtatcttttcataatgtcacgacgcctctagtgtggttcaggtttggatttggtttagtcagtgtcctaaatatagtttcattgccagcctcaaacttgttaagatacccagtcataaggatgaatatatcaaaacctatgttatccactattatatgtaattgtaatcctgcattgttttaaattatctcacctcatcatatttgtatttaggatttaaaatatactaaaaattataatgaattagtatgcagttaagtagttattaaggatcaaaacaaatgaaatggtcagaattataagtcaagtctcttgtttttagtagctattggaagatcatgatatatagctcttttcaatgtgatattttctctttaacatttgggaaattatgaagacatttcagatttttccagtagatggcagaattgttttaaacattttagattcactgttaaattttttttgaattgatttgaaggagtaatcatttctctaaaataactggatgtattttttcttccaaataagccctgcactactgttttataaactaacttttaagataaagatttttaaatgataatatggatcattcctaatcagtaatgcacaatgatagaagtggcaattatattttgaagaatggataaaaaaattttaaatcaaacatttagttttttcaatagtaagtaacattctttctttagttatcagagatccagaggtcacatgatgtaatcatcaccatgggcatcatcagattgatagaatatcctaaaatattttgattttagctaaaacatgccttcggtttagtgatatctataaaaagttgaacttactttaaaatactttgttgactataaaatagtaatttaaaagtttttatacaggttgtctcagagttgtttgaaggttggatttttaattttctgatcttcattttgaaatttcatgtcttatgttttcttctgagactatttcaaatacttactgaattcccttagttcgtgtgtatatgtgttcatgtacttaaatatttaattgtattttgttgaggggaaacaaaaacccttctcccttacttatacaaatagtaccacatctgtgtcacactttcaaacagaaaaacaggaggatgaaatgtgttcacagtcgtacctgtcagttctttatgctttatgcttatgaagttaaggaaccttaatcttgaattctagttttccctgccatagaaatatgaaacattttaacagaaatggaactaataatggatgagtgactaagctgggttatgtttctaagtgaggttgaaaatatttcatgtaagagaaaaagagttatttgtctccttttgttttgagggttttgtaattgctttatattaagaatagtagtgtcaataataacaataatgagaattagtatttcttaaatactgtgtataggcactatgcctagcatttgttgtgactcgctgtatttgttgaagaatataataaatgagggaaaataatatgtctagtgttgatttgtcaatatcacgtagctatgaaactcaatttgcattctttttgtgtaaaacccagtttctctgcatcagtgtaaatcacatgaaactattacttttcatactccctcacttttcaaagtactactcagttcagcagttcctttctgctgctgtttgaagactttgtaagtgtgacttactctgcaagagttgtaaaagtgagttgacaaggttgcttttgagatttttcaattgaattgggtttggtagagatagtatcttcagaactatatgtcagacttcactgtttgattgtttgaataaatttccattcttataaaatgaattggaaatgtacctgattttttttaaaattaggtttgttatttttacacttaaaaggctgtttttttgcttttatctttatttccgtttaggtgactggtgcctccatcttgtggtccaactcacaaattgcatcctttgctagagattgtgtttacactttttttcccctcagctgaataaatgacagaaaattattttctgttttatttattaaaaatataactccgattaagcatacattaccttcaaagaggacagaaagtgctcaaaagggaccacctaaagcaacctgttcaaggatgaagtcttgtaaaataaattattattgttgatggtagtggtgatggatgatggtggtggtagtggtggtggtggtggtgaatgagagagaggatgaagttcgatttgctctttatgttgaaaaatgaaacttaaagtcttcagcaaaatttactgtataacttggtcaggcatggtggttcacgcctgtaatcctagcactttgggaggccaaggcgggtgcatcacctgaggtcaggagttcaagatcagccaggccaacatggtgaaaccctatctctattaaaaatacaaaaattaggccgggcacggtggctcacgcctgtaatcccagcactttgggaggccaaggcgggtgggtcacgaggtcaggagatcgagaccatcctggctaacacagtgaaaccctgtctctactaaaaatacaaaaaattagccgggcatggtggcgggtgcctgtagtcccagctactccggaggctgaggcaggagaatggcgtgaacacgggaggcggaacttgcagtgagccgagattgtgccactgcactccagcctgggcgacagagcaagactctgtctcaaaaaaaaaaaaaaaaaaaaaattagccagacatggtggcaaatgcctgtaattccagctactcaggaggctgagacaggagaatcgcttgaacccaggaggcagaggttgcagtgagccgagattgtgccaccacactctagcctgggcaacagaaggagactctgtctcaaaaaaaaaaaaaaaaaaatttactatgtaattgcaaccttagctaattattagaattaagaatgaatcagtatctgtggtcctacttaggaagctttggtagcaggatcgcttgagctcaggagtttgaggttacagttaactatgattgcatcactgcactccagcctgagtgacacagcaagactctttctctaaaaaaaaaaaaatcttaaaaaagaatgaattaagtactattttttcctccagctttattgaagttcaatttataaatacaaattgtatatatttatattgttgagtatgcttgaacaccataaatatatgtatacattgatatatacttcgtgattaccacaatcaagcttaggcaacatatctttcacctcacatagttatcttggttttttttttttgtagtgaacaagtactgatttttttaacataggttttctgacaaaactatgatagcacaatatgacattcttcttttcacatttgtctccatggaattaacaaaagtgactttttttgcaaaagttgaaagcatcatcaagttttctaaagatttttattactcagtgattaatactgtattcactgtcctttaaacacctttcatgttccaattcttattggtctaactaccttggccacgttttcaattagaaagtaataattttctcatgaagctatattattttcatagacttcatgaaactttatctttttgagatttgcaattttactttgcattcaccttgtgctacattcataaacattagaaaattgcgtggtggctcacgcctgtaatcccaacactttgggaggccgaggtgggcagatcacgaggtcaggagatcgagaccatcctggctaacacggtgaaaccccatctctactaaaaaatacaaaaaattagccaggcctggtggcacgcgcctgtagtcccagctactttggagtctgaggcaggagaattgcttgaacccgggaggcggaggttgcagtgagccaagatcacaccgctgcactccagccaagtgacagagtgagactgcatcttaaaaaaaaaaaaatggagagactgacttataaacaaagagattgtcatttatttatttatttatttatttttgagacagagtcctgctctatagcccaggctggagtgcagtggcgcgatctcggctcactgcaacctgcgccttccaggttcaagtcattctcctgcctcagcttcccgagtagttggaactacaggcacgtgccaccatgcctggctaatttttgtatttttagtagaggcagggtttcaccatgttggtgaagctgggctcaaactcctgacctcgtgatccacctgccctggcctcccaaagtgctgagattacaggtgtgagccactgcacccagccaagattgccttttaaagatgaggtagagattctaatattgagtagatatctaaatgtcccctgatataagttacatagtgaagatttttatttaccttgaaactattgttttcctacacgtactaggaacttcagttactctgttaatgagtacacagtcagtgaggaattcttggatgtaaataagtctgcaacttgccttcccctcactggcaagatttttgaaaagggagtcaacctactgacttcatctctcatctagaattcatctttccataagtgttgtacattgtactgcatttcccatttggattataggcgattgcttgtatagctaggtccctgactctgtgttcttctggacattttctagattgtagcaggtattcagcaaaacttgttcatccatctgactgatatttattgtataccttgtaggccaggcacagttctaggcatttgagatactatattaataagcagaatactgaaaaatccgtggctttactgagcttacattgaagctgaaggaatcagatggttttaaaaactgtcatagttgttacagtgtggtaagtgtcaagagaaaagaaaaactaggttagagttgagatcagaagtgttggctgtagagagtgggttgaaatcttaaatgtgatggttagggtagattcattgagaaggtgatatttgaacaaagacttgaagggagtgaggaagttagctaagtgaatatctggagtaagagcacaccaatcagagggaatagcagtatacattttgctttcactgtgaataaaatggagaattattccagggtttttagcaaaggagttacataatctaatttatgattttaaaaggattgctgaatttttttttaattgagaatagactgtagcaggcagagattgaagcagggagatcatttaagaggcttttttgatgttgtttttgttttaactcttcaacaattttagacttacagaaaagttgcaagaataatacaaagaattctcacatactttccccaaatcaaccaaatgttactgttataccacatttggttcatctttccaatttttaagatttattttttaaattaacaaataagatgtatatatttatgatgtatagcataatgttttgatatatgtatatattgtggaatggctaactcaagctaattaacatatgtattacctcataatttttttttgtggtgagaacacttaaaatctctcttagcacttacaaagtgtacaacactttttttttttttttggagaccgagtctcactctgttgccccggctggaatacagtggtgctatcttggctcaccgcaacctctgcgtcccaggttcaagcgattctcctgcttcagcctcctaagtacctgggattgcaggcgtgcaccaccatgcctggctaacttttatattctttggtagagacagggtttcaccatgttggtcaggctggtcttgaactcctgacctcaagtgatctgcctgccttggcctaccaaagcgctgggattacaggtgtgaactaccgcgcccggccacataacgttgattaccattaccatgttgtacaatggaactcttgaacttactccgtcctgtcaaagaatgttcatatcctttgaccaacatttccccaatacctaccacccaccagactctggtaactcctcctgttcctgcccttttttgacccaggtgccttaccattttcagatgaccttcatcaactaaatcctttgtcacgtattttctgtccgttcctcatgttatggttgttgctatgtctgagaatagtttaatgcagtactaggaagaggttcccaaacctggccaattgtcagaatttccccaaacacactaacataattagaatctccccaggtttttccgatttttcaactaggtctaggaaccactaacatgacagatacagaagacagaaaaattgtactgacctgagcccatacctaaagtaaatgatttcaaatctgacttgacatagctgagaacataattttcctccgactttattaaggtataattgacaaaaattgtatatatttacagtgtacaatgtgatgttttcatatatgtatacattgtgaaatgattaaatcaagctgatgaacatatctacacctcacaggcttatttttttgtggtgagaacacttaagatctaccttagcaattttcaagtatataatacattactattaaatatagtcaccatgctgtacaatagatctctttaacttattcatcctgtttaagtcaaactttgtactctttgaccagcgtctccccatttccccaccccagcccctggcaaccaccattctaccctttgtttctatgagttcagctttataaagattccacatataagtgaaatcatgtggtatatttgtctttttgtgcctgtcttatttcacttagcgtagtatcttccaggttcattcatgttgtcataaatggcagatttccctctttttaaatgtttaatagagttccattgtgtatatataccacattttccttatctgttcatctgtcaatagacacttaagttaattccctatcttgattattctaaataatattacagtgaacatgggagtgcagatatctctttggcatactgatttcatttcctgtggatatatacccagtagtgggattgctagatcatatggtagttctatttttagttttttgagaaatctccatactgtttttccataatggctatactaatttacattcccaccaagagtgtgcaaggttttccttttctctacattgtcgacaacacttgttaccttttgtctttttgatactagccattcgaataggtgcgaaggtatgtcttgttgtggttttaatttgcgttttcctgatgatgattgatgttgaatattttcttcacatgcctgatggccatttatatgtcttcttttgagaaatgtcttcttagatcttttgcccaattatgaatcagttattagttttttttcctgttgaattgtttaagttccttgtatattttggatattaaccctttatcaggtgtacagtttgcagatactttctttcattccaaaggttgtgtctttactctgttgattattttgttgtgcagaagctttttaattagaggtaatcccacttgtttatttttgcttttcttgcctgtgtgtttggtgtcatatccaagaaattattgccaaggccaaaaagcattcccctctgttttcttctagttttacagtacaagtcctgtgttttaagtctttaatctatttcaagttgatttttgaatatagtgtgagatgagggtctaatttcattcttttgcatgtggatatccagttttccaaacattatttattgaagagactttcctcttcccatctgtgttcttggcatctttgtaaaaaatctattgatggtaaatgcatggctttatttctggacatcctattctgtcccagtggtctttgcgctaataccatgttgtttagctactttagccttatagtagattttgaaatcaagtagtgtggtgcctcagccttgttccttctgctcaagattgctttggctatttagagtctttggtggcttcactgaaattttaggattgtttttcactatttctgtaaaaagtgttattggaattttgatagggattgcagtgaatctgtagattgcatagggtagtatgaatatttagccaatattaattcttccaatgcatgaaacagagtatgtttccattcagttgtgtacactgcagtttcttttgtcagtgttttataatcttcagtgtatggatttttcacctccttggcgaaatttattcctaaatattgtattaatattattttgtagctatagtaaatggaattgatttttttattcttttattggatagtttatcagtgtatagaaacactgattttttgtgtcttgatttttgtaccctgcaacttcactaaatgtattagtaacagttttttagtggcatttttagaattttttaagaatataacatcttgttgtctgttaacagatacagtgtaacatcttcctttctgattcagatgtcttttatttatttttcttgcttaattgctcttgctagtatttctggtactatgttgaatacaagtggtgagaggtgagcatccttgtcttgattcggatcttagaggaagagctttcaactttttactgttgagtatgttaactatatgtttatcatatatggcctttattgcattgagatatattccttttatacctaatttgttggaagttttttttttatcatgaaagagtgttgaattttgttgaattccttttctacatctattgagatgatcatatggtttttgtccttcattctgttattatagtttatcacatttattggtgtacattggcaaaccattcttgctttccagggataaatctcacttgatcatggtgaatgatctttttaatgtacccttgaattaggtttgccaatattttgttgagagattttatatctatgcttatcaggaatattggcatataattttcttttcttgtaatgtccctttctggccttggtatctagtaatgctggcattatgaaatgagcttggatgtttcccttctcttcagttgttttggaagagtttgagaaggattggtattaggtcttctttaaatgtttggtagaattcagcagtaaagccatcaggttatgggcttttctttaatgagagactttattactgatccagtctccttacttgttactggtctgttcagattttatatttcttcatgattaagttctgttaattgtatgtttctagaaatttatatatttattctaggttatacaatttgttgggaaataagtgttcatagtagtcttttatgatcctttgtgtttctttctgtagtatccgttgttgcttcccctttcatttctgatattatttgtatattctctcttttttcttagtctatctaaaggtttgaccatttttaaaaaatcttttagaaaaccaatttcttagtttcactgatcatatctattgggtttctagtctccatttcctttttatctgctctgatattttttatttcttttcttctattaactttgagctaagtttagtttgttcttttctacttcctgaggcatagtgttagattgtatatttgagatttttttaatgtaagtgttcattgccttaaattttcgtcatagaactacttttgttacacgctataagttttggtatgttatgtttccatttttgttttttgaaaaatttttttatttaaaaatatttttagtttttaatttttgtgggtacatagtaaatgtatatatgtataggttacatgagatattttgatatagctgtgcaataaataataatcaaatcaggggtattcatcacctcaagcattcatctgtactgtgaacaattcaattacactcttctagttattttaaaatgtaaaattaatttatttttgacaattgtcaccctgttgtgctatcaaataccaagtcttattcattctttctattttttttgtaccacttaaccatctccacttccccaccacccctctactaccctccctagcctctggtaaccatccttttctgctctctatcttcatgaattcagttgttttaatttttagcttccacaaataagtgagaacatgtgaaatttgtctttctgtgctgggcttattccactttgcataatgacctctgggcccattcatattgttgcaaatgacaggattgcattcttttttgtggctgaatggtactccactgtgtatgtgtaccacattttctttattcatttgtctgttaacggacatttaggttgcttccaaatcttcattattgtgaatagtactacagtaaacatgggagtggagatatctctttgatatactgttttcctgtcttttgggtatgtacctggtaggggattgccagatggtatgttagctcaatttttagctttctgaggaaactccaaactgttatccacagtgattgtactaatttacatttctaccaagagtatacaagggttcttttttctccacatcgttgccaacatttgttactgcctgccttttgtatataagccattttaaccagagtgagatgatatctcattatagttttgatttgcatttctctgatgatgaacgatgttgtgcaccttttcatatacctgtttgcaatttgtatgtcttcttttgaaaatgtgtattcagatgttttgcccatttttatattggattatcaggtttttttttaccatagagttgaaaacaatatagagctccttctatattctggttattaatcccttgtcagatgggtagtgtgcaaatatttttcacccattctgtggattgtctcttcattttgttgattgttttctttgctgtggagaagctttttaacttaatgtgatcccatttatccatttttgctttggttgcctgcacctgtagggtattactcaagaaatctttccaagaccaatgtcctggaaagtttccctactgttttctttcagtagtttcatagcttgaggttgtagatttaagtctttagtccattttgatttgatttttgtatatattgagagataggggtctaatttcatttttctgcatatggatatccagtttttccagcaccatttattgaagagaatgtcatttccccactgtgtgttcttggcacttttgttgaaaatgagttcactgtaggtgtatggatttatttatgggttctctattctgttccactgacctatgtatctgttgttatgccagtaccatgccattttggttattatatctctgtagtataatttgaaatcaagtaacatgattcctccagttttgttcatcttgcttagaatagctttggctattcagggtattttatggttctatatacattttaggattgtttttctgatttctgtgaagaatgtcattggtattttgatagggattgcattaaatctgtagattgctttggatagtatggacagtttaacagaattgattcttcccatctatgaacatggaatatcattctatttttttgcatgtgtgtcctcttcaatttgtttcatcagtgttttatagttttcattgtagacatctttcacttttttggttaaggtaatttttaggtattttagttgtacttattaatgggatttcttgatttctcttgaagattgtttgctactgatttttgtatgttgattctgtatctcacaacttaatttatttatcaatttcaatagttttttagtggagtatttaggttattccaaatataagatcatatcctctgcaaacaagaataatttgacgtcttccttttcaatttggatgccctttctttctcttgcctgattgctttagctaggacttccagtacgtgttaaataacagtggtgacagtgggcatccttgttgtattccagatcttagaggaaaggcttttagtttttctccattctctccattattgagatgtaaagttcaatatgtaggctgttaaactcttcatcattgattatgttatttggttgtttatatccttatatatatatttttgtctacataatttgtctcatattaaggaggattattttaaagttttctttttttactgtatttttatctgtgttctaccaatatcatttgtgtttgcttcattgagtggtggttctgttatttattgaatagttatttataatttgtctttattgtgaactgtggctgaaaattttgggtcatgcttaatgctctctaattctattttaatatttgaatcacaacctctatttcttttttcgttttttttttaaattgtactttaagttctagggtacatgtgcacaatgtgcaggtttgttacatatgtatacatgtgccatgttggtgtgctgcacccattaacttgtcatttacattagatatatcttttttctttctttcttttttttttttcttttttgagacagagtctggctctttcgcccaggctggagtgcagtggctgatctcagctcactgcaagctccgcctcccgggttcacgccattctcctgcctcagcctctcgagtagctgggactgcaggcacccgccaccgtgcccggctaatttttttgtatttttagtagaaacagggtttcaccgtgttagccaggatggtctcgatctcctgacctcgtgatccgcccgcctcggcctcccaaagtgctgggattacaggcgtgagccaccgcgcccggcatatcccctaatgctatccctcccccctcccccaaccccatgacaggccccggtgtgtggtgttccccaccctgtgtccaagtgttctcattgttcagttcccacctatgagtgagaacatgcggtgtttggttttctgtccttgtgttagtttgctgacaatgatggtttccagcttcatccatgtccctacaaaggacatgaactcatccttttttatggctgcatagtattccatggtgtgtatgtgccacattttcttaatccagtctatcattgatggacatttggcacaacctctatttcttaatatttggctgatacaactttgcccattctttttgcccccctccctttttttttttttttttttctgagacggagtcgtgctctgtcacccaggctggagtgcagtggtgtgatctaagctcactgcaactgccacctcccgagttcaagcaattctcctgcctcagcctcctgagtagctaggattacaggcatacgccaccgagcctggctaatttttgtatttttagtagagatggggtttcaccatgttggtcaggctggtttcaaactcctgacctcgtgatctgcctgcctcggcctcccaaagtgctgagattacaggcatgagccactgtgcctggcccatttttttttttttttaattcttagcatttgatatggtttggctctgtgtccccactcaaatctcacctttagttgtaatctctaaatccccacttgtcaagggcgggatcaagtggagatagttgaatcacgggggtggtttccccaatcctgctcttgtggtgatgagtgagttctcatgagatctgacagttttgtaagggacttccccctcttcactcaccactcattctctctcttgccaccctgtgaagaggtgccttctgccatgattatatcttttctgaggcctcccaggtatgcggaactgtgagtcaattcaacctcttttctttataaattacccagtcttgggtattccttcatagcagtgtgagaacagactaatacagcatttttaaatcacttgttttaggtgtgtttcttgtgtacaggttatattagagtcttgatttgtcagccaagtttttaatctctttttttaaagtagaaaaactaagcacattctcatttactgatatgtgtattctgttttttttttttttggttttcttttttttttttgctatgttttaaaatttctcatggtatataggaaggtttgtagttttgtatttacctctgtatttctaccttttttaatgcccgtatttcttggtttcttattctattactatctcatttgttagtttctaatgatatcctttaattctcacccattttttttaccataaccaaagagcttataccccttttctttctccttttaactttgtctcctaatgtttagttgcatttttgacttcttttaaaatatatttaatacatagtatataacatataattaggttgtcttgcactctgatccttgcctttgttttagacttagatctctaattaaaggtattgaatgctcaccattagtctttttgctaaagttgccccagttaacacttggttggatgcagcttactttttggtagattcctcaagaagtgttcctgagtatagagttccctgagttcattcatgtctgtagtcttgaatcttcatgcttggatgtaacatccttgtctcatactttttttcttgagttttttgtttgcttgcttgtttgtttgtttaggaagcttactgttgccttgctttctatgttgttgttgagacatttgccaacataattttttccttttcacaaagggaaaaaaatataacacaaagatgttatattcaatcacaaagattcaaggctacaaacatgcgtgaactgagggaaattctatactcagaagcacttcttgatgaatctaccagaaagtgagctttgcgaaccaagggatgcctggggaaactttagcaaaaggagtaacgtaagttatgcagtagttttgtttggaggccttgagtatttttgtttttggagtcttataattttagtagaatatgtcttggagttgatctttctaggtgttaaatcacatgcattcttaagttctttattaagtcctctggtttttcaagatcctttttaatactttttacaaaaggatgaactttttcttcccggaggttattttattgagacaaggtctcactctgtcaccctagttggagtagagtggcatgatcctggctcactgcaacctttgcctcccaggctcagtgattctcccacctcagcctcctgagtagctgtgactacaggcacatgccattttgcctgtctaatttttgatattttgggtagagacagggtgtgatggttaatattgagtgttgacttgattgaaggatgcaaggtattgttcttcagtatgtctgtgaggacataagccaaaggagattaacatttgagtcagtggactgggagggacagacccactctcagtccaggtgggcaccatctaatcagctgccagtgctgctagattaaagcaggcagaagaaagtggaatgagcagacttgctgagtcttccaggcttcatctttctcctatgccggacgcttcctgccctcaaacattagactccaagttcttaagcttttggattcttggacttacaccagtggtttgccaggggcttttgggcctttgccacagactgaaggctacactgtcagtttttctgcttttaaagttttgggactcgactggcttccttgctcctcagcttacagttggcttattgtgggactttaccctgtgattgtgtgagtcagtactctttaacaaactttcttttatatatacctccatcctattagttctgttcctctagaggaccctgacaaattcacagggtttcaccattttggccaggctgctctcaaactcctgagctcaggtaatccaccctcctcgcatcccaaagtgctgggattacaggcatgagccactgccctctgccctgatggtaattttagatcaatcttaagcctgctgctagctccttctctcttctgggaattttctcagtttttcttggaatgtccttgtttttcatgaatgattgtgacaagagccagtaggatagcttactgagatttgtgtttgtttgtttgtttatttgtttatttatttatttattttgagacagggtctcactgtgttgcccaggctagagtgcagtggtgtgatcttggctcattgcaacttcctcctcccgggttcaagcatttctcctgcctcagcctcccaagtaactgagattacaggtgcacaccaccacatccagcttattttttagtagagacgaggtttcaccatgttggccaggctggtcttgaactcttgacctcaagtgatctatctgccttggcctcccaaagtgctgggattataggtgtaagtcaccatgcccagcctttttttctatttgcagataatttgaagtttattttccaattatgttgagggcatgagttttatttgttctttttggttttgtgtatgtatgtataatttatttttttaaggatattgtgttacgacactccaatttatttggccgtcattacctaggcttgctgttattttgaagtctcaagtgagcgaaagaaaggatttaagaatgattctaaggatttttacctaagtaattggaaggatagaattgtatcagctgaaatggggaaggctgcaggagcaactagatataaaggtaagatcagatattcagtctcgggttgtgtttaagatttctgtttgatatctaaacagagagattcagaaggtcagttggataaatgagcctggaatttaggagagacatctgatttggaaggaaaatttgtgagttattaacaatagatggtatttaaaagcatggaactagatgagatctcctacagtcagtatagacaacagaaccagaccaaacacagaacactggtgtcttctgcattaattggtttgggatatgagaaggaatcagcaaggggtgactgatcagctgctgatttcttggtcaatcagtagctgactccttggtcaaaaaagaatgagccataaagtagaaggaaaactatgaaagtcaggtgccctggaagccaaataattttttttttaacaagaagggagggagaatgttactgatgctactgatagttcaagtacgatatgccgttagaattaagaattggatttagcaacatgtaggtcattgataacattgacaggagcagtttgtggaattaaattataatcagcgttgcaatacttttaaattagtcttgtcaatttggtgcccttggcatatgagcaggatgaagatgatccaagtagcttggcctctggccttcacttgttttaaaagaactgctaatctttgttctaattttgtatactgggtttccatgtaatattttctttgggattggtagttataagggtctactataaagtaaataaatacactaacagtttcaaaaataataaagaactttttaaagaacacattactagatgtaaatttttaaaaaaatttaatgggaattttttgttttaatacgtctctaattctagtatcaaatgaagtagactttgattagaatgtatgtgcttttttttttttcttagcttctcttaatgcgtaagcttaaagcttttttaggctttatgtatgccctcagactcattcatttctttaaatttctcagactcttctaagctaatattcacatattatagtctttctgtcctccgcacttatgttgatccttaacatatagctgatattttgtcagtgttttttaaattgaaggaaatggaccccaagggggtagactttggcttactttgtctcatttcttttcttgcagtgcttctgctggcctgtctcttaagcagtagaataataaaaagtagtttctttgaggatataaaagcccttgagatagtttcactttaagcttaaaagattttcttgtcattttacctctaaaatttgattttcatgtttctttttagtatgtattttctgaaccctcctcttgtgcattttaaatgaacctatatttggtaactgttcccagcaatgcctttttctttttcataaggaacctgatacgttattctatgcctatgtggtatttagggaggcagatggtataatagaaggagaaatgagcagtacatcaaaaccagggccagcttctgccacttgcattcatctttttagtaaataattattgaatatctatcttctgtgtgctaggtatttactagaagtttgtgcttgtgttttaattaatagactttattttcttagaaatgccattttcacaaattactttctcttagatactaagatctagtctgtaataaagtattaagtactaaatgagcaatattaaaaattaatataatattaaaatataggtgttataaaaattgaaaacactggtggagtgtggtggctcacagctataatcccaacactttgggaagccgagccaagaggattacttgaggccaggagattgagaccagtctggaaaacagagtgagaccccatctctacaaaaaatacaaaacattagctgggcagagtggcatacatctgcagtcctggctactctggaggctggggtgttgggattgtttgagcccaggagttcgagattacaatgagctatgattgtgccattgcagtccagcctgggttatggagctgtctccaaaaaaaaagaaaaaattgaaacaaacgacttttccttggttgttggagattggtatatattgtcatggaagatcaaaagtaaaattatgagcagagaggaggcagagcaaaatggctgaatagaagccaccaggccaggtgtggtggctcacaccagtaatcagcactttggaaggccgaggtgagcagatcacctgaggccaggagttaaaagatcagactggtcaatatggtgaaaccccgtttctactaaaaatacaaaaattagccaggcatggtggcacacgcctgtaatcccagctactggggagtcagaggcaggagaatcgcttgaacctgggaggtggaggttgcagtgagccaagatcgtgacactgcactccagtctgggctacagaacaagactctgtctcaaaaaaaaaaaaaaaagaaaagaagccaccagcagtcatccagtcacctccttctgggaacaccagattgaacaactatgcacatgaaaaagcacctttatgagaaccagaagcagagatgagtgatcatagtacctagttttaaaatcataataaggaaagaggtactgaagagagtaggaaagactcgtcccccattccctggtagcagctgtgggccactgagatcatatctgtgtgcttggggaagggagagtgccgggattatcagacattgcgttagaactcagtgccctgtcacagtggaatgcaacacagggtggaactcagctggtgcccattgagggagcattaagaccagccctagtcagaagtgaatcgtctatctcagcagtgggaacctgagttgtggcaagccttgatactgcgggttaaagtcctctggggtccttgataaacttgacagacagttgtattagtctgttctcacactgctataaagaaatacctgagactgggtaatttatggagaaaagaggtttaactggctcacggttctgcaggctgtacaggaagcatagtggcttctacttctggggaggcctcaggaaacttacaaccatggcggaaggcaaatgggaaacagaaacatcttacatgtccagagcaggagcaagcagttgggggaggtgccatacacttgtaaacaagcaaatctcatgagaactcactattgcgatgatagcaccaagggggatggcgttaaaccatgagaaactgcttccattatgtaaccaccttccaccaggtcccatctccaacattggggattacaattcaacatcatatttgagtgaggacacagacccaaatcatatcagcagtctaggacacaaggactacaattcctggcctagttttggtgctgtactatgctgggctcggagatggtggacttgcggtgcctatgacctagtgagacaccagctgggatgcccaagtgagtgcctgtgtcacccctcctttaaccctagggagtgcagctcgcaattctaagaaaacctctttctccctgcttgaagaaaggagaagggagcgtaaacacgactttgttcttccaacttggataccaactcagccacagtagatagaggaccaggcagagttctgagacctccatttcaggttttagctcctggatgacatttctagacacatcctaggccagaaggaaatccagttttgaagggaaatacctggtccctgcaggatttattacttgctgacaaaagtgccttgggccctgaataatcagcagtagtagctaagcagtactcactgctggcttcagataagattcagagctattctggcttcaggtgtgacccagcacattccagctgtggtggctacgggtaatgactttttctacttgaaaggagagaggagactaaggggattttgttttgcagcttgtgtaacagctcagccacagcagggtagagcactaagtgggctcatggggcccccacttttaggccctggctcctgggtggcatttctggatctgccctgggccagagggaagcccagcatcctaaaaggagagagactcaggactggcagtattcagcataagctggccgaaaagcccttgggccttgagtgaacaatggtggtagccagaccatactcccttcagggttcgggcagtggtggccatagggtgagacttctctacttgaggaaaagggagagaagactgggaagaactttgtcttgtggctcaggtgccggctcagccacagtggaatagagcagcaggtagattcctaaggtccctaattcccaaccctggctcctgaatggcatctctggacctgcccaaggccaggagcaacttgctcccctgaagcaaacaggacataagcctggctggatttgtcacctgctgattgtagagcccttggacttgagagaacatagatggggtagccaggcattggtcactgtagtccttagtgagacctcgtgtgtgctggctttcaatctaatccaaagcaatacaactagtggtgaccacagggatgcttgttttacctctcccccagctccaggcagctctgcacacagagactctgttaagggaagaggacgaaaatgtctgccagggaatccagggaattctgcatattacccaagaccaccaacgtgtacctcaataagccagcaagcactacagcattactgggcttggggtacttcctaatgcagatattaccgcaatgaccaaagaccaaagatcataacaccctttgaatacttggaaagccttcccaagaatgatgagtacaaacaagtctagactgtgaagactacaataaatgcttaattcttcaatgcccaggcagcagcgaatatccataagcatgaaaaccatccaggaatacatgatctcaccaaacaaactaaataaagcaccagtgaccagtactggagaggcagagatatgtaacctttcagagaattcaaaataactgtattgagaaaacccaaagacatgatgtaatcctattcctattccagagaaggaattcagtattctatgagataattttaacaaagaaatacaaataattaaaaagatcaagcagggcaggtgcagtagctcatgcctataatcccagcactttgggaggctaagacaggtggattgcttgaggtcagaagttcgagaccatcctgggcaacatggtaaaaccctgtctctactaaaaatacaaaaaattagctgggtgcagtggcacatgcccatagtcccagctactcagaaggctgaggtgggtggatcacttgagtctgggagacagatgttgcagtgagctgagattgcaccactgcactcaaaatattttttgaaaagcagaaattctggagttgacaaatgcagttgacacactgaacaatgcatcagagtctattaacagcaaaaatgatcaagcagaagaattagtgagcttgaagatgggctatttaaaaatatacggtcaaaggagacaaaagaaatgagaataaagaagaatgaagtatgtttacaagatctagaatgtagcctcataagggcaaatctgagactctgaactcaaaaaggagataaagagagagatggggtagaaagtttattcaaagaggtaatagagaacttcccaaagcttagagaaagttatcagtatttaagtacaataaggttatacaacaactaagcaggtttaacccaaataagactacctgaagacatttaataatcaaactcccaaaggtcaaggataaagaaaggatcctaaaagcagcaagagaaaagaaacaaataacatacaatggagctcaatacatctggcagccaacttttcagtaaaaaccttacaggtcaggagacagtggcatgacatatttaacatgctgaaagaaaaaatacatatattagaatagtatatctggcaaaaatgtccttcaaacataaaggagaaatactttcccaggcaaaatacctgagggacttcattgatctcagacctgttgtatgaaaaatgctaaagggagtttttaagtgtgaaagaaaaggacattaatgaacaataagaaatcatctgaagatacagaacttactggtaataatatgtacacaggaaaacaaagaatactgtcacactgaagttatggtgtgtaaactacttatatcttaagtagaaagacaaaaagatgaactgatcaagaataataactaaaacaattttttaagacatagtacaataagatataaatagaaacaacacaaagttaaaaagtggggagacagtgtaaagtttttattagcagagctatattaaccaaaacagcatcatagtggcataaaaatagacacacagaccaatgaacacaatagagaatccagaagtaaatctgtacatccacagtgaactcattttcagcagagatgccaagaacatacagtgaggaaaagacagtctctttaataaatggtgctgggaaaactggatatccatatgtagaaaaatgaaactggacccgtctctcaccatatacaaaaatgaaataaaaatagactgaagacttaaatataagaattcagactgtaagtactaaaggacatctttggagaaacacttcagtactttgaactgggcaaaaatttccccacaagcacaaacagccaaagcaaaaatggacaaataggattacatcatgttgaaaagcttgtgtgtgacaacaaaagaaggcacacaaacagcaaagaagtaaatgaaaaggtactcacgatcactgattatattagtctgttctcatgctgctgataaagacatacctgagacagggcaattttcaaaagaaagaggtttaatggacttaacagttccacatggctgcagaggcctcacaatcatggtggaaggcaaggaggagcaagtcatatcttacatggatggcagcaggcaaaaaagagagagcttgtgcagggaaactcccgtttttattttttaattttttaaattttttgttatactttaagttttagggtacatgtacacaacgtacaggtttgttacatatgtatatatgtgccatgttggtgtgctgcacccattaactcatcatttaacattaggtatatctcctaatgctatccctcccccctccccccaccccacatcaggccctggtgtgtgatgttccccttcctgtgtccatgtgttctcattgttcagttcccacctatgagtgggaacatgcggtgtttggtcttttgtccttgcgatagtttactgagaatgatggtttccagcttcgtccatgtccctacaaaggacatgaactcatcaatttttatggctgcatagtattccatggtgtatatgtgccacattttcttaatccagtctatcattgttggacatttgggttggtcccaagtctttgctattgtgaatagtgccgcaataaacatacgtgtgcatgtgtctttagagaagcatgattcgtaaacctttgggtatatacccagtaatgggatggctgggtcaaatggtatttctagttctagattcctgaggaatcgccacactgacttccacaatggttgaactagtttacggtcccaccaacagtgtaaaagtgttcctatttctccacatcctctccaacacctgttgtttcctgattttttaatgattgccattctaactggtgtgagatggtatctcattgtggttttgatttgcatttctctgatggccagtgatgatgagcattttttcatgtgtcttttggctgcataaatgtcttctcttgagaagtgtctgttcatatcctttgcccacttgttgatggggttgtttgtttttttcttgtaaatttgtttgagttcattgtagattgtggatattagccctttgtcagatgagtgggttgcaaaaattttctcccattcagtaggttgcctgttgactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctggggtttttatggttttaggtctaacatttaagtctttaatccatcttgaattaatttttgtataaggtgtaaggaagggatccagtttcagctttctacgtatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggcaatgtggctcttttttggttccatatgaactttaaagtagttttttccaattctgtaaagaaagtcattggtagcttgatggggatggcattgaatctataaattaccttgggcagtatggccattttcacgatactgattcttcctacccatgagcatggaatgttcttccatttgtttgtatcctcttttatttcattgagcagtggtttgtagttctccttgaagaggtccttcacgtccctttgtaagttggattcctaggtattttattctcttttaagcaattgtgaatgggagttcattcatgatttggctgtttgtctgttattggtgtataagaatgcctgtgatttttgcccattgattttgtatcctgagactttgctgaagttgcctatcagcttaaggagattttgagctgagacgatggggttttctagatatacaatcatgtcatctgcaaacagggacaatttgacttcctcttttcctaattgaatgccctttatttccttctcctgcctgattgccctggccagaacttccaacactatgttgaataggagtggtgagagagggcatccctgtcttgtgccagttttcaaagggaatgtttccagtttttgtccattcagtatgatattggctgtgggtgtgtcatagatagctcttattattttgagatacgtcccatcaatacctaatttattgagagtttttagcatgaaggttgttgaatgttgtcaaaggccttttctgcatctattgagataatgtggtttttgttgttggttctgtttatatgctggattacgtgtattgttttttgtatgttgaaccagccttgcatcccagggatgaagcccacttgatcatggtggataagctttttgatgtgctgctggattcggtttgccagtattttattgaggttttttgcatcgatgttcatcagggatgttggtgtaaaattctctttttttgttgtgtctctgccaggctttgttatcaggatgatgctggcctcatcaaatgagttagggaggattccctcattttctattgattggaatagtttcagaggaaatggtaccagctcctccttgtacctctggtagaattcggctgtgaattcgtctggtcctggactgtttttggttggtaagctgttaattattgcctcaatttcagagcctgttattggtctattcagagattcagcttcttcatcgtttagtcttggaaggatgtatgtgtcaaggaatttatccatttcttgtagattttctagtttattttcgtagaggtgtttatagtattctatgatggtagtttgtatttctgtgggattggtggtgatatcccctttatcattttttgttgtgtctgttttattcttctttgttttcttctttgttagtcttgctagtggtctatcaattttgttgatcttttcagaaaaccaactcctggattcattgattttttgaaggcttttttgtgtctctatctccttcagttctgctctgatcttagttatttcttaccttctgctagcttttgaatgtgtttgctcttgcttctctagttcttttaattgtgatgttagggtgtcaattttagatctttcttgctttctcttgtgggcatctagtgctataaatttccgtctacacactgctttaaatgtgtcctggagattctggtatgttgtgtctttgttctctttggtttgaaagaacatttttatttctgccttcatttcgttatgtacccagtagtcattcaggagcaggttgttcagtttccatgtagttgagtggttttgaatgagtttcttaatcctggaaactcccatttttaaaaccatcagatctcaggagactcattcactatcatgagatcggctcaggaaggacccgcccctataattcaatcacctccccactgggttcctcccaccacatgtgggaattgtggtagttacaattcaagatgagatttgggtggggacacagccaaacagtatcactgattatgagaaacattaaaatcagaactacaaggagatatctcattccagctaaatggcttgtgtccaaaagacaggcaacaacacactggtgaggatgtgaagaaaagggaccccatgtaccatgctgatgggattgtaaagtagtataatcactatggaggatggtttggaggttcttcaaaaaactaaaaatagggctaccatgtgctccagcaatattactgctatgtgtatacccaaaaggaaggaaatcagtatatcaaagagatgtctacactcttgtgttcattgtagcactattcacaatagctaagatttggaagcaagctaagtgtccatcaagagatgactggataaaatgtggtacattgtacaataaaaatggaatttaatttggagaaaatcagtcaaaactatacagttatatggcaattaaacatgctcctgaatgacttcttagtaaataatgaaattaaggcagaaaacaagaagttatttgaaactaatgagaacaaagatacaacatactagaatctctggggcacagatatggcagcattaagagggaaatttctggcactatacactcacatcaaaaattagaaagttctcaacctaatgtcacaactagaaaaactagacaggtaagggcaaaccaacctcaaagctagcagaagacaaaaaaaataaccaaagtcagagctgaactgaaggagattgaaacatgaaaaactggccaggcatggtggctcatgcctataatcccagcgctttgggaggctgaggtgggcagatcacagggtcaggagtttaagaccagcctggccaacatagtgaaaccccatctgtactaaaaaaatacaaaaaataagccaggcgtggtggcgggtgcctgcaatcccagctattcaggaggctgaggcaggagaatcgcctgattccaggaggtggaggttgcagtgagctgagattatgccattgcactctagcccgggcaataatagtgtgagactcttttgtctcaaaaaaaaaaaaaaaaaagaaacatggaaaaccatacaaggaccaatgaatccaggagatagtttttttgaaagaattaataatatagactgttaagtacacaaagaagaaaagagagaagatccaaataaacaaaattagaattgagaaagagaatgttaccgctgaccccacagaaatacagataaccatcagagactactatgagtacctctatatatacaaactagaaactccagaagaaatggctaaattcctggacacatacattctcccaagactgagccaggaagaaattgaatccctgaacagaccgataatgagctctaaaactgaatcagtaataaatagcctaccaatcccccataaaagcccaggatgagaaagattcttggctgaattccaccagatgtataaagaagagctggtaccattcctactgaagatattccaaaaaattgagaagggatttcttcccaactcattctatgaaaccagtgttattctgataccaaaattggcagagatacaacaacaacaatagcaataagagttcaggccaatatctttcatgaacataaatgcaaaaatcctcagcaaaatactagcaaatccaatccagcagcatatcaaaatggtaatccaccatgatcaagtaggctctatccctgggatgcaaagttggctcaaaatacacaaatcaataaatgtgattcattacataatagaactaaagacaaaaaccatgtgattatctcaatagatgcagaaaaagcttttgataaaaattgaacatcctttcatgttaaaaactcaataaattaggcattgaaggaatgcaaataataagagccaactatgacaaaccctcagccaacatcatactgaatgggcaaagctggaagcattcttcttgaaaactggcaaaagaccagaatgccctctcctaccactcctattaaacataatactggaagttccagccagggcaatcaggcaagaaaaagaaataaaaggcacccaaataggcaaagaggaagtcagactatccgtttgcagaaaacatggttctatatttagaaaaccccatactcctggccaaaaagcagcttaagcaacttgagctgataaacaactttagcaaagtttcaggatacaaaatcaatgtacaaaaattagtagcatttctttacaccaacatgcaagtgaagagccgtatcaggaatgcaatcccattcacaattgccagaaaaagaataaaatacctaggagtacagctaactagggaggtaaaagatctctacaatgagaattacaaacactgctcaaagaaattagagatgatacaaagaaatgagaaaacatttcgtgttcactgataggaagaacccaatattttttaaaatggccatactcctcaacacaatttgcgattcagtgtgattctaatcaaactaccaatagcattattcacagaactagaaaaaaacttttaaaattcatatggaaccaaaaaagagctcaagttgccaaagcaatcctaagcttaaagaacaaacctggaggcataatgttacccgacttcaaactacacccacagggctgtagtaaccaaaacagtatggtactggtacaaaaacaggcacataaaccaatggaacagaatagagagcccagaaataatgccacacacctacaaccatctgatctttgacacagctggcaaaaacaagcaatggggaaaggactccctattctacaaatgatgctgggataactggctaggtatatgtggaagactgaaactggacccctttcttacatcatatataaaagccaactcaagaatataacgctgtaaatgcaaaatctaaaactataataccctggaagatgacctaggcaataccattctggacataggaactggcaaatattttatgacaaagacaccaaaagcaatttcaaccaaagcaaaaattgagaaatgggatctaattaaactaaagagcttctgcacagcaagagaaactatcaacagagtaaacagacaatctacaaaatatgagaaaatatttgcaaactgtgcttctgacaaaggtctactatccagaatctgtaaggaaaattaaaattaaacaaattttataagcaaaacccaaacacatgaacagatgtttttcaaaagaagacatacatgcagccaacaagcatatgaaaaaatgctgtacgtcagtaataattagagaaatgcaaatcagaaccacagcgtgatatcttatattagtcagaatggctattattttaaaaatcaaaaaattacagatgctggaggggttatagagaagagggaacacctatacactgctggtaggagtgtaaattagttcacccattgtggaaatcagtgtggcaattcctcaaagaacttagaactacttttaaacccagccatcacattattgggtatatacaccaaggaatataaatcgttctaccataaaacatatgcacatgtatgttcattgcagcactattcacaatagcaaagacatggagtcaagcacccatgaatggcagactgggtaaagaaaatggagtgtatatacaccatgaaatattatgcagtcataaaaaacaagatcatgtccttttcagcaacatggatggaactgaagaccattattcttagcaaactagcacaggaacagaaaaccaaatactgcatgtgttctctcttatgagtgggagctaagtaacaacgcacgtggacacaacaaagggaacaacagacactgggacaaacttgaggtcagagggtgggaggaggaacaggatcagaaaaaatacctatcgggtactatgcttaatatctgggtgacaaaataatctgtacaccaaacccccatgagctgagtttacctgtattccaaacgtgtatatgcattcctgaacctaaagtgaaagttaaaagagaaatttttttaaaaaagaaaatgtggtacatatataaaatggagtactattaagccataaaaaagaatgagatcctgtcatttgcaacaacgtagatggaactagaggacatttattaagtgaaataagccaggcacagaaagacaaacttcatatattctcacttatttgtgggagctaaaaattaaacaattgaactcatgaagatagagagtagagtgatggttaccagaggttaggaagggttccggggaggagtggagttgttaatggttgcaaaaatatacagaatgactaggacctagtatttgatagcaaaatagcatgactacagtcaactataatttattgtacttttcacaataactaaaagagtataactggattgtttataacacaaaggataaatggtcaggtgatggatatcctatttattgtgatgtgattgttacatattatatgcctgtatcaaaatatgtaccccataaatatatacacttactatgtacccctaaaattaaaaattaaaaagtgaaattatgagcaattcataaggtattaaatgtagaagtagaatatataaatgttatgtacatttttaaattattttatgtatttattaaaatagcatttagctatgttgcccaggctggtcttgaattacttggctcaagtaatcctcctgcctttatctttaatgttttcacatgagaggattgactttgtacttgtagttttctatatagcaaatttttacaaaaagtctaagcataatttgtattaaaaagtatttctaatttaaatatgttttaactccaattttatttcagaaatcacgtaaccaccttgaagatgaaagataaatcattatcattaaaatttttaattttgtgtatttctaggtgtgtgtgtgtaactttaagacgctattatttcctcccagatatggattgtcaatgcagagccttttggatctgtccttttcttcatttatggatgaggcagctgagatttggagagtttgtgactagcccaaagctcctacgaactcaggctgtattttcctggtatagttgaacaaaaaattttcaaagtgatttttttactatgctactttttattagtg

SEQ ID NO: 119 - DNA, 2250 bp, Homo sapiens
cttacccaaatggtatacttatccgattcacttcaatagttgcctattttccctttcagaaatgtctgttctctcaccaggagactaaaacattgtgcagatgtacagttggatacaatgatgccaatataatatatgcactgttcaataatttattttgtatctggagtgatgcatctgtttccttcttgtgggagggggtttgagcttcatttcaatgtcattttaggtactggtccaattcttccatccagttaaccaaaaatgaaaatttccatctgttcaattggcattcggaggaatgttttatctctgaagcacattatgacaactaaaattgacagcataatctgtctgacttttttctcttttattccctcttcagattctcttgagatttaacaagagaggattcttttttacagctcctaagattataggacttactctttcttctgtctagtaactgtagaccaatagaacatgaatggctgtccactattcactgctttattatatatttttttctgtccatttgtgactctacaggaaatatacttgttagcatgctattaacagaacaatgcaaacatagcattctctttccataaatgtctgccagtactatttggcattctgttgaatgcacagattctctgcaatcaacgtttggaaggtacagttacaggctgatttttattgatcgttccgtactttagaaaactggctaagaaggcctttggaatatactgcttctgaagttttttaactcttataattctaagaatattgtctcaagttttgttgctgaaatggcaaaaatgtttcttttttattactatcaatattccaatttaaaatttaaataaggagaactctttttatttatgagccaggtaaaatttttctggtacgctgaataaaacaaggtactatccatcaaataaagggttatatccttggggcatcatgattaggataagataactaatttttatggcagtcccctatgtgaaatgtaaatagcaatacaccagaacttcagatatgttgaatcccagaaaaatatcctggatggctgggtttctttgaaaaaaaatctatactttttttttttttttttttttaagagacaggatcttgctctgtcacccaggctggagtgcagtggcatgatcgtagctcactgcaacctcaaactcctggtctcaagtgattcttccttctcccatttcagcctcctgagtagttaggactacaggcatgtgccaccatgcctggctattttttatttatttattttttattaggagattgaggtcttactctgttgcccaggttggtcctgaagctctgtcctcaagtgatccttccaccttggcctcccaaagtgctgagattacaagcacgagctactgtgcccagccctaaaatctgtacttttagtaaacatctccgatgcctgtatcctttcttttttttcttgaaaacattgcatgatagtttacactgtaataacgaccactgcttacttgcctatcctgtaaaatatttgtgcctttatagtcctttgaagtttattaggctatttgcatctatgttatttatttatcctatgtggctgtgttcactaagttttctgtcttatttgtttttattttttctcttttcccgtgctattggcttacagatatcccttctatgttcatatatctcatgtactttcttatagcaaacatgatttcctgtgaattaaatcaatgagttagtaccatattccaattatattatgctacccaatgtaaaggataacacttaaaaaactgaaattgatttttttaataatacaagagtctgatataatggataaccaactgtaaactactattgaggagtatttcaaaagctttaattgtgaaatctactggagtatcatataagggaataaaagagcattcttgagattgttaaacattagaactgaaggattttagatgtttcagacattttttagctggaataacatgaaaatatgtatatttgtatattttatgggaggctgagtaaatttaagtctactattttaggtctttgggatctcactgagaaattctccagactagcatggtaactggcacttttacaggtaaataaacattgtgactctaccagtcatagagagagacatggaaggagctgtttcagatccaagacacatacaaaagaagttaaaacttttctgagataaag

SEQ ID NO: 120 - DNA, 78423 bp, Homo sapiens
tgcaaattcagaaagttggtccagatatatgtcacagaacttttcacttgtatactactcttacaatggaaaaaaatcccgaaaactgtatacttctgattaaattcaataaaagattttgattagatatttcagaattgccagtatgctcaatactgttagtgtttaacatcaatttaatatctgaattagaactttaaggatagtctactcatctctttgtcttagtctgtttgggttgctgtaacagaccactgtagactaggtaacttgtaagcaacatttatttatttctcacagttccagaggctgggaagtccaagatcaaggtgccagcagacttagtttctggtgagtgtcctcttccttgtcctttcctcaccatctcacatggcagaagggacaagagagatagagcactaatcccattcatgaaggctccaccctcatcatgacctcccaaaagccatacctcctaaaatcaccatattgagtgttaggatttcaagatgaattttttgagaacacaaactactcagtctataacacttgcttcgataactgagtctagttatctcaccagttatatgctcaaggaccacaggcctgccttatatatgcagtcaccagtgggacagaaacccaacaggatgactgggcctgcctttttaaaaggctgaccttaggccctgtctggtatatttatctggttgaactagcaaccagcaatattagaacatgaaaaatcaaaggctagagaagcgaccatggtatgcatgatgagtgatccatccactagattatatagctcagtgagtaacaattctcatcaattagaccaacaactcttcctactataagggggtgtgcagagggacaaaaactcctatacttggctacatgggtaagaatgatggacatgcagatcttctgggccacggagaaaatgtggacaaggcaagaaattcctgtcccaacactgttggtattgcaatataatgggtaggaaagaatgatgagagggtagtagagtagtgtaacaaatttacacaccataaacttggcaaaagtagctgcatacttctggcagtcaatttggaaagaaacaatcagttttaaagttcctagtcttggccaggcatggaggttcaggcctgtaatcctagcactttggcaggccaaggtaggaggattgctggagtctaggagttcaagaccagcctgggcaacataacaagaccccatctctacacaaaataaaaaataatagccagttgtggtggtgcatgcctgtagtcccagctactcaagagtctgaggtgggaggactgcttaaacccaggaggtcaaggctgcagtgagtcgtgattgtgccactgtaccccagcctgggtgacagagagacttgtctcaaaaaaaaaaaaaaaaaaaaaaacccacaaaaaatcctagtctacacaactgtaacctatacaactgaggagaaatctcttcagtggattctcagaggatggactccagatagatatacagtgcatcacactcttcaccatccccatagtaaatacaatagcaagattcatgggcctgtttcttctaacacctgtcaatacaagccaaagcatcacagagaagtgcaaagttaaagcatctcaaaagcggccaacatgatgcagcccaaatatagtgtagtcagaaatactgtttaaaatgatccactggttaaagacccactatttaacactacttaatctgtttaactcagattttctagtatttcgaatactaatgacatattagggaattcttaatactagatgatatctgaagtaagttttacttgccataccctaatcaaaatataacagcactgacaaaaatccctaggaggcaaaaataagacttaagactaaaattcctgacttgtgattatgaatttagtacctatgtggacaaaaaatggtcattcctcaaaagccaaataaagcaccagacagaattatataaaagtaattacaaattaagaatttatttataagttttcatctttttagaaataaaaaggcttaaaaaacaaaatggttgcaaaaatggttaagtagttttgttatatcctaattgcttaggtgtgctctgtaaattccaaataagtaaaataatataaaaatacattttcatatctttatagaacaaaaacaaaacattaaatgcttttggattttctttactcctcccacagatgagttcacaaatacaaaaactggtgtacatttatactcaagtacaaatctccaacagccaagtaattatagtttgttctgttatgtgcaaagtagattatttcatatttacttggtatggaaagcagagtacaggctcaatggacaataatcattaaacacagattatgtttaagaaaatgctgttgtaaaaatgtacaatagtacatacaattttggtaattatgcacttcttttaaagtaaatacagcttttagatataaatctttcaaaggttttctttgaagagctgtgaggtgactatttcagatttgatgaacagtaatttgtcagtaaacttctcaaaaaaccaatccaagaaagaattgttttctttttccctccatgtggtcggtttcattcttaaggaaggtctgatgcagtaagaagatgcatttcacaaacctttacacaagtttgtgaactgtcaactaaagacaccacctctgatgtggatggtttcattcaatccatgttcgaccagctttatatcttctagatcgtctttaatgatgctaatcaaatggctaaggccttcctgttgttgtttcaaatgctagaacaaattaagaaacaacatattaatgtattaatttcttaaaactgcaagctagtcacaggaaaaaagactccactttgactattttactagcaacacagtacctagtaagtgctctaaatatagagggcatgcatatttaaacatttgtactacatcttttgctaacagtgaaagacaaactctaaagaacaataaaatcaaacaaatatataatgaacaatatcttccaacaaaaatgttttttagatagctattccttttaccaacttttgataaaggcatgataataaaacagaactcaaaggaggtattcaaatatagatgactagcaaaataacattctgaaaactgagaatattcatgttttgaagtacaaagtacatagtgataatggtggtgatgactacagatgctaacatttttttaagactcctcctcatgggttaaggtgctgttttaacagtactggtattcactcacttaactcatttaaaatccttttgagccccctttggggtaccattatcatctcgacagttaaagaaactacaggtaaataacctgcccaaggtcataaagtagatggtgaaccatgattcaatcccaaaacaatacactgctcataattttaaaaaagacaggtgtttaaattattcccagttttattgcatatatcaactctatttaatacaactatttatttcaatatactggaacctgttaatttattgcaaatacttaaaacaatggaatataattggttatgtgtgtaatatccaagaacctggaagccaaagtagtttttggttgcataaaaccagccatatccattctaacataataaaattggatttgttgatgacatttataatctttatctaaaatcctcagggccatgccaacagtcattagctacctagtatgttccacaaagttcatcatcttcatatattttctttagatacaactgttcattttcattaaaccaatctgcatttatactaatgaaaataagccaaagcagtgtttcccaactttttcacacaatgtgaaaaccctagaaaagtggttggaggttctggccacctcaacctacctccatccagatctcctgagagcttaggggacagatcaataaccaaatgtttataacttacatgcgacatataggcagggaaggtattatctagagcagttgcttctcaaactttaaagtgcatacaaatcattctatgatcttgataaaatgcagattgagtacgtctggagtaaggactgaaattttgcatttctaatgaccttccaggtgcggctactacctacactttaaggagcaaggtctaggaaactttagtgtctctactacctctaaattcatctttttggcgaggagagggataattcacttttttaaacagtggcaaaacaggcataccataaaattttgcctgtaactatttttaagtatacagttcagtggcattaggtacatttatgctgttgtgcaataatcaacactatccactttgtttagaacttttcatcttctcaagttgaaattctgtaccagttaagttcctcccatcccctcctcccctcacaccctggcaaccacctttctactctctattaattggactactaggtacttttcataagtgaaatcataaatatttcccttttatgagtggcttatttcatgaagcataacttcttcaaggtcaaattgcattgtagcatgtgtcagaatttcattcttttttcaaggctgaataatattccattgtgtgtctatatactacattttgtttctctattctttgattgattcttgggttatctccacattttgactattgtgaataaagatgctatgaacatgggtgtacaaatatgttttgagtccctgcttccaacgtacttgggtatatatccagaagtagacctgctagatcatatcgtaattctatctttaattttttgagtaaacactacactgttttccatagaggctgaaccattttacattcccccaacagtgcaagaaagttccaatttctccacattctcactaacacttttcttattaggataatagccatcctaataggtgtgaagtggtgagctcacactttaaataatgcagcctcatgcaacacttacctgcttgatttctcgtaacagatctgcatctatgtaatacctttcttcagatctgactgctccaaaatgattctgcatcctgatttgagacatcaattcatttagtcggccctaaaagttaagactgagtcaaattacaactgccgacgaagacttgtaaaagacaatgttttcttctgaaaggatggtttcaaaaccatctattaaaaatttctatttctctctctgtacattatattcgaaacactaatactagccaaaagaaccatgactgagtttactttagaaaggaagttctaattggagataagaaacacaagtatacaaaattcctgcttgaagattacataactttttgtctgcagatccacctgaaacaaattttagaattatggtcttagaagtggttaccttgaactgagtaggtgcatttagttcaccctgaatcgtatccagctgaactcgcaactgctcttcatcagcctgaatggcataaccactcttcctttgaatttcctgtttgattaggacctatacaaataaaaaccaccaataacaacagaatcatctctttttagttatgcaagtagtagtagtacaattagttactgaaagaaatcagctgaaaatcaaacaacagtagggttcaacagttcaggatttgaattatgtttctgtccattttaactaggcaaaagttatcatataaatacaatgatatagacttaattgttttttttgagacagggtcttgctctgtctcccaggctgaagtgcagtggcgtaaacacagctcactccttgacctctgtggctcaagtgatcctcctgcctcagctcctgagtagctgggaccacaggtgtgcaccaccgcacctggttacattttttaatttttttgtggcggggtgggggggggggtctcactatgtggcccaggctggtcttgaactcctgggcttaattaagtgatcctctagccttggcctcccagagtgctgggtttacaggtgtgagccactttgccaagccaacaattttaaaactatggtatggcttggccgggcgcggtggctcacacctgtaatcccagcactttgggaggacaaggcgggtggatcaagaggtcaggagattgagaccatcctggctaacatgatgaaaccccgtctctactaaaaatacaaaaaattagccggacgttgatggtgcacgcctgtagtcccagctactcgggaggctgaggcaggagaatggcggaaaacccgggaggcagagcttgcagtgagcctagatcgcgccactgcactccagcctgggcaacagagcgagactctgtctcaaaaaacagacaaacaaaaactatggtatggcttaaaagcagtacaaaaaaatagacaacataataccagtttcagacatttactcacagcctttccaaataaagtgttctttaaagatgagtttataatatttaggtctaaaaattatttcttggattttttttgagattacaaaagcaaaatgtacttgttaagaaacaatacgagaatgtaaaagacaaattttctctcatacccccaagacaaatagtgctaactgatgtttattcccctgtacctttctccttgctcatcatacagagagagcacacacacacagatccaaaataaaactaaactgtatatatcactctgtgacatggttcctttttttggttgttgtttttgtttttctgagacgaccttgctttcttgcccaggctggagggcagctcaatgcagcatcgatctcctaggctcaagcaatcctcccacctcagcctcccaagtagctggaattacaggtgctcaccaccatgcctggctaattttttttctttttttttttttttagtagagatgaggtctcccgatgttgcccaggctggtctcaaactcctaaactcaaatgatccttctgcctcggcctcttaaagtgctgggattacaggcgtgggccactgtgccaggctgcttctctttctttccaatttaacaatgcatcgggggaaagggtctaaagcagtggcctctaaaggcagactcttggtttgctgctactctccaagcccagcttactctgttaaaaacagtgcaaatccttccatactctcatccatgctcctataaccatatctttttcataaacacacacatagaccgactgctttttactcatctaagtttttaaaaatggattatataaaattaacaaaattttattatcaatattaaccattaaattttataattaaaataattttattatcaaaatctcatgaaatgccttaagaagtatagctctaatttgttatttttaatggctgtatgctttttaaatgttattaaccaataatcaataattattgtcttgatggatatacattttgttttcacactacaatgccataataaacatttttgtagctttgactctataaacaatgctgtaataaattttgtagctttgacactacaatgctataataaacattttggtgcatatatctatttaactggtatagatctttaacaatgaggctgagttttaaagtatgtacgttttcagttctaaagctgctagattgctttttcaaaatatcctaatgatttagattcataggccacacatcagaataccctttccccacattcctgtcaagaacaggtggtggtggtttaaatttttcccaaccgcatgagtgtaaagggatctctttttttttttttttttttttttccccagatggagttgcactctgtcacccaagctggagtgcagtgccgtgatcttggctcacggcaacctccacctcccaggttcaagcaattctctgcctcagcctcccaagtagctgggattacaggcacctgccaccatgcccagctaatttttgtatttttagtagagtcggggtttcaccatcttcgccaggctggtcttgaactcctgacctcgtgatccacccgcctcggcctcccagagtgctgggattacaggcgtgagccactgcgcccggccaggatctcattttttttctttaatctgcaattcccagattcctagtaaattaaagggaccatcttttaatgactaagaactattttgcatttgctttttctatgaactgcctttacacatcttttgcccaaatttcaattgggttttactgtcaaattataggatctctttgtataatatgaatatgaacactaaatctaaaatgaatgctgtttgcaaaatttccttttcctaaactctatcacatgactattgacaaatggcttctggtatcttttgctacacaattttttatgtggccaatgttggtttatagtttctagctttttgatcaatgtctctcaaatcccaggctgtacatacagctttgaaagtttcttaaagtctttagtccactttatttttatacaatgcaatggtctaattttcttttcttccttatggatagttatactccagcattatttattaaataaacccactgaattgaaataccacctttctcatatattaaattttcagcacacttgcatctatttgtaaattccctactctgttccatgcattgttctgtccaatcccatgcagacactatattgattcaattataagaggtttaaaataggttctgaaatctggtaaagaagtccccttcactatttcttttttgttcctgaacaagctagtctcaaacacttatccttctttataaacttaaagaaattttaatcaaaatttttttagagacagggtctccctatgttgcccaggcaacagagtgcagtggctattcataggcacaatcatagctcactagagcctcaaactcctgggctcaggtgcttctcctgcctcagccttctgagtagctgtgactataggtgccatgtcatcacacccagcttaatctatttttaaaaagctgtaattcatttttaattttgtaaagtgggtattaagtattctcatctaagaatatagtttatctatttgtaaatacctatactttcctcagaaatatattcctattttacagttttgtcaccatagtgaatggaacattttcctatttccagatagtaaaaaggaaagttgatttttgtacttttatatctagccagcttactacattaattctatggtttattcccttgggttttccagatatacaatcatatcagcaaaaatagatcacttaatcatcttcccaatgtttatattatttctttgcttgttttatttatgaaaacctccaagatagcaacaaataatgatgataatattgggtgtccgttgtctagtttctaaatgcgattttagtgttttgccttttggagtatttgctattcatttttggttacagtttctattatatattttcctttaatgtgttgctataataagtcatgttgatagatgtcctgttattaaaaccaaccttgcattcctgaaataaactttacttggtcatagtatattttttaagaaattgataaatagctggattctctttgcttatacttcatttagaatgtggttttttggtccgatttgaggtatactctacatatgacaattcacctgttttaggtgttcagttctatgaatctggcaaatacatacagtcgtgtaaccaccacagtgattaagatacagaatatttccatcaccccaagccccttgtagtcacacttctctcttcatctacagtccctggcaactactaatctgttatctgtccctaattttcttttgtataatgttatataaatagaatcatgccttacacagcctttaagtctggcttttttcacttagcataatttgcatctctttaaaatagctgtttataatttctttttttgagatgctacaaacagaaatgtaaaatggtacagttgctttggaaaacagtttacgtagttcctcaaaaagttaaacatagtgtgcatatgacacagcaatttcactcctaggtttatacccaagagaaatagaagtatatgtccaaacaaacacttgtaaataaattttaatagcaatattattcataatagccaaaaaggagaaccaccaaaatgtccatcaattgagtaaaatgtggtatagccatatgatggaatattcagcaataaatgaataataatcatttattagtacctgaagtactattacatggtacaacacagttgaactttgaaaacattatgctaagtaaaagccagtcacaaaagaccatatatcgttatgattccatttatatgaggtttccagaacaggcaaacccatataggcaaaactggttgcataggactgacagatttgcagtgaaacggggaagtgactgacaatgggtacgggatttgtctgtagggtgacagaaatgttctaaaattgattgtggtaataacggttatacaagtctctgaatatactaaaagccattgaattgtacactttaaatgagtaaatagtatggtatgcaaattatcttaagctgtgaaaaaagaacaaatgaagctgtataaattattcctcaattgtctagaataatcaaaataacactggattagctcttttgtggttagacaaaatttggcaatgaaactatctgtccctaaggcctttttcatgtttcatctttcatttttccaactgtttctgtggtatttgttttcttacttctctgtagattttggtaattttcattttcatagaaaaatcaaaataaaacttcctctgagttccaaatctgttaccctaaagtacatgcagcatcttcttttttttttctccttttttctgagatggagtcttgctctgtagcctaggctggagtgcagtggcgtgatctcggctcactgcaacctccgcctcccaggttcaagcaattctcgtgcctcagcctcccaagtaactggaactacaggcacaagcaaccatgcctggctgatttttttgtattttagtagagatggggtttcaccgtgttgcccaggctggtcttgaactcctgagctcaggcaatccactcacctcggcctcccaaagttctaggattacaagagtgagacactgtgcccggcccatgcagtatcttcttattctgttttgtatatctacggtgatgcctcttttcccactactaattttgtatattttactctgtttttcccttcttccagctgatgagatgcttagtaattttaacggtcttttcaaagaaacagttttttaatttattctttccactattacattttttagtctttcactaatttcacatttatctttctttctttttagtttcttttggcttatcttgatattccttttctaatttaacatgagtactaagttcctttatttttcacatttgatttttttaaatgagaattttttatggctgtaagttttcctctgagtacagattttgctgtttcccactggttctggtatgtaatatttctgttttcatgatagtttataatttcagttgttattattcttttaattcctcctgttaatttggaaattctattgtttttcgaccattatggttacactcctttttctagcactcaaaaaattttctgaactattttatgaaactattttatgaaatttatgagacatcaataatctcacagaagcttcccttgcactaagatgctttatttcttcactgctttccctcaaactgtcactaaaatacgaactttaggatatttttattctcctcactcaaacctatgagacttgttttccaatttcaaagttttactgaaagaattcggtacttgtaatttcacattattctttcattttagtatttttttttctattttaaaaatctatatttagtacattatttcacacacatagtcttataaacactgggggggaaaatccaaattactacctgtaaagttctatgggaaagatccatgagtttcctcttgtattgtgcaattttggctacagatgtagtttgattcttttgtagctcactaatatcttcagatatgatctgtttaaaaaaaaattgggggggggagggttaatcaaatatcacaactatttatcagttacacctgtatggaaattctaatcttgggataagcctgagattcatctctcaaaatataaactctttccctataaatctgtgctttatatttcttccctttttacatacctaaaatttttttaaaagaatcatgcaaagatatctttagagctctaggaaatttagcaatgaggcaatacatagaaaaaataagctgggcgtggtggctcacacctgtaatcccaccactttgggaggacgaggcaggcaaattacttaaggtcaggagttcaagaccagcctggccaacatagtgaaaccccgtctctactaaaaatacaaagaagtagctgggtgtggtggcatgcacctgtaatcccagctacttggaaggctgatgcaggagaatcacttaaacctgggggatggagccgagatcgtgccactgcactccagcctgggcaacagagtgaaactccatctcacagaaacaaaaaacaaaaaacagagtgagactccatcacacacacacacacacacacacacacacacacacggctgggcacagtgggtcactcctgtaatcctagcactttgggaggccaaggcaagaggagtgcttgagaccaggattttgagacaagcttgggcaaaatggcaagaccttgtctctacaaaaaatataaaaaattaaccaggtgtagtgctacatgcctgtaatcccagctccttaggaggctgaggtgggaggatcacttgagcccaggagtttgaggttgcagtgagccgtgatcatgccactgcactccagcatgggcaagagggagagggagagggggagagggggagagggggagagggagagagggggagagagggagagagggagagggagagagggagaagagggagaagagggagagagggggagagagagggagaagagggagagagggggagagggggagagggggagagagggagagagggggagagagggagagggagagagagggagaagagggagaaagggggagagagggagagagggagagagggggagggggagggagagagagagacagagagagagggagagacctatctcaaaaggaaaaaaagaaaacacatacttcagaaataattaaggaatctgaagtaacatggaatacagccaacaaccaggtctgagtggaaaaagttaagatgtgtaagatgatatctagggggtgtcttaatagacaattagccctgtatctaactactgacagcaagtacagtacatttcaacattaactgttacagaatacttggagggagtaatcagagtgcagaggaaaaggaatgatattaattatgcagcaggatacatttttatgcctctggatctttgacttgctgttttacctgactgaaatcccactattctgccttaggaagtcttaaccttacagggtaggttaaaatctcactattttattaaagcatcccaatcagaattaatcccataattgtctctatcataattaatcattctatgccactggcttacatttacatgttacaagaaagaggttaagattgtgcaagacatattttagcacatccacctgcacacatcaccttttacagaaactttccaatgccaggccatgctgaaaggacaaaattaggtggccatgttttatattacaaaacctaggcaatctccccatcccaattttgaaaaatcaccagggtttttagatacaagagtacttacaacattattttctaccagtaataactaaaaaaattagacatgttatcagccacagtatttattaacaaatactaaaaccatctaggaattgatccaagaaagccatctaggaattgatccaagaaagaacgcatgagattttaaaagggaatattttaaaattattttaaaggacataaaagactgcaaggattaaagagacataccacattcatggatgaaatgatttaatattaaaattcaattcccacaaattagtctttgcatttaatgcaattccaaccataattctagcattctgacaaattgattctaaagtttttatggaagaataaagacccataaagacccagaaaactttgaaaagaagaaccaagattagagattcatgctactagatattaagatacactacaaagccataagactaaaaaaatgtggaatgggtgggtataagaacagaccaactggccaatgaaacataagagagggtctagaaatagatcacatatatatatgcaaacagtgtaatttaaattctttgataatcattgaggaatatcatatttttataggcaatattaaaaatatagggctgggcgcagtggctcacgcctgtaatcccagcactttgggaggccaagacgggtggatcacgaggtcaggagatcgagaccatcctggctaacacggtgaaaccccatttctactaaaaatacaaaaaattagccaggcgtggtggtgggcgcctgtagtcctagctacttgggaggctgaggcagaacaatggcgtgaacccaggaggcggagcttgcagtgagccgagattgcgccactgcactccagcctgggcgacagaacgagacccccatctcaaaaaaaaaaaaaaaaaaaaaatggacccactatttagagaaaaataaatctgagttcataccacatactttatataaaggtaaacttcatgatgacaacaaaagactcaaacgtgaaaggttaaactctaaattttttttaatgtaggatactctcagactttggggtgaaaaattatttaagcaaattcccaaaaagaaaatacaaggcaaacatttaatggatatcattacattaaaattaaggatttctcttcaactacagacaccaaagacagaattaacaaagagatgagaaactagaagatatttacaacgttataaacagagactacaatctagagtaaatgattactgaagttcaataaagaaaaaataggaagcccagtggaaacactggccaaagatatgaatgatttcagttctggacaagatggactaagcatatacaaccccaatctctcccatttaatatagctataaaacttggatggaatacacggggcagctatttgggaactctggcaggaagatcaggtaagataggaatttaaagtaccaataaacttgtggtgagtttacccatttttcccctcaggcgtccctagtctggtttcaacccagcctcaaacctggaaatgagcataaatgctgaaagggagctccaagggaagtctgctagttatagtgggaggagatacatcgtattacctagagaaaggtttctcaacttcagcactattaatcttgggtaattccttgttgtgggagtactgttctgtacactgcagaatgtgtgcagcatctgggcctctacacattagacgcctgtagtactccccaaccaagagtctccagacattgccaaatgtgctctgggagacaaaatcaccaccaccaccacaagccactactaagaagtactgctctaagacttgaaataatagattaaaaggaaatgctgaaaaaaaaaaaaaagtccaaataactcaaaagaaagcagaaaagtagaaacaggaatgaaaaacagaggctacaaacacaaaacaaataaatggtaggactaaatccaaactttttgctgtctacaagaatctcgcttcaaatataacaatataggtaggttaaaagcaaaaagatggacaaaggtatgccatacaaacactttttatcaaaagaaaggtagcgtggctatgttaacaccagacaaagacttctgagtgtcttgagtaagtgtccatgaacagatgaatggataaagaaaacatggtgtgtatgtgtacacatatatacacacacaatagaatactatttaatcatgaaaaagaatgaagtgctaccatttgcagcaacatagatgaacttggaagacattttgttaagtgaaataagccacgtgcagaaagataaattctgcatgttctcactcatatgtggaagctaaaaaaagttgatttagtagaagaaaagagtagaatagtggctactagaggtggagaaagagtaggagtagggaactgccaaaggttgcttaacagatacaaaagtacagctggataggaggattaagttccagtgttctatagcactataggtaactataattcacaaccatttattgtgtttcaaatagctataggagtgaatttcccatgataccaacaaatgataaatgtatggggtaatggatatgctaattactttatttgatcattacacactatatccatgtattgaattatcacactatgccccataaatatgtagttatgtatcgattaaaaacaataaaagaaaaggccattagagaagatttaaaacttaccgaggattaagagggatatgatataataataaaaggtaaatttgccaagaaaacacaacaatcctatataacaacagcccttcaaactattaatacatgaagcaaaaactgagaaatgaaaggagaaaaacacaaatccgtaagtgttgctgtagatttcaaatctcttctcaaactagcagacagaaaaaacaacaagaatacagaactgagcaatactatcaaccaactggatctcactgacattaatagaaaacttcacccaaggactgcagaatacacattattttcataggctcctgggttataaaacctcagcaaagttggccgggcgcagtggctcacgcctgtaaccctagcactttcgggaggccgagatgggtggatcacgaggtcaggagatcgagaccatcctggttaacacggtgaaaccccgtctctactaaaaatacaaaaaattagccgggcgtggtggcaggcgcctgtagtcccagctactccggaggctgaggaaggagaatggcgtgaactcaggaggtggagcttgcagcgagcctagatcgcgccactgtgctccagcctgggcgacagagcgagagacgtctcaaaaaaaaaaaaaaaaaaaaaaaaaccttagcaaagttaaaagaattgaaatcatagaaatttctctgacctttaagaatctttaagtatttaattatgaaagtttttttttttttttttttttttttttttttttttgaggagtctcactctgtcgcccaggctggagtgcagtggcacgatttctgttcactgcaacctctgcctcccgggttcaaacaattctcatgcctcagcctcccaagttgctggcattacaggcgtgcaccacgacacccagctaatttttgaattttttagtacagaccaggttttgccaagtcggccaggcttgtcttgaactcctgatctcaagtgatccacccaccctggtctcctaaaaaagtctactttatgaaataaaatattaagtatatttaagcattaattttatcaacatacaataatataccaagacaattatatgtcaacataaaataatcattactataaccttcattttcataaggccccataaataataatatgcaatccctggctgaaactggaaatgacagtctaattaatccactaagacaagaattctaaattcattattatatcaaatcagattcatgtgatttggggacttctatcataaagaaggtagttgtataaaactattaaattgcagtgtatgctacattgtttcctgattaagataaaacagtagcacatatactaaaaagaattaaatgtctataatccctttccctacttccagggccagggaataaaaagctaaatgcttacatctaatctggtttgatgctgcttagtcatctgatcttgaaccttcagtcttcggagaagttccttaaaacccaccattggtacaggaattaacctgaagaaacgcagtgaacaattttcagaccttaagcctattactacaaaatacaagaagtgaaggttttagtaacactcatgtaattttacatcaactttctagggctctaaggcagatctatgactatgagataaccatgttataccaaagagattttattcaacctccctattttacaaatgaggaaatacagttcagtcaaaacattacattattaaatgaaaacgcaaatagaattttccgctcctagttagttctcactatgctatgctgccttaccataatctttttttttcttatttttttctttttgttttggctgaagctttagctggacaataatcaatattttttaaaggccaggaaaatgaaaataaacttgtctcatatgtaagaattataattaatagctcccatgtttgctttcctagtagcaaatattagttcttaaatgaaacaagatgaagacatacttacttttcagaatcagggttatctaccttggcctgttcccagataataggatcaacacctaccacaaataaaaaatattttttctaaaacaattttctatttttataatatgtgtatgacaaaggctttcctaaagcaagaccctatacctagaagctataatgaaaagtgactgtcaaatataatcatggtaaaaatacaaatttttgcagaataaataaagttcaaaaaaagcacagattgaaaggaactatctataacctataggataatagattaacctccagaatatagaaagagttcctatacatcaaaaaggaagacaaaaaaatctagaaaatgggcaaaggacacaaataggtaactcacaaaaaatataaatgtagctaataaacatattaaaaataagtattaatttttaaattaattattttgccatcagtggccagaaaaaataacattcctgttatgaatataaacggtagaactttccctggagggcaatttggcaatatctaacatacataatattgactcaaaaatttcattaccagagatctattctaaagaaatatataccaatgtgttctaagacatgtttacaaggatattgttaattactgtacagtttataatagtaaaaagaaaacaacttagaggtgttaagtaaaggtgtatccatggaatactatgcaatgtttaaatacagtaagatttatcttcatgtattgacatgaaaagtgctaaggaatactgtaaaaaggcaagctgaaggtgtatatggagaatccttttttaaaagatctacatgtaaatatgcttacatttcaaatcacagataaaggattaaacatagtaccataaattgacagtagttacttccggggaaaggaactaaaggtaatctatcacatagtcaatctagttatgccatccagaatattttacagttagaatacattcaggttttacttgaatattcagttaaaatgagataagctagaaaaaaataagccaaaattttactagtaaattacctttgggtagatggattatggactatttttcttcagttcactatttctcaaaatttctattttaacatatacatattagctatataataaaaaactaaatgaatacaaatattcaaaactatttcccaaataagtagatatatgacaagatgatactaattttattagcattaataaccaaccaacacctctgaaatacggggagtgtttagttctaaatctttctttttttttgaactctgtgattctagaaacataccagcaggaggattctgtaaaagctgtttgatctgtgcaggagaaagttctgttctagtcatagaaagggttacaccaagttgctgcaattgtgtttttatattggcttgttcaaaatgggcatatagcgttgtagctggaactcttcttgaagtaccatttggcgaacgctcaacaacataaataacaacttctgtcctgaaggaagaataaccaatttataaaatatggagcacaaaactcatagcgacaaacctcagcatatcatagcatgtgatttcagaagggtttaagttgaattcagaaatggttgttttaggaggcaattaaaatgtttcctttttttttttttttgagcaaggtttgctctgttgcccaggctggagtgcagtggtatcatcactgcagcctcaatgtcccaggcttaagcaattctcccacctcagcctccaagtaactgagagtacagctgcacacccgctacgtttagcttacatgtatgtgtgtctatacataaatatatatgatatatatatatatatatttttaaatttttttgagagacggacactcgctatgttgcctaggctagtctcaaactcctggtctcaagcaatcctcccaccttgacctcccaaagttctgggattacaggtatgatgagctgctgtgcccaactgttttcttcttaaatcttggaaaataagaaagttttacttcatgtaatgttcatttacaaatcaacctaaatgataaagttaaaaagaaccaggtaaataagatagtatttgtttttttttttgagacggagtctctctctgtccctcaggctggagttcagtggctcaatcttggctcactgcaagctccgcctcctgggttcatgccactctcctgcctcagcctccctcgtagctgggactacaggcacctgccaccacgcccggctgattttttttgtatttttagtagagacagggtttcaccgtgtcagccaggatggcctcgatctcctgacctcatgatccgcccgtctcggcctcccaaagtgctgggattacaggcgtgagccaccgtgcccggccaataagataatatttataaaagggtttgcttagttgcaaaatcctatgtaaatgttatttactataggaaattctgttgaaatttatgggctgcttctctgcaattacaaccacaagtaaaatctgttcaattattgcatctcattaataatcattcctccaaatatcctaaaataaatgtcttgccactaacactgagaattatacttaggtcaagggaagtaaagcaataatatttattcatgaatgaacatgaacagtaatgagttaataacattttccaataacatctttatggccctcaatttgcacgcatctatgacaaatggtcccttcctggcctgaatgaaaatctagaaaattattagcatctagtaagttaaaaaatccaaaattttaaaaaaacttttaaataaatgtttttatcaatactgaataatcactagctgagaaaaggcattctgctctgagagttaatttgtgctttagcaacaaaaacattattgatcactcccttaggaccagaaataaatacacagaaataaacagtatatttatgtatacttactgatcatctggcaatgttttagtgccctctacatttacagtaagggtctggtttcctcccaaaactttatgcaatgattctaccaactgttgttgttggcttcgaatctctgtttcttttttgttgaaaactaaaaccactagcccatcttcatctttattactgggcatgcaactataacctactgcctgtggaatgacaaaataaacaatataaaaaatatgtacagatcttaaatcaggtgtttaatattaatagcttaatatctgctaaaatgggaaaaacaacttaatgtctggtaattaagggaataatgattcttcccaccattttgtgccctaggaggtcacaaaattataaagaaaaactattttacccaggaataacattaacctatagagtaagattaacatttcctctttgagagagtaactaaacagctttctcccctaaaaaattttgatattcattattgttggttgtttctgaaccatctgcatgtcattataaaagtgactgcaaaaatcaccaactaattataatttatttcactatacagattctcaacttatgatttttccattttatagggtgtgaaagcaatacgcattcatatatacatacatgtaaaccatacatggaattctgatcttttagtttttattataaaattattattattataagatggacttgatgttagattattctgcccaattgtacactaatgtaagtgttctgagcatgtttaaagtaggctaggctaggctatgatgcttggtaggttaggtgtattaaatgcatttctgaattacaatattttcaattatgatgggtttattgggatgtaacccataataagttgaggagtatctgtatatctgattcatggaatcttaaactaagttttaaatatataaagaagtaatttacaaataaatacttttaaatcacagtaatgacagtcaacttacaaatactataaagaatgtctgtatcactttattggtttatataatacaaaactttatgaaacagggttgttgtttttttacatattaatatgaccaattatacttttctaaataattgctcttttagatagaagccttttatcccttttcaccactcacctgcaacttttaaaaaagaatttaaattaactcaagtgtacattatgcattttaccatgttatacaccaactttattgttatattcaacttatgtctattattgaatacctcttagcgactaaatacatgtatcaaaatttcaactatatgcactcaatatactttttgttagtgatgacacaaagagatgttctgtaataagacaggctgaccactttattcaaggatctgatcctcagccttacagctccaaacacagggttatgtacatattgattaggtttaagagaccaacgtaggccaatataactcctaagaggctgaggtataaactggattgcaatacgtaatttgttatggaaaatgcattaccaaatggacctaaatactctcactggctgataaagagattttctgaagagacaaatgagaaggttgtttggtaggcagggaataagaacacagaaaatgggcaatattgttttaatagctttggggttatacatgccaaggggaatttctgtctgctggttagggtatactctcctggccaatgttaaatgaataccactaaattgtagtttggtgtctcccctttacaggtgccaggcaaaccattctcctgtttacattttttttcttcagttataaatcacattccagtcacaccttccttcattcatattctggtcaccttcaaccacacatatgtatgaaatcacttcaattttataatttctatattttcaaaataaaagtataatcataccatgttcaaggagtaaagatccaagcaattgttatcttgatattaatctaaatatattttctgttatacaaaatcttcaactgaagataaaaatagtattaataataccttaaatcggcaaaagggattttcttgtgtgaattccactggcggaatattattgttgaaatacccttttcctgttccccaaaaggcctgcagttgattccattttgccaaaatagcatctctctcatctcccaacagcgttggagcagaaagagcactcgcagtatttatcagctggttggactgggtaggagcttgtgtaggctgactgaagagaccacctaatgctaaaaatgtacccaaaattagtatttaaaaacaaaacaaaacaaaacttaatccagatcctaggcgtggtaggcaaaataatggccccctccaagatgcccatatcctaatctacagaacctataaatatgttatcttacatagcaaaagggcctttgtagatgtgattaaattaagcatgctgagatagagggttatcctggattatcaggagggactcaacgtaatcataagatcctcaaaagtggaagagtgcgctcagagtcaaacagatctgaagatgctatgctgttggcatatggcaagatggaagagccgcgagccaagaaatgcaggaagactctaaaaactggaaaatgcaagagaatggattctcccttagtgcctctagaagtaacgcagtactgccaggaccttcattttagcacagtgaaacccacttctggacttctaatctccagaaactataaaataataaaattttattgtcttaagccactaagtttgtggtaatttggtatggcagcaataggaaactaacacactaggccaaaccttataacgttaaatttgtttttctaataatatttttttgagacagggtcttactttgttgcctagactggagtgcagtggcaagatcatggctcactgcagcctcaaccttctgggctcaagcaatacccctgcttcatcatcctgagtcgctgggactacaggagtgcaccaatgtgcacctggttaattttttaaaattattttttgtagagacagggtcttactatgtttcccatgctggtctcaaaacttctgagctcaagcgactctcctgcctcagcttcccaaagtgctgggattataggcatgagcaactgtgcccagccctaatgatgttatccaaattaattccattaccagaacacagattgggtccacaatattaaacctacacatgaaagaatggagggagggaggaagggatgcatgtggataaaaaaaagtttgtaaagatgtaggattttttaaaataacctttattgctgttatatttatataataaatacaaattgggggatacaaagtctaaaaatcattgttatatcaaataccagcttactaaacattttcctttctctcattattaaaaaatatatatagtaataacaaatggattaaccatcagtattctaggctaaaactttagatggctgtgtaactttgggcaaatcaacctctctgggataccaatttctctaatggaaagaagggccaagttcttagggcagataaatatgccccaaagtgtgagataagtatgtcatctttcaacaaagcgaggagcaagtctaaggctcagagcttaaggcaaagttatctacctagaatttatttacactatattttctttgtacttaatttcaattaccttttccttagagcaaatgatactaattttccacttatagcagcaataaattttactttaaaataactgtatttcgtgtttcaaagtaaactgatttaaagaaaattcttaaatagtaatacaaatggtatgtagatgaggagaaaacgtgaataccaaaatgacctgagttttaaaacactgtattagatattgtttaagttctctttcagctctaaacattgaaagtaccacaaggtccatggagcttctacagagctagagagaggctcttttactctccagaaaagtattaattcccaaattagtatatataaacattggcaagaactggactagaactcagaacacttgaatcctggtttattataaggtcgctttctatccttgagcaagaaattcctgggctttatcttcctcaacttttacatgagatgaatcaactgtgatctctataccgagacatatgcagtcagcctcccatgctgttgattattcctttggcccccaaagaaaatcttcaccttctgttgaatacacatcctccttgaaagcccttctcccttaaatttcctgacaacacagtctctcttggttttttataaacacattcattcattcattcaccattaattcatacaacaaatatttactgagtacctactaagtgctcagagccaaatactaaagatacagtggtaaacaaggtagacaaggtgcattaaacaaactgaacacatcaaacaaatattaacaattgtgataagtccttcagagaagtacagaggttctgggagtactaaataagggagctgatcaagcctgagagaggggtcaagagaagacagttccattagcacttcagttagggcctaaaggaaggagtcagctaagccatggggtagaggtaaaggccaacagtatgtgtaacatctctgtagagacagagagaggaagatgagtggacaaaagcaataaggaggactaacaatgaggtaggaaaaaactagactggagtgtcacagaagttaaggtctcccactggccaaatgcaacaactgaaacatatttattaaagcccatgcattcaaaatggtaattttataaagtaaagatcaaattttttttaaatcctaactccttggataccattagaaataatgagaccgccaactcctttttacaaaaattgtccattaaaaagaaaaaaaattatcttgcctttactatacaaactgtacatcagggtgatcaagcagtcttggaggatgaagaaaaagttccttttacagaagaaatttcagtgtgatagggaggaaattagaaaatcaccattttgcaactcctaataagataactgattgaggcaatgatcatcaaggaatgaaaccattaggttaaagtagtaagataaagatacgctgtcaccatctgaacctactgatcaatcttagcatcaccaaaagtgagatagcctctcaacgtgacgtgatatgaagcacacagcaccacttgcaaaatgttcttaccaaaaaagcaaacgtcaagtccctaaagcaaactttatttaccacaattatgagagataaagttaaataatattacaaggaagcagaagaaaaatacagaatggggggcatttaacaagacaactggaaaattcatgagggaaaaaacagaatggggaattctctacactaaaaagaacttaagggacatgacaagaaaatgaatgtgtggtccttgtttggatcatgattcaaacaaaccaaataagaaaacgcttttgagacaaatagggaactctggttatagatggggtattagatagtaccaaggaattattgtgggttggaatgaggtacacatttttaaagagagaagtatagtaaagtaagcatgaaatgacacgcttgggatttgctctcaaatacatcagtgatttaaaaaaaggaaaaaggagatggacaataacaagttctgacttttgatgactccagctggtagggttcacatcacttctttttttctttgttagcatttttcataaagaacagtaagtgttcactggatttactgagatgattaatgaccttaacttatttgataaaataaagaaaacagaaaccagattggcgaatagtttgtaaaggggaggagagtggtagctgaagtgaaatgtgggattaaagtagttttgttgttgttgttattactgtttcaagaaaaaataaactttgagttacttaaatgtggatgagaaggtgaagactggggaacggagtacagctagaataatcaacagcacatgcgccctgaaaaggcaggaggttataagatcctgagtcaggtaaaaagaggaaaaggtggatagagggagaaaaaaaatagatttggtggagggaagttgaaggaattgcaataagggattttattttctctttggttttttttttttttttttgagacagagtcttgctctgtcacccaggctggagtccagtggtgcgatctcagctcactgcaacctctgcctatggggttcaagcaattctcatgtctcagcctcccgagtaactgggactacaggtgtgcactaccacgcccatctaatttttgtatttttagtggagatgggtttcaccatgttggccaggctggtctctgacctcaggtgatccgcccacctcagcctcccaaagtgctgggattacagatgtgagccactgcgctcagcccttttttgtcttggaagtagcagtcaaggccatctgctaaaagtaagaacagataaatttgagatttgaagagaataaaggtttaaaattactgctatagaaagcaggagaataagttgaaagtagaaatttcacaggattaccaggcaacattgagacctgaggttggtgatcaagaatttagagaggtattatcccctcttccataatgtgtgatctttctcaagcaatatctacacagacagttgggcttacaaaggcttggggttttttcaggcaaatgtgacacaaaaacaaggaagtttagcatattggcaagagatatagaaatggaaggccatggaatctaagctagttagagtagtgaagacagaaagagctaacagagcagaaagtatcagttgtcgaaagatccaacagtcttctgaaggatcctcgataatccatgctttggcttggaaaggacttctggcggttgtcacaaagtcaaatgtgacttttccccttgattcacaggtattgccaactgagataggaatagctgtgattagtaaaagggagctaataagtatgaggaatacatggacgggcatctctatactgagataggacaagcagtggtcctaacaatgctgctcgctaatttatggtcaaaatcctacttggcttggggataggagatggcagcatttaagtgttagtgtttctaagagttttgttctagtactctcctcttactctggaatcaggtctcctaaattacatcatccatatctaccactttaaatactacttacgttctgatggctttcataaatatatacaactacccaagggacacctcaaactcattatctacccacaaacatctgctcttgctttagtattctggatcttagtgaagagcaagggatccttcagttacgccacccagaagcccaagatacctttatccagtcattcgcttttattgattctacaagttaaatctctctcaaattcacatcctgttttttctctccattcttaactgtcactgccttaattcaggtcttcactatatcttgctcagattttggcaacagcttcaccagatctctgcctccattccaacccacctataatctatctttgtatttctctaagagatacttctaaaaatctgattattttcctgtctacttaatcctacaacagtttagaattgcttaaaggacagctccttagtaaaacatataaggcacgctaataatccaattcatatctatctctccaactctcactactgaccctgaggtcatttatgcattaaaaaaactgcactgatctagttatactggtcccaaaggcattatactctgccataaaccatgccatgttatttcctctgcgtggataccctagaatctccttgactatgagcaaggattgtggtcttcaaccttgtacacccaatgcctgacatacgatatatacaataaatggatattacataacaaaatgagcccctttcaattttaaaatagcaccagattcaaattcccattttcctaaaaaaaccaaatgtaactacagttactcatagttggagagactttatttcaagaaacaaaggaaacacttcacttttgctgttctttccttaactacttaaatatttcatcaaattttgtatttttgcaggattgtagaaaagacgaatgactggaatacttgaaagaataattctgagaatactattctattatcttcatcctactgttaggcaatccttgaaattcatgtttaataagttaataactaatcttcagtgactgagtaggatgaattttagctagtcaatcaagttacttaaaaaaatgaaacagaagtaattttaagaggcatcagattggaaaagtgaaaagagcactagaatgagtagttgaatttgcatccctgtacttcttctagagaggtatacaggtaagtcacaatctctcaggttcctctcttcacccataaaatggggataacaaaagtattatttcacagggttcttgtgagaataagttaatccatacagaacaacccctggaacctactgccataccacctagtaaggatggttagtaaggaagccatcaaagactaataaccagactgtctcaaagggacttgggagccaacttgaaaaggcttgcactggccaaagatgtaacaatttaagcatcaataagaatggtaactgcaatggattaaaaaatagtaactagtttaaaggctgcagtttctgacattaaaaaaaaattggtcatctttggagaatgctagataaccaactctttattctgaaaaccagtaataaagagaaagaatcaaccaaacagatgaagtcaagtttctcctcacagaagtatttcaacaaataaatgaatccaggtggaatggcactatttgtaacccctaatgaattaatggatctaggtaatgatcaccaatggctcaatggctgatcactcaaaaaaaaaagatattatatgtcttctgataaaaaataggcctataaaatagtcttgcaaacaaacaacaaaacaacaaaatatatatatgtacgccccagatctaacccaatcatcaagaaatacagagaacaaaggaatgtgttaaactataccataggcgtgcaatcagaaaagtcttgactaaaaaactctataggataaatgatctgttttcttcaacaaattaaaaaataaaaaagagaggccaggcgcggtggcgcacacctgtaatcccagcactttgggaggccgaggcaggcagatcacgaggtcaggagttccagaccagcctggccaatatggtaaaactccgtctctactaaaaatacaaaaattagctgggcgtggtggtgtgcgcctgtagtcccagctactcaggaggctgaggcagaagtatcgcttgaacctgggaggcggaggttgcagtgagccgaggtcgtgccactgcactccagcctgggcgacagagcaagactccgtctcaaaaaataaaaaataaataaaaaagagagataaaagaggagcctatggagatttaagacaggcaaaaccaaatactgtttacatacttgaatgacaaaatataaagtaagaaaatgatcaccataaaagccaagactgcaggtcctctgatggggaagcaattggtagggaaatgtggtaggcttctgaactggctggccaggaaccatctcctgacatgggcagtgattacaagggtgttaacctttgtaaacttatatataattcattaagctgtacttttgtgcagtttctctatttgttatttttaacaacaaaaatttaaatggaatgatcctaaacacagggaccttataatcctaactgtgccaatcagtgttctccccagttgctatcatatttaaacatgaaaagtaacattcctaatcctttggaatatattaataattcttataaaaagtccactaaagtattctgaatgcactcaataatgtcagctagtatcatcacggttttgtatttgaagctgaaaacctcatacttactagtttgctgctgctgctgtgtattaaatcctccaaatcccagtccagttcccaaaccagtacctaaaccagtactagttcccgttgttgtgccaaaaccagtaccaaatccaaaacctttgttctgagtaccaccaaagagtcctttgaatgaaaaattggaacttcgtaagttaaaaaaaaaaaaaaatctgacctctacttcatttacttctatgaatgacttaagatggcctcttaccagtagtgcctgtgttagttggggcagaaaagctgaatgcagaacctgcagttgtagatgttgtcccaaatcctccaaacccacctaattaaaaaagaacaaaaatagaaaggaagaatcttttgtatatataaaggcaacttctttttaaaattattttataattgctacatataaaatcaaaatatattgatctaatttttcctttccctactttcaagatcaattttttaaaaaactatactaccaatcaagaagtcaaaatgttacaagaaatgaactaagcatttaaaatagaaatatcacaatgtaatatatacccttcaattaaaggggtggttaacagttacagctgagaaaacacattaagcctattgccataattctaaaatgactatgtatgtacttttagaggaggtgttgcaaattcatatgcctagaagatttagactgataacagtaaagagtaaagtagactatgtgtttactgataggtggaactgtttaaaatgaatagttttttagatcagcagttcctaaattccagcagatacaagaaaggtagtttagcagtgtcacatattcccattttttaccccaagagaaacaggaaatctggattttctatgtaaaatttattggtttttggctgggcgcggtggctcatgcctgtaatcccagcactttgggaggccgaggggggtggatcacaaggtcaggagatcgagaccatcctggctaacacggtgaaaccccgtgtctactaaaaatacaaaaaattagccgggcgtggcggcgggcgcctgtagtcccagctactcaggaggctgaggcaggagaatggcgtggacccgggaggtggagcttgcagtgagccaagatcttgccactgtactccagcccgggcgacagggtgagactccgtctcaaaaaaaaaaaaaaaaaaaaaatttattggtttttaaaccctaattcaactacttttttttgcaaggaattcaaatgttttgaaaacagcatgccaaacatatcacattggcagacttgttgccagttagcaaccttggttttggtgaattaatttatgtctaaattaacttatatttctacttagtctctgtcaagactaagtaacttttcaaaggaagcataccaatatacttacctccaaacaacaagaatgtgtttcttgaaggaagagatttgacagataaatggaatgctagccaatctaaaattgttttgttatttttgtaacttattgtcagtcttcagctgattaccaatgtggtatcaaaaagcctttcaagacaaatgtttgaaccattagtgtcgaattatattgcagattttttggaatcttcctttaatctcatttatttctggtatacaacacagattcatcaatattgcaatatagaaaatacaagaagaaaaacatgcaaccattttatattaatcacctcattctgatttggaaaactactcaagagtaagctgcatgttgcatgcaggcacaactaaatattctatttacttgtaggttctactgcagtactgcaaactataaacattttcataaaagtcacccacagtactaagcactgttgtaatttcttttcattattcttcacttccatagaataactatgatataatctgaattggctacgcaatagaaacactagtcagtttctcatcatgctccacaacatcaaaaatgttttagtaatagcagatctgcaagtatacaaaataaaaagtaaacaagaaagtctatcagccctttgctgaaggttaacacatataaaagtagttaaaacatattacattatcataactcaaaacttaacagtgataactccaaatgaacatgaaatcaagcaaataccaacaagtttatttattgttgttgaattatgagctgggtggctttattcagaaacacaaatttcaaagtaagatttctgttttacccagtgccaattttaagcaaacaaggaaaagtaaacacatcaaaggacagtgatatgtgattacttcgaatacatcttaattaaaatgcatcatcttgtctttgaagttttcaaatattcttcgaactgttttcaactcagatgctagggtgataatcacattgcagtaaccagtgaatgaacaaaataacaaacttcccaattaacttttagggagtaaataatgtttatcaaatgcatataattggcatgggcacaagaggcataacgtaagagactatggacgataaattcatatacgagcagctgaagaacaagtttttttctacagtgtcactatgtaaagtacccataaacctattttaaatgtatatatcattattgttttgcaaaatttctaatgagctgcaaacaacccacgtgcatatgaaaatcttcataattatctttttgaatgcaaagacgtctagcttaccttttagaattcgatgctatatcacataaaactaaactgctctctttgagcatttcccaaaattccagcaaagaactggggattctttctataattacaaatcttatagaaattacacatcttatagtatcctaatctgctgagttgaccaaagaaatacattattatcattataacacaagttaaaaaacaaaacaggttactgctgttcgtataagacttgtttctctttggaaacacaaggacaataaaatgaaatctcaatgaaagatgcagaaaaaatgaaaaatgactgcaggagtccaagaatcccaggatgggcttgactggtggtgagtttatactttggaagtcctacctaataattttaaagatctattcaaaattataatccaaatgcttatcatttggaagataagtgcacatttaataaaggaacactgtaacttgcaaaactttcctaaaccacatcttttaaggcagtaaaaacttgatacagatgtttttgattcgagataaggaaataaatttcctttccctattagacaagtaactgttctttcccaaactccaggaaccacaatattcttggactccagctcccaacactggttacacatacaacccgcagtatctacctgcacttgccagactgttaccaaaattgaacggagtcgccgaggtagtagaaacaccgaaattcccaatattaaagttcactgcaggattagcagttaatccgaaacccccaaaattaaacccactggcggtggagttggcagtctcaagcccaccaaatcctgataggcgtgtaggcaaagaaacaaaattttaaaaagggggagagggaaaaagaaaagaaagcaagataaggattagaagaatcagcaggaggtttcacagaagtgaacaaacctggttttgctccaaacagtttaagaaagcagagtgggggtggggtggggcagatggaagaagcatgacggataaaccccacagcgaggaccacagggggccgggggtggaactaagggagtcaatgggcagtgccggtggatccccagccctatcctcgccgagtccggcagcgggaaccacgcaagcgttcccgcccatccaggaggctgaggtgcagaggggagggaggttctcgggcaaggggagagggaagcaacctccaatttctctgagtaggactccccggcagcgggaagcgaaccgctcaagccagggccctgtggaaactcacgcgcggcaagcgagcttctagtgggaccccgagtacccccgtggcctcctcgggtgccgcctcggcccactctgccgccgcccgcccttttccaatgcctctaaagtctccgcgtcggcgggagattccaggatccccaggtcggagagtctcggacagagggggcggaccagacccttccccttcttcccgggtgaaggtctagggggatcactcacccgcgggggccgcggtggctgcagcggtaccggaggtgcccgagggagccccaaaattgaaggccatgtcgcgaaagcaggagaccaagtaggttactcctgcgacgcgcagcgcgctccccttctcagtccggccgggaaaccgccagtcagatcaccgagttccgcctcctttctgacctagcctaagaggccggaaggcgccaagggcgtaggaggtgggtggttgtgagggaacgcccccagccagctcacttccggtgggcttcacatgctgtggggtgtcactgttaaggtaaaatgctgggacgctcgcgagggtgtgccgcctgagagtcctttaaaaactgccgtagggaggttctttgggaaaggtgtgcagaggctgaagttgttactgtagggatacgcggtagacagctagaatttgtatgtggtagggttgaagttgctgcctcatcaactagcgggcctgggaggtcgggcagcagggctggggttgagaacccccccaacacccacgaggaggtggtatttgaacccagtgctgaaggatgagtagacggagcagaagcagtaaagaggatgcacgttggaagaaatgaaagcgaatggaattgtagcaaacacgttgcgtttactatgtgccaggcactcttctagacattttacataatttaatcagctatcttatgaggtgggttgctgctatctccaatttataaaagaggaaacaggtaccaaagggtcaggctgtttacagagtaaatactcctaaccacagctctaaggggagcactgaaaaagaggggaagagtgggccccctctgttgtacttgtaatataatttaatcctcagaataaataaatagagaagattctgtaactgtattttgcaggtgagatgagagaattgaggtttggagttgttaagcagcttgcccaaagtcaccttgcaggtaggttctggagtctggttttggactcatgtttctccactccagagtcccaatttgtaaaaattaccattatattatattgccttgtaaattatggtaaggatttcagactatttcttgagggtaatgggaaacctttaaggggttttaggcagaggactagtatgactagaattttgtttttagaagatccctctggctgccataaggagaatggattggaaggagccagaatgcctgaggaagatagagcttttaggagtctgttgtagttgcacaggtaggagatgataatgacttggattacatctggcagtggaattaggagaataaatttgagagatacttaagaaatagcatatatgagactcgtagtatttggacgtgggaagtaaggattcaaggacaacctcctgctttctggcttgggcaagttggtgaatggtggacccgtgtctgactcctacaaactgagtatgctctcatacccactgccctgccttctttcactgtttgtcacagataatttatcaatctaatttttccttacaatagtatatattccataagtgcaagaaccatgtccctcttgttccatgcccatcacaagtgcctggcatataacagggggaaataaataatgaatgaatgacagataggtggaaaccagatcttgaaagaccttccttagcatgttaaggagctttgatttaccagcagtttgtccagctgcggcccacaggccacatgtggctcatggcttaggatggctttgaatgcagcccaacacaaattcgtaaactttattgaaacattgtgaggttttttgcgattttttttaaagctcatcagctattgttagtgtattttatgtgtggcccaagacaattcttcttcttccagtgtggcccaaggaagccaaaagattggacacccctgatttagcacatagcctaacgcttaagtacttagcttaccttaaaaaaacaaacaaccattcttcttcttccagcgtggcccagggaagccaaaagattggacacccctgatttagcacattgtctaatggctaagtactcagcttaccttaaaaaaacaaacagccctcccagtctagcagaaaggaaaaccaatgattaatttatggaatctgccagaagctcaggaattggagatatcacgtatcttcataagttggggtaaagggaagttaaaatgagaggaactggttgaaagtctatttaagaagcagttagagctccccaaatcctcttctgacctcgtgcagccaagtgaatgcttcttccccactctagaaaaataatggaggattcttctctacagtgattaaaatagtatttgccaggcacagtggcaccagcctatagtcccatctactcggaaagctgatgtgggaggattgcttgagcctaggagttcagccagcctgggcaacacagtggggactcccccccaccccccgtcagtgtaaaaaaaaaaaaaatagtagtgtctctggacttgggggcaccagacattattgagagtgggtagtgccctactgaatggtggaagactgagtggaaatgcatgcctatacacaccttcccctactgctcccagaacattggcagccaggccttcgccctccaggaagatataggagaattttttatgggtgaaatgaccagtatcaaagaaaagacaatcatctgacatcagaaatctctaaataaatgatttagccacatgacattatagcagtggttctcaactggtgccaattttctacttctcccatcccctggcacatctggcagtgtctacagacagttttggtggttgcaattgggaagatcttacaggcatctattgagtagaagttgaagatgctgcaaaatactctaggacagactcccttcctacccaaacaaaaaattacctggccccaaataccactattacagagtttgagaaatcctgctttataataaagctcacactttgcaagcctcactaaggcactcagaacttccattcagcttttaagtcccactcttatatatgagtagaccagcaaggattaccaagctgaggagagcctttaacacaatgtatagaggtcaaaacaaatagagcagcaaaagcagcttggaggaaactaactgcaaggagaataaaacttttaaaaagtgaacatatccgcagagagataggaagagatattgtaaccatgaaataatatcaggatgttattattttcaaagaaaggtattcttagcagaacaaaagagagctattggaattttaaagctattaccagaaatgaaaaacccagtagaagtgtcggaagataaaggtgaagaaatctctcagaaagaaaaacaaaaagaccaaggatggaaaattgaggagaaactaaaactagaggactagttcaaaaagccctctatcacacacactgttatatcatgcacactaatacaataatttcagaaagagtatagagaaaaatctgtcctttaaagtccttcaagatttggtctcttcctattattcgttcattcagagtttattgagtcctactatgtacttggtactattctgagtgctaaacaaaaaaggtatggtttgtgcctttgagaacttacagttgagtgagggaaaaccagatattgagttaatagtacacttgtgggccaagtgcagtggctcatacttgtaatcccagcactttgggggaccaaggcggcagagtcactgagctggggagattgagaccagcctgggtaatatagggagaccccatctctacaaaaaaaaaaaaaaatagaccaaattagccaggtgtggcacacgccaatagccccagaggttgacgctgcagtgagcagccatcatgccactgcactccagcctgggtgacggagtgaaacattgtctcaaaaataaagaaaaaaaaaatagtatacttgtgactgttcaagaaggcagcacagctgaggaaattattaaataattcaagaaaatttatcataattgaaagacactgctgggttgaaaatggttcaccaaatgctcattacaattaatcaaaatagactcacactaaggcacattccaaaataacagaaccatgatggcaaagaagtttccagagagtaaaagaggtcacacacacaaaaacaagaatcaaaatggcatcagacttctcaatggtaacactagctagaaggcagttgagaaatgcctttgaatttctgaatacaaattatttccagctacaattctattcccagccaacttatagatcaactatgaagggagaataatagcatttttagacaaaaaaaaaactattaaaaaacaaaatacctcctatttcttaggcagttagttactagaggatgtttgccaccaagatggagccaatgctgaaagaggaagacattaggagctccaacacagatggcaggaatcctcaggatgacttggagagcaaccagtccagactgtagcaagtcaggttctggggaaggctacttcataaggatgagcaatttgagagagacttagacaatcagcaacaaggttggggttgaattggtaataaatacatgaaaactaagccagtgggacaattaatattagatgagaaaggaaaagtgttgaaatgttactacatggctcaattgtgcagtttccacatcatcccaataatgtgaattgaatattgagctagacaaaattatggcataactatactggaaagatgggggaatgaaaagaatatttatgtgcatagaaaagagctaagccctcatcctccatggtggggagtcagtgggtaatgctgaaacaaaattcaccaagcagcgtatcatttatctggagacaagggggtaaatttaaaaaaaaaaaaaggctaaaagaggtgcctgcaagcactctgagagtagtatctgcttttcttatcttttttaaaaataacaattgtagaattgtttgattgttagtatgtgcttatatgtataactttaataaaaatgaaaacaaacaataacaaaaagcctttgtacttattaaaattactaatgtcgtttgacccagcaatgctacttctaggaatttatcttataaatgatttggcaaaataatggaatacaaggtaattcattacaacactatctataataatgattggaaacaaaccagggtttgggtaaataaattgttgcttttatacaaaggaatactattccgctatgaactgggaacaaaaaagccctttatgtactgaaaagaaagacctcaaagataaattacatgtggaatgttcatccttggagttgaaaaaacaaaattacatgaaaaatgcacaattcagaacactgtatgtatgctacaatttgggttttaaaaaaaagagggctagaatatataaatacacataatttgtacaaaatattcctggaaaaatacatttgaaaaaccaaataatattggttgcatgtgggaagatgtattgggtggctaggaaatgggtagaggaagacttttaccctaaacccgttttatgcattctgaaaatgtagaagggttacttatttaaaaaactaagtaatgctggctaatatggtgaaaccctgtctctactaaaaatacaaaaaattagccaggcgtagtggcacgcgcctgtagtcccagctacttgggaggctgaggcaggagaatcgcttgaactcgggaggtggaggttgcagtgagccaagatcgcgccactatagcctggtgacagactctgtctcaaaaaacaaaacacacatacaaaaaaccctaagtaatgctaattgtttcgggaagtcagggaccccaaacggagggaccggctgaagccatggcagaagaatgtggattgtgaagattttatggacatttattagttccccaaattaatacttttataatttcttatgcctgtctttactgcaatctctaaacataaactgtaaagatttcatggacacttatcacttccccagtcaatacccttgtgatttcctatgcctgtctttactttaatctcttaatcctgtcagctgaggaggatgtatgtcacctcaggaccctgtaataattgcattaactgcacaaattgtacagcatgtgtgtttgagcaatatgagatgtgggcaccttgaaaaaataacaggataacagcaattgttcagggaataagagagataaccttaaactctgaccgctggtgagctgggcggaacagagccatatttctcttctttcaaaagcaaatgggagaaatatcgctgaattctttttctcagcatggaacatccctgagaaagagaatgtgtgcctgcgggtaggtctctgaactgacccccctgggcttagccgtctcttatggtcgaggctgcagagatgaaataaactccagtctcccatagcactcccaggcttattaggaagaggaaattcccgcctaataaattttggtcagactggttgatctcaaaaccctgtctcctgataagatgttattaatgacaatggtgcctgaaacttcattagcaattttaattttgcttcggtcctgtggtcctgtgacctcgccctgcctccacttaccttgtgatattctattaccctgttaagtacttgatgtctgtcacccacacctattcgcacactccctccccttttgaaactccctaataaaaacttgctggtttttgtggcttgtggggcatcacggatcctaccaatgtgttatgtctccccccgacgcccagctttaaaatttctctctttttgtactctgtccctttatttctcaagccggccgacgcttacgaaaaatagaaaagaacctacgtgattatcggggcaggttccccgatatctggcgcccacgtggtctttcttttgcaggattcctagtgacagtgcagatgtgcaggtgaggacagcaggaatgaagactgatgggtgattgcttaattgattgtatatggaggggagggaaaggaggagtctagcatgagtccctgatttctggctatacagtgagatatgattgtgatgctattttctagtaatgggaatttgggaagaaaagaaaaatgagttcctttacttactgcatttgaggcatcctggctaaggatatccagcaggtgtctggatatgtgaggctgaagctgaacagtaaatcccatttacttcgccgacttcaattacaacccaaacacaaaccaacctgtattgtggaaagaaagacctcaaagataaattacatgtggaatgttcatccttggagttgaaaaaaaaattacatgaaaaatgcacaattcagaacacaacccaacctgtgtttaggttgtaattgaagtctgggaggtaaatgggattgtcagggagagagtatcaagtgagaagaggttgtagctgagcactagtagtaagaagagagcagagagccctcaagggagcctgagatacaggggccaaatccagcccactgctgatttttgtaaaatactcttttgttggaacatagagacatcatttatgtgttgtctttagctgctttcatgctgttaagaacagaattgaatagttgtgacagggcacctggcttgcaaagcaaaacgattttctgtatggccctttggagaagtttttcaaaccccacctagactactgcagcagctcccatagcataatgagcaagactgtctatgaccttggcagttcattcttggttgcctgcagaataagttagctgtggctggggtttcctccttctagggaaaaggctgcacccaagctcaggttcccatgggactggtgccttcttcatcacaggagtggagatttttaacattccatggacagctggcatttccagacaactcctgtaaatcattggcactccaaatccaaaccacctgttgctcagcaccttgtgtattctcccgttgacgagactgcttcttcaagcttgccctattaaaggggagactagtaggatgtgctcttctgaaaccaaacagcgttgtgggccttggctcacctctccatgggataacatgaggatggtaccttcttttttcccggccctgtaaatttgtatttcctccagtgaagctcattccttaacccatgctatgtagctttgtggattcaccctgaagggtggtgtatgacagctgatgacccagaagacccatcttgcatgccaatggagacctagcacaacagctcctaattgatctctctgcatccatgttgattctcttcaattgtagtcttcatcttgcagctagaatgggtctttctaaacagacttgcccaccttcctcccacaacccaattgaaaacacaatagctccccattggtcttaagacataccaaaatacccaaatctttaatatggtttaatgagactcaagatgatctggcctctgcctttttctccagccttatttcccaccgttcatccctctctggactgcagccaaatattttctcagtcacttgtagtaaacacgtttcctcctgcccttgaccatgtcctgttccttttgtctgaaataccttgctttgcttaattaactccagctcctagtcatgttcccaaaacaatgaactcagttgaaattttacatttatctgtatgattatttggttactgttttccacactagaccataagatccatagatctcttttaaaccagtagcctagtttatattcaaagtgcctagcataaagtgagtgcttaatgaaattagttgaacacatttttaggtataatgtagaaagaagccaggatccaaataccacatactgtatgattatataaaatgtctcgagaaggcaaatctataaagaccgacagatgattagtggtttgccaggggctagggttggcaacgctgagtggctataaactggcatgaggaattttattgaggttatggaaatgttctaaaactgcacaactcagtaaatttactaaaaatcattgtacatttaaaatgggtgacttttatggtatgtaaattatacctcaataaaggtgtttaaaaacttgactaaatgaaaaaatatagttattggaaatgagatctttatcttgtgctgaatgtgtatacatctttttatactttgtattctataccactcatcctatactattttcttattgctaatggatatatgttttaacataccttattgttttaaatttttttttctggatttttcttactccctgatttgaaataactaggcttggcatgttacaaagttccaggtgtctctaactaccttgagtaagaagaaataggtacaaggagcttccctgtgacataaaccagctgcagagttaggattcctaggaagtatgtatcttagggatcaagtgtccttgatacatgacatttgtaacactgagccagatattttaagactgatctagatttgctgatttcaaaaataagttgcaatattgggatgagaaaggttttaaaggtaatctgaattttagaactaataactttagtaccctagatagtaccatagataaatatccctagaaacaaaagcctcagcactttgggaggctgaggtgggcagactgcttgagcccaggagttcaagaccagcctgggcaacatggcaaaaccttgtctcaacaaaatatacaaaaattatccaggtgtggtggtgcacacctgtagtcccagccactagggaggctgaggtaggataataacttgagtccaagaggtcgagactgcagtgagccgtgattgcacgactgcactccagcctgggcgacagagcaagactctctcaaaaaaagaaaaaacaaaaaacaaaaaaaaccagtgcctctccaatagctcttggatcctactgagcccttttgggtggacttatctgcattttggttgggtttacctggaagcagacctaagataaggatgttaggacaggtggatgatttgggaagcagcattgaagggctgggcgattaagacagggaataaagaaacactgatagaaagtagttaccactgtgggcaaccctaattgaggacccatgtggaataagcctgagaactggtcctctgaggattgaaacatctatcagctgactgactcctgccccatttagttgagggttgccttgggttattaactccctgatactcctatggtgctttgagggctcttgagaaagacttaagacagaaaagcagaatgtgggactgcttggagtgaaacttgtcaggctgattgtaactgtccactacagcgaagctgaaatcagacatggcccaagtgtgtgactcagggctgcatctgtcaaggaacatctttccagggaaactccataaacaacaggacatccaatgacatatgacttctagagcaattttatataaagtggttttttattaatgaaacatttcattgcattaagggtagaaataaacatgtcaagaaccgcatgaagtgaaccaactgtataagctacatgaagagcattctggtcagtattcttgttaacaggcacaagcaatttagtgataatgtccagagggccaaggatgcggaccaccttttgcagaactcatatctcgagcagtttaaattaaaaattagcctcccttaagttaaaaaccccaataggggttagtcgtgtagtgcttgttccacttgaccattagtgatctttctagaacatgaggaaatcaagtctggttagaaaagcctggagctaaaagtggcaaagcccatttcctgtcctgtgctcaactcctaattttccctgagagaagtgagttaagctctctgtcttggtttcttcctctctaagttgaggatcatggtaccagaagcttgcattctgtgatcatgacagtgcttacaatcacaaagcctttgggggtctttctaagataactgccgcaagaaaatgagcatgagaaataattcatcttcaacttaaagccaaataggtgcattcattcctcttaatctataattttgactgtagtttgtagatctgtctcagacttttcagaaggatagtatcaaatgtgatttaaaccaagtaactattaagaatcataaaacaggccaggcccggtggcttacgcctgtaatcccagcactttgggaggctgaggtgggcagatcgcagggtcaggagattgagaccatcctggccaacatggtgaaaccccgtctccactaaaaatacaaaatttagctgggcgtggtggcacgcacctgtagtcccagctacttgggtggctgaggcaggagaattgcttgaacccgggaggcagaggttgcagtgagccgagatcatgccactgtactccagcctggcgacagagtgagactctctcaaaaaaaaaagaatcatgacacaagtatggaagtaatgtttttggtctccctgccagtgtgcaactcagtctaaatgtgtatatcattaactgttatcatttacagtatttaaaatatcctcctcacagatgattatatcctgataataggactaaaccaataagtatgcactagcattgtcaattttattagtatggataagtacatgcataattaagacatgcccaattatctagttaaatgttgataaattctaaaaatgtagatatttagcattattgaagaccaaatatttttgttagtttttttacattttggtgagttggagtatctaaaggttctatcttgattctatagaaaatttgagagtttaatgaattgcctcttcaagaggggaaatatatcacatattgttttagtgtagaaaaaggaaaaattgtcagtaaaacaatttattacctcaatacagggataagaagctatggaaatgaaatctatatttttttcttcatttgcttacattgaaatccagttttaaacaaaaaaaatccttttgaatggttcagttgttaagaaattctataagcactttgtcagctaaatgtataggcttctcaattcaaaatgaatgctgaactttgagaatcaaagaaaatgcccttaaatatgcttgaattctgaacactgtgacatatgatggctcccaattccctgtcttaggttatgctgaaaccaagaagtcctttgaaaagtggtgtctctgcttctggtcctaacagacctttctttaaagtactttgtgcaatattttaaacatccatcattctgtcagcaaaatgattgtcacaggaagtatagggcacacgtttctctattcagtgagtgacagtgagctacaaaacactggaaagaactgaaactgaggaaggaacttgtaaaaagaacttcaaaattaccaagaaggcggctgtcccagaagaaatatctctttagtctaatcagactttctgaaacttatgtgtaacttaggctgtagatagatggatttcccatattcataattttacaaataatcactcaatattagattaattaatacagtaacatatttggcaagggcgactcaggaagaaaaatcagttactcattacattctctcagaagcatcttttcgtagcatgatcattttgactaaaaaaaaaacagttaactatccacaagcatcataactagcaattaattctacatgaaatatctgtactttatcctcaccaacattatttatgcattctcttcgttcacaaaagtacaagttaaaaatccttaggagcttatcactatcaactcatgggtattgccccacccaacccctttcccatttgattctacccagtattttattgcagttggaagactgagttttcctggaagaattatgaactgaagatcagcataaaatgtaatatgttttagaaatcagatgcatttgaatgatatattggatgaagctaccattttaccctgggtcccgaactcttatttacttctgttttgcaagtgaaatggaggaatacaacataaaatggtatatacgcattttgagcacaaagttcggtgaatgaagcatactgaatgaagttagaccagtagcattaacaagtgatgcagagacattttacccacaatagtggtcacaaaattctggagctaccagcacccaacaacaacaaaattactatacaagggtttattaaatacttgctagacacataaaagaacaatttcagagcccacatgattttataaagcttaatggccagccatgtcagcctgctctttaacctctggccagaatgttcctatcacttgccagcgccgtgtctttttccttctttcaacaggcaacaagcctgcaaggaggtggagggtttccccacgtcatcgtccaggtcaggacagctcacacagtttcttcaccaagcaaaggcaatgtttaggttcgaatgaggggtgctctttcatccgctgttccctgaaacacagaagagagaaaacaagttagatgttcatgtcagaaacttctccccagtgtgaaaagtttgggtggggagtgggggcatggaaggaggagagacctataggaaggtggctcatctcactcacctcccctcttgggctgctgcttgttcttgaagattcagcaggcctaacctttccaggaggccttctctgaccactcccaccctcaataccagagcagtacccttctctgtgttgatctggattataaaacttagactctattcaacttgcctccttcctggtttgaaacctactaaggagtagtgtctcagaggtattagttctcaataattccttgcttgttgaatatatgaggaaggttaattgtaggagcagtaattaacatttccatgaggtttcatttgtgcttaagacaatttcaatgactgcataaagtcacactggaagatccacacatagaaatggcaaaatagtttgcctcacagctaattcaggctaaagtgactggcaggggataagagaaataatggaagaatatggaagtcagggaaattcagctaattttactcagatggtttcacgtatttattttctacttcacatttgccttggacacttagttgaggaaactggaggaaaaaaggccactgttgtaaaaaaaaggaagctgcagaaaatttaagaagggcttctacagaaaaggctcattgcaggtattcaggttcctggctgggctgctggtcacttggaaaggcgaacccaactctttatcctagccttccaggaaagtaactacacccatgttccaatcatttattatgcagtgatacctaaatcataggtatcttcggatacatcagggattctttccaagcaggaccctggctgtcttgctctataatcttggagctgttttatcatatttaataatacttaaacctttattgagctcttactatatgctaacactgggccaagtcctttaagtctactatatcatctaatcctcatgaaaaactcataagggaggcttttattatcccattttacagatgaagaaactgaagcacagtttctagggtcgtatagctgttaagtggcagaactgggatttgaactcaggcagtctgacaccaaagatcagatgtgtaactgttatatattcttccttttctttcaggttattgttttcaaagacataaagttaactcccaggggatacatccaaagagattctattccccaaatattagatggtaccttctaaccctccaccttctttgacacacttcctttgcttcccatttggtccagcagtaaaataagcacgaaatcactatgcccagcataaaatcccagaatttatcctaataagccagctgacagcccttcagtgaagtacagttgaattcctcaggtaaagttatccagtaaggaagaagttccttcagccagttctcacctcatccatggatccctgtcctttgcatgcaagccaggtaaaaaccaaaccaaagaacacacccagcgccatgatgatgtagggtatgttggtgatgatcaaagtagtgttaatcatagacttcagtcgactcgccgtctctttatcaatgtgaacactctggagaggcaagaaaatagtattcttgatgactaaacatccagtgtgtaactgttttttgctatatctttcctttgtttaatacaatttgggaatgtcctcctgttagcaaaccaaacatactgaaaatccatttataagtcagagtaatcagaagggacatttattcattaatatcttgtcttctcctgaagacattttttttactcttaaaatagattggaaaaaggaggtaaaatgtattcagaaatattgagacagtatcaccttttgttttatgtcagataattccaattcatccttaaaaatccagctcagcatcacttccttccaaaagttttctctggctacctcaggcctagtcaaaggcctcctccctaagtttccatctcactctctacttccatcattgtccttgcactctgcattgtaactgtttgtcttgcaatggctgtgaagtccctgaaggcaagacttaacctcagtcacctccacactgggtatagcacccagcacacagtaggtgcttgattaatgctggctgattaaatgaataaataaatgaaacactgcaaaaatggtatgtggaaagtataatttctttcttggttacatctatagtaatcaggaccacagccctctacagaaagtgctcagcaaagttgtgggctaactagaattccagagactgctgatagaaggaaatgtactagaataacacttagtgtatgcagagcagaggaattaccacctagtgtaatgagtgaggtatctgaagagcttaattccatagaaataatgagcaacaattctggcctagtttaggcttaatttgcactggaggcctggcatagttgcacacgcctataatcccagcactttgggaggccaaggcaggcggattgcttgagctcaaaagtttgagaccagcctgagcaatgtggtgaaaccacctctctacaaaaaatacaaaaattagctggggctgggcatggtggctcatgactgtaatcccagcactttgggaggccgagatgggcagatcacttgaggtcatgagtttcaacatggtgaaacctcatctctgctaaaaatacaaaaattagccaggggtggtggcgggcgcctgtagtcccagctacttgggaggccgaggcacgagaattgcttgaacccaggaggcagaggttgccgtgagctgagattgggccactgcactccagcctgggcaacagagcaagactccatctcaggaaaaaaaaaaaaaattagccgggcatggtggcacacacctgtagttccagctacttggaaggcagaggtgggaggatcacttgagcccgggaagtcgaggctgcagtgagccaaaatcgcaccactgtagagggtgagagtgagaccttgtctcaaaaaaaaaaaaaaaagaaaagaaagcattttttttcattggaccgagtcagtggattgggttctaagacattttttccaataactggatagagtttcctcctcggtaaaaaggtggtgtggcaacagtctccaatgtcacttccagacttccaggtctaatattttatttttctagagaagagaataatcacgctcttcctaggaggcagcaaaaatacaaggttccactccacacacctggacttaatctagtctttcacaaaaaagcaaattagaagttgggggtggagggacttcaaatatgccactactgaacagaagttggcagaaaagggcccttctgcattttcaaaaagatctttcatgcccctgcccacaaacaggaacatggatgatcaggagcaattgcaaagagatcctataaattggtaaatattgcttgaatttttcctatgaaacgataaaaacctcatcttagaattgtaataacaaacccttaaaagtttgtaaatgtgaataccaatataatgctaaatggagaaaaaagatataaaattgtatctatcgtatgatttcaactatgtaatatcaagaccagaaaatatcaggagttgacatctgaactgcacctgcctctgatagagagggacttatcagtaatttactttttaaatcaatttttaaaaaaatttctaagaattttataaagagcacatgttttataaaatgtaaaacattagattaccttttaaagttgttattggaaaaaattgtacaacacattgagtaaaataaaataaaaatattatcaggctgacacagattttgtgaatagtgattttaatttttctttttcttgctaatctctgttattcaatattctacaaacagcaagtatttttaggaaacacaaaaataataaaaaggagaagtttgccaatcaagaatttattgaagaaaaaaacctgcgttttttttttttccctcaaactgggcggaagcaggagaaactgaggagatataactacagtaaacgtgatatgtgattcagaaaagaatttatcataggtgtcttaaaccagcatggtttcaaagaagggggagacaaagggctagctggcatctatctgagtgtgagctatttccctgcttcaacaatgtctgccaatggctccttttacctgtttctgtttcctacgtgagcagctccccagaagggagttttgcccaaatagtgttcttgagaaggaaaatttctttccatcatttctccaaatcagctctcagacacaggcagattcatgtgaacatttaagtgaaattttctgaggaataacaggttttaaaaatcttttgcccttctgtcataacttacatgtaactacaacagtagacatcataatggattttttctgagtctgaaaacacccgtggctccctccgtctcaggacttacctcattgaggtacatcactgggaaaaccatggttctaatgtctcccgtttcactacaaagacaaaggatgagattgtttcagaaacatcctcatcacaatggcacactttcccggacagacacatttatatgaagattctagtacacttatttcttaaattacccagaatttgctgatttcttagttatctttgcaaacatgtaccccaaaagttagattccagtctgtctagcaattccatgtgctgtacgtttatcaaaacacaagatactgaaggcagattccttaaaatgatgactagtctccttagagtcatcagggaaggctccagtcgacagaacaaaactgtcactcctcagagtgttttgtaactaggccactgaagtactgtctttgcaacaagagccaactgagcatgtaccacgtgccagctctgtgctgggtgtttttgggatattatctcattcaattcctagagtagtcacctacagtaggtattactgtcccaggtttacagatgagaaaattatgactcagagaggcctaggatcaccacaagtaagtgatggagccacaaatgtaattccactttgcttctaagattccagctcttaactactaaattatactgcctcggaaatagatatgcagatgacaaaatgcattcttgtaaaccacctacttcttagaaagagccatgacacctggtattaaatctggcaaattcaatgaggtaaacaagccaagttttatagataaatatattatgcatagttttgcatcctgtttatttcactcaacattatatcataattttctcatatctaaaaaattcccattgaaaagtctgagcaggagattatactttggaatccaaattaagctgcagcatggggaagtaaggctagactcaagagattataactatacaaatgagagctatggctggccccaagtgggatcagtgggaatagagagagaggaagaggaagagactctgtctcaagtctctgagtgatatagtttggatacttgttcccccaaatctcagggtgaaatgtaatccccagtgttggaggtggggcttggtaggcagtgactggatcatgggggtggatttctcatgaatggtttagcaccattcgcttggtgctgtccttgtgatagtgagttatcatgagatctgttatttaaaagtgtgtggcacctcccctcctctctctcttgctcctgctcaccccatgtgacgtgctttattcctgcttctccttctgccatgagcaaaagctccctgaggcatccctagaaactgagcagatgccagcaccatgcttcctgtacagcctacagaactgtaagccaattaaatctctttataaattaaccaatctcaggtatttcctttcctttccctccctccctccccccccccgctttttttttttttcctgagacacagtcttgctctgtcgccagactggagtgcagtgccaccatcttggctcactgtgacctccgactccctggttcaagcgattctcttgcctcagcctcccgaatagctgggattataggcacccaccaccatgcccagctaatttttgtatttttagtagagacgaggtttcaccatgttggccaggatggtcttgatctcctgaccttgtgatccacccaccttggcctcccaaagtgctggattacaggcatgagccactgtacccagccaggtatttctttatagcaacacaagaacagtctaatacaccaagagagtcaaggtgcatgagggaaaggcttagtggagtggataaaagttgactagatagtaaggcttagccaagttacctaaacactctgcttctgtttcctcatctgtaaaatggggataatacaaggttatatgtgaatccacataaggtgctgagaacaatacctgatccatgggaagtactctgtaagtgtatgattaaataaaacaagtaaattccaagaccaaggcacccatgaaaatgctgatcatgccccatccctgaagggcaggggtgagcaggcttagatgaagtaggctgtactcctcctgacatcaaccccaccagacgggcaatggagcaaaactgctgtcccctccatagaaagaagcaaaacttacacaaagtcatctaattttttgacataaatgttgatttggaacctcttggctgcttttaggattattccagtcaactgcaaatcagagaagtgaaaaggaaacattaggatttattaaactgcaaacaactttttcaatagagcaccatttctgtgtagtcctcataaacaaggtgaccattaccatgtgtgacaggcagagtggaaacaagtaaaagtgatccccagaacagaatgagaaccatgggttgtattaggtggctgatagaccagtgtgtctcaaacatgagtatgaatgtaggtccttgggaatcctgttaaaatgcaggctctgattcagtagactggccatttctaacaagctcccaggatgctgccactctgaatagcacagccttagaagggatccaacaggaaggaggcctaaaagatagcctgtcaggtctggatttccaggcagttgtccagagagctaagaagagggtggtggtcactgccagagagtggcatcctagtatagggcccgcctagcgtagccatggggcacagctgcagcacttgtcatccttagggcagctccatctttgcactaaggttataagactgtgttcgtcccttggtgacaagcactgctaacagtttggctgatccaagggaactgatcagctgatggctaagagaaaagggagaaaaccacacacgattttattcaccagagcataagatcactggtttctcagatacaaatgcaatgtatgcagctaagagtgtgaagtacccataaaatactgtgctaaaagaatgttcttgttttttttttttattggtccataatgttcaaattccaaaaatgaagacatggttagcatggtttttgtttttctcgtctatgaatacaggagtaaatgtgtattatacacacacacacacacacacacacgtgtgtatgtctcctctatgtatatctgatacctttacaattaataatataataaactctcaaataacctgtagaaagaagtttgccaaaagtgactgaggttaatatacatattcatatttcaaccaaaatattcctggcagtgaggaagcaaagggacatctttaaccttatcgatctgtgtcccaaggggagaaataaatatatgttgaggtccaaggctagcatcagaagattgaccaggttatatgggtacatcagtagtttccaataactgagttttcactgttgctttttgttaaaggcaggtttgctcgtatttctgctattcaatccacaaaattcagccttctaattacagggctatgagacaatgcctccatcagcactgagctgaatttctcccacttgaatatgtatatgaaagtaaggatatttttaaagaaggctcaggactaaactggtgaacaatgtatagacagaataaaacatatgctcttttaccaggaggaagtatgtactcacaggattaatgtccacaaatgtctcatggtcttcctgatttgggtgcatgccttctatggcagaaacaaacctctcatctgcttggtaaaagtgtgggaaagacataatgatgggtgcacctgcatttgaaggaaaacagaaatgaatgatgctgtttttaaaatctaagctgagctgaatataaaagttcctggccacagcctggttcctaaagaaaaacaaaaaagctacatataaattaacttgggtaggctaaaacaccatcctttacctcctagttcaggatttatacttcattttctgacatctcatttacccccaattttttattccacattatatattgaagttcaggctaaattatttattcttcaacaaatatttactgaagttaaagtataagtgcttcatacacattattttatttaatgctcccaacagcccagtaaagtcagaactattagcctcactttgcatttgaagaaagtgaggttcatagaagttacaaaatttacccagggacagctagccatcaggctatgaaggcagaatactaagtgaatgaagggtgttgtacctcaaagcactagtttcaactacaattctctatcagtaagtggactgactttttatttcttgtcctttttaaaattaaaaaaaaatttttggtggttttttgttttgttttgttttgtttttaccaaagacaggcataatctcagctcactgcagcctccgcctcccaggttcaagcaattctcctgcctcagcctcccaagtagctgggactacaggcatgcaccaccacacccggataatttttttgtatttttagtagagacagcgtttcaccatgttggcaaggctggtcttgaactccttacctcaagtgatctgcccgcctcagcctcccaaagtgctgagattacaggcttgagccaccacacctggcctacataattttttaagagttagcctggttgtgctatacacccagcctctaaccagatcacaaagattctggggtttttcctttcctattcattttaagaaccaaataagtgcttatgtaaatttaaatatatatatatatatatatatatataaccaaatagggaaacaagttactaaaggaaacctattctagatctggctattgaaaagaagagagggacccaacaattgctgccagggaaatacatttttggagaaaggagcttgtcggcaagttatttaaatttgcttacatattcaccagcccatggcttaaggaactcatccctcatctctcacatgcacatgcattttgctgtttactgctgaatagttccacaaaggcatgacttccttctttgtgacctataatgaccttgaaaatgtattttttaaatctgttgagggcttaataggggctactgtcctgagtgttttatatatattatttctaactctcacacaacctcaagaagctataaccacctccattttattaatgagaaaactgatgtctggaaccctccttaataaactttggccaatttaccaacaaatagaataggactcaaacccaatctgcctgactccagaacactcatcctgctatccaaaatgtttccctggagaattcaaaacactggaggataatcctggggagtttcacttcagtccaaattcgggaatacgttaagagggaagaggaaaaggattgtagcaagaagtttaaatgtgtaaagtagaatacttctgttgattctggcatcagcttcttaaggaaacagaatttaataaaaacagcaagagaaaatatatctacatttttgctttgagccagatgcacaccagatgagggggcagggacactgtttcaggactattaccagtaaggcaatgggggagatcacaaccaggaacttgttcccattcacccttggtctttatctccaggtaaagggtaccatgttcccttgcacaatggtccccaaatacctagacgccatctttatggaaatcagctggagtacttgttaaaagtgtagattctggggccctggtatatccaacatgggaccctgggacatacatgcatgtgtgtgcaccatgagtgtgtgtgcacacttgcgcacgtgtgtgtgtatacctatatatatatactatatacatatatattaaaatatagcaaatataagtatatgcaaatatatgcatatttatatataactataaaatttgttaatatactcatatattaacaaatatattaacatatacatacataaatatatacatgtggctgttaaaactagtcttcaagatgaaaaatacttttgtcagttgtatatatatatgtatatatacacatatatatgatatacgtatatataaacaattttttatatatatataatttttttgttttttgagaccaggtctcactctgttgcccaggctggagtgcagtgttgcaatcatagctcactgcagccttgaattcctacgctccagcctcagcctcctgggtatctggaactataggtgtatgctactatgcccagctaatttttaaattttttgttcagatggggtctccctgttgcccatgcaggtctaaattcttggcctcaagtgagcctcctgcttcagcctcctaaagtgttaggattacaggcatgatccaccatgcctcaccaatatatttttaataactctccagataattctgatgtaaagccaggtgtgggggtcactgccctgtcagacaaggatcaggaggtatactgctgacttcagacttattccaaaatgatatcttattctttttttttttttcttttttaaaagatggagtctcgctatgttgcccaggctagaatcaaactgggctcaaacgacccttccaccatagcctcctgagtagctgggtctacaggcacacgccaccatgccaggcctgaaaggagattttaaaatgagatagataagggagcaaaagtgagcacattactattcaggagaaagggactacacagagagctctccagagaaattttaaagaggaattacagcccaagagggaatcacagggcaaatatgagaagaccctgagttccgccagggatctgctcagagggaggagtcgcatcaaaatcacgttccctctctgagccctagtttccccaattataaaaacaggccgctgaatgtctactatctagtaagttcattgtgaataattctgcaacatgtggctgttaaaactactcttcaagatgaagaaaatagttttgtcagttgtgccactgataattctgcctcattcatggaaaggagcagagtagctctgacattaagaaacactgggacatttgtgtcagggtttaaaactaactctgcttcaaaatcactgagaatctttgccatgatacgtactttcttaaaactgagttgtccactttttcttttagcttttttttttttttggtggggaggtgcggaatcactctattgcccaggctggagtgcagcagcacaatcatagcacagtgcaacctcgaactcctgggttcaagcaatctctctgcctcagcctcctgagcagctgtaactacaggtgtgtgccgccacacccagctaattttttaatttttttttttttgtagagacagggtcttgctatgttgcccaggctgatcttgaacccctggcctcaagcaatcctcacatctcggcctctcaaagtgctgggaatacaagcatgagccaccgtgcccagccttagcattgttttgaacatgaaatcagttaatgttttgcatgcattaactacatgtaaatatgtaaagcacttaggacagtgactggcatacatcaggtgcttagtaaacatgagctattattactgttaagacttctaaaccactgtccagaaaaaaaaacacaacatggcattctagaaataaaaagcatcacagaaaagccatgatttttttttaccattcaatagccatgttatgaaacattgttcttgaaagaaactgatctttctattgggctgacaatatattcttttttgtttgttttgttttttagagacagtggtctcgccatgttgcccaggatggacttgagaactcctgggctcaagtgatcatcccacctcagcatccttagtagctgggactgtaggtgtgcgccactacgcccagctacatattctttgttgaactccaatccttctgcattcttgacacccctatcatgtcccctctctgagttcttaccattcttgcagatgctgacattcagaactcctgagcccaggcagtttccctcaggtatacagaagccggcattgtctgacgtattggctaatatttctgcaggaactttataccgaaaggcaggcagtccctgtacactctcatagtcactgaaagtaatatacactgacctgttaggatgtaagaataaaaagtgaatgtggactctggtcagtgtaatctgcccgaaatccgcaagttagcaacagttctcaggtacaacatggccaaaagctcacagggtaagtagaaaggaatgtttggaaggcattctgtcaactcaacgtgtaataaagcagaagatgaattgtagtggaaggtgtttattgtagcaacggtgatatcatccaaacaagaaaaaacaatatgtggtacaaaattaagatgataacatttagaatggagactcacataaaaaagaaataagaggcctctctagacctgcatggacatatgccagtgtggacgggccaccggcaaagccagggaagccagggcacggcagagccaaagctaaggtagaacaggcagcgatggccgtggcctcgtagggtcttaggcacttgaaaagtgtcacattggacagatactttattggaatacacactttgatactcaatccccccctccaagaaaaatcagattccatattttgccccagtcatttatttaaatggagttcaacgtaattctgcctttcattcttactgatttcaaacatagtcccatgtaatatgaccactgcttacactgcatagtgcctaaccactttgatgtacacagtcaccactgagccttcagcccttcctttgaaggctggccggaagagccttctgggcctcactttttcatctctgaaccagagctgttgatacatctctcgcaaggttgtgaataacataggtggtttcactgcacaaaccaaaccacccctacagcattttttaatgaaaaattttaggcaccagaaagagataaaatactctaacaaatacctttgtatctgccacttagacaaataaaaattatattatggatataactgaacctgtctacgtaatgctcttgattccattccttctctgcctcccctgaggaaaccactctgctgaaatatggacaacagtatcttttatttggcttccatgtagagactacctattgactggaagtagaccaggtcagttgatgcttgacagagcatatcatagtaactaagagccaacacttaatattggttactgtgtgatgggccctgggctaagtatttgactaatactaactcatttgtcctcataacaacctctaacatagttaacaatttctatctttgttttacaaataaggaaagtgaggtacagagtggttaagtaatttgcccaaggtcacacagctataagtggtagagccaagattcaaaccaacagtcagaagtctgtgctgtgaaccagtacactatactgtctcgatgtgccatcagcatttatcactgattatgcataaatatccatgcataataagtgtgtctgcatatattcctcatgcttttggtggtcttgcagtgaaagaccttatttttgaaaaagaacttatctttaaagcttttacctgcaaaagtcagatgggaagacataaaggacctcatctttggttattagtgggtgaaaagaatctccatctgttccattaatcatattgcacttgtctgttatccaccagtcaagtgacctataattgataagcacaagaaagagtaaagatgatcacatttgagtttagattctcttaaatggtcaggactttgcaagatttaactggagctgtctatccacagtatcttattcatacacagacacaacagttttaattagatcaagggggagaaaaagtaggtccctggcccaaatcagctttcatagaggcaatggccaaatagcccaaaacatgtggtggtttgaaaagtatttgtgctgtagctactacacatcactcaatgactactaagcaagagtgggacttttcactggcctgtaattcatgcctggccatgataaatctacaaatcactaatatttaatctgtaagatgttttaccaccatcttgatttgtagaataataattacaagactatttacatgtttttatatttttcatccaaaaaaggctaaacacatttttaagcaatgtagaagtagacatgtagtttaaatgaaaactgaaaaaataattccactgataaatcatttgacttacgttttcccattccattccacaatttttgtaaagttaaggtaactgtcttctccagttagaaaaacatagtctccatcattagtcccatttttctgaaaatatgtgaatatgatcatttaaagtaactgtgataattttatgacaacttggctagactatggtgcccagttgtttggtcaaacactagcccagatggtgtggtgaaggtattttgtaggtgtgattaatatctacaatccgttaactttaagggaggttaccctcaataatgagtggctgggccccctccaatctgttcaaagccttacaagcaaaaacagaggtttcttagaggaggaattctcctcaagactgcaacatcgaaattctgcctggatttccaggttgcagcccaccctacagatttcaaactcaagaccacatcatcaacttttacctgagtttccagctgctggcctgctctatggatttcagacttaccagctcccataatcacataagccaattccataatataaatttctttctctccctctttctcatctctacatatacaccctcttgattcagtttctctggcaaccctaactgatacagtaactaaaaaatttaatcttcatctaactgtcctactagggcctaactgctacacaagactgaaccaggaccagaaaatagtgactattttgctaaatactatattaaccatattattattttatggttttaaaaagtaggagctcaattttaaaatgggcaaaggatttgaagagacatttctgaaaagaaaatatactaatggccagagagcacataaaaacatgttcagcatcattagtcattagggaaatgcaaatcaaaaccacaatgagataccacttcacacccactaggagggcaattaaaaaaaaaaaaaagaaaaatagtaagcgttggtgaggatgtggagaaattggaacctttatacattgctagcaggaatataaaaatgttgcagtcactgcagaaaacagtttgtcagttcttaacaaagttaaacagaattcataggactccaaaattccacacctatgtatatactcaagagaattccacttcaaggtatatacccaatgttcatataaaagcttgtatgaacaaatattcatagcagcacttctaataatagccaagaaggaacacaacccaaatgtccatcaactgataaatggataagcaaaatgtggtatatctacacaacggaatattcctcagttataaaaaggaatggaacactgatacatgctacaacatggatgaaccctgacaacattacactaaatttaaaaagcagacacagaagggcatatattatatgactccatttatatgagatgtccagaatatgcaaattcacagagccagaaagtagattagtggttgccagggcctgggagagtaagacaggaataggagtgactgctaagagagtatgcagtttcttttttgggataatgaaaatgttctggaattagcagtaatggttgcacaaccttgtgactatactaaggactactgaattgtacattttaaaatggtaaatgttatagtaagtgaattatttctcaataataacaaatttaaaagcctaagtccaggaccaggaccaattataccagaatagctacactggaagaagacggtattaatatagccctattttcaattaaggtttcttcaattgtatattctctccaagttatacttcttaagggcacatacagacactacattcctaaaattctttatttgggcatgtagctatgatttctcagaaatagcacaggtagtagctcctctataataataggagtgaacaattgttgagtataatattcctggctctgttctaaaatttttgcatgaatcatctcatgaaatcctcacaaccacataagatagtgtggctatcagtctggtgaattcaatgatgtaaaaacaaaaaaagtgagttatataatgcaaattatctgagaaacagtgagatattagcaacaagatctacttggctgatggattgaagccactgggaacaaaagggcctcgagggaacctttgcataatatctctcagtaggaggctctcctgaaattatttctagaagggaggttcagtcagggcttgacaggaaatctgtgcttcctctggtcctgtgaagctgtattcctctgagacaggaccctctagggaactcctgcctggtctgcttctcccgaatgatgcattcagagttggtgaggccctacttttaggactcctgtctctcacacatataattttttaaaacttgctcacaattctattttaacaatttctacgttttatataaccttgaaggcccagggacacaattattgctgtttgccataaaaactggaatgctacaggattacatgaagagggtaagactcttgaacaggcagagccagaaaacagctacaaatttaaagctgaggagacccatcacaatcccagagcacacccctaatctaatcctcttcctggggttattttatcttttaccaacttcccaactatccactgcactccagggtttttgtttttgtttttgtttttgttttttttttggcttttttagacagagtcttgctctgtcaccctggctggagtacagtggtgtaatttcagctcactgcaacctctgcctcctgggttcatgcaacttacctgcctcagtctcctgagtaggtgagattacaggtgtacatcaccacagctggctaatttttgtatttttagtagagatagagttttgccatgttggccaggctggtctcaaagtcttaacctcaaatgatccacccacctcggtctcccaaagtcctggaattacaggcattagccaccgcacccggcctcaagttttttttctttccaaaaaacactccatttttcacacactctataagataacttaactctaggcaatttctagaagaaactcaaagttaatctggcttggggtgccccaacccactgtcagctaaaaaaagaggttctgaaaagaaaaatctacttacctcatagaataggccaaaatagggagagatatcgggcctgaaaacatggataagggacaagatttcatctttgtagccccagagcaattcgtcaactgtgtgagtcacaaagagcttctgctgataggctttcaacatggcctcgatgatctccctgaggaagtgcacctgggaccactctatgacagtctgcggagcagaggtatattaagacagcagcatcccctccaaagcacctccatccactctctcctactaccccatagcaaagggggttggaaatataaatgtaaaggttgagattaaatagctgaaaaatcaggcagtgagctcctttctggctgcatatggaagacaaagcctcttctctgtcctttcccagtactgcattttgtaagtgtaatatttacaaagagaccatttgcaggctctgagttatccagacaccacaaaaggggaaaagctcttgtaaacatgtgggcatctttggccacaaggtggcgctaccttccgcctaagcagggccagaggctcattataaacccgacctacacccctgggactaggtggcagggacctcatactgtctaggtcctgggtccatcatcagtgtccagctgcatatggagcggtcacctaggggttagggtgggagagtcggcaggggttggtgtaggtgaattagaatgtttactgggccagcccaggaacagtggttcacgcctggagtccctggccgacacaggaggatccctggagcccaggaggtagaagcttcagtgagctgtgatggagccactgactgcactccagcctgggcgacagagcaagaccctgtctcaaaaaaaattaataataaataaattaatttaatttaaaaaaaaagaaagtctcatgggtctcagtatagaatagatgtagaataggtgtcgttattaggtagaattaccattataaacagagcccactgaaatcacagtaggctgccagtctattgatttctggtgtcaatttatgaattttgagagtataaaatccaacataaaaatctgaagtaagaaatggtatacaaatttcattgctagaatttctgaatgaaaacaaggggcaaataaacatttttaaaattattagctaccaaaaaatcctaggggcatatttatttgcacaattgctaatcctgaacacccaggaagaaattatgaaaacaaatcctaaaatctgaattttgtcatcatttgaaaagaccttatttgatacatcttagaaaaaagtccaagatgtactttaaagaaaagaaaagaagtatttttctttttatatatgtatatttcaacataacttaatggctcctaaatgtaaaatcataaagagcattaacttagctttttcctttcttccaaaatccaacttaatggtattaaaatgcctacttaccaatacaggaatatttaatgttctaattaagtcaattttagggtctccaacagattggtctcgttcaaaaacataggccttgttgctaacagcagatattgttgttccattatctccaaattgaatatttgctttgtttctgagttccctaaaagaaagaaaagggttttatttgaaaatagacaccactttaataagcaagacttttcctttctttcagcatccaagttatattttcaatataacattcccaatataacattatatagagactgcagctactaagccttaaaaagctggagatcgaagctataatgtgggaaggaaacgaggcctaggatagagtcttctcaaaaactttgttttccttcttttcttccctgattagggaggtgcaatagttgagggtcaccttgaccgggaatcaaagccgatgaactctctcctgggttatggtttggtcctgaagtattttcaaaattttcagtttggttcacagatttagtttgaatttcaatttgtttaccaatgtcttcttgtttctacattgaattaaattgaaattttattttaaaaaataatgcccaaggcttagtaaattacaggagttcactcctgtttctttttttgagatagggtctcgctctgttgcccaggctggagtgcagtggcatgactacagctcactgcagcctcagcctcctgggctcaaacaatcctcccacctcagcctcccaagtagctagaagtacagaagcatgccaccacacccagctaattgttttatttttttgtagagatgaggtcttactatgctacccaggctggtcttgaactcctggactcaagtgatcctcctgcctcgaccttccaaaatgctggcattacaggcatgagctaccacacccggtctctgtttctgatatacagcacagtttggttcaagttagagcccccaaatgaagcattagaaagttcttagaaagcgcctggtgccagggctgggcctagagtcagtgtgagtgatgtaagaggtgcctaaacaagtagtaatcaagataaatagtttaatgcactatttattaaaaccaaaatttatgccaaaaatttatgatgaacaaaattttaaataaaaacagaatctgatcttttgttcatcaaatgcctcacactagccctagccctagccctgcctggtacatagtaggtgttcaataaattccagtgacttttgtttctttccctttgcttatctttccttcttcctaaaccagctagggttattatgtctgacatggtagccactagtcacatgtgactactgagtacttaaactgtggctaactggaattgagatttgctgtaagtgtaaaatatatacagaatttcaaaaacagtgccaacctttttttatattgattatatattgaaatgatgctatttcagttataatgggtaaaattaaaatatattatcaaaattaattttacctgcttccttctactttttaaaaaatgtggctactagaaaatcttaaaatcttaaattacacatgtggttcatgtaatatttctattgaacagagctaatttaagagcacaggttaggaaggcattggccagctgggctacccacacctcctctgaggcctttcccaaccatagcagcacagggatttttctcacccacctgtggatgtccgtacatgtctttagcattcaattagaaacttctgagtgacatcatttagattgtgaaattatcatgtagcctcaggtagactgcaagcaagctgaaggctgaaactggtacgtaaaaatgcgcctcggtgatgatggagttatgtcccagtaaacccatcataagttgaaaacatcgtaagttgaaagtttgtttttgattcaacaacttagtatctttccaatttacaatgggtttatctggatgtaactctatcgtcattggaggggcatgccaaatacatcactttcacacaatcgcgaagtcaaaacatcattcaagttgaaccatcataagtcaaggactgtctgtatattgtatctctttatacctcttaaatcccttctagactttaaaataaaaacagatgagaaaataaatgcattcatatagatgcatacaaatagatgagtctttgtatcttctccagtagaaaaaacaaaccatttttttctgtgctctcatactgtaacaacttacacagaagacttctaagacttctgagacttctggtcaccaagaagtgtgtggcgttttctctgcaccaataattctgcagtgtcctccaattcaattcaattctgatactttctacttggacatagcatcagattctacaggttgagactgccttccacctcctatgccaatcaaaagccccaggctgttttacctgtgcttctgaactaatggctataaattggggttcccatccccctgtgcttgggctcaattaatttgctagaacagcccagagtactcagggaaacacttacattttattataaaggatattacaaagtatacagatgaagagatgcactgggcaaggtgtaggggaaggagctcagaacttccatgccctctgcaggctcgctactctccaggaacctccccatgtttggttctctggaaactctccaaattcagtccttttggttttttatggaagctacattacataggcatgattgattaaatcactggccatttgtgatcaacccaactttcagcccctctcccctcctgggaggttggggggtggggctgaaagtcccaaccctctaatcctgtcctcttctttcaggaccagctcccatccaggagccatagaggctgccagtcatcagtcaattcactagcatacaaaaagacacttatcacttaagcgattccaaggatcttaggagctgtatgccaggaaatggaggaagactaaatatatatttcatcatatcacatgtctatatcctatactctgtcaagtgtatagaaggaagcatacttcctatcacatatacacatatcacacatcatatcacactaagcaccaagctatgcccactaatcctataaatagctgacccttgcatagctcttcaaagagtttaacccacattattttattttatttaatccttacaagtatgtagtacaaatacagcatgtagtattgccccacttcacagctggggacacagagcacaggcagaagagtgagaacttgatcccaagtctttctcattagcacaaggtgctcctctctctgtatgagacaacctctcctaacaggtacctaagaaacgcctgtaggatgaaaccagctaatgcctctaacaaatgcctctaaccaaagccaaatctaatgataaattacatgcccttccagtttacaaagaatatatttaaaaatttgatagacacttccgtgttaaaccacttacacagcttgaagttcagtgtttgcagtggacttttcatttgttagacaaccattccgctttctgctggtaatagccctgatttgctttcctctcttgtattgtacagctgtgtaagaccatcagtcaaggttgctatgggacctgagctcaaccaattcctttcctctggcctctgaatcctgagcacagtgcctcaagatagaaaacacagtaaaagaaccaggcgtggtgacatgtacctgtagtgtcagctacttgggaggctaaggtgggaggatggcttgagcccaggagtttgacgttacagtgagctatgatcatgccactgcattccagcatgagcaacagagcaagactttgtctctaccaaaaaaaaaaaaaattttaatttaaaaacaagaaaactcagtaaaagacaggattcctcccagtggcagacacatgatgtgatgatcaatacactctcgtgacctggatctttaaagctgccctgcatcctgcttttgtcttccaagctgctttccttgattctgttaacctactttatagccttcaaatagattcccgttttacttaaattagccagaggtagtttattttgcttataaccaaagacccttcacttagaaatcattaactccacctttttatagataaggatatgtggattcaggaccaatcgaaagtgtcagggccaggtttagaatcctggtgacctcacctctcattcagggtattccttgattttacacagaggttaattcacagtaatttattggaatatggaggaggagaggaaatttcaaagccaaacttttgtgtaagccaaggctggtgcctgcagagaggggcatattgatcagttactgtcctacaagatcaaagaagaccaaatgaactttcagaaatacaaagaagagtttgaaaaaacaaaacaaaaacaacaacaaaaaacaaatcaaattttcagcctaggcaattaatcaaggaactatacttaaaagtgcccggcatggtccctggtatttagtagatgctaatgaatctcagactatagtataacatttgtgcattactatgacggtccttgtcattaagacaaggttcagttatgctccatgaactatttaatcaggcaggaaaattcatggttggttttagaaataattttagaaacaatagactgagataaggagtggaaatcaaaaggaataattttaattaggtggaaaattaacatcggtatatctaattcctcagaggtgtttgataaattggatgcgtataatactatcatagtatcgttatctttcagtcatattggttccttcattcacctaatcctctgttgagaattactattaagaagtgattgggcatacactggatacaaactagactgagatctggctggtagggttaacattcaaccctggtttcatcttactcactgcttctgtgcctcagtttcctcatctgtaaaatggaggtaataacgtactcaccttgtagggttgttgtgagaatgaaatccacataaatccagttacaacactacctggcacacctgctgcttaggagggattagctactgataccatgtgcaacggcttgtgctaagctcttgagatggtgtgacattaagtcctggttctggtcctccaagaatccacagtagagcatgggagactgccttcagaggccacctccttcacagtaaacgcactgtgggcatacagaggagggagggatggcaactggaaggggactcctgcaaaagacacttttgcttgattctggaaagagtgggcttctgcaggtgggagggtgaagggggtgttccaacagaggcagcggtggggcgaaggtgggcagcaagcatgaaagcattcccatgtggggagtgagaaagctgtggtcctggaggaggaggacacgctttaaaagaccatcacagatccaggcgaggctggggtgatgaacacatcaacgtgaaaggagtactgaagtcctagggtgaccacagagaagagggaaagcaaggggagccagccaaaggcacaggctgaggagcctctacccttaactttgagtacgctgcccgctcaggtaactgaaggcagcaacctgtagatacaaagcaggatactgagaagaagtggtaagagcagggtcgggagaagactcacccgcttgttgacagtgtgcaagaaacagtttcactccttaagatggaaatatctccctggtctccctgtccccaggcagtgacccataggctcacgtaggcaattcacctaatgtaccacgtgcatttaaaactcacacatacctggtcacaaccttttgtgcatgataagatggtgtgagagatctttttctatttttttttacttctgagcagtttaaggattttttttttcaaaatctgtttctattttggcaaaacaaatacagttttagctaccaatctaaaaacactatcagagaaaagcgaggcaagtttagaaaaaaggagaaagcattctcctataataatggaaacaatgatcacggtgttcctaaattttttgttgtctctttatgttaaaaaaatttcttatacagcttggctcagacacggttaaagaactaaagggttaataggacagaattagacagtataaacaaaattcctgcctttgctaaattgcaaggaagacacttagatcctgaagaaattaaatgtggaaaaacagaactataagaaaatcgacttgaacatcaaaccattgaagggagtaagacttttaaagctcagacctgatagaaatgttgaaaaagaatagacttgactacaacacattttaaaaattgacaaggtaaacaatggaaaagcagttgccccaaatgaaacataaaaggttcacagagtgccatgaacactccagaacccagataagcaaatggacaaaggacaagaactaaaagtgtggaaacacaactggctggcaaacatgaggagaacattcaacccacgaggtaaccagaggagaaaatgaaaacggatctacatgttcaggaaaggaacagttaagtgtagtaatacatttactctattaaatataatcatcattaaaattcatttgtatgaagaccaaaatataacattgaaaaatcctatgctataacattaggtgaataaaaaatatgtatattttgtatatgtacatgcatatgtacatagtatgataaccatctaaaactcatccatggaaaaatggccaagaagatatccactaaaatgttagttagcattggttatttttgagacagtgaagccatggattagtagtttttgttcaaaactttactgcattttcaagttgatctttagtgattatatatatggaacacatatatatgtgtaatttttataatataaaatatagtctacactcttaaagataatgctgtatatattatatatgttgattatatttgaaaatccagtattacttgttatcaatgaataataaaataacttaagatctagcccttacatctttttaaataatacaagcctaaaatagaaatgaataatccaaacagcaaaactaagaaaccccaaaataagatatttcacgggatactgtaaatttagtaaatacttcttagaaatacgcaaattaattggaagtgcccttagacaaattgttttcttttttaattcttgaaatgttaaatggtaggcaaaatagaaaaaggtatctgacaagataaaaaataaacctcaaaaaggctgcagaagccatgggataccacaactttgatacaaattttatacaaatatgtccctgagcaaaaggatcatgaggccaatgagccttgtattcacagacccattccagggctgctcaatctgcagctttacaaaaatgtaaataatacacttcattccttaaaccagactgactggctgttatcaacatttggaatgcccatcatctttttccaaaaacattactattctgaactccccagtatgtgaaaggtttgggaaatgtgccactgtaaatcctgtgtcagatgagttaggccctccacagtcttgcttggcccttccccatctcagaggtttcccaccaccacaccaatctgtactaactggcgaaaggggctacatgccctccccttcctttgccccaggccccctggcatacaattgatggagtcagctgactcagttgggagaaaacactggagcagaagcttctggaatgttctgtcttatccagcctaaacaatagcatcataaagccacaagtgacagaaatcaaatccagtgaatgaccgcaaaaggcacatgtagagactaacaggccccatagaaggtttggacagctccctaaaaagccatgtttttctacaaatcccagatctcacgacccactcagccctgtaaggagctcttagcagcctgcactgcacatatgcatattcctaacaaagccattcattttcagggcctgattcccctttcttgaacctatatttgggtttcctgaactaagtcctatggttccggctattaggtgggtgcaaagtaactgcgttttttgtcattacttttaaatactttttaataattgtgtcctatagtgttagtttttccatgtgtcctatgaatttaaaccacagttgaagatgtttaatttacatattccacaaatattcattaaatagtagacagtcagagaccaaaggacttggtcactgcaccccatggagcttccagtacattgggaagaaagacagatacctaagccaattattaaaatgcaattagtcactgtcataatggatgcacatatttattagtctgttctcatgctgctaataaggacatacctgagactgagtcatttataaaggaaagaggtttaattgactcacagctcagcatggctggggaggcctcaggaaacttacagtcatggcagaaggggacacaaacacgtcctttttcacgtggcagcagcaaggagaagtgcccagcaaaagggtttttgtttgtctgttgttgttgttgttgttgttgtttgagacaaagtcttgctcggtcgcccaggctggcattcggtggcgtgatctcagctcactgcaacctctgcctccggggttcaagtgattctcctgccttagccggtgtgtgccaccacacccagctaatttttttttctttttgtatttttagtagagacagggtttcattatgttggccacattggtcttaaactcctgacctcaagtgatctgcctaccttgacttcccaaagcactgggaatataggcatcagccaccacacccaaccaaaagggttttttaaaaagtcccttataaaaccatcagatctcgtgagaactaactcagtatcaagagaacagcatgagggtagctgcccccgtgattaaattacccccctgggtccctcccatgacatgtggggattatggaaactacaattcaagctgagatttggctggtggggacacaaccaaaccacatcaacataccactttacaagtgctataaagtggtatacttgacacttttttttttttttttgagatgggggtcttaccctgttacccaggctggagtgcagtggtgcaatctcagctcactgcaacctccacctcccaggttcaagcgatgctcccacctcagcctcccacgtagctggggccacaggcacatgccaccacgcctggctaattttttgtatttttgttaaagacggagttttgctatgttgcccagcctagtctcgaactcctaagctcaagtgatctgcccacctcaaccccccaaaatgctgggattataggtgtgagccaccgtgcccagtctacttgacattttaaataagatgtaacagggagagtatccgaagtcaggcaagtctcaggaggagacagcatttgcactaagtaagatgtgaaggtcaagagaggtagcgctgaggaattcattcttgactgaagcaacagcatgaatactggcaaggcagtgtgtctggggagcttataaatcatgggagtggccaagcatggtggctcacgcctgtagtcccagcactttgggaggccaaggcgggtggatcacttgagaccaggagttcgagaccagcctggtcaacatggtgaaaccttgtctctactaaaaatacaaaaaattagccaggcgtggtggccgtgcctgtaatcccagctacgggggaggctgaggcagaagaatcacttgaacctgggagacaaaggttgcagtgagccaagatcgcgccactgcactccagcctgggagacagaatgagactctgtctcaaaaacaaacaaacaaacaaacaaacaaacaaaaaatcatgggagtatggttggaattatgctgtctaatagggtagccactagacacatgtggctattgcacattcaaaatgtggctagtctgaaatgaaatgttctataagtgtaaaatgcacacaggatttcaaagacagtataaaaaaagattgtaaagtatctcattaataattctaaatattgctaacatgttggaatgacactattttggatagtttgcagagtctccatcacatcttaaggaatttcatttaaaaataaca

SEQ ID NO: 121 - DNA, 217319 bp, Homo sapiens
atgacaagaccagccaatcaagttttaaagtccttacgggacacacattaaacctggaaacaggaagtagtattaaaaacaagattgaaggcaaattagaaaccaaatctgaaagtagtttcaggccagtcgtggtagcccacgcctgtaatcacagcactatgggaggcaggaggatgaccttagcccaggagttcaagaccagcctgggcaacatggtaaaaacactatctctacaaaaaatacaaaaattagccaggcatactggtccacatctgtggttccagtactcaggaggctgaggtgggaggattgcttgagcctaggaggttgaggctgcagtgagccatgattgtgccactgcactccagcctaggtgacagagccagaccctgcctccaaaaaaaagggcaagtatggccacagaaggcagttttccagtgaataattcacaaactgtttctaaaagaatggtgctaagctttcttctcttactgaaggagcagtagtggccactgacaagttttttagaacccaaagtccactcagtcaaacacagcccgtaccacatgatggccggcacagccccaagtgagcccagggcagcagctctgtgttgagctggcatggtcagcagagcatctcctgagagggcttgggaccgtgaggaacacacccatggcttgtcgccttagaccatgccccacattaatacgctacatttagcattatttagatgaaaaatcagtgctagcttcctcagtgtggttacagctggaaaccaattttaaatggcaactgcactccaggatctcaatcagcagtttgcctgtttgagaggagtgaggagagaacaaaatatgaaacaggcagaaagtacctgaaaagctcagcatttactttttggagtgagtgaccaaggatagagccgcgcccatgtgcccagtggtgggaatgggcactgccaacccactggcctcttatctaaggtgagaagtgggatctgcacagaggcccagaggcagcatggggcaggcacctggagccgcaggcatgggggacctcatcctgtctgccacaagaaaccaggtagcctcaggagagtgaaaccttaacctctctgagcctccatctcctctgctgtaaaatgggtacattcaccaataggtcctgcctcccacacagagtcacagtgagaagtaaacaaaacaaggcaagaaaaagtgctctgtcaatatggcagtgagttacagctgttctaaggggacccaagaggagtgctgcggctgggactggagggcagcggcactcaccactgttggcttgttccaaacggtctgcaggcagtgcttcactgccccgcagtcggacgccgtcttcacattctggcaccacactgccgagcccctggtgcattctttcagtccaaggaccgggccggctagagctaaaatgaaaaccaacgtgaggaggtggcccattttgtagcaaaccaggtcgacctgacttatttccccagggctgagggcgactgtccttgagctggactctgctactcagcccctcaccaagctgtatgggacaccagccacacagatacacgcctgtcccggtcaagaagctggcttgtctgtcacagggctagaagggactcatgtatctggttcacgttcatcctctctagctacctttaaacagtatcagggagtatcagaactttaaccttaaaatgtttccataagtaataaggtatcatcataaccttaaaatgtttccataagtaacaaaagaaaccataggagaaaagactaacaaattcaaatacagggaagattttgacttctgtaaaatggataacaactgtagaatgaagggtttttttaaaaaagaaaaacaggctgggcacggtggctcacgcctataatcccagcactttgggaggccaaggtgggtggatcacgacgtcaggagatcaagaccatcctggctaacacagtgaaaccccatctctactaaaaatacaaaaaaaaacaattagccaggtgtggtggcgggcgcctgtagttccagctactcgggaggctgaggcaggagaatggcgtgaatccgggaggcggagctggcagtgagcctgggtgacagagcgagactccgtttcaaaaaataaataaataaataaataaataaataaaataaaaattaaaattaaaaaaaattcatacccttataacataaaacaatggccagctgccggtggctcatgcctataatctcagcactttgagaggccgaggtggggtcagttgagtccaggagttcgagaccagcctgggcaacatggcaaaacctcatctctacaaaaaattagccgggcatggtagcacgcacctgtgatcccagctactcgagagactgaggtgggaggatagcttgagcccaggaggcagaggttgtagtgagccgagatctcaccactgcactccagcggtgagctaccatacctagccctaaaaatattttataaactgccttgagagtgcctatgtttcttaaaacaggtccttgattttagaaccaaaaaaatggggaaaaaaatcctcagattcacatctcacttctagcccaattatttagctaggaaacaagagattacatcggactacacatagaggatggtggcatgagggtcaaactccaacaggcatctcagtagggttgaacaaacttttgctgcaatagatacttgacccaagtctgagacagaaaaaaaaaaaaaaaaaacaaaacacaatcacctgagaaacacacttagaacctcaggaatcttgctgtatgctgcttccctctgtaagccaattctacatacgtgtgtaacacacataggaaacacgtgttgtataggtcagtacgtgttcttcctccaggagagggtaaggaatgaactgctttctttcattactacctccacaagctactcacacaaagactgagtcccacaaagctcgagtcagatcaccttcaccccttcagacacaagcaaatgaattattcatctgctgcccagattatagccttccctgtcccctgggagcaaaatcacaaacacgtccagttcgcaacctcaaccaagctggccacattccagaggctgctggtttggactctagtttccaggggaaaacatgtgccagatgcaaatcagtaccaagctccccagatggctcacaaaagcttagttagcccgcagtgtagccaagcatggctggcgccagcctcagttataaatctcaggggagcggtggaggggaggcagaattgagtcatgagggtaagggctctggggactgtgcggtcacagagacagcacaaataggaaccccagacctgatgactcccaccacaccctagcaggccctgggcccctaggactctgaaaaggacccatgatgacaccatgatacactgcctagccctacctccaaatcaagatgaacaggaggctaccaaatgagtctctaggcagaggaaggcagagtgatacacagggaagccagaagaggatgggctcagacctcaggagaccagagccaagacagaggagtcaccaccaaaagcaggggcaagtgaccagcacccccgattcttaaaaatgctcatccagtgtaatgtccacccagctactttctccagccctctcagcagggaactagctacagctgaccaaaatctagagtgtttccggaacacaacacactctcacaggcccatgtgagaatactttgtaggctgcctacttcctctaggaatgtgaaacaataatcgttttccatgatgactttgttacttgttttggtccggccaacctggactgaaaataatcttgggcagccccttgtatctgaaactggcccagctaatacaaactgactgtcacttcccaatccatgacctactgaatggcagcaggcctcttcctcagatctggaggcaaaaagatacgcatggtggagaattcggtacgcctataaagtcaagttccagcgtaaaacagatttccgtggacacaggaagtaacacgtaaattccaactcctagaaagtgccttcttagcaagacacccccttctacctccaaccacaagccaaacataaaggtgcatgttacaaaaacagcctgtggtatgcaacggattccatctcccaggatgaacgacatgatgacatacgttcatagactgcgtgtcctcagggcaggcaccactgggtggtgctggggagctcccagccgccaagaggtgcaaagcccactcccagagcagatctcctaagaggggatcaaacagtgggtcagaaccttttggggacatggatccctttcccagaaactttattacacacacatttctcctagcacttgaggaacttctcaggtcccagctgtggattaatcataaagctctacaggcaagggtggtttttctccacacaagcaggtaaacaacccagctgaaggcatggctaccagctccactgactgcgcagagcccgaggccctcaggccaaagaacaaatgaacagtcacgattttctttaccccaaagagcaggaggaacagacatctaagtaatggtgtgtgatcccacgcatcggtgggaatgggagcggcaaggcaatgctaacggagccttcctcaaaacgaaattggaattggcacctgcaagatggtgacagaaaaggctggctacgtggagagggagtggggaattccagaacattccaaaggagtccagttctctgtggggaagggaagaaactgtcctgtcttttcaggagcgaagccaagggaagtagcggcagccaggctgcaaaggcagacagatctcaggtgcttgggggaatggtctcacctgccccacacaccctaaggtgagggctcaaccccgtgggcgatactgcaggaagcttcagggatttctgggagggacaggacaggcaagctcatgtgtgggtctcaaccacccaggcacaaggtggcagaactgaagaggaggtgggagataccaatgtcaggcacctaactggaaggcgaattcaaaaacgtccacatgagaaatggaagcagcaagagccaagagaggctaacacagagtccaagagaacaagatgggcaaatggcactaacagggttccatgagaagttgtgcagactcaaagggaaaacagaacagcaagggccaatagcaccaggagagacacgcccatgagcaacgtgagctgctcagcagaggccagggaggggagggcctggggccccacccagagagtcccctggaggactggggatgagtgacgggagaaggaatgtttcagagacacgcggtcatctccaaggagggggagaatcccgtacaccttccaccagggtgtggagctggtatgagtggctccagaccacagatctctgaacaatgggtgcaaggaagcagaccacagctccaggtaaagaatgcatttaacatccacccaggggcataaaaagagaacggattagctggacgtggtggtgcacgcctcagtagtcccagctaccaaggaggctgaggtgggaggatcgattgagcccaggaggcggaggttgcactccagtgccccagcaccactgcactccagcctgggcaataaagccagagcctgtctcagaaaaaaaagagagaatgagtggcatcattaggtgatgacctcaccaacagtggaagcaaacaagcagaaacaaaatgcataacttatgagcaattctatataagagggatcctttcagtggtgggctgaactaaaagagctccgaggagctccaagtcttcactctaacaaggcagataacattttcagcatttataactaataaataaacactacccaaaaacactttctcgtgagttatttctcaaaacatgtggccagcaaagcctttaatctctattctcatcctcccacaccctacccccaaataccagcttccttctctgaggcagtatgctgaactccaaaaaagttcttagaatgtttgacctcctaaagatttccaattaaatgtgtcataaagacatgaacagcactcggggcaaattgagcacttcacttcttagttcaagggcctggcaagacagcttggaacaacgggctcttttttttttcttttgagacagagtcttgctcttgtcgcccaggctggagtgcagtggcacgatctcggcttactgcagcctccacttcccgggttcaagcgattctcctgcctcagcctcccaactagctgagattataggcgcctgccaccatgcccagctaatttttgtatttttagtagagacagggttttgccgtgttggccaggctggtttcgaactcctgacctcgtgatccacccgcctcggcctcccaaagtgctaggattacaagcgtgagccaccatgcttggccccacaatgggacttttttaaagacatagatttcagggccatgtgcggtggctcatgcctgtaaccccagtactttgggaagctgaggcaggagaatcattttgagctcacaaatcaagaccagcctggcaacacgacaaaaccccatttctacaaaaaatacaaaaattagctgggtgtggtggcaggtgcctgtaatcccagctactcaggaggctgaggcaggagaatcgcttgaactcaggaggcagaggttgtagtaagccgagatcacgccactgcactcctgcctgggcgacagagcgagactccatcaaaaataagaaaaacaaataagccattattattctatgtatttgttgtttacagtcaaacctaagcccaactaatatacatacttaatcaacgacctcgcttacagaaaggtctcccaacaagtgtttcctggcttaccccagtgaggataccgaaaagcccagtacacaacataatcaccaaagattttctgaagcaatcttaaaatgacaggacaacatttcctagaatgtgataaaacaatcagtctcattattttagccatacaacatatgcttttccttttaaatattttagtaacatgctaagtacaatttgaatctagctaccagaaaaaaaaaaaagaggtaacagaaaatgcatgcagcctcccagtgctgacaatcagagcctacattccacagggcagcagatctgctgcctgggtaaggcggcaccatggcaacaggcaggttgctaggaaaccaagagaggataacccctggaggagcggcttctaccgcagggcatttctcagaggaattcatgcacttccatcccctaagagcaggagataatgcaatgcactcaacactagctactcaaacagctattgccacaaatatcttctatggcaaagagcacttgtctcttcctcatagataatcctgcctttggaaaacagtctgcagagcagaataaaaacacagctcactgaatcattcagaatagtatacgctcagaggtagtctcccttgatttggaggagttaaggtccaagagtcctcatatcacataagaaatcagtggcaataaagctcttaagctcactaggctgacatcccatcacctctggcctcaaagtgttaagacaaaggtcctttcttccctgcttctcctctgctgctacagcctcgcttcttaattttccttacaagccagatgattccagggcaggacattatctacacggagaaggcaacagagtcctcagggaaattaccttgtgcagtaatgactgaggctggggacaagaatgcaatcttctcagattgtatgcaatggaggcttaattaatttggggacaattcctaactagttcattcaagggtactgtagtccaataaaaactcctaacaaagcttttcttccaaagcatcaacatatcaggtgatgatcaaagaagaacttagatcaccttagataagattacatggtaatccatgactgaaaaactagcccttggcaggactatccagattccagccaagtgagcaagtggaggcaggggtcagaggcgggctctgcatggctccccatcctcgagaaagctccactgcagatccagcatgctgcaccgcagttggcacaggcacccacacaaactggtgctggctcccacactgagcattgctgaccagctgcgtggtctctgcacatttgcagaagataatcatatgctgaaaaaggtttcatgcaaacctcattaaagaaattcagtattctgaacctgtctcatctactgtttactaacttaaaagttccagatatatgtgagtctactataaatgtcacttttggcttccttcagttagtactttataggaatactgccttcacttgaaatctaaaatgttcagaccacagcatgggtcacgggaggatatcagactggcccagaattccgattcagttgctttcaccacagagggctgttatgagaattaaatgaattaatgttcaataaaaagcaaaacgggccaggcacagtggctcccatctgtaatccaagcaccgtgggaggcagaggcaggcagatcacctaagccctggagttcaagaccagcctgggcaacatagtgaaaccccatttctactaaaaatacaaaaaatggccaggtgcagtggctcacgcctgtaattccagcactttgggaggccgaggcgagtggattacttgaggtcaggagttcgagaccagcctggccaacacagtgaaacctggtctctactacatatatatatattagccaggcatggtggcacacacctgtggtcccagctactcaagaggctgaggcaggagaatcacttgaacctgcaaggcagaggttgcagtgagccgagatcaagccactgcactccaacctgggtgacagagtgagactccgtcttaaaaaaaaaaaaaaagcagaacatctccgcatgggttagctattataatttctgtagtttctgcaaatcatctaaaccagtggttctcaaagtgtggtccaaaacgccgagcatcccagggactctttcagggggtgagggcaaaatcctcatgataaaaccaagacatcagttgccattttgctcattcacaaaagtccagttgagtttctgcggaggcatgtgacatgacattgcaacagactgaatgcccaagcagctaataatccagccaggtgttaaaaggattgcaaaaatgtaaaacaggctgctcactaaatatttgtgttttggaaaatattttttcattaaaaatataatacatacaataaatatatatatgttaacatgtaatggtttatcaatatttcaaagcattaatttttaaacactgacagtttaacttataagatgttaaatattgatagatacagcccacgtaaacacaagctctttggggtcctcaataactaattagtatatagggatcctgcaaccaaaagtttgagagcctccaagctaaacatctggagaacaaccaacttctgaaaccaaaagtgggagggataatttcctcaacttatagctgcttcccttttcagatttacctcaaatcagagccaccatgaacatctaaattatattagacttccctgtacctatcacctacatagaaccctccccaaaaggtgtgggaggggcaggtcccaaactatcatcaactattataaaagtcaacacttcatttgcgcccaaagtcactcttaatttcataactcctaaaaacaatttcttaaaattaatttcagaaaaataaaagataatattctatctaatcatgacaaagactcggcactatgaagcaatgaagtttcaggcacactagcctacacttccacagctgaagtctacctggctacacctcctggcactcatcaatgctaagcacctgttatgtgccaaaactgccgcacatgctgcagacacagcaagcgatcaagacaacacacacatcacaacgccaggtagcggtgagtgctacaaataaagcaaggtggggtggggcagctatttcaggcacatcagtggggaactctgataaggcaacatcaagcagggacccgaatgcacagagaggaagccccatgggttacccagggaggaagatgttccagagaggtggaattcaaaatggaaaatctctgagcaccaagaaggaaggggccagaaggctggacagcaggccagacagaagagagggggaggagctgagaggtggccaatcaccaggtgacaggcgaccttgcggacacacttgagttttattcctagtgctataggaagccacatggccctctggtatcaatgcctgaaaaagagacttactcgtacagaacagcatcccatcacagctactgagagagtcataagtaacgtgacaaatactggccaaaagaactttctctgcgtcttcttcaatcttagtcatgacgtttccactcatgtaaataattttttaaaggcagtatctgtccaaatgtggccagaatttacaatttttacatttgcaagtctcattagaattcacctagcagtttattagacgtcgatgtccatcaatagggattaaaaagacacatccatacaatgaaatactcagctgggaagtgggaagagattaaggagacctgacagccaagggcaatgtggcatactgggttggacccaggaaccaaaaaatgagattagtggaaaaactggtaaaaatccaaataaagtttgcaatctagatactgacagtgtcctgatattaattacttgcttttggcaaatgtaccatggttatacaacacgttaacagtaggggaagctgggggaagggtatacaggaactcagtatactacctttgtaacttttctgtaaatctaacattatctcaaattttaaaatttaagtacatctatctgtgttagcatgaaattacctctaggatatattgtttaagaaaacaagaagaaatgcaaatgaaaccactaagtcattttactcctatcaaattagcaaaattgaaagttttaacaatatcaaatgttaacaagggcatgcagtaactggaaactgaatacgttatggaatggcaactgccaagatcatttgagagcacttctacaattgttagttactccacaactcagcaattctgctcttagacatatgccctagataaatgttttccatgtacacaaggagacatgtacgagaatttttacagaagcaggctgtaatagaaaaaactagaaattatctaaatgtctatcactagaacagaaatgatacaggccaggctcagtggcttatgcctctaatcccagcactttggggggctgaggtgggcagaacacctgaggtcaggagtttgagaccagcctggccaacatggtgaaaccctgtgtgtactaaaaatacaaacgttagccaggcatggtggcgtgcacccataatcccagctactcgggaggctgagacaggagaatcacttgaactcaggaggtggaggttgcagtgagccaagatcacaccactgcactccagcctgggcaacagagcaagactctgtgtcaaaaaaagaaattacataaatggaatactatattgtagtgaaaatgaaatagacctacatatttttgtagggggctttccagtaaaaaccagaaagccttctagacaaattctaaaagacataacagtaatctatacattttcaacatagaaaaacctccctagcaaaacaaaaaactaacctaacaatatacagtggtccctccttaaccatagcttccttttctaccgttgcagttacccacggtcaaatgtggtttgaaaatgtattcccacagtcaaatgtggtctgaaaatgtatcctgagaaagaccacattcacataatttttattatatattgttttaattgttctgtattactagttgttgttaatcccttactgtgcctaatttataaactaaactttatcacaggtatgtatgcataagataaaacatacatatataaataagatttggtcccacccacagcttctggcaacccctgagggtcttggaacataacccccaaggataaagagaaagactatttattggatacaatatttgcaaaatgtttaaaatatccaaaacaatactctatacacactgctgaagcttccagtcacatgtatggaaggaaaaagacctaacggggaggaaaaacaagtccaggaaggtggctctctacgggggcagctgggttatcaggttccatttcttaacctgggtgttgcgtacacatgtttatgataatcacttttccacttttcaaatgtttcacaatttaaggagcaacaagcaaaacagtcagtagaatatactactatttgtgttaaaaagaaaaaaggcagaaggaactcacacatgggatgtacctctgcaagcttctaagggagctgctaccaggctgtttggggagggcctggggacagcagtggcagggacaaaccttgtactctatactccattctactgactgacctggcttcccacgtccatctattatctactctaaacagctcgcctccatttacgaatggggaaaccgaactagggggctggaacagacaacctcaggtccaggattagtgacaacagatctagacccaagcattcgggttaccaggaaccagctctgatctgctgggctgctctgatgtcaagatcccctggcagctaaacctagtttggctacctagactatgaactgcctgccaactccctcctaactgctgtctacctaccctggcttgttttcctgactcactaattatacccagcatgtatgtttttaataagtcaatttaattttgttaaagtcacaacgtcctttgaaattaaagacgccaaaggaaatcacaaaatcaagggcagaaaataggccgctgtgctgttggggacaaagatattgacaatacattacttttattagtggtacagcaacaaagaatactaactaagcccttttctgtattaacctaatttattaaagctaaacagcaacccagtgaaatagatgagtaatgccactttacaaatgatgaaatacgggagagtttaagcaacttgcccaaggtcgtacggctactgtcagcaatgagataatgtgaaacttccactccacattatcatcttgtcccaacatacaaaattacaaatgccacaaagttatttttttggaacttcatgtaataaaaaataaagcaattagtacttttgcaacagccaaaatcttcatcccaatcactgtatttatcatcattgttttaaagcccttaaaaaaaaaaaaaaaaaagccaggtgcggcgactcacgcctgtaatcccaacactttgggaggccgaggcagacagatcacttgaggtcaggagtttgagaccagcctggctaacatggcaaaaccctttctctactaaaaatacaaaaattagccaggcatggtggcaggtgcctgcaatcccagctatcagctacctgggaggctgaggtatgagaatcacttaaacccgggaggtggaggttgcagtgagctgagatggtgccactgcactccagcctgggcaacagagtaagaccctgtctcaaaaaaaaaaaaaaaaaaaaaaaaaggcaagcagggcaatgtaattctaattagtactctctttcattgatctgaagaatatccagaccctccttcctggtggcagaaccaaaaaggagccagaaagcaaggcttacagcctggtagccagtaacctagaatctctgctagaagctgcctccaaagctgccatgcacacctgtctaagtggctttggtcttggccttgagaacttcctaagcatgcctcattaggtgctgttcccagccagcaacaccccgccctacccttccacttccccacagctgcctggacatcccatggtctcactcaccaagaaaatggaagaccaagttctcctttccctcatctacaaaatgccacaccaatcaatccaacacacttcaactctcatagtttgttctcaaaacaacctgtcagggccgggtgcggtggctcacacctgtaatcccagcactttgggaggccgaggcaggcggattacttgaggtcaggagttcaagaccagcctggccaacatggtgaaaccccatctctactaaaatacaaaaaattacctcccatttacccgagtgttcagggaagagggtcctttggtcaactaaatattgtggttaaccataagcccatatataccagaggtggattttataggcatggtggtgggcacctataatcctagctactcgggaggcagaggtgggaaaatcgcttgaacccggaaggcggaagtggcagtgagccgagatcgcgccactgcacaccagcctggggacagagcaagactcccatctcaataacaacctgtcaggcttctccctttcggatgcctctctctcacaagagagagctgctctcctttctcctttcttctgcctattaaactttctgctccaaaaaaaaaaaaaagaaacaaaacaacctgtcaaatgtacttcaaggacttgacaaatcactgatttgttaaaacaaacccttctttcttcaggaattatactcttattttcacagaataaaactgatttactattaataaacaggagatttatccaaaatccctgacaggccaagacctgaagttcctactgatattcagcaggccaggctataaattcacatgttattgaaagaatatatataacaccttctagcatccccagaaaacataactgtcttagcgtggtgtagacaacattcagcaggctagccaccacacagctgacagctatcagggcatctaagcttcagggagcacctgccacatcccaggcaccatccctcatgccttacacctagctgatgaacacgctcctttttccaccagaggactcacctaacagcaataccctccatgatcccatttgtaaaagatcgaaactgcagccttcacatctatggtgttcaaaggttaacaatgtttccttcggggcaagtgggacagggcagtgaatgggtgaacaggggcctctggatgctactgcactgctccccaacctcgggggctgctcactttgtggtaattcatcaagttgtctacttaatcgtccacgtatgtaacttacactaagtttttaaaagttaagaggtccatgtggacagagggatatggaaaaagcgagcactgtggagtcttgggttctggtcctggcatccccagtaaatggtctatgatttgggagagtcacctctgggcacctccaggtcttcattccttacaaaggggtcagattacatgctctccaattctctcatggtgccatggctttgctttcgcttttaggtggggaaaaaggaggggcagctggatgggcagaaaagtaactcaaaagcaagtgtctctaccaccaggacatcactgaaacacaaaatacaaagcccatcccgattcagggtggcattctgtactacgacagtgtcacgaagaaagttctaagtgcctctcgggcagcagacaatggctgcagtcaccaggcactttcactaacaaaactcattatcatgtctagaaattttaggagtaacattttcacaatatcacaaaggggccagagctgtgaaggccagggagcattcaaacactgttatcagcactgactttggcctaatcctaaaggtaggacagcaaagttaaaccaaggccattacaatacctcccatttacccgagtgttcacggaagagggtcccttggttaactaaatattgtggttaaccataagcccatatataccagaggtggattttatatttcccgagacacgattgagtcccttttgggtgatgtgaatgaatcagaactcttaagggtcttgtgaggagtgactcaacgtcaacaagaacaatggataatgtaaaaagaaagaaaaaaaattgccctgaatcagtataaaaaatttagagaccagcattagtttattatacagaccatggaataactgcagtataagcttgagtataaaatcaaaatgatttttttataagcagatcatctttcattgtgtacaagtaaaacaaatttaagagcttcgtatagggtcaagatacattcttgagagctgctgaaagctaactcatttcttcggttttgcatcaaccctgtcatccactttgttactttttattaaaatttgggtagctaggttaaaaatggcagccagcccttaaactacatatagttactaaaaaacagacattgtggtgggggctgggtgcggtgtctcacgcctgtaatcccagaactttgggaggctgaggcgggagaatggcttgaacccggaaggcggaggttgcagttagccgagactacgccattgcaccactccggcctgggcaacaacagcgaaactccgtctcaaaaaacaaacaaacaaacaaaacaaacaaacaaaaaaaaaacggccaatagcgtgcaagactttcttttctctttttctttttttcacaggtggggtcttgctatgttgcccaggctggtctccaactcctaggctcaagcgatcctcccacctcggtgtcccaatgtgctgggattacaggcataagccaccgcacccagatgcaagacatttcaaagcaagtgaaatgaggaccccatggcaaaataactggaccagaaaaccctatatcgccttcaatacctatgagaattaagctccgattttttttagcttgcccaaattcctatctaaggggtgtaggaatcataccctacaaaccataaactctcatcagatgggttttatttgaccccatatatcgtgacttactttccaatctgactctggcataacattttataagacaaggaaaaaaaaatcaaaatatctaaccccaaaatatatttccttgccataccttgaaattgccctgcaaagtctcttgtgggaaaaatccacattctatagagaatcccctttcccctatgttttccttccttcctctccagatccaggagataatcaactaagagccagtcaccctttcatttccatagaaatattttacaacgtgctcgctctcttagtcggctacctgagagcttcctctgcacaataaaacttggtctccacaatcctttatcttaacttgaatactttctttctattgattctaggttttcagataaactcaaccaattatcaactagaaaatgtttaaatttacctatggcctggaagccccccgccgctttgagttgtttcgcccttctgaaccaaaccaacgtatttcttaaatgtatttgattgatgtctcgtgcctcccgaaaatatgtaaaacccagctgtatcccaaccaccttaggcacatgttctcaggacctcctgagggctgtgtcacgggccatggtcactcatatttgcctcagaataaatctcaaaatatttttacagagtttgactcgttttgtcaacacctagaatccagagtaaatacatatgcaaacgtcaatatagatgatacacatgtgcttcctgcagcttcgctacccttacaaacaggcaactgaagccaacggccaaagtgtcctgcgggacggggctccagcccacctcgatcacgtgcgcccagcacaggcacaacacagctgcccaaggggtcaccctacaagactcacccacccccacagtgggaagcgcagcctgagggaaggcctcggggccccagccgcgcaggaacccactcgagccccgaaggagatgctgcccagggcctgggccgtcctcccgggggcattttcgcagcccgccccccgcagcccccagccgcccagagaaagccagagaaagccagcgaacgcgcctgcgcagtgcgcgcgcccccttgccaactagggcagggggagcagaggggccaggcccggcacagcccattctggggcagatggacgctgcgaggcacctcctccccaggatgagggtcccagggcttacccgcgcccaggaggctggccaggaggaagagggcgtacatagcgccgtctgactccgcagtctgcaatgcggagcgtcagctgatcccccgcagatataaatctgccctgccccaaagccgtccagagcgcaggcgctaaccccgccccatccgggcctgcccgagctcaacagcgccctgactcagcgcctctgagggcgcctgcgcgaaggggaggccaataggagggggcaatgggaggggcgaaaggaagggctatggggaggagtgaggaagaacttggagaaagggaagggaaaggtcataaaagaaaagccctactaattgaataggtcagagattatatatgtaaaataccttttaaatctccacattgttggccggccgcggtggctgacgcctgtaatcccaacacttgggaggccgaggcgggcggagggttcaagactagcctgggcaacgtggtgaaaccccatctctacaaaaaaaaaaatacaaaaaaattagcccattgtagtagcgggtttcacatagaatagcttggggtttcacatagaataagtagtcgtgtaacagggtacagggctcagtcctggccaggggcacgtgggggcaggtggtggcacctggtcaaaggcaagtctgggctgggcatgctggctcactcctgtaatcctaacactttgggaggccgaggcgggcggatcatgaggtcaggagttcaagaccagcctggccaatatggtgaaaccctgtctctactaaaaatacaaaaattagtcaggcgtggtggcgctcgcctgtggttccagctatttcaggaggcagaggcaggaaaattgcttaaacccgggaggtggaggttgccgtgagtcaagatcgcactactgcactgcagcctggaccacagagcgagagagattcccatcaccaaaaaaaaaaaaacaaaaaacttttaagcctcacattgtggtaccgttaaagatgtaataccattcctcacccatcataagagatcataagagtcacaaccaacactcctgtaacgagacagcttaagagaaaagcataacaaatttatgtaatcaacgttttatgtgacatggaagccttcagaaattaagacccaaagaccctctgcctgtggctgcccctgccaggacctgaacagagaatgatgatgaccctctccagaaggataagaacctgccaaccgcaaggcagggaaaggaggggaatcttagccccttagggcaggcacttagaggtcatttacctgtagggacattgagcctaggagagggcaagacgtttatccaaggtcacacaacaggtagagatagaacctggcccgaagccaggtttcctgacccaggaagggcaaacctacagttcctccaacttcctccaatctgcaatccgctctggagaacaaccccagggactaaggcctcagaaccttcagttctgctcccctgcaatctccctaagtgcccccagcccccaccacagctctgacttcctctggggagccagatggggaagtgtgccccatgcaccacagtgggccatgtgaggcagctgagtgagttgggacaagatgtggtctcaactggacgcctcacaggtcggcctcagtggccagatggagacttcgtggctgctccacctttgggcttcccaaggccaggcagaagcgtggggcagaccacacaacaactggttaaaagcaagggagctagccgggcgcggtggctcacgcctgtaatcccagcactttgggaggccgaggcaggcagatcacgaggtcaggagatcgagaccatcctggctaacagggtgaaaccccgtctctactaaaaatacaaaaaattagccgcacgatgtggcgggcgcctgtagtcccagctactcgggaggctgaggcaggagaatggcgtgaacccgggaggcggagcttgcagtgagccgagatcgtgccactgcactccagcctgggcaacaacagcgaaactccgtctcaaaaaaaaaacaaacaaaaaaagcaagggagctggggctctaggacaaatcccccatccttcagctccttgcagatggaggagcaaagcatcccagtgctccatgcagaggttacaggaccccaagccaaaaggacgctcagagacctcagatcatcccctctcatcttatagagctactgacatctcagggctggttaacaacagagcctgaaccaggacttgttttttttgttttgttttgttttgttttgttttgttttttgtttggagatggaggctcactctatcacccaggctggagtgcaatggtgcgatctcagctcactgccacttctacctcccaggttcaagcaattctcctgcctcagcctccagagtagctgggataacaggtgcacgccaccacacctggctagttttcttgtattttttggtagagacaggatttcaccatgttgaccaggctggtctcaaactctgacctgaagtgatctgcctgccttggcctcccaaagtgctgggattacaggtgtgagccaccacacccctccttttttttttttttaaatattcctccttcatacctagaggaatatgtcagtgtttttgagagaaacttttgctgcctttcatctcctcacctgtaactcaacagtaatatgctgcttcatccgcctcgtcctgaaccccatgaggacagaattttaacaaagaatataaaagcaataagtagattattattaatttttttaccttgtcagtagacgcttaaatcctcttaaaaaaaaaaaaaaaaaaccttctgaaccatctgcgtgtaggcaacaagagctgtgaagctcctcaaaccctctggctctcttatgcctttcctagctatgtaccctcagggaaatactccagaagtgaaggaatattttgtccgaagtgttcacagaagggccctttagaaacatggaagctggaaagatcccaagtgctgaacaatgaagagatgactgtggaaactggctggacagagcaacggtactgaagcagctttgaaacaggaggaggagggagcaagggctaggctgcagcaagtcttccaggaacgtgggtcccaagaaacatgggcagagtgagaggccaaaccccatctgctagtaagccctgctgctgacttcccagagaggatggcagaactggtggagagcttctagatcctggatcccatcgggcgcagtggctcacacctgtaatcccagcaatttgggaggtcgaggcgggcagaccacttgaggtcaggagatcgagaccagcctggccaacatggtgaaaccccatctctactaaaaatacaaaaattagctgggtgtattggcatgcgcctgtaatcctagctacctgggaggctaaggtatgagaatcgcttgaacccaggaggcagaggttgcagtgagctgagatcgcaccattgcactgtagcctggatgacagagcgagactctctcaaaaaaaaaaaaaaccccaaaaacaaacaaaaaaagatcctgcagcctgccgcaccccaaagagaggatgcacgggcagccatggccctccaccctgtccctctccctcccacaagtgcaggatttcagccaggaggggaacagagaattggaagtaggggggaaattctgactttggattaactcatcttgcattatttcactcatggaaatgtccacattgcaatttttaaaaaacaaaattaatataggaaattttaaaagagaaaagaaaatcccttccactaccaccctctgggagctcaagtcttcaaggaactgaaaagatatttttccttagaaatgtgagccacgcttaaggtttctcaatggccttccagttctggatctcagttctgcatgaggccccaattttcatgtctgagatctcttgaaatccccacctgtcagacccttttaataattttccagccgggcatggtggctcatgcctgtaatcccagcactttgggaggccaaggtgagaggatcacttgagcccaggagttggagactatcctgggcaacatgacgaaaccctgtctttacaaaaaaatgcaaaaattagccaggtgtggcgacacaggtctgtgatcccagctactccagaggctatgggacgggaggacggcttgagcccaagaggttgaggctgcagtggtgcacctctgcttgtcagccggggcaacggagcaagaccccatctcaaataataataatgatgttccctgtggccccagatggcctccatctgttactttttctacaactgaaagttccggccaagacagccaaggagataagacatatctaccattgaggcccagcccacctgcttggccccaaggctccactccagtgccctaaacagcaaccctggagccccctaatgccctggaagcctcccttgacccctcaccctgtctcaaacaatgacaggttctctccctccagcatcttcctactcgagacctctggcttcagaccctctagcctgcacttgtccttgtgcctggaatgagacctcaggtgtcactcaaggcaggctcaggctgtcccagggacacctctcccatcacccaccaattcccaacctctgacttctcctcctatacccccacctcccctggactgatggagcactcaacagtgcagccaagctcaccaagccctctgtgcttctcagcacctatttagcctcccctgtggcagagtctgctacaccctctaatatcattcacccccttctccttgatttgatagttactaatgagaccccttatttctagcagggcacatggccacctaaaataaaagctacacattccaacctcccttgcagccacgggacttcactgtggccaatgagatttaaaaaaacaagtgcccaatttgtgacttctaggtactgctttttaaaagaaggcatatatccagtgcaaatattcaaatatttaacaactagtactgccaggacactggccatagtgctgggggaatgtcctagaaggccccaactgagccaggctgctgtcttggaggggtggatggttcctggggatgacccggcagcgggggtgggcagcaggaggctagcaggtgttaccaactggtacgaagtccttcataatttatttatttttattttattttatttttatttatttatttatttttattttgagatggagtcttgctctgtcgctcagactggagtgcagtggtgccatcttggctcactgcaacctctgcctcctgggttcaagcaattctcctgcctcagcctcctgagtagctgggactacagacctgcgccactatgcccggctaatttttgtgtttttagtagagatggtgtttcaccatgttcgccaggctggtgttgaactcctgacctcaggtgatctgcccacctcggcctcccaaagtgctggattacaccaaccctgctctttataatttaattactggtacagttctactgatatgtatcagctaaatatcagccctggctacaatctcctttcttcggcccgctgcctggattgcagacataatggcaggagctcaagcatccatcctggaccatgaggtagaagcctctttaaggatgacaaagcaacaagagaggagcctgcctccctgatgattgtacctgctctaggctgtcccttgcgggctttatttatgtaaacaaactcctatctttattaagtttttgttatcttcagttttctgcttcattcctaatcttgttaacaatgctcaagcccctatgtaatttttaatttatttcacacccatttactgttttactccttccctttctctaagaagatgtccttcctcttctttgcaaggctttgtgtattttcctcccctttgcaagtttagccactaaacactactatgcttttgctgatcagctcctgtgacttttaggacaggactgatattctgtctattttggttgtttaatgcctgcgtccttcactttgttgaattaattatttcctaactgctatatcaccaggaatcatcggtgaatatttttaatatcaccgctctggtactttgctttgtcaattgttctttctttattttctctctctttttttttttttttttttttttttttttgtgatggagccttgctctgtcccccaggctggagtgcagcggtgtgatctcagctcattgcaacctccgtcccctgggttcaaatgattctcttgcctcagcctcctttgtagctggggctacaggcgtgtgccaccacacctgtctagtttttgtatttttagtagaggcaggatttcgccatgttcaccgggctggtctcaaactcctgaccttaagtgatccacctgcctctgcctcccacagtgctgggattacaggtgtgagccattgcgtccagcccccttctttttttttttttttttttgagatggagtctcactctgtcacccaggctggagtgaagtggtatgatcttggctcactacaacctccgtctcctgggttcaagcgattgtcccacctcaatctcccaggtagctgggattacaggcacacactaccacacctggctaatttttgtatttttagtagagacggggttttgccatgttggccaggcttgtctcgaactcctgatctcaggcgatctgcccgcctcagcctcccaaagtgctgggattataggtttgagccatggtgcccagcccctttccttttttatatcttctgtctccctctgtacactgacttttccctgtcagactataagtatgcccaaggctctcccatcctaaaagaaatctttcttcaccttgactttcacataagccactgtgctttctctcaccttcccttcagtgccatactcagtatggcatatacactcaccataactactactatccctcccaactataatccagcccactgatcccccaaatggcttctggaaagtagacagtcaattccttcttggtaagtccaccagcaccttctgttccctttcacctctggcactgttggtttgcttctcctttctacaagtcctcctctcccgcccccgcctttggcatcagtgacagggtgccactccacagggatgctgaatatgcaccacacacgtccccactgcctgcttcctcattcatggcagacatcaccaatagaccttgcctcctgaagccttgtcaactcggtactcctctgctttcaaagttggctcttgggttaacatatttgctgtctgtctcagatggggttgcctgggaaccacagtctaaggctgagatgagcaggcaggagtttattggggtatgttctcaggatcacacctgtgaggccgtgagggcagcaagataggggaaaccaaactgcgacaaggttgttacattggcctcagcccataccgcgctgcagggacggtgctgcagaacggctgtcaactggggtaaggggtgtgggcctttaaagcccaagataatatgtcccaggggagggagtgtaagcttgggtgaggggctccgttggctgaggggaattcctggagatggcacaattgtgagccctcagcagacgagcccatggtggagagacagtgggtggcttggtcctgaaagaagaagctatatagtgaattccaccaccatactctgcttgctctcagtcatccttctacttctctgaccatttcttttgctttttttttttttaagatggagttttgctcttgttgcccaggttggagtgcagtggcacgatctcggctcaccgcaacctccaccttccaggttcaagcgattctcctgcctcagcctcctgaggagctgggattacaggcatgcaccaccacacccagctaattttgtatttttagtagagagggtgtttctccatgttggtcaagctggtctcgaactcctgacctcaggtgatccacctgcctcagcccctcaaagtgctgggattacaggcgtgagccactgcgccaggccgccatttctttatagcaagcttgtccaacccacggcctgcaggtcacatgcagcccaggacggctttgaatgcagcccaacacacatttataaactttcttaaaacattatgagattttttgtgtgtgattttttttaagctcatcagttatcattaatgttagtgtattctatatgttgcccaagacaatttttcttcttccagtatggctcagggaagccacagaatggacacccctgctttacggaacacaaggccttggtcctagcccagctttgcaatctctgttctctcaaacttccgaccttgccctccatcccatggttccacctactctgcccacattctctaagattgtctaaataagctatgcagctccacatttatgtgccttataaatacccccatcccctacctcgaattctattccctgcctctttctctggtaaactcttattcatccttcaaaatccatttaaggccaggcacggtggatcatgcctgtaatcccagcgctttggaaggccaagtcaggtggatgacttgagatcaggagttcaagaccagcctggccaacatggtgaaaccccgtctctactaaaaatacaaaaaattagctgggcgtggtgtcacgcgcctgtaatcccagctgcttagaaggctgaggcgggagaatcgcttgaacctggtgggggcggggaggggaggtggtatggaggttgagctgagatcatgccactatactccagcctgagcgacagagtgagactctatatcagaaaaagaaaaaaaaaaaaaaaaaaaaaacagatactgccagagggaaacctttgctatttgctatgctttaggaattggtggacacttcctcctcactgctccctctgggatctgttcacatctcaacagcatttcttattttgtcctgttatttttttagcaatacatttattgagtgcctggtatataccaggcactgtaccaagggctgaagacagagaaatgaagcacgcaggctgagtggaaaggccacacaagaggctcgttgttatgtccccactccggggaagccagattgctggccgggcccacagctccatcagggctccttgtacacacgtcccattcggcaccctgaggccctgtcacccgctgggctgtgggtgatcagattcccagtcagtctattctgagagccgatcagtgcatgggatgcggcctggccccacagctctgtccccagatgttattcctattggacaggcggcccccatcagctgctctcttggggagagcaggagctgccaagaaggccttgcatgagctggtgagtcagcagcagcagggcagtggggcaggccgggagctgctgagtcactgtagcagtctgcaagttggtgaggtcagagcccctagagaatctgatgaaagctgggaacactctgccagaaaaatgctcagacacattttgcactgacttcaggaggctctcaggcctcagccacccatctgtggatgtcagaaggagaaccttagtaaacccaaagaggggaagtgacttaactgctcacaacaccaataaataatagaactgagatcagagccagttctcctgagtcacagtcctgtcaatttatcagattatgtccctgtgccaggcatctatcaaagcctccctttatttcaaggcccagctgcatttcacctcctgggaagcccccctgcttcctctagcctcaggcacctttctccttctctaaatttcagatgatttgctgctagagcccttactcttgggtgaacttggagggtgaaaagaacaaagactagattagatcagttgtttctgagcctgaaaaggaaagcaagaactgggctgtaatcaaactgaccatgttagcatatcttaaaaccaaagcttcttagctgggcgtggtggtgtgggcctatagtcccagctacaggaggcttaggtgggaggattgcttgagctatgattgacccactgcacgccagcctgggcaacagagcaagacactgtctcaataataatactaataataataactggcattaattagttgcctgttaatatacctgactgtcaactgatcactctatatacataatctctctttttttttttttttttttgagatggaatcttgctctgttgcccaggctggagtgtggcggctcgatctcagctcactgcaatctttgctgcccaggttcaagcaattcaccttcctcaacctcctgaatagctgggattacaggcgtgcaccaccatgcccagctaatttttgtatttttagtagagacgaggtttcatcatgttggccgggctggtctcaagttcctgacctcaagtgatctgcccgccttggcctcccaaagtgctgggattacaggcatgagtcaccatgcctggtcaatatatacatgatctctattatttatttatttatttgagatggagttttgctcttgttgcccaggctggagtgcaatggcacaatctcggctcactacaaactccacctcccggattcaagcgattctcctgcctcagcctcccaagtagctgggattacaggcatgtgccaccactcccggctaattttgtatttttagtagagaggggatttctccatgttggtcaggctggtctcgaactcctgacctcaagtgatccacccgcctcggcctcccaaagtgctgggattacagatgtgaggcaccaagcctggctacttatttattttattttaaaataaatatagcatctcactatgttgcccaggccggtctcaaaatggtctcaaactcctggcctcaggtgatcctcttgccttggcctcccaaagcactgagattgcagttatgagccactacacctagccaatctccaatctattctttctttctttcttttatttctttctttttttttttttggcagtctcactctgttgcccaggctggagcgcagtggtgtgatcacggctcactgcagcctcaacctcctagactcaagcaattcacccacctcagcctcccaagtagcagggaccacaggcacatgccaccatgcctagctaatttttgtatttttagtagagacagagtttcaccatgttggccaggctggtcttgaactcctgaccttgtgatccacccgccttggcctcccaaagtgctgggatgagccaccgtgcctggccaagcctccaatttttaaatcaaaggtttgattactcccattttacagatggggaaaccaagtctcagagaggccgacttgcctaggatgtccctggtcctgatagaaccaggattcaagcccaagatcatttggggtctgaagtctatgcaatgttgtctccattgagaatcagaattgcccaagggaagcagacacgaagtacaaagatccaccaggccaccgggggctgatgccatcgcactccacctttccacattcccactccacatgcctgagcagacgctatgactgaccagtctgatctcagaggtgcagtgtactgctcagctgtgcagataaatctgttaaggtgacagagctgtccccctggggtcagcttagtcttaaggacttaatctggtttatgtatcagactcttgtaagtttcttcaggagcctcaccctgaaaaccttaaccttttctttgggccaggtaaaccaagatccttggaccccagtgtcttcatcaagattgtgacaccctatgaagacacttcccaattggcccctggcctccacaatgacacctatcctaatcctcagggcagtggactgagaacacgcttggctcaggctggacgtttgtgtcttaaatgaccttggacacaagtgggctggaattagggcctctgaatctttaggttttctggagatttccattataagttatgatcctgtcttcagagtttctttatcttattaggagtttgactgagtactactctgagttcgaattacctcacccaggaacccaacacccaacccaaacctgagagctttgcttatagagagaggactggctttcatgtcagggacctggaatctcctccttgatctgcttcttgctggctgagtcacctctggggagaacttcacctccccatacttcagtacgtgcattacgaacatggacgtagtctggcaactgggaggagctgtgcccaccgaaggaatcattgtgcctttaagggcataaacctggtttgagatcaaatccgtccactgaaacattaattcaacaatcctcccacctcagcctcctgaggagctgggactactggtgtacatcaccatacccagctaatgtcttattttttgtaaagatagggtctcacaatgttgctcaggttggtcttgaattcccgggctcaagggatcctcccacttcagcctcccaaagtgctgagattacaggcatgagccactgtgcctggcagatttgtacactttatttatttatttatataataaatagagatgaggtctcgctatgttgcccaggctggattcaaactcctgtcctcaagcgatcagcccacctcggcctcccaaagtgccaggattacaggcatgagccacctcacgcagcaaattgtacactttttttttccccgagacggagtctcgctctctcacccaggctggagtgcagtggcacgatctaggctcactgcaaccttcgcctcccaggttcaagtgattctcctgcctcagcctcccgagtagcagggactacaccacatgtgccaccacacccagttaatttttgtatttttaatagagatagggtttcaccatgttggccaggctggtggcgaactcctgacctctagtgatccctccacctcggcctcccaaagtgctgggattacaggtgtgagccaccatgcctggccccagttgtacactttaaatgtgtgaattgcatggtatataaattataacgcaataaaaaaattttcttcttctttctgagacaaggtctctctctgttgcctaggctgtagtgcagtggcacaatcatggcacattacagcctcgacctcctgggttcacatgatcctcctgcctcagcctcccaaatagctggaaccacaggtgtgtgccaccacacccaaataacatttttttttaaatttttttgagatggagttttgctcttattgcccaggctggagtgcagtggcgcaatcttggctcaccacaacctccgcctcccgggttcaagcaattctcctgcctcagcctcacgagtagctgggattacaggcatgcaccaccacggctggctaattttgtatttttagtagagatgggttttctccatgttgctcaggctggtctcgaactctcaacctcaggtgatccgcctgcttcagcctcccaaagtgctgggattacaggcgtgagccaccgcacccagctatttttatttttttttgagatggagccttgctctgtcacccaggctggagcgcagtggtgaggtctcggctcactaaaacctccacctcctggattcaagtgattttcctgcctcagctgggactgcaggtgcatgccaccaagcccggctaattttttttttttttttttttttttgtatttttagtagagatggggtttcatcatgttggccaggctggtctcgaacttctgaccccaactgattcacccaccacagtctcccacagtgctgtgattataggcatgagtcaccatgcctggcctccttctccttcttcttcttcttcttcgtcttcatcttcatcttcttttttttaaaaaaagaggcaataaaatatttctcttaagcaatctagcttgaaagtgtccagaggaggagacgctaaggtccaaatcccgctctatcccttagctgtaccaactgtgagatcctgctgggcaccaacccttggtgtcctcattcagaaggtggacagcccctgggcctaggctgttgtgaaaatgagaggagggcagggaggaaatgcacctggcactgggcctgctgtgtgctggtcaggatgccatcagcaggaacaacaggcggaggaggctgcaggtgaatgatggtgttgggggaagttctttcccttttatttattaagaaggggaggagggtttcttaatggagaaagaaagtggggaaactatcccagagcctgtgcatcccaggggacctttgttctccaacctcccctctcccagccccacccccgccatgggcctatatctgctccacaagcccccacaagtgtagttacctggcagccccatccccatggttgcctcaccccagtgctggtagcaggacaagggggctgccgaggctggagtgatgtcaatgctgggggaggagagagaccctcagtccactgccaccaaccctgccaacagcagttgctgaggagcgtgctgtgctgactgtgggctgggctcttgcttcccctcatctgcccacagtccaggtgttcccagcatccccccatcccctcccccgcctgcccagctgctgagccagtgtctgacaacacccagacccaagatgtcagagcctgtcccctgcatcccagcgggagctgttcctggactcagaggctgtggtctacagaaaaggccctgataggagtctgagctggttcctagtccacactcatcacaaccaagctatgggactttgggcaaggcactgcgcccctccggttgcgctgtccccatcaccaatgtgactgtgggagccagggtacgggtcatccaggccccactccatggtagcacagtggccctggaggccagtgcttctggtggtaggtgtcccagatgatgctggccatttgcatgggctctctctggccctggaaggagtgagggcaagggttggaaccctactgtgtgcgggactctgtgccctccatgtgctccacctcatttaaacttcaccgaccccatgggtccagtgtgaataagtgggcaggctcttccaggcctcatggtcagacagtctggactcatatcccatctccaccatggactagctgagtgacccgggcagaatatttaccttctctgtgcctcagtttccccatctataaaatgaggccaaaatagtacctttctaacggagtagttgggacagactgattgaatacatgtcaactgggcagaacagtgcctggcacacgttaagcccacaataaggttaactgttgttattactagtcccatcttataaggaacttggggctcagggaagctaagtggcttgcccaaggacacaccgctagaaaatggtggggcagggctttccactttttttttttttttttttttttgagacagagtcttgctctgtcacccaggcgggagtgcagtggtgccatcttggctcactgcaatctctgtctccagggttcaagcaattctcctgcctcagcctcctgagtagctgggagcacaggtgtgaaccaccacgcctggctaatgtttgtatttttagtagagacggggttttgccacgatgcccaggctggtctcgaactcctgacctcaagtaatctgcccccctcagcctcccaaagtactgggattacagacatgaagttgatgttccttcccaccacccagtactggaccccttaaaaaaaatcctgagatgagcagtgtggtaaatgctgatggtctcaggaatggcattaaaaaataatcatgtagccaggcacagtgactcacacatctaatcccagatcccagcactttggtaggccaaggcaggtggatcatttgagcccaggagttcgagaccagcctgggcaacgtagcgaaactccatctctacaaaaaattatccgggcatggtggcaagtgcctgtagttccagctactcaggaggctgaggcaggaggatcacttgagtccagggaggtactgggtggtggagtgcagtgggagacaccactgcactccaacctgggtgacagggtgagaccctgtctcaaaataataagtggccaggcacagtggctcacgcctataatcccagcgctttgggaggccaaggcgggtggatcacctgaggtcaggagatggagaccagtctgaccaacatggagaaacctcgtctgtactaaaaatacaaaattagccaggcatggtggtgcatgcctgtaatcccagctactagggaggctgaggcaggaggatctcttgaacccaggaggtggaggttgtggtgagccgagatcgcaccactgcactccagcctgggcaacaagagcgaaactccgtctcaaaaaaataaataaataaataaaataaaaaagaaagaaagaaaaagacatgaaaataatgataacaaggtttattttctgattaccaaggcagtacagtagtcccccttgcttatccaaggttttgctttctgcagtttcagttacctgtggtcaactaagttccaaaaatactaagacattttgagagagagagagagagagagcatgctgacctaactttattacagcacattgttataattgttctacttatttattgttgttaatccgttactgtgcctgacttatgaattcaacttttatcacaggtgtgtatgtatagaaaaagcagaacatatatagggttcgatactatcacttaggtctcaggcatctactggggctctgggaaagtatcccctgaagataagggcgactacaatatttgttcactatcagtaactgagaaaatgcggaaaagcggaaaagagacaagtaaaaatatttttcccttcggggaaaaccctttcttctttggataactaaaaacctgatctcctgcatgttgtgagacctatcaaagggaggtggccttcactcaccttaagcaaggcttgacgttgtccaagggcccagcaggagatattgccagcacccaccctccccagggtaaacacagccccttccactccctcctggggccttcgggccccacctggggtcacagccttgaggatgcacactgcaagccacagcctgcagctgcttaggtcatgtgattcagtgaatgccaagccacagggctcagtcctcctcagaattgtctgggtcacccagaacaccctatgtgagccatgtgattcagcggggtcacatgctgagccacaggcatttgactccatgccaaatgtcatcacttccagaaagttagcaaaaaattatggtggctctggtgtggcaagcacagggcagggcaaaggagaccgtcactccgagataccaacacctgttaaaagaggatgagctgggagaagcggattgcttgagctcaggagttcaaggcagcaaggagctataatcatgttttttttttcttttttttttttattgatcattcttgggtgtttctcgcagagggggatttggcagggtcacaggacaatagtggagggaaggtcagcagataaacaagtgaacagaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccacccttaatccattcaaccctgagtggacacagcacatgtttcagagagcacagggttgggggcaaggtcacagatcaacaggatcccaaggaagaagaatttttcttagtacagcacaaaatgaaaagtctcccatgtctacctctttctacacagacacggcaaccatccgatttctcaatcttttccccacctttcccccctttctattccacaaaaccgccattgtcatcatggcccattctcaatgagctgttgggtacacctcccagacggggtggtggccgggcagaggggctcctcacttcccagtaggggcggccgggcagaggcgcccctcacctcccggatggggcggctggccggacggatggctgaccccccccacctccctcccggacggggcggctggccgggcagaggggctcctcacttcccagtaggggcggccgggcagaggcgcccctcacctcccggacggggcggctggccgggcggggggctgatccccccacctccctcccggacggggaggctggccgggcggggggctgacccccccacctccctcccagacggggcagctggccgggcggggggctgacccccccacctccctcccggacggggcggctggccgggcagaggggctcctcacttcccagtaggggcggccgggcagaggcgcccctcacctcccggatggggcggctggccgggcagggggctgaccctccctacctccctcccggacggggcggctggccgggcggggggctgactcccccacctccctcccggacggggcggctggccgggcggggggctgacccccacctccctcccagacggggcggctggcctggcggagacgctcctcacttcccagacggggtggctgccggagggagggactcctcacttctcagacggtgcggctgccgggcggaggggctcctcacttctcagacggggtggccgggcagagacgctcctcacatcccagacggggcagcagggcagaggcgctccccacatctcagacgatgggcggccgggcagagacgctcctcacttcctagatgggatggcggccaggcagagacgctcctcacttcccagatggggtggcggccgggcagaggctgcaatctcagcactttgggaggccaaggcaggctgctgggaggtggaggttgtagcgagccgagatcacgccactgcactccagcctgggcaccattgagcactgagtgaacgagactccgtctgcaatcccagcacctcgggaagccgaggctggtggatcactcgtggttaggagctggagaccagcccggccaacacagcaaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcagctctgcatcagagggagaccgtggaaagagagggagaggagggagaggagggagaggagggagaggagggagaggagggagagggagagggagagggagagagctataatcatgttactgcactccagcttgagcaacagtgggagacccagtttcttaagaagaaaaaaaaaaaggaaaaagtatcccagcactttgagaggtcgaggcgggcggatcacaaggtcagaagtttgaaaccagcctggccaatatggtgaaaccccgtctctactaaaaatacaaaaattagctggaagtagtggcaggcacctgcagtcctaggtactcgggaggctgaggcaggagaatcgcttgaacccaggaggcggagattgcagtgagccaagatcgcgcctctgctctccagcctgggcgacagagcaagattccatcccagaaaaaaaaaaaggaaaaagttaatattaaatactaattttaagtaactataagtaattacaactattttcactttaaacattaagtaaaataatataaaattaaattaaaaatttaacctaaaaaatttaaattaagtaaatgttaatactcattaatctaattaaattaatgaaaatctgcaaaaacaaagcaaaaaacccttaaccatgccagcactctgtaagttctcaataacacatttaaaagtaaactgaggcacaataaaattagaaggtttatttattcatattttattttatttatttatttatttaaagacagggtctcactctgttgcccagactggagtacagtggcacgatcttggctcactgcaacctctgcctcccaggctcaagcaattctcctgcctcagcctcccgagtagctgggattacaggcatgcgccactaccgccggctaatttttgtttttgtttttgtttttgtttcagtggagacagggtttcaccatgttggtcaggctggtttccaactcctgacctcaaatgatccacctgcctcggcctcctgaagtgctgggattacaggcgtgaaccactgcgcccggtgtagaaagtttatttgagcaaatgatgactcatgaatcaggcagatccaaaccagaagtgattcatgagctctactgagagaacacagctgggacagatacagaagtaaagctaaggtggaggctgcagtgaactaagatcgccccattgcactccagcctgggcaacagagcaagactgtctccaaaaaaaaaaaaaaaaggtaaagccaagaaaatatttgattatttgatttggcagggcacggtggttcacacctataatcccaacactttggggggctgaggcgggagggtcacttgagcccaggagttcaagaccagcctcggcagcatggcgaaaccccatctcaaaaaatacacaaaattagctgggtgtggtgttgtgggcatgtggtcttagctgcttgggaggctgaggtgggaggatcacttgagcccaggaggttgaggctacagggagccatgaacatgccactgcactccagcctaggtgacagagcaagactctgtctctaaaataaataaataggcatgacacagtggctcacgcctataatcccagcactttgggaggctgtggtgggtggatcacttgaggtcaggagttggagaccagcctggccaacatggtgaaaccccatctctactaaaaatataaaaattagccaggcatgatggtgggcgcctgtaatcccagctactcgggaggctgaggtgggagaattgcttgaacccgggaggctgcagcgggagaattgcttgaacacaggaggctgagccgagatggtgccactgcactccagcctgggaaacagagcaagactccatctcaataaataaataaataaataaataaataaataaataaataaataaataaaatagagcttgcagtccctcagagagcaccctagtccaatggcctccttttacaggaagagaaactgaggcccagagggatcaagaggctcccccaaggtcacccagcaagaggctagagctgggacaaaacccccaagtttctgactccctgggcaaggctttttccactgttttggtctttggccatagagataatctgcttaaaaaattaacttgggatttcatgtaatcactgaggcctcagaagccttgcccaaggaaagacgaggagggtttattaagctttgttctaggagttacagggacaaggccacatagcagggctagaaactgatgtgtgccaccctcctccaggccagtagcagcttgtatttctagaaaaggcttaattttccaggtcagggcaggtcccagaaggcaccttctggggatgcggctggaccccgtgactcagctgattccacattattctctgtttccctccccactcagggtgactgccagattctggcctcccttgggccttcagagatggaagtgatcttaggttgttggtgggtcctacaacctatagtggaaaggtgaccatctaatttttttttttttttttttgagacagagtctggccctgttgcccaggctggagtgcaatggcgcgatctcggctcactgcaacattcgcctcccaggttcaagcaattctcctgcgtcagcctcctgagtagttggggttacaggtgtgcaaccacttccagctaatttttgtatttttagtatagatggatttcttttcttttttttttttttttagaaggaatttcgccctctcacccaggctggagtgcagtggcatgatccagtcttggctcactgcaacctccgcctcccgatccaagcgattctcctgcctcagcctcccaagtagctgggattacaagtgcgcaccaccatgcccggctaattttttgtatttttttagtagagatggggtttcaccatgcagcccaggctggtcccaaactcctgacctcgtgatccacctgcctcggcctcccaaagtgctgggattacaggcatgagccaccacgcccggcctgagatagggtttcaccatgttggccaggctggtctcaaactcctgatttcagatgatccacccgtctaggcctcccaaagtgctgggattacaggtgtgagccaccatgcccacttgtgtctaatttatcatcctcaccaggacacttttgagcatggccagggacatctggtcacccagccactgctatctctgagcatcatgatgggttgaagagtcagtgagccggcggttgaggacccactgtgcttgggtcccatacctgatgagaaagaagggcccaagtcccaggcctgcaaaaccacagccctagaaggagtgagagcacacagccagcatgacccaggaaactagaactgaaaccctcaaagctgaaaggtctagatgactgtccttactgtcccaacggggagcacacagctctgaaaggccaagggccttgcccaaggttaccccccgagaagatcagagactcaaacccaggttcccaactctcagctcagtgtgcgctgtgccaccggttccctttcatctgcaaaccccctgcctatctggaaggtgtgcacacagcctggaagcttgttatactggattgtaaaaattgttccttgccctggactggtgtgtggctttgtttgtgtgtggcttcctaatcctgcagcccctgtgggtggggaggtcccctttgcaaataagcgtgccaggctccagaacccagggagaaggcaaatatttcctgaactaaacctgctctcagcacttccactactactaccccagtccaggccaccatcatctcccaggtggcctcagtggcctctaagtggtatccgggatccttctcttttccccactcttcatcctccatgtcagagcatggagcctgggtgcagatcccacacaactctccctcagagctatccacgctcaaatcctggatgcacagcaatgtcatgtggctgccatcctcctgtctggcttccccgtgtcccctttctttctttctttttttttttttgtttgagatgtagtcttgctctgtcgcccaggctggagtgcagtggcgcgatctctgctcattgcaagctctgcctcccgggttcacaccattctcctgcctcagcctcccgagtagctaggactacaggcacctgccaccacgtccggctaattttctgtatttttaggagagatggggtttcaccgtgttagccaggatggtctcgatctcctgacctcgtgatccacccgccttggcctcctaaagtgctgggattacaagcgtgagccaccgggcccagccccccgtgtcccctttcttggtatcctgccacctcacacaagaaaggcacaactcccgcccaactgggccttccatggggcagtgccctgtgaacaacctcctacccccagtaggtagttagagaggtacctggaggcagagcctgttctcagcacactatgagggcaggaaccagggtcacactcctttggcccagataaggctcagaagtgagaacgttgtcatggggccacacccttatttgaatttcaaacatgaagccagggttttctgacagaaagaaagtcttgtcttgcttgactgtgttgatggggcgtgatgtggcaggcattcttcttaaagggactaaatgtgtagccccagttttgtgtggaaaaaatatttatttatttatttatttttatttatttatttttttttattgatcattcttgggtgtttctcgcagagggggatttggcagggtcagaggacaatagtggagggaaggtcagcagataaacacgtgaacaaaggtctctggttttcctaggcagaggaccctgcggccttccgcagtgtttgtgtccctgggtacttgcgattagggagtggtgatgactcttaaggagcatgctgccttcaagcatctgtttaacaaagcacaacttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagaccgggtggtggccgggcagaggggctcctcacttcccagtaggggcggccgggcagaggcgcccctcacctcccggacggggcggctggccaggcggggggctgacccccccacctccctcccagacggggcggctggccgggcggggggctgacccccccacctccctcccagacggggcggctggccgggcggggggctgacccccccacctccctcccggacgaggtggctgccgggcggagacgctcctcacttcccagacggggtggctgctgggcggaggggctcctcacttctcagacggggcggttgccaggcagagggtctcctcacttctcagacggggcggccgggcagagacgctcctcacatcccagacggggcgtcagggcagaggtgctccccacatctcagacaatgggcggccgggcagagacgctcctcacttcccagatgtgatggcggccgggaagaggcgctcctcacttcctagatgggatggcggccaggcagagacgctcctcactttccagactgggcagccaggcagaggggctcctcacatccccgacgatgggcggccaggcagagacgctcctcacttcccagacggggtggcggccgggcagaggctgcaatctcggcactttgggaggccaaggcaggcggctgggaggtggaggttgtagcaagccgagatcacgccactgcactccagcctgggcaccgttgagcactgagtgaacgagactccatctgcaatcccggcacctcgggaggccgaggctggcggatcactcgcggttaggagctggagaccagcccggccaacacagcgaaaccctgtcttcaccaaaaaaatacgaaaaccagtcaggcgtggcggcgcgcgcctgcaatcgcaggcactcggcaggctgaggcaggagaatcaggcagggaggttgcagtgagccgagatggcagcagtaccatccagcttcggctcggcatcagagggagactgtggaaagaaagggagagggagaccgtggggagagggagagggagagggagcgggagcgggagcggaaaaaatatttaaagatgatatacagtctacagcaaaccaccaaatgcatcatttgcaagtttaggctaatgataaaaatttcaaaggggccaggcacatttgctcatgcctgtaatcccagcactttgggaggccaaggagggcggatcacctgaggtcaggagttcgagaccagcctggccaacatggtgaaacccccgtctctactgcaactataacgattagccgggtatggtggcaggtgcctgtaatcccacttactcaggaggctaaggcaggagaatcgcttgaacctgggaagtggaggttgcagtgagccgaggtcgtgccattgcactccagcctgggtgacagagtgagagtccatctcaaaaaaaaaaaaaaaaaatttgaaaggggttttttaaagggtgcctgtggacaaagtgtgatcactgttgtgtggaagtgatcctttacgatcccaatcagatcacaccatttgctgttcacacatctccagtggcctcttttgcctttgagcatgcccaggtcgtttccccccagtctggaggctcttgccctttgctcctgctccagatattcattctgcatctgctccctagcagctttctctctgccatcctgccatcttttcttcttgccatgctagcatatgtttatttatgagtggcagctgtatctctagtcactaggtcaggacctggtatattctaggcgccctggaagcattctccagaaacagaggtgcggtgaggagagtttggatccagtttggactgcagataaatgtttgtgaggctgggcatggtggctcacacctgcaatcccagcgctttcagaggccaaggcgggaggaccgccagagcccaggagtgagagaccagcctgtgcaacatagtgagacccctgtctaattattttaaaaaaggttgtttgtgaaatgactgagcaagtaaataatgaaggagtgaaggaacttggactgatgacctggaacacctgtacccttctcccactccaaaaaacccctgcccatcctcacaatccagggccagcatcactctttttttctggaagcttcctcagtatcctgggtatgggtcccctgtgattcatggaggacccccagtggggctcccaatggcacggcattaccagcacctgcacctgctgcctccccagtcacccctggctcccagggttccattgcacagtagatcctctagaaatgcttcacagacattgatgtggtgagggaggagggacagggtagcagtctcaccacccattacccccacccccgcctctcattcaacgaacactttgagcacctggcactttgatcccctcagtgccaggcactgagctccaaatcccagactctgtaacgtgcaagcaatccttactctttctattttaatatcttaacccatgtatttatataccttgtcaagtaaaatgtattcttttttaatgattctcaaaaggatactcattgaaaaaatttagaaaacaccgaaaaatgcaaggaagaaaaatacaattctcttacaatcctgtataatcctgtgcctctaggcctacagtcagctccaagcaacggcacagacacctcctcctccggatgaccaggattgcctctgggtttgtcacaagctggaacagggtcctttggaggatggggctctgtgaagaaaaagaggtgaagtgtttggattcagtctgagccaaaggtgagcgttatcagtccccgaaaggcctcaggggttggctgactctctgagaggccggcaagactggtgaagttctggaaggggacctggggggtggggcccggggacctggggggtggggcccggggacatggggggtggggcccgaggcccaggcagaggccaaacattgcccagggcccggctttagtctgcaacaaccctcattgttctctcactgtctctaggccgctttatctgggtttaaggacacaagactccgtgaaagacaagctagttcttcttcctgccccggcagtccactgcaggccgatgcagacgcaaccacttcctcagccgctgtggctgagagcccgccactgcactctatgggcttggtgctgggtatggagaggagggtatgacatagcccctgccctcagagttttttcctactcattatccctgctgtctctggggacttcttaaatgtcagcaatcattgtcatcttcactgttgcctccgcagccaccgcacatggctgcacctgggccatctcctctgatgtaaaggctgtgcagccaaaatttgcaattcttcccccagcttttaaaattgtagtaaaatatatataacataaaatttgccagcttcactgtttgttaagtgtacagttcagtggtatgaaatacacgcattgtgctgtgcaaagtcaccaccacccatctccagaactcgctttatcttgcaaagcagaaactctgtacccattaaacgataacgtcccatccccatcccccttacccccagcccctgtaatgcttgttcttttctttttttgagacagggtctcactctgtcatgcagtctggagtgcagtggcacgatcatagctaactgcagcctcaacatcctgggctcaagagatcctcctgcctcagcctctcaagtagctgggactacaggcacagcaccacacctggctatttttgttctttcctttttcttttcttctcttttttttttttttttgagatggagtctcactctgtcctccagcctggagtgcagtggcgcgatcttggctcactgcaagctccacctcccaagttcatgccattctcctgcctcagcctcccgagtagctgggactacaggtgcccaccaccatgcccggctaattttttgtatttttagcagagacagggtttcactgtgttagccaggatggtctcaatctcctgacctcgtgatctgctcactttggcctcccaaagtgctgggattacaggtgtgagccaccgtgcccagcccttttttttctttttttattactggcttaggtttgagcagtgatcattttaagttttttttgtagagatggggtctcactgtgttacccaggctggtctcaaattcctggcctcaagcaatcctcctgcctcagcctcccaaagtgtggggattacaagtgtgggccaccatgcctggtcttcctgtttttcaaataaaattactttttatttatttatttatttatttatttttaaagatggactctcggccaggcaaggtggctcacacctataatcccagcactttgggaggccgaggcaggtgcatcacctcaggtcaggagtttgagaccagcctcaccaacatggtgaaaccccatctctactaaaaatataaaaattagccaggcgtggtggcgggcacctgtaatcccagctacttgggaggctgaggcaggagaatcgcttgaacctgggaggaggaggttgcagtgagctgagattgcaccactgcactccagcctgggcaacaacagtgaaaccctgtctcaaaaaaagaaaaaagaaagaaaaaaaaaaaaaacaaaaaacagagatagagtctcttttggctctctaatgcccatgggatcaatgccaaattcatctccctggcagtcaatgctctattctccttctcccctccacctctccacctctccagcatgctcccacaacattctgccccagtgacctcaacctgcaatgcccacctgtcccatggacctccctgcccatgcctctactccagccaatactggctcatgtgtacacaccatgctgtgtaccgtctgtgctttgctcatgccgcttgcctcacccgagtgcctctcctcccctcggctcgtctggtgcctgtttactctgcaaggccagcgcatgccccctgcatcctggaggtctcctctcatcatcccagccccaccgggctcctgcagcatttctgaggtctgtatctttcagagagctacgctgcacattgcctgctgctcccagcaatccttacacctttcacccctctccccatgtgtttactgggcacctagggcatgctgaacactgtttgggataaaacagatccaaggcttaatgagacagataccatctctgccctccagaggttacagtctgcggtcaggggtgggggggggacctacaagagaaggggcagagaccacagggcatgtggtcagatttaaagggaggggctgcctcggaagccacccagtccagaattgggcagccgtagaaggcttctgggagcaggcggatctgagctgagacccaagcataggcaagagtcagcctggcagaggggtggggcacagagctcatcttccaggcagagtcctgggtgcacatgtgtctggcagaaggagggctgagctgggcatgaggtggaagtgagccgggccatgcagagctcagcaggcctgaaggggaagccatgactgtctcacaatgcctccctcagcatgtgatgctaaggggcagaagctggctcccaggcacatctcaagggcaccaagccaggcaccccacagaaggccttcaggaaccctagttaaataggtgactaagcaaattatttcatgaataaatgtaacaatgaactgatacatttgaaggaaaccagagtattccacccctaaaatatgcctccttgacatttttttgttttgttttgttctgttttgtttttttgagacagtcttgctctgtcacccaggctggagtgcaatggcacgatcctggctcactgcaacctctgcctcccaggttcaagcaattctcctgcctcagccttccgagtagctgggattacaggtgtgagtccaattctgtatttttagtagagacagggtttcaccatattggtcagtctggtctcaaactcctgacctcaggtgatccacccgccttggcctcccgagtagctgggattacaggcatgagccactgtgcccggcctttgtgtgtgtgtgtgtgacagggtcctgatatgtcacctagggtggagtgcagtggcataatctaggctcactgcagctttgacctctggggctcaatcgatcctgcccccaagtggctgggactacaggtttgagccaccatgcccagctaactgtaaatttttttgtagagacgaaggtcttgctatgttgcccaggctggtctcaaactccaggcctcaagtgattcccccgcctcagcctcccaaaatgctaggattacaggtgtgagccactgtgcccagccttcaaaagatatttttgaactgaggtttctcccacatgatgggcatagcacgtgttaaaaataaaattgcttctttttcttgtcaatctatcttttgtttgaggagaatgcctcaatcacgaacttgtgagggatgaacaaagatgatgtcttttctctccttcccatgcatgtgggaatgggtgaatccagggtttctagtgctgtttccctgagtctttttttttgagatagagtctcactctgtcacccaggtgcaatctcggctcactgcaacctctgcctcctgggttcaaacgattctccagtctcagccccctgagtagctgggattacaggcacccagtaccatgcccggcaattttttttttttttttagactggagtgcagtggcacgatctgagctcactgcaacctccgcctctgggttcaagcaattttctgcctcagcctcccaagcagctgggattacaggtggctgccaccattcctggctaatttttgtatttttagtagagacggggtttcaccacgttggccaggctggtcttgaactcctgaccttgtgatccactcacctcagcctctcaaagtgctgggattacaggtgtgagccatcatgcccagcctccctgagtcttcagtaacaatcttgtttggcctctgggcaggccaaggaggaggaaagttacttggagcttctctaccctgattttcaaggaagggaaaacagaacgaaccgtgagccaacaggccctgttttctttctcttgggagaaggctggccttggggagatgttctaggaaaggtcacctttccactccatggtgccaggtaggaaaccagaaggccttccttacaaacgaagggaacatttcttgccagatctctggaggaaaacttggagggaaaggtttgctgctatcctggagaagaaagataacagtactatccaaccccatctgacctctggaaggcaaagtcaggcacattatctttcaagccacgtgggaaggaaggcaagagctagaggagagacatggaggaggcccagggagggcaagtgattttcccaaagctacatagccagccttagacccagctatgagttgaacccacaggaccttctctgtccattaaaccacggggaaggaggacagaagcagggaaaactgagtctgtttgcaggaagaagattcagaaaagcaactggacttactagaaaacgaaagaaaaattatctttcgaggggcaccacggctccacctgcgcagaatgcaatttggcaatgaggagtcagggactcaaatgtgttcctttccgttagcccagtaatttaacagctgggaatgcgtcctaaggcctatggccaggaaaacactcatacagagatgctgatcagggcattagttcaatggtaaaagactggagatgagccaaatgtctgacaataagaaagctgttaagaaaatcaagacagtcacaacatgttataggcccaatcagagggccatttgtgagggctttttcataacggagaaaaatatgaacatcaagaagtcaggtgtagaaaaacaggatgtgaaataatttatgctgaataacaacagctattttaaaaaggcataggagaaagataggaagcaaatgggccaaaacggtactgcagtggcttttgtgggatggaactggggagaacttggggaacttgggttttttattcttcttgttggcattttctttaatatatatgtattgcttgttttttttccagacagggtttcactcttgttgcccaagctgggtgcaatgatgcaatctcagctcactgcaacctctgcttcccgggttcaagtgattctcctgcctcagcctcccaagtaactgggattacaggcgcgcaccaccacacctggctaattttttgtatttttagtaaaaacagggtttcactatgttagccacctgaactcctgacctcaggtaatccgcccccctctgcctcccaaagtgctgggattgcaggtgtgagccactgcacccggcctgcttttttctttaaaaatgaaaaatattttacacttcttttctgattataaaatcagtaatcagtatggccaggcatggtggcactttgggagcccgaggccggtggatcaattgaggtcaggagttcaagaccagcctgaccaacatggtgaaaccccgtctctactaaaaatacaaaaattagccaggctgtggtggcatatgcctgtaatcccagctacttgggaggctgaggcatgagaatcgcttgaacctgggagtcagaggttgcagtgagcccagatcgtgctactgcactccagcctgggcgatagaacaagaccttgtctcaaaaaacaaaaacaaaaacaaaaacaaaaaacagtacattctgctggtaaaaaaataaaaatacaaacaatatagatatgtatgagagtaaaaagtgaaagaacccctgtaattccactgcccagagataaccagtgttaatagttaatattttcttagtcatgcacacacacataaaacacaggcagtgaggtaagtggtcacattcctgtacctatatacacatatacacatggacacccacatatacacgtacacagagtgaagggaaaatagaatctcaggaccccaaactcactatgccaaagggaaaagttaagcttggaaactgagtcacaccaaaagctgccctttctttttttctttctttctttcttttttttttcttttgagacagattctcactctgttgcccaggctagagtgcagtggcacaatgtcagctcaatgcaacctctgcctcctgggttcaagcgattctcctgcctcagcctcctgagtagctggtattataggtgcccaccactatgcctggctaattttcttatttttagtagaaatggggtttcaccatgttgggcaggctggtttcgaactcctgacctcaggtgatccacctgcctcggcctcccaaaacgctgggattacaggcgtgagccaccacacctggtcaaactgcctttctttttgtttctaagcagatagctacaaaatagaagaccgtgtctccgctggtggcttccctcaccctgaccatgtacattaacaccttatcttcacaggtataagacaaagacaagactagaaatcacccctccagccacccagagacaaatgcagatttactgagccggcgacagaggcataattgcctgtgcctccaccctctcctttcataggtaacacgtggatttggtgagcactaatcaaagcctcacagaaatgtgcccccttatctcactgcctaccctcctttttttttccttccccactttccctcctgcctgctctttctccttctaatactgaagccctcaaaatcttctctgaaaaaattatgcggccacagatcccactgtggcatatgcctcttttttggggcacgtcctcagtcttgtcaaaatagacctctaaatattgatggagacttgcctcagacacttttctgggttacaacacgcatacatacatatacacatacatactacatatacacatccgtatctatacatgcacttatgcacatatacacatacctgtgtgtatatatatatacacacatggacatgcatgtatgcacaaatacatacacatatatacatgtgtgtatatagaactactgttttggaacttattttttcatgtaacatgatatatccatttctccacatcaattcatatagatcaatcagcctcatcccctttatatttaacattttttctttatttaaaaaaacctttttttttagagatggggtttcactatgttggccgggctggtctcaaactcctgacctcaagcaagcctcctacctcaggcttccaaagtgctggaattacaggcgtgagccattgcacctggccagactcaatctctgttttttttgtttgtttgtttgttttttttgagataagctctcattctgtcacccaggctggactgcaatagcgtgaacacagcttactgcaaccttgacctccccgggctcaagtcatcctcacctcagcttcccaagtagctgggaatataggcatgtaccaccaggcctggctaatttttgtatattttgtagacatcggatttcaccatgttgcccaggctggtcttgaactcctgggctcacacaatccacccgccttggcctcccaaattgctgagattacaggtgtgagccaccgtgcctggctgcctcttcctttcctttcctttccttccttcttcctccctttatttttatttatttatttatttatttatttatttatttatttatttattgagatggagttttgctcctgttgcccaggctggagtgcaatggcccaatctcggctcaccataacctctactcccaggttcaagcgattctcctgcctcagccttccgagtagctgggattacaggcatgagccaccacgcccggccaatttttttgtatttttagtagagacagggtttctccatgctggtcagactggtctcgaactcccgacctcaggtgatccgcccaccttggcctcccaaagtgctgggattacaggtgtgagccactgcgcccagcccttttttcttttctttcttttttctttttttttaacttaaagacttcattctatttgatggctgcttaatttccactgtaggatgcagaatttttttttggtaacaaatctcttatctctggatttttgtgctgtttccaattactttaatcatgacatatgactctgcaatgaacatatacctcggcacatgtgtttttcctagaagtgtaattgctggagcaaacagaaggcatgtttaatgcttttcctccacattaatacattccttttagaagattgtacaggtatgaatttgaaggtagtactcatttccccatatttatgcagcattagcattttatctttgccaatggtataggtgagaaaatgtttcattgttggtttaatttgtgtctctttaaaacttggtgagactccttttccatgattacagcctatgtggatttcttattttgtgaattgcatttatgtacatctttggatggttatttattagaactgcattgccttaataattgcaacagtaatataaatcttagtttttgtttttgtttttgttttttttgagacaagagtctcactctgttgcccaggctggagtgcagtggcacaatctcagctcactgcaacctccgcctgcctcccagtttcaagaaattctcccacctcggcctctcgaatagctgggattacaggcttgtgccaccatgcccagctaatttttgtatttttagtagagacggggtttcaccatgttggccaggctggtctcgaactcctgacatcaggagatccacctgcctcagcctcccaaagtgctgggattacaagcatgagccaccatgcctggcctaaatcttaatttaaaaaaaatatatatatacttttatatatacatataccttatatatatcttttatatatatacaccttatatatatcttttatatatatatatcatatatatcatatatatatatatatcatatatatatatactctcacacacacatatacatatatctttaccccatgatctccaatctgaagacagagaaatttgcatgaaggaggcacactcagggtggtctgagggcagagccctggcgtgggcagtgggagttcctgctccaggccagctttgcacctcgcctgctgggagggctcaggcagagcatccacctgggcttctgggagcctctgcttccttcttcaaggcctgtggctttcaaaatcttaatatggaatcccaccatgatagcccagtgtttctcaatcctggctgcccttttgaaaaactggaggaactttaaaaatatatacctcttctcagtccccagagatactgactcaatgcctgacttaaaaagctgctcaggcgggcaaagtggctcacacgtgtaatctcaaccctttaggagactgaggtaggaggatcgtttgagcccagtagttcaggaccagcctgggcaacatggcgagaccctgtctctacataaataataaaaaatattagccgggtgtgatggtccacgcctatgatcctagctattcgggaagctgaggagggaggatcgcttgagcccaggaggtcaaggctgcagtgagccagatcgtgccactgtgttccagcgtgggcaacagcaaaactcttgtctcaaataaataaataaaaaataaaaaacaaaacaacaacaacaaaagaagaaaaaggaggaggaggagagaaagaaagaaggaagaaaaagagaaagaaaattagaatgggaagaatttcagttttataactgtaactgattattttaaacgtatttttattgtaaaaataaaacccggatacagaatccaatggttctgatgtacggcttaactaattactacaaagtgaactgcctccgagaccaagaaaaagaactttgccagccacagcagaagtctctccacgcgccccaccccagtcactccttcctcttccataagtagtcatccttattctgactcacaggacgcattaattgcgtttttaacagcaagtccgctggaggtgggaggcgctcggggaagcttctagggccgtcagggcccattccctccgctaacacccctctctccccaaccctcaggttgcgcaagacctctccagcccggcgaacccgtggggctcagcagtcctcctccacgctcaagatgcagtttgatgcaatcctagaggacgcagtttcaagtttctcgagatagagaagcgaaagaggatccgaaaccgcgcttcacatctgaatctgatttcagattcctccggaatatagcggaagcgcggggttgagggcgcagaccggggcagaggagaggcgcgcaggtctgctgggacgcagcgcggggcgagcagtggcgcactcgtggcctgacgcatccgcgagactgcacgcggccaggcgggggcacgaacgggttggggcatgcgcgggcagcgtcgagtgggtcccttgggggtgggggtggggggcagtcgaactagggagagagtctgtggaagggctcagttgtcacttcacacctttccccgctgtttattgatctttaactctctctgtgtgtcctctctctctctctctctccctctcctctctctgtttctctctctctatcccttcctgtccaccctttggggccatctcttccaagaaacaaccgtctctcccagcccatgggaaattgtctctcctgcgaacttatccaacctgagggggtctcatccatgccgataccggctgcttgtggaaccttgtaagagttcttccctctccctgtaaaatggagataagctgtgtggtgctgaggccagcgccgggcacactcaccctcaccttcttcctgagagaggaaagagcctggagacctggattctacctctgcccccaacccctaccacagggtagccctgccaccacctgctggttctttgggcaagtcactcttttattggacttccatttcctcagctctaaaatgaaggaggtgagcccagtgtggtggcacctgtagttccagctacctgcaggctgaggcaggaggatcgtttgagcccggggggcagaggttagagtgagcggagatcttgccactgcaccccagcctgggcaacagagcaagaccctgtctttaaaaaaaaaagtgattaaaaaataaaaataaaatgaaggagttaaacaaactcaggaattttgtatgaatggcataaatgagcacattagaaggaagcaactttccttctctctttttttcaatcctgtacaggccagcttcccctctgccctctgctcccctcctccctccctaccatcctccagccccccaaagccctcccaatttgagcctccttttggaaaacatctctgagtatggtaccgttggtatcggtgactaagaggctccaaggatacccttctgggggatttccaaaataatgaggaagtccatttccaaaatcatgggaagtcccaactgggcctcccagacagttggccactgagtctgtcccctaaaggatctgcttgacttgcacagtcttaaaggcatcatgtctggtttttaaacataatttcagttagtagccaacagttcagatcaagggatcacacggcctgtttgacctgttcttgcagggtcatgcatgctccactgagccatgggaagtgtccacacccagccatgggagccctgtgggatctgaaactgacatttctgctttaggtgccttaagctgaagaaatgcatagtagcgggaattggagtgcaagtgagtgcagtaggggaagtattttgccataagaaaccctaagcctctatggacaagaaattctccaggggcagactggccttgaccccagaaatgtcacattggactcggccttggttttcctcatctatacaatggtcaatcagactagtggtttgttttttgtttgtttgtttgtttgttttctctgtcgcccaggctggagtacagtagtgcaatctcggctcactgcaacctctgcctcctgggttcaagcaattatcctgcctcagcctcccaagtagctgggactacaggtgcacgccaccacatccagctgatttttgtaattttagtagagatgaggtttcaccatattggtcaggctggtctcaaactcctgacctcaggtgattcacctgccttggcctctcaaagtgctgggaatacaggcgtgagctaccacaccgggctcagatttgtgatctttaagggtcctgtgaactcagcactctagacattttagggcctgtgcacttccgcggtaatggtttcttgttttgtcctcactcggagggcacactcctcaggctagtggcatgggccattgtcctagagtccctggggcccggccctaccatgaattctgcgtctctcccttcagcccttgtccctccctccgtgccatggcttggcaccgttcttgtctttgcaaccctccacaggcgcctcctcctctgacccttcaaaccttcctgccctcaaactctgtctccctacacctccctgccttccactctatgtttctgccttctccttcagcccacagatattactgaccatggttgccagccctatgttaggcctgggaattcaagagagaattagagccctctgtggactcccagctctactagggagagagacccacaaatagggatagagaggggtaaatgcttcagtgggtgagtacagggcctgcaaggccactcagctcagactgagggggtcagagagagcttcctggaggaggcagtatctgaagtgagaagcggagggaagtccaccaggcacacacagcaggtcggcgagagtgccgcaggctgaggatgcggcatatgtgaaggcccaaggaaaagcagagcacgcagcatgcaggccctggaggggtgaggctgcacctggggaggtctcatcccaaggctgacagcaggtttagggtctggaaacgccacatgccctgctgtctccctggctgttcaactccttccaggcctgacattcaccagctccttgaagacaagatcatgcagatacttttcagcacacacatctggtctccccggcaagtgcccagctctgggcctgtaccctcccagcagcaccacacaagatggccgacctgagctcatcaactgctcactggggtccctcccctgaccctaaccctgcttcagtcacccagtaagggatccctggcatgcaacatgtccttggctccagaggggttagatccttggggctccagcaggcagagctggagcctcgtggcgttttgagtactcatagggacggtttgggttgttgcagggatgtgggaggcactgctggtgtttgggccagagaccaggacggccgaacatcctgcaatgctcagagccgccctttggaacaacaacaacaaaaaaactgtccaaagtattctgattttcaaatgtcccttctgtagcgtcccctagtttgtcccactttctttccgtgtcctgaccgaaaatctagagtgccttgactgtttcatgacccaaccagctgcagggcttcccagcaggcttgaacccaaaccagggcctcgaacattcccaggcactgataaagaagtctaggttattgcccaaaaccctgaacaaaactggccccaggcttgagcccaattccttaaagcctcagaaaaattccacaccctgacctcatggctgtggacacacctaggtggacctccctttctctcctggctgcctgaggatgtgcacggccctgtggaagtgagctcccctaataaaagcctggactcatcaccccggcgcttcgtgcttctctctttggaatcccagctggccccccttcaggatgattcaggcactcccttgtgggaactcctctgccaccacttttggggcaaccctagctgagggctgggggtgagacaagacactttcacatattcgtgtcactgaaaaaccaaactccatttcacacctaaacatgaggtatttttgaatattttattttattttattttttatttattttattgtattttttgagacggagttttgctcttgttacccaggctggagtgcaattgcacaatctcggctcactgcaaactccgcctcccgggttcaagcgattctcctgcctcagccttccaagtagctgggattacaggcatgcgccaccacgcctgactaattttgtatttccagtagagatggggtttcaccatgttggtcaggctggtcttgaactcctgacctcaggtgatccacccacctcggcctcccaaagtgctgagattacaggcacccagcctattttttatttttgagacagagtcccactttgttgccaggctggagtgcagtggcacaatctcggctcgctgcaaccttctcttccagggttcaagtgattctcgtgcctcagcctcccgagtagctggaactacaggcgtgcaccaccatgcccagctaatttttgtatattcagtacaggcggggtttcaccatgttgcccagtctggtcttgaattcctgacctcaggttatccacctggctcgacctcccaaagtgctgagattacaggtgtgagccactgcacccagcctttttgcatattttaaaacatactctgagaacacaaatgaatggaagattggactttgttttgtagggaacttcgccaagagtttaaccatttcagagaatcacagcactgatagcggcttctctcccaggttcaggtcaccaaaacagcatcctccaccatcggcgttggtggctgggtatctgtgatgcttcccatgcaatgtgagcagctgcccactgagtcccggagtcctaagacccttccctcacaatcctaagacagtattgccttttcactgtgatggcattggtgacataaaagccactgtgggcagggtgcagcggctcgcacctgtaatcccagcactttgggagggtgaggcgggcagatagcttgagccgcagagtttgcccagaccagcctaggcaacatggcaagaccccgtctctacaagtaataataataataataataataataataataaaattatctgggcatggtggcacgcatctatagtcccagctacatgggaggcttaggtgggagaattacttgtgctcgggtggtagaggctgcagtgagccgtgatcgtgccgttgcactccagcctcaaaaaaaaaaaaaaaaaaaaaagccactatgggtgaaactgctggaacttcaggaagcaaggcagtggccacagactaggcaggtctctgtgcactcccctagataagcacttgtggggacaaaatatgcctgtgtcacttaagtacatacccttttgatctcctgtgtgatgaagcagggatgcacacagagcgcctgctccagagcaggggactggctcgcagaaacaacttgtcagaggtggagccacgcgagcctctggtccagggaacacagtttatcttattttttaaattaattaattaatttatttatttatttatttttgagatggagtcttgctctgtcacccaggctggagtgcaatggctcgatcttggctcactgcaacctccgcttcctgggttcaagcaattctcctgcctcagcctcctgagtagctgggatcacaggcacacaccaccaggctgggtaatttttgtatttttagtaaagatggggggtgtcaccatgttggtcaggctggtctcgaactcctgacctcgtgatctgcttgcctctgtctcccaaagtgctgggattacaggcgtgagccactgcgcccagccgagaacactgtttatacgggaaagaacgacgaacagacacatgatgggtattcagatctgggcatttggcagacagacattttctcataaatgagcaaagtgagcctgtcccttcaagaaactgaagcatttgttgccaatgataaagttggaacttggagctttcaagggaaaattagaattttggaaaatttgtgtacaccaccacaagcttgacaacttctcaatatttaaagatttttctgatgcgatggatggcagtgctaacaaatgctattttttgacactgttcagtgacatgtcatcttttgggagatgtatgtgatttaatgggtacaaaatttcaaagaggccacatgatgctgcacatcacatgtaggtaaaacagccattcacggtacaagataggccaggcacagtggctcatgcctgcaatcctagcaccttgggaggctgaggcaggcagatcacttgaggtcaggagttcgagaccagcctggccaacatggtgaaatcctagctctactaaaaacagaaaaattagccaagcatggtggcatgtgtctgaaatcccagctactcaggagtctgaggtgggagactcacttgaacccaggaggtggaggttgcagtaagccaagatggtaccactgcactccagcctgggcaacagagtgagagtccttctccaaaacaaacaaacaaacaaaagtacaagataggcccgtgcattttaatataataaagcatgaaatgttcattgatatgggttcagattctacattataatcaaccttaaagaaacaattgcttgttaagttttggcgtagcattaaagaagaatattcacaattatctgaaaaagctatcaaaatactcgtctttttttccaactccgtgtttgcgggaggctggattttcttcaatcaaaacaatatattgcgggacgcagtggttcatgcttataatcccagcagtttgggaggctgaggtgggcgggtcacctgaggtcaggcgttcaagaccagactggccaacatggtgaaaccccatctctactaaaaatacaaaaaaattagctggatgtggtggcgcactcctgtaatcccagctactcgggaggctgaggcaggagaatcacctgaacctgggaggtggaggatgcagtgagccaagatcacaacattacactccaggctgggcgacaagggcaaaactttgtttcaaaataaaaaaataaataaaaattttaaaagccccaacatattgcaacagactgaatgcagaagtagacatgaggctccaacagtctttaattaagacagttgcttgagagatttgcaaaagtgtaaaacaatgctgtttttctcactaaatttctctttgttttggaaatgaaggtatttttcgtaaaaatatgtttatgtttacatgtaatgagttcattattactttttgataaattaataaatatctgggtcctcaataattcttttaaaaatttttttataatttaaaatagagatgagggctgggctcggtgtctcgcgcctgtaatcccagcactttgggaggccaaggtgggcagatcacttgaggtcaggagttcaagaacagcctggccaacatggtgaaactctgtctctactaaaaatacaaaaattagccgggcgtggtggctcatgcctgtaaacccagctactcggaggctgaggcaggagaatcgcttgaaaccagggggcggaggttgcagtgaggggagatcacccccctgcactccagcctgggcgacagagcaagactccttttcaaaaaaacaaacatgtagcaatgaagccattaaaataatttattttttatttctttttctttttgtatgaatcgactttggataagaaaaaaatctactttttaaagagctgggtttgtgtggtgggacacctattgggtgcaacaatgtggagaacactgccctctggcggtcactcccagtatagtaccagagaggtggggaagcttcccttgctattctaggactgaccatgagacggcagaagaatacagtatttgcttcttttctatttctattatacttgcttttctttttcttttctatttctatttgcttcttttctattttctgttccttcttttctatttttttaaatttaagtgtagctaaggggactcactatgttgcccaggctgatccccgactcctcgggtcaagtgaccctctcaccttggtctctcaaagtgctggaattatgggcatgagccaccatgcctggcctaaaaccctgttcctaatctctaggttggtcctcaaagcctcacactcagccgggtgcccagggattggggcaggagtgacctcacagagctgcccacagtaatgatgcctgaagtgctccagctagcaggctaagccttgtcttctctgcctccacagcaactcatagcagccctagggaaggccacatcccagacccctaaacccagagagacagaacgcagacctgggtggcaaggactcagtaagttattgagtgccaaaccgggccaccactgtgcttggctttaggaaaacttgacatctataaaacttttaatctctagtaggtgctcaaaaaagccattcactctttcatgtaaccaagaaaagatgtttgagcacctgcaaagtgccaggcactgtcctagtcactgaggacacagtgagaagcaaaaggggcccaggtcctgcccacatgggacttataatttggtgagggaacaaaaaaaatttagtctcaaaaaaccaaagtttggttagatgctgtgaaaaaggatggggttctttaagggcacctgagagaggggtcttgtttttcctggaagccaaaaagaagcataaaggttgatacggtttggacgtttgtcctccaaatctcatgttgaaatgtgattcctggctgggcatggtggttcatgcctgtaatcccagcactttgagaggccaaggcaggcagatcacttgaggtcaggagttcgaggccagcatggacaacatggtgaatccccatctatactaaaaatacaaaacttagctgggcatggtggcacgtgtctgtaatcccagctactcaggaggctgagggaggacaatagcttgagcctgggagacagaggttgcagtgagccgagattgtagtgagccgagattgtgccactgctctccagcctggctgacagagcaagactctgtctcaaaacaaaacaaacaaacaaaactacctcttaacttagtcccctcgcatttttttttttttttttttgaaacagagtctcagtctgttacccaggctggtgtgcatgcagtggcacaatcatggctcaccttccaccacagactacaaacatgtgccaccacatccgactaagttttttttgttttttttgttttttggggtttttttttttttttttgtagagatggggatctcaccatgttgcccagtctggtctcaagctcccaagctcaagtgatcctctcatttcggccccctaatgtattgtcattccagccatgagccatggtgcccagcatctcctgctttttaactttgtttttaaaagcttcttgatttttgtttcaatttaatactgtcttggcaactttttaactttttgttgtttagtctcactctcttgcccaggctggaatgcagtggccagatctcagctcactgcaacctccacctcccaggttcaagcgattctcttgcctcagcctcccgagcagctgggattacaggtgcccaccaccatgcccaactaatttttgcaattttagtagagacggagtttcaccatgttggccaggctggtctccaactcctgacctcaggtgattcacccatctcggcctcccaaggtgctgggattacaggcatgagccactgcgcccagcccaattctgctattaaaggactctgatgcattcttcagtatgccaattgcatttttcagctccagaaattctgctctggatgttttttaattatttcaatccctttgttaaatgtatctgatagaattctgaattccttctctgtgttattttgaatttctttgagtttcctcaaacagaattctgtctgaaaggtcagagctctgtttctccaggattggtccctggtgtctaatttggttcatttggggaggtcatgttttcctgggtcatgctgctagcagatgttcttcggtgtctgggcattgaagagttcagtatttattgcagtcttcattgtctagccttagttgtcttttttttttttttttttttttttgagatcaagtctcactttgtcacccaggctggagtgcagtggtgcgatctcggctcactgcaacctctgccttccgggttcaagcaattctctgccttagcctcccaagtagctaggattacaggcgcctgccaccacgcctggctaatttttgtatttttagtagagatggggtttcaccatcttggccaggctggtcttgaactcctggactcgtgatccactctccccagcctcccaaagtgctgggattagaggcgtgagccaccgcgcccagctgtacccgtccttcttaggaagactttccagatattgaaaggacttgggtgttgtgatctaagctgtatctgctttagggggcacccacacccagtaacactgtggttcttgcagactcatagaggtactgccttgatggtctcagacaagatctgggcgaattctctggattaccaggcagagactcttgttctcttccctaactttctctcaaataaatggagtctctctctctgttctgagccacctgaagctgggggtagagtgacacaagcacccctgtggccaccagcactgtgacagtgctgcagacccaaagccaagacagcaatgggtcttgcccaaggcctgctgtaaccactccctggccactgcctatgacagttcaagggcctggggctctgcaatcagctggtggcaaagccagccaggcctgtgtccttccttccagggcagtgaggtctcccaggccctaggcaggtccaaagatgctgtctgcaagccagggactagagtccaaaatcttacaagtctacctggtgttctattgtactgtggctgagctggcactcaaatcacaagacacagccctacccgctgttccctcccctttctaaaggcagaggagcctcaccccgtggccaccaccaccacaggcccacagggagttctgccagagttcccttaaggcccaaaagctcttcagtcagcttgtggtgaatgctgcatggctgggactcacccttcagggcagtgggctcctctctggcccagggtaggcccagaaatgccacccaagagtcaagtcctggaattggggaccccaagagtccacttggcactctacccctctgtggctgtgctggttcctaaagtgtaagacaaagtcccctttacttttcactctgctttgctcaagtggaaggagcctcaccccacagccaccacagctgggaatgtgctgagtctcacctgaagccagcaagtctcagaggctcactgaggcccttgacatagctcctgggcatcgctgctggttattcagggcccaagggctcttcagtcagcagggggtgaatgctgccaggactggctccttcccttcaaggcaacaggttctcttcctgccaagggtgtgtatagaaatgtcatctgggagctagggcctggaagtggggtctctgactagtgccctatcctgctgtggctgagctggtagtcaagatgcaagacaaaagtcctccccactcttcccctctcctctcctcaagaggagggaaggggtctcttttggagccatgagctgtgcagcctggggttaggggaggggtgatgccagcatgcccttggctgccccagctgatgtctcaataggtcatgtgccctgccccccaactggctgagtgattttgagtgaccttgaacaagtcatgtcaccactcagagacagataatgggtatgaatcacgcattcattcaacaaacacttcttgggagcctgtcgttgcccaggcctgttcaggacactgtgcaggtagcctggagcaggactctcgctctgtttccaggctttccagtctagtggagaatctggacacagacatgaacaggtggtcacgctactgtagtgtgcacagagtgacccagcatggtagcctgggggacataggcgctcttgcaaaccaactcctggggactcggcccaaaccctttgctagccagtcctccgtggaggccatgatccgctgcagctgctgagcctggggtggtggatgggtgcagccggcctggggaaggagggtatggcacagatgccctccgtccccgatccccaggcatccctggaagtggctttggggaacaagtccctcgaatacccttgagattattttgtcatttgctctttttcttgaatatgacggggggtggggggcggcagatgtgtggctgttacagtttgccctgcttgccctccctctctccctccccattcccatcttccctccccattcccatcttccctccccattcccatcttccctccccattcccatcttccctccctccatctgccatttgcagaaccccttacacattttcccaaatcagcagccctgtgagttcctttggatcagacagctgaaaaacaatagcatcaattaaatgttcattgttggaaagcagaaagaactgtcgcccctaatcttgctcctcagagagaaccattgagaatatcttggaaaatagacatctagttttttttttctccatgtgtattcattttattttatattttattttattttatttatttattttttaagacggagttttgcttctgttgcccaggctagagtgcaatggcatgacctcggctcaccgcaacctttgcctcctgggttcaagcgattctcctgcctcagcctcccgagtggctgggattacaggcatgtgccaccaagcctcgctaacttttttttgttttttgttttttgtttttttttagtagagacggggtttctccatgttggtcaggctggtctcaaactcccaacctcaggtgatctgcccacctcggcctcccaaagtgctgggattataggcatgagtcaccgtacctggctttattgttattttttattttttgagatggattcttgctctgttgcccaggttggagtgcaatggtgccatctcggatcactgcagcctctgcctccccggttcaagtgctaggtgcagtggctcatgcctgtaatctcagcactttgggaggctgaggcaggcagataacctgaggtcgagagttcaagaccagcctggccaatatggcaaaacgccatctctactaaaaatacaaaaattagctgggcatggtggcgcacatctgtagtcccagctactcaggaggccacggcaggagcatcacttgaacccaggaggtagaggctgcagtgagccgagatcacatcactgagctccagcctgggtgacagaacgagactctgtctcaaaaaataataataataattaaaaataaaaattgatatatagttttacactatagggtcatattgtatatatttcataactttgcctttgcaatccatgtggttcctgtttaaagagagagagactgaggcagagaggatggagtgactgtcagaaaatgttggggcagagtggggcgtgaacccctcttcctgtcctgtccctcaggtgccttggagcaatttcagggcccacctaaagctggtagggcagaggctgacggcccattggactggcccctccgcctgctttccagatggtgcaggacatggagcctctgtcagccatgcagtgtgaccaagacccagcccccacatgagcacccacctcacatgccctcctggacacacagctgggctgcatgccatggtccgggcaaagcatccctaatgttttctctaacgctgaaaaacagacaaaaagagttcagaaatcacccccagatcccaccactctacacatcgtccagtaagaagggaaatgcccatctttacccatcagctcccagcaccaccgtcccatcccccacccctgccacattctaacctctgttaccggtttggggcatagtcttcccaaactttccccaagtttaagtagacatcactttacgggtaagtgtatagatagtttacagaataatacattttttccttcttaaacatgggattaggccgggcgcagtggctcatgcctataatcccaacactttgggaggccgaggagggtggatcacctgcagtcaggagttcaagaccagcctggtcaacatggtgaaaccctgtctctactaaaaatacaaaaattagctgggtgtggtggcacatgcctgtaattctagctacttgggaggctgaggcaggagaatggtttgaacctgggaggtggaggttgcagtgagcagagatcatgccactgcactccagcctaggtgatcaagcaagactccatctcagaaaaaaaaaatgggattatagagccaggtgtggggatgcacacctgtagtcccagctacttgagaggctgaggcaggaggaccactaaagctcaggagtttgagaccagcctgggcaacacagtgagacccccatttcaaaaaaattttttcaatgggattatgctcttaatattgatctgtattttttacactcagtaatatactatggatatttttttcagctcagtattgatagatttaccttatccttttccaatgactgcatagaatttcattgcatggacatagcataatttattcactcagttcacaattgatatatagctatacatataaacatagacaaaaatatagatagatgttactttcagttttcttatttttaaaaaacctttattttcggtttggggtccatgtgcaggtttgttatattggtaaactcgtgtcacaggggtttggcgtacagattatttcgtgacccaggtactaagcctcgtacccagtatttactttttcctgatcctctccctcctcccactctccaccctctagcaggccccggtgtctgttgttcccctccatgtgtgtatgtgttctcatcatttagctcccactcacaagtgagaacatgcagtatttgttgttctgttcctgatttagtttcctagagataatggcctctagctccatccatgttcccgcaaaggatatgatctcattcttttttttttttttttttttttttgagagagagagtttcgctctttttccccaggctgcagtgcaatggtgccatctcagctcactgcaaactccgcctcccaggttcaagcgattctcctgtctcggtctcctgagtagctgggattagaggcatgcgccaccacacccaggtaattttgtagttttagtagagatagggtttctccatgttggtcaggctggtctcgaactcccaacctcaggtaatccacttgccttggcctcccaaagtgctggaattaaaggcatgaggcacctcgcccagctgatctcattctttttttatggctgcatattttcagttttctgcattacaagattacagaaaacattaatatctacacctgtaactatatatttgtatcagtctctaactgacattgtcacgctttatttctatagggtcaacttctggaagtggaatggctaattcagagggaagtggatttaaaatgttagtacctgttgtcaacttactctcctaaatttacactcccatgcacagagggtgagagtgcctgctccccaggctccccagccctggatgtaaaaagttttctgcctttaaaaatagctgctctcaggaggctaaggcgggcggatcacgaggtcaggagatcgagaccatcctggctaacacggtgaaaccccatctctactaaaaatacaaaaaattagctgggcgtggtggcgggcgcctatagtaccagctactcgggaggctgaagcaggagaatggcgtgaacctggaaggcagagcttgcagtgagtcaagatcgtgccactgcactccggcctaggcaacagagcgagactccatctcaaaaaaaaaaaaaaaaatagctgctcttcccttctttgcaaggcccaaggttgcccgggtggaaacacatcagccccagcaggcagggaggaggccgagggaggcaggtgtggatcctgggagctccacttcctcatcccaagaaccggggactgtgttacctcaggggcaaagggctttgcagatgtgattaaggtgaaggaacttaagatgtggagataatactggattaactgggtgggcccaaactaatcacacaagtccttaaaagctgataacccttcccagctgtggtcggagagaggcgaagttgctggctttgaacatggaagaagaggccgtgggccaaggaacatgagcagcctctagaacttggaaaaggccaaaaaatggcctctcccctagagcctccaggagcacagccctgtccacacctggattttagctcagtgagacctgtgttgcacttcttgtctttagaactgtaagacaattaatttatgttgttttaaaccacaaagtttgggattatttgttacagcagcaacagaaaataaatacagtagacacaaaacagcctatcaccatggccagatttctcaggacctgggaggctaggcaggcctctctggctccaactccttcagggaagaaccctttagccaccaaaggcgctgtcttgctgtactgattctcccaccaagaaggccctgctgcctccctttggacttggccttcagctccttccagcccagccactacaccctccccacctgccttctggagcccagtcaaccctcagggagcacctcttccttgaacacagtgcgattgggctcacctgtacctcctcttttgtcgggaggatggagggccaaagagaagcataggataccttctctcctctcctgagccctgaatccatttggggcacacagacccacagagaacaagggctcgtgtgtacgcctgggcccttctccaggtgagcaccagccttgaagggcaagacagcgttgttcctctgtgccttccagagcttttacttgagttagatggtaaggctacctaagcagatgcttttaatggccctgtcacaccccttcagcccctgatgacagccacagttgtggtggaccgctgtaaatggatgctgatggtggctcatccctcaaagcttacgttctgtgaccctccactcctctgtcccaggactttctcaaaagctgcagaatcttgctgggcccctgggcaagcacagcctggtagggtggggaagctgacctccaggccatccacagccagtgcggggaggagccaggggaggaaccccagcctcccaccctgagatggaccattctgggccaggtgtgatgccttgtgcctgcaatcgcgctactcaggaggctgaagcaggaggatcgcttgaccccagccaggggttcaggatggaccattctgggatgacttctgtatgagacaagcaacctcaatcacacaccttttgtcagcatttccactgtccctgtggcagcccctcccttcctcacccctgcttcctgggaggaccccgataaactcttgcacccaagtccttgtctgaggctctgcttccagcagaagctgtaagggtctccagggtcataggaatttaatcaactgaacaatccacttgttttatagcctcctgacctgcagcctgtttcttcctaaaccccgtgcggaatgcactcgcctacttggttaaaatcagctcctggccgggcgtggtggctcatgcctgtaatcccagcactttgggaggctaaggcaggcagatcgcatgaggccaggagtttgagaccagcctgggaacatggtgaaaccctgtctctacaaaagatacaaaaattggccgggcacagtggctgacatctgtaatccaggcactttgggaggccgaggaaggcagatcacttgaggtcaagagatcgagaccaccctggccaacaaggtgaaaccccatctctactaaaaatacaaaaattagctgggtgtagtggcacgcaggagaattgcttgaacccaggaagcggggttcaaggttgcagtgagccaagatcgtgccactgcactccagcctggtgatagagcaagactctgtctcaaaaaataaaaatacaaaatacaaaaattagctgggtgtggtggctaattaattagttccagctattcgcgaggcttaggtgggaggattgtttgagccttgagcctgggaggcagaggttgccgtgagccaagatggtgccactgcattccagcctgggcaacagagtaagatcttgtcacacacaccaaaaaaaggctgggcgcggtggctcacgcctgtaatcccagcactctgggaggccgaggcgggcggatcatgaggtcaggagatcaagaccatcctggctaacacggtgaaaccttgtctctactaaaaatacaaaaaattagccgggcgtggtggcaggcgcctgtagtcccagttactcgggaggctgaggcaggagaatggcgtgaacccgcgagacagtttgcagtgagcggagattgcgccactgcactccagcctcagcaacagagcaagactctgtctcaagattaaaaaaagtcagctcctgacagagccctcaacttacagatgaacccaagtgacctctcctcatgagcctgctacggtctccactcaggaggagagatggcttcatcaccatcgcatgcggcccaggtgctggtgtgatggctcactgcatctacgccactggggcttggcctgtacacacgaccacacaacctctcccctctcctcacccgataaaaccctcctgtcactctccctggaagaggcactgctttagagaatcctcccagcgtccttactcacacctagtaataaaatgcctattgataacccctgggtttttttttccaggtaacaaacccaaactaaggtgctcaggaacgatcacaaccaaaacttgagtatcttgtatgccagagggactatcaataagggccctgagacctagcaaagtcacccctacaacacacaggcttggcagatggtttcagtctaatccagaccagagagacataacaaccaaatgtagccaggaaatttgattggatcctggatcaggaaataaaaaagacaatttaagggaaaagttgaagaaatgtgaatgtcctgtagactgcatgtttgctgatctttttgaatgaatgttattctcgggtgtcatgatgattctgtgattccgtaggaggatatctttgttcttaggagacgtacaccttcgtgtttatgggtgaagggccaagagattggcaagttactttcaaattagaaaatagacagaggctgggcatagtggctcacacctgtaatcccagcactttgggaggccgaggcaggcggatcacctgaggtcgggagtttgagaccagcctgaccaacatggagaaaccccgtctctactaaaaatataaaaattagctgggcatggtggtgcatgcctgtaatcccagctgctcgggaggctgaggcaggagaatcgcctgaacccagaaggcggaggttgcagtgagcaaagatcatgccattgcactccagcctgggcaacaagagggaaactccatctcaaaaaacaaaaacaaaagaaaaagaaaatagagacacagagacagagattaaaaggatggggacgggagggagaaaacatgctaaaatgtgaagaattggtgaaatctgggttgggggcacacaggtattcattgaagaagaacaggtgtgcacaaagggctgcaagcctccagattaaaaaaagaagctattcttgagacccgtggctcacgcctgtaatcccaacactttgggaggccaatgcaggcagatcatgaggtcaggatttcaagaccagcctggccaacatggtgaaaccctgtctctactaaaaaatacaaaaataagctgggcatggtggtgggtgcctgtaatcccagcaactcaagagcctgaggcaggagaatcacttgaacctgggaggcagaggttgcagtaagccgagattgcaccactgcaccagcctgggcaacaagagcaaaactctgtcaaaaaaaaaaaaaaaagaaagaaaagagaaagaaaagacagaaaggaagaaaggaagaaagaagaaagacagacagaaagaaagacagagaaaaattactggggagccaggaaggcctcatggaggaggtactatctaggatgagcctgaagtttgggtatgttcatggcagagacaaaggtgttcccagtacaggaaacaacacgtgcaaaggtgtgagggttagatgtgacttagatatgattagccgatgggttcctcctgcttcctgtacgaacaaaaccaattcattgagaccatggtactgcagtagagaaagaaggtagctacgtggaagacggagttattactaaaatcagtgtccccaaaggctcagaggttagagtttttcaaggacagtttggtgggcagggggctgggggagaaggaatattgattggttggggtgaaatcacaggggtgtggaaaattgtcctcgtgctccaagtcctctgggtgggggccacaggaccagttgagtcacgagtcggtggtccaggtggggtcagttgatcatcagaaatgcaaaagtctgaaaagacatctcaaaaggccgatcttcggttctacaagagtgttgttatttataggagtaactgaggaagtcacacatctgtgacatccggaacaatactgataataatttactgcgccttcatcttatcagagttcaggcccttctcataaccctatctttgtggacttttattagctttacaaaggtggtttagttttgggaagggctattaccatgcttgccttaagctaaaaactaaattcctcccaaagtcagcttggcctatgcccaggaatgaccaaggacagcttggaggttagagggaagatggagtccactctgtcagagttctctcactgtcataattttgcaaaggtggtttcactaacacaatgtggcaggtgttatgggttgggccactcatcacatattcaagttggatcaggtaggatcttagacaactacaaactcaccttttctcaagcccttgcagctagcagtggccatgtgacacaattttgaccaagaaagctactggggaatcccaggaaagtctttgctttcctgatacggctgcaaacttgtcttctgtctccttcctcctggaactcagacctaattgacgtggggctggccatgcaggagacagaaatatgtaaaacacaatactcaccaacagtagaatacacattcttctagaatacccaaggaatgctggtcaagataaaccatatggaccaggcatggcagctcatatctgtaatctcagcactttgggaggacaaggtgggcagattgcttgaacccaggcattcaagaccagcctgggtaatatggcaaaaccccatctcttcagaaaatataaaaaattaactggaagtagtggagcacacttgtagtcccagccactcaggaggctaaggtaggagaatcgcttgaacctgggaggtcaaggctgggggacagcctgggggacagagtgagaccctgtctcaaaaaaaaaaaaaaaaaaaaagacaaactgtatgttggaccataaaatgagtctcaataaacttaacaggattgaaacaatacagagtatgttctttgatccaatggaatttaaaaaattcttttagaaatcaatagcaatatgatatccagaaacaccctcaaaggaagcaagacttctaaatacatattctctgggccacggaaaaagtcacaagggaaattagaaaatatttataagtgaaagataacaaaagcacaaaatattaatttcttttagtagatttttatttatttatttatttattttgaggcagaatctcactctgttgcccaggctggagagcagtggtgtgatcttggctctctgcaacctctgcctcccaggttcaaacgattctcctgcctcagcctcccaagtagctgggattacaggtgcccatcaccacgctcagctaattttttcatattttcagtagagacagggtttcgccattttggtcaggccagtcttgagctcctgacctcaggtgatccgcccgcctgggcctcccaaagtgctaggattacaggcatgagccaccgtgcccggcctcttttagtagatttttaaaattttcttagagacagggtcgtgttctgtcacacaggctggagtgcagtggtgcaatcatagctcgctgcagcctcaacctcctgggctcaagtgatcctcctgcctgggcttcccaaagtgctggtgaagggttgacaagcattgcatgctgggttctagacagaaatacagttacaattaagcattaatcaggctacactttcgcccacttccttgtttctagaagtcagcatgagatcctgaccgattgcatccccattgttcccatagacagggtctctgacataagaatcataaggcttttcttgaaggatcacttcagatgtttttcagacgccaaattccagcagccagtttggacactcccacagaggaatgggatcagcatgggaatacagctgcttcctctcccagtcccatgacttcaccctgcacttttccaccaatcagtgatctccacacttcagcccactccaaaacccttaggaaccctagccccaggctcctcagggagatggatttgaggttctctcccatttctttgtttggtgaccctacgattaaacctctttctcttctgcagcctggggtcttgtattgacatgctgtgtgctttgggcaatgaacttctcacagttatactgaggtcacaggcatgagccactgtgcccagccctctttcaatagtttttttttttttttttttttttggaggcggagtctcgctctgttgcccaggctggagtgcaggggtgcaatctcggctcactgcaacctctgcctcctgggttcaagcgattctcctgcctcagccttcagagtagctgggattacaggcacgcaccaccacgcctggctaatttttgtattttcagtagagacagggtttcaccatgttggccagactgatctcgaactcctgaccttaggtgatctgcttgccttggcctcccaaagtgctgggattacaggtgtgaaccactgtgcccagcccagtagattttttttttttttttttttttttgagacggagtctcgctctgtcgcccaggctggagtgcagtggtgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatcggcccgcctcggcctcccaaagtgctgggattacaggcgtgagccaccgcgcccggcctagatttttttatttcagaattgtatctggctattccaggatttccatgggcttcttaattcccctggtctcctgagagtctcgcccagcacacgtgcaggtcaggagttggcaaagaatcttagggtgttcttaggcagatgttgctctccccctccccaaccccaatcatggctcctactctgctgggatttcctccctccatccctagctgctggacctgcccttaactcctgttaccactagggatgtctctgagtcacatggcaccagagtagtttagaggcagtgaatctgtatggtcatctgcacaggtctgcagcaacctcaatccttgcctcctcagaagacagaattcaaccaaagggcataaggcagagtgagagaccaaggcatgttttagagcaggatcaaaagtttattaaaaaattttagagcaggaatgaaaggaagtaaagtacacttggaagagggccaagcaggcaacttgagagagtcaagtgcacggctcaacctctgacttgggattttgtatgttggcacgcttccgcggttttgcattatttctcccctgattcttcccttggggtgggctgtctgcatgcacagtgggatgacagcacttgggagggagcatgctcagtgtgtgtactgaagttgggcacatgctcacttgaggcattcttcccttaccagtgagtgttcctagaggaaggttacatgccagttaaactccaccattttgcctcttagtgcgcatgctggagcccactcacctaactcctgagatcttacccagaagctgcttcaggtgtttctatctattaggagactgcctttccctggcactggctgcaaccacttattattttagagagacagttaacaaccgcctgaccatcacctgatggttgcctgacattcctggtgttggggggccctgttgatgtctcgctaactatctactgtaacactctgacctctgatccctgaagccagtgtccagtggctttcatcctctggataccagagggaaaactggagaaacatggatgtcagcccacgacccccttctttcaagagtcacatccactccactctcctgctctgtgctgttctccaatgccttcaaagggttgtttttttctattgcatccagagctgtaattgtttttgttgttgttgttgtttttgagatggagtttcactcttgttgcccaggctggagtgcaatggcgcgattttggctcactgcaacctctgcctcccaggttcaagcaattctcctgcctcagccttctgagtagctgggattacaggcatgcaccaccatgcccggctaatttttcgtatttttagtagagatggggtttctccatgttggtcaggttggtctcaaactcctgacctcaggtgatccacccacctcgggctcccaaagtgctgggattacaggtgtgagccaccgcacccggccccaaagctgtaattgttattgccagatttgtccatctgccaatggcagataaatgactctgccactcctgggagccagaagttagtcttgcccttgtgtgatcatcttcccaggtattgaccatgtgacatatgcacatggtttcacacaaatggagccatacagctcatgtggctttatagtgcgtattttccctcagcaatacatggatgtctttcagggtccaggtttatagatctacattgtcctttttaatagctacatagttttccatagataatttattttcatagttccagttcagtacacaaacaataccgtgtaaaacactttgtgcagttctttttttattacttatttatttattaatagagacagggtctcactatcttgtccaggctggtcttgaactcctggccttgggcaatcctcccacctcagcctcccaaagtgctgggaatacagacatgagccaccatgcccagcccctttgtgcatctttgtgcacttcaccagttatctctgaggacaaatttctagaaatgaaattgctgtgtccaaggcatgcctccatgacaccccgtcaactttttgagagtcttttgagaccctcttcagtaagcaaaagaaaaacataaatattttctacccacctctggccccagtcacccaattccccttcctggaagcaactagcatattaatttctatataattcttctgggcataatccatgcttctatataaaaagatagtaatatatttctcccaatccatttcacacaatggtagccagctctgaacacaattctgcccttctggcacattctacttgttttgtttcagacacagggtatctctgtcacccagactagagtgcagtgacgtgatctcggctcacctcagcctcgacctcccaggctcaagcgatcctcctacctcagccttccaagtacaaactacaaacaggagccaccacatctggttaatgttttttcgtgtagagagggggtctccctctgttgccacctcctaaaatgctaggactacaggcgcgagccaccatgcctggcccttctagcacactttaattttttttttcctggtattttcacaaagatggaatggcatattttaaaagtaaagatactaagaataaaacacaatattgtaagctttataaatgggccccaaaatattttcccaagatgttttttaattagtccccaaagatggaagaaaagagaagtaactaatgttaacatgttatatcctctatctttgattgtctgtggacaagtgactgtcaatggcagagacgcaggacagagggagaggcgtgaccctgccacccatgtcctgctaaggccacgtctgtagccagccctgttctccaagaggagatgccccttcacctcccaaccttggccagggcttatttttatccaccccaatcaccagctagcctggcagccctataatttgggagtctggccacccctgtactatataattccctggcagaccttcagaccttaggttggcccctttgacttgcattttggtgatgctctgtggccagaagtctcttcggcaaattaggggtcagaacttggtgcagtggagtcaaaatgggggagggagtctggggcctttggattttttgcaatcgtctcacttccaccatcaaattgcatctggccgtcctggaaatatgagtgtaccaccacttctcaaaggagaccagttggtgctgagagtggggcttgctataaaaaggtgaggccggatcaggcgtggtggcctgtaatcctagtactttgggaggccaagacaggtgaattactggaggtcaagagttcgagaccagcctgaccaacatggaggaaccctgtctctactaaaaatatgaaaattagccgggcatggtggcacacacctgtaatcccaggaactcaggaggctgaggcaggagagccacttgaaccagggagatggaggttgcagtaagccaagatcgtaccactgcactccagcctgggtgacagagcaagactctgtctcaaaaaaaaaaaaaaaaaacctgaggctggaggagcagcatggggggccggtggctcaggtgctgaggcagccttcagtaaagcccatccctgtttcttgggcaccatcactttagagaggcagaattcctctgcagcctgtcttagattgatcatgtggctacatgctgtcatgcctcaaggaagacactaggggtcctttatatgcctgtcaaggttgtttcactaaaactcagcttccatcctacctctcctccagaatccacaaaataaagccctagctccttaggaagaagggaatctagtatgtgttaaattgaaatggaggtcaggcctgaagaatccccgagcagataaaaccagttcggcatcataaatgatctaagccttgcttgatttacaaacataagtaaaactgaacttaagctatttcttgtaaatgcttatattaaagaaaaacagaagttgaacttaaccaatcagaagcagccaacaagcttataaggctgaggcagacggatcacctgaggtcaggagttcaagaacaacctggctaacatggtgaaaccctgtctctactaaaaatacaaaattagccgggtgtgatggtgcatgcctgtaatcccagcccctacctgggaggctgaggtaggagaactgcttgaacccaggaggcagaattttcagtgagccgagatcataccactgcacttcagcctgggcaacagaacttgactctgtctcaaaaaaaaaaaaaaaaaaaaggaaaaaaaagaaagtgacattctttacttaccacaggtcaggaaccctgcaaatggactgtgtagacaagatatgaggccagttttcccaaggggcttttattgactttataagtcaaatttgattccttaaaggaaagcacaccattccagtcaaagccttggtaaaataatcaatttatcaaattgtgtcctgttgcaaaagaaaacagattcttattgcacttgtgtaaattactattttgccataaattaagaatactcacaaatagcttccaaattttggagaaatcaggtatgttccaaattttgttcacagggatatattttattcaattgctacaagctgtaaatagcttaaaagttttcttgactctgaaaaataaaacaaaggatcagcaatgttttaaccaaaaagtcagaaagattattccatgctattaactcctgttctgcttggtattcatgaacatttcagctgtacatgagagtcctgaatgttttttctctattctaatgtcacagtctccaaagttatcagaaatctgcattcaagagcacctgttaagagttctatagttgattataaaactaccttttgaagaggattgaaacaagacagcaattgtctgtgaatgacaaaaggtctttgggcctccattaaagccacaattgactaggaattttggttatttctgtggcatacaacaatttacttaacaattataactactaataacatacactaagttgtacaagaattatagagtttcctgtaattttggaacacataccaattacatatttatacaaatacagcacaaagaaaaccaaacaccatttcatatttgacaatgcttcctatatgatttttataccaaataagccaaatttcactgttgcattattgacgttaaacccaattcttaacaaaaccttatagacaaatgtatttcatgttaataagtttgaccataaggttaagattctcataaatctttttttataacctttacaatttttgttaaagagtaggtctgctctaagagagacctgttctgcttttattccaatgctcaatttacagaaaaaccgaataatacccctttaaccttagccaatatgttcacatgcagaatttcttttacaagattaacttttcacaaaccttccacaacttgcttaaactttcagctttatcttatctaacttaatgttttaatcctttaggcaaagccaaaaaaaattcccatgacttcttataatcttttaccaaaacacatttcactttctttatataccttgcatgtaaaactgtttcttcagtagtctcaattacatgttacatttttatgtactaggtgtgaagcctaagacatcagacagaagtgcaggtaagggctgactctttccagcatcacagggggcatggttatccacatgtccccaagcctttctagaatctaatgctccaaagtaggtaaattgaacaatttttaaaagtcaaagaagcaatttatgaccttaaagcatttagcaaacctaatatctgacctgcctaatttagatcaaatgtctaaattttcaagacacttttattttaccaataatctttttttgtttgtttttgagacggagttttgctcttgctgcccaggctggagagcaatggcacaatctcggctcaccacaacctccacctcccagattcaattgattcttctacctcagcctcccgagtagctgggattacaggcatgcgccactatgcctggctaattttttgtattttcagcagagacagggtttgtccatgttggtcaggctggtctcaaattcccaacctcaggtgatctgcctgcctcagcctcccaaagtgctgggattacaggcgtgagccaccatacccatctaccaataatctttaaaactgtctgtatttcccaaaaattacttaagtcatgtgaaccaaaaggcattacactttttatttttctgattaaatgtttgatttaagctctttttattattattattattatattttttgagatggagtctcactctgtcgcccaggctggagtgcagtggcatgatctcagctcactgcaacctccacctcctgggtgtacgccattctcctgcctcagcctcccgagtagctgggactataggcacccgccaccacacctggctaattttgtatttttagtagagatggggtttcaccatgttaaccaggttggtcttgatctcctgacctcggggcctcccaaagtgttgggattacaggcgtaagccaccgtgcccggccctttttttttttttttttttttttaattactggcttaggtttgagcaatgatcattttaaattaaattcccattccctggatggtggagaccaagaggaagttccgccacgtgtttacaaggtcaagctcccaaggacatttttcaacatgtggtctctgggcaagatggtcgccctgagtaacagaaaagataagaaagggaaaggagagaaagagagagagaaaagcattgcctgcagcagggtggggaaggcaaggtgctcagggaagccagagaaagacccacccatcgcctcaatgctgaattaaaagttcaggcagccacttgtcagttgcaaagggatcttttccagcagtcccatcagctctcaagtttccccttctagggaggaaaacactccccatgttccatatccctgtacatgcctaatcctgtcaccaacagccctcagcaaagagtgcaaggcagattaattcaaagacaatagcagttaacatcctatagtgccaaacccattctttgctgagagcgactttactgaggtggggggcctctaactccctaaactttaggaaggctttaaccttcctgagttgagacttgaacccaagttcaatcaagcgtccttactttttttttttttttttttttaggcagagtctcgctctgttgccaggctgtagtgcagtggtatgatctcggctcactgcaagctccgcctcccaggttcatgccattctcctgcctcttacctttcattaagaggaagctttaaacttctctgtcttaggagagactctaactcccctaagttgggcctctaacccaatcccatcctttatccaggtaaatgcatcccacttatctaaagtcaaccaatcagtgctatagtctattttctttgggttgggggtttcctcagtattgtcccttccgtggttcacctgaaagatgttaccagaaaggggtcccaatccagaccacaagagaaggttctttttttttttgaaatgtagtctcactcttgtcacctaggctgaagtgcaatcgcatgatctcagctcattgcaatctcaaccttccaggttcaagtgattctcctgcatcagcctccagagtagttgggattacaggcacctaccaccaagcctaactaatttttgtatttttagtagagacggagtttcatcattttagtcaggctgatcttgaactcctgacctcaggtgatccacccacctcagcctcccgaagtgctgtgattacaggcatgagccaccgtgcccagccaggttcttggatcttgcacaagaaagaattcaaggcgagtccataaagtgaaagcaagtttattaagaaagtaaaggaataaagagtgactactccataggcagagcaggcagccccgaattctatcccttgacagcattaacctctacctcctggagtgtcatttgctttccattctgttatcagatcctggcctgtttctccctagagtataagccccttgggaacagggacttagtctgctttgatcgcagctgaatctcagcacctagagcagggatggcatgttgagggcaatcagctggtttcacggaacaaattcaggggcaaagtccggatccgaacccaggtcttgtaaccacccaatgggttcaccttgcccgctgcctagacagacagagccgattcatcaagacagaggaattgcaataaagagtgattcactcagagctagctgtgcaggagactggagttttattattactcaaatcagtctccctgagcataacaggatcagtttttaaggacaacttggtgggtggtgggaagccagtgagctaggagtgctgattggtcaggtcagagataaaattgtagggagtcgaagctgtcctcctgtgctgagtcagttcctgggtgggggccacaagatcagatgagccagtttatggatctgcatggtgtcagctgatccatcaagtgcagggtctacaacatatccaagcactgaggttaggagcagtttagggagggtcagaatcttgtagcctccagctgcatgacttctaaactataatttctaatcttgtggctaatttattagtccttacaaaggcagtcttgtccccgggcaagaaggaagtttgttttggtaaagggctgttattgtctttgttttaaaccataaactataaactaagttcctcccaaagttagttcagtcaacgcccaggaatgaatgaggacagcttagaggttagaagcaagatagagtaggttaggttagatcttcactgtctgtcataattttgcaaaggcagtttcagtttgcctgatgctaaatggttgctttttccatctgccatcctactacaggggcataatgagattatgtgatggaaggaggctgcagagttagctccagctgcgctcaggatttcaacccaggtcctccagtcccaggctgtcctggtggagtccctagtgggtggggctgcaaaagagtttgccaaacacccacgatccttcctcctacctcttgcctggagagtttaagcaaggggatttgagggaatggtagacatctgggatatttctgagcatggcagcaaaacccattcaaagttctccagcagggtaagggttactaatgtggccggcccctgtatgaaacccttggccagcttggactaaaggccagtatccagtgccaggcctgcagtcacagtcagatgggtctgtgtgttcctcaccagcacaaagcggattctggtcaccatggaaactgggcccctgggcttccttctaaggacatctttggacagcatccaaccagcccctcctgcccaagctggccctgaggagaggctcagagtggcctggggtatccaggattgcagggctgacctgttgactcagtttctgatcaggattccaagaaaggagagattgccaggattagcacatttggcagggggttgtgggtggctggaaccctgtgctcaagactggaaaataggcgactgcagagtcactgattccagagctacaagggaccttcagcatcaactcatccaatgtctttgttgtccagatggggagactgaggcccagagaggggaagcaacttgcccaaggtcatgcagggtgtgagtgtcagagtggaaatggttttaggttggattccctgaagcaaggccctgagtctaggatttgtgtgaaagtgattatttggaattctttgggagtagggagagatggaggccaaacaaaggggtaatgtcaagtcatgtaccacaggtggggaggtggggggtacccagtcctggagagagctcagctgtggaggcaacgtgggtcacacctatgaagttgtcagaacagtcactaccttttttttttttttttttttttgagacagagtctcactcttgtcgcccaggctggagtgcaatggcgcgatctcggctcagtgcaacctctgcctcccgggtttaagcaattctcctgcctcagcctcctgagtagccgggattacaggcgcccagcaccacgcccagctaagttttgtagttttagtagagacgagatttcaccatgttggccaggctggtctcgaactcctgacctcaggtgatccctccaccccggcctcccaaagtgctgggattacagtcgtgagccatggtgcctggccgaacagtcactaacactaaaaaagaaaaaaaaaaaaaaaaaacctgacaaatagagccagagaaggccatgaagagatggttctcatgcttgtatgcctgataacaaaaattatcacaaaagactgcaaaaccacagccttgcagaaaggccaatcacaaccttacacaaaaagtctttctgcaaggacatctgcctggcaactgcctgtccaaacttgaactggcgtcaccatgttactgatctttgtagccaaggataattatttcaagaccattatgtaatcctcctcatttttcccttagaaacctctgtcttcttttacctccctgaatacccgcatagtttactatggctgcatattcccaaagcaatgctccatttccaaatatattccttttcttttggagagcatctctccgttatttaggttgacacatctcaaagttatcctgatcaggtgacaagggagctggaaattctatggctccccacttgccagctgttgacaaaaatctgccccaggagagcgtgaattcccaggtacttccagggctccctcctgagcacgggccaggcaggtgatgcagcccaggacagtccttcaacaaagagacgcagacgctggctgtagggggtggagcacactgggagagggtggcccagaagtgaagggagcaggaaggaaagatctcatctgctccagagttcaccaggttctctctcattgtacggaggaggaaactgatgctcagagaaggcaagtcacttgcttaaggtcacacagttagttaatagaagaggcaggcctgggaccaactcccctggctccaagtcctgtgagtttcccattttactcagatgtttctcatcacgttcccaccctgagctgctggaaatcagggaggtgaaagaagagaaagccaagaggagacaggcaatgcttggacaagccattggtgtgtctggctccaactgacacaccggctctgcacacaggaggtgttctagaaatgctcagagaggccaggcgcagtggctcacacctgtaatcccagcactttgagaggccgaggtgggcagatcacgaggtcaggagttcgagaccagcctggccaacatggcaaaaccccatctctactaaaaatacaaaaattagccgggcatagtggcacatgtctgtaatcccagctactcgggaggctgaggcaggagaattgtttgaacccaggatgcggaggttgcaatgagctgagatcgcgccattgcactccaggctgggcaacaacaacaaaactccatctcgaaaaaaaaaaaaaaaagggaaacgctcagagaacttgctggccaatgtgcacatcctccaaacgcaccagaccagtgagtgcacagaagtcagaggggcagaggcgaagctggagcacagagcacttggttttgctccgtgttgcagaatcccaagcagggagggtgctcagagctatggcaccatgcccttgatgtgtggaaggggaaactgaggccttaagagataatagacacccaaggctgtgtggatcagtgagcaggccagagtctggtctgtggagtcccatgtggtcaccgttcccttaggtcccccaggactgggcaccggctggttatttctagaatcagataactcatgtcccctcctctccatctgcctggccctgctcacaccttgttcatctctcttctagagcatcacaggtcctgagggcctccgttcctctagttctcctcctgcaatccaatcctctcgctgtctacagagcaccactctgtggggcacttggactttctgtctctcaggcactccccatttcacaccttacatttcaaccctgaaactcttgcagttcccgcagtgagacctgctttactgcccaccagtctgcctgctccaaggtccctgttcttatctgtcttggtcccaatgtatccccaatatttggtccagtgcttggtctgtacgagatatttgtcaaacttttgatgaatgtggggccagcttcgtgagtgtgcgacctgtgcaactgcacagggccctgggcttagaagggctttgcacttgtatgctctgctgatgctgtcttgaagttcttaataatttgaacaaacatacctgcattttcatttttcacaaggccctacaaattatgtggctagtcctacatgatgaatgaatgaatgaatgaatgagtgaatgaatgaatgcctctgtgtctttgcacatgctgttcccttttcaccagggacaccgattccaatcttatttggttaaggtcccggcacactaaagatgctctcaagaaaggacagaggacagagatgtgggcagggttgggggtaacatgggatgggaaccatctagggactagcacttggggtaagcttggaggcctttggggcaagaagaggtagggggctactggagccagggagagctggatccagggaggagtaaatattcccacctctctcacctccctgcttccatcttctgccagtgcgtttcataggctgagtccagctagaagccagaggatagggcccaggtaatgccgcctgtagaggcccagccctttggcatagagcaagctgagaagcgcagagagtggatggggtgtgaaggaggcaaatggaatcaccataaaacctgtgttaagcatccttcccctgcaaagccttccgtggtgtccctgggtataaggggattcctctccctgcgtctcacacaatgacagtagcagtaagtgtctcacactctgtgccagccctgtgctaagtacctatgctgtagagtccgttattgtcccatcttacagatgaggaacctgagacgcagaaaggtcacagccagcatatggcggaactggcatttgagctcagggctgcctgaagctgaaacccctgttttttttttttttttttttttgagacaaagtctctcggctcatcgcaacctccgccttccaggttcaagcaattctcatgcctcagcctcctgagtagctgggaccacaggcacacgccaccacacccagccaattttttgtaatttttgttttgttttgtttgagatgaaatctcactcttgttgcccaggctggagtgcagtggcacgatcttggctcactgtaacctctgcctccccggttcaagtgattctcccgcctcagcctcccaagtagctgcgattacaggcgcccgccactacgcctggctaattttttgtattttggtagagacggcatttcgccatgttggccaggctggtcttgaactcctgacctcaggtgatccaccctccttggcctcccgaagtgctggggttacaggcatgagccaccgcatccggctgaagaaaatattttttttttttttttttttttttttttgagatgggatctcactctgtcgcccaggcaggagtgcagtggcgcgatcttgcctcactgcaacctctgcctcttggcgattctcttgcctcagtctcctgagtagctgggattacaggcgcctgccaccatgcccagctgctttttgtatctttagcagagacagggtttcaccatgttggccaagctggtttcaaactcctgacctcaagtgatccgcccacctcagcctcccaaagtgctgggattacaggcatgagccactgtgcccagcgaagaaatttttaaacaggtaaaaaactaaaaggaattgtctaatgagcccaacatacccatcatcagcttcaacaatgatcactacaaggcacaggtttcatccacacttccacccactcccacccacccatgcctccctctcttcagagtgtttggaagggaatcccacacatcaggcacatcattttaactgtatttccgcacataactctatacggcaaaggctccttttcacaaaaacagaaccacaatatcattatcacacctatacaatgtaacgacagtttcttaaatcatcaaatatgccatcaaaattcatatttcaccaaattattttataaatctttaaaaaaatacagtttgtttgaatcaagatataaagtccacgcattgtttttatttttatttatttatttgtttatttatttttgagtcagggtttggctctgtcgcccaggttggagtgcaatggcatgatctcggttcactgcaacctccgtctctcaggctcaagcaatcctcaggtgcaccccaccatgcccggctaatttgggtatttgttgtacagatgggttttcaccatgttgcccaggctggtctcaaactcctggcctcaagtgatcagcccacttcagcctcccaaagtgctgggattacaggtgtgagccatcgcacccggccgaagtccacacattgtgtttgcctaatatgcctgtgttgtaaatgggctgtaagcccctctcatggagcctttgagtatcatcccaaaatgaactacgaaatctcacttggagaggcatatgcagtggaagggtttatattcacaggtcctggagacaggagatacaccatgccacatggagggcgactgggaagcagctcccaggatccactgagcaggtggggagctaaaaggcataaagatttcattgtgtgttgagtggccctaagtcgcagttatgggggttgtggaataaggagagagggacttatgggagggaccagccttcccacactggggcacctggccacctggccacctgggtggggtgttcacagcctgtttgtgaggatgttgaagcttcaggaaaatacgaagtttttcaaatatataatacagtatcccttaggtttcctttttttccccttcaatcttgtttattctgtaagtttcccttatatctcttcttttttttttccttataatttctatttggtggtggttgttgaaaaccttgagttttccatcggtagagttttccgcagtctggagcatgctgatcttggtggtatcattttagcaatattcttctgtcctttatatttgttttgtttcagagacagggtcttgctctatcgctcaggctggagtgcaatggcatgatcatagctcactgaactcttgaactgctgagctcaagcgatcctcccatctcaggctcctgagtagctgggactacaggtgtgtgccaccatgccacggtctctcatactttatcagattctaggtcatttcttctctcctcttcttcctttttctacttcttttcagcaagattgtttaataggtgacactttgttcttccatcaggagatacataatacttgatgatctttttttgtgatattagcaactgctggtaatcattgcctgcattgtttaactcattacggattgcaaaacagtgatattccacttctatggttccttgtttattagttggaatacttcacatacttcatgtaaatgattcaccaatcttttcagttttctgaagattgtttttttgtcagctgcagtggctcatccctgtaatcccagcaactcaggaaactcaggcaggaggctctcttgagaccaggaatgtaagaccagcctggtcaacaaagtgagaccctgtctctaaaattttttttaaaaattagctgtgtgttgtggcatgcacctgtggtcccagctattcaggaggctgatttgggaggattgcttgagcatgggaggtcaaggctacagtcagccgtgattgcatcacagcattccagcctgggtaacagagtgagaccctcactcaaaaaaaaaaaaaagattgctttttagtggattatccagaaaaggctcaaagaaacaatattccttgggtttttccatgttcataatagtttatttatgtcttttatacttaaaggtcagtttcactcagtataaaatccttggttcacatttcctgagacatgtcattagattgtcttctggcataaggcattgctgttgaaagtaagatgacaatttatttttcctttgtttataagtgatttgtctgtttctttttttctatttatttatttatttatttatttattttgagattgagtttcgctcttgttgcccaggctggagtgcagtggcatgatctcggctcactgcaacctccacctcccaggtttacgagattctcctgccttagcctccgcagtagctgggactacaggcacgcaccaccacgccccgctactttttgtatttttagtagggatgaggtttcaccatgttggccaggctggtctcgaactcctgacctcaggtgatccacccacctcaacctcccaaagtactgagattacaggcttgagccaccgcgcccggactgatttgtctttttcttgaattccctgcattttttcctttttcttcaatgcccagtagttttcttagacacaggtctcagggttgatttgtccaggaatacagtgtgcctcttcaatagttaatttctttttttttttttttaagacggagtctcgctctgtcgcccaggctggactgcagtggcacgattcggctcactgcaagctccgcctcctgggttcacgccattctcctgcctcagcctccccagtagctgggactacagacgcccgccgccacacccggctaatttttctgtatcattagtagagacggggtttcaccgtgttagccaggatggtctcgatctcccaatgtcgtgatccgcccgcctcagcctcccaaagtgctgggattacaggtgtgagccaccgctcccggcccaatagttaatttcaagccatgttttatgtgaggatcatttctttcaattatagtttggtttttgttctatctactggtttggttttctttagagttcttcacagcccctttatttctagattttaaattgctggcagggtggggtggctcatgcctgtaatcctaacattgtgggaggccaaggcgactgggtcacctgaggtcatgagtttgagaccagcctggccaacatggtgaaaccctgtctctactaaaaatacaaaattagctgggcatggtggcgggcgcctgtaatcccagctaattgggaggctgaggcaggagaatcgcttgaacccaggaggcagagtttccagtgagctgagatcgtactactgcacttcagcctgggcaacaagagcaaaactgtctcaaaaaaaaaaaagccctctttttatttttattttataaaaaaattaatttttagagacagaatttcgctctgtcaccgggctggagtgcagtggtactatcatagctcactgcagctttgaacttttggactcaagtgatcttcccacctcagcctcccaagaaggcaggacaataggtgtgccccaccatccctggctaatttaaaaattttttttttagagacggtctcactatgttgcaggctggtaaatgccctcttttgtatcttatttttctcttaaagtcttatttattgtaattattctctttcatttcttttgttttcatcttcatttctgaaattgttgttcttttatatttaattatttgctgacctttataatctttttattttttaagagtcaagggcaatcccagcactttgggaggccgaggtggatggatcacctgaggtcaggagttctagaccagcctggccaacatggtgaaaccttgtctctactaaaaatacaaaaattagccaggcatagtggcaggcgccagtaatcccagctactcagtggggaccgaggcaggagaattgcttgaacctgggaggcggaggttgcagtgagccgagattgcgccatctcactccagcctgggggacaagagcgagacttcgtctcaaaaaaaaaaaaaaagagtcaagatctcactctgtcacctgggctgaagtgcaggggcacgatcatagttcactgtggcctcgaacttttgggctgaagctatcctcccaccttggcctcccaaagcactaggattagagacgggagccctggcaccagggcttattatcatttttcccaaatctcccttcttttttccccaattacctaacttctgagtttaattttgatttatataacttcataacgtctaccatttaaataatttttctaattttgctttgaaatattaggttgtagttttcatctgcttcatgaacatgttctggcatgcttgctttgtaggaattctgttctgctacttattctcttttttcttataattttacatgagattcaacctctttctttttttcctttttctttttttaagtgacggggtcttgctatgcccaggctggagtgcaggtgtgcaattatagcacgctgtagccttgaccttccaggctcaaatgatcctcctgcttcagcctcccaatagctggggcaacaggtatgtgctactgcatccagtcacatttgatccttttctgatgctactttataaagtaaaatgaggctgggtagtggcacacacctgtactcccaacactttgggaggctgatgcagaaggatcacttgaggtcaggagtttgagactagcccgggcaacattgcaagaccctgactctactacagaaaaaaaaattatccatatgtggtagtgcatgcttgtagtcccagctactcaggaggctgaggtggaaggttcccttgagcttgggagtttgaagttacagggagctatgatcatgccactgcactctggcctgggtgacagagcaagactgtctctaaaaaacccacaaaactggctagacatggtggctcatgcctgtaatcccaacactttgtgagacccaggcaggtgaatggcttgagccgaggaattcaagaccagcctaggcaacatagtgagaccctgtagaaaaaattagctggggggagtggcacacacctgtagtcccagccacttgggaagttgaggtgggaggatcacttaagccccagaaagtcaagtctgcagtgagccatgatcactccactccactccagcctgggcaacagagcaagactctgtctcaaaaagaaatcccacaaaactttacgttaaaaaatgtttacaatcacctgagtcttcagtgagtcatatgtttttattgatggagggtcttgccttgatattgatggctgctgactgatcagggtggtggttgctgaaggctggggaggctgtggcaatttcttaaaataagataaccgtaaagtttgccatagtaattgactcttcagctcaggaaagatttctctgtagcatgtgatgctatttgatagcattttacgcacagtagaatttctttaaaaattggagtcaatcctctctaaccctcctgctgctttatcaacagagtttatggaatattctgaatcctttgttgtcatttcaacaatgttcacagcatcttccctgggagtagatgccaccttaagaaaccacttaagttgatttatccatagaagcagctccgcatccgtccaagcttcatgagattgctgcaattcaatcctgtcttcaggctccgcttctaattctagctctcttgctatttccaccagatctgcaagtttttttccctcctgaagtcttgaaccccctcagtcatctatgagggttggggtccatttcttccaaactcctcttcatgttgatattttcacctcctcccatgaatcctgaacagccttaatggcatctagaatggtgactcctttccagaaaattttcaatttactttgcccagatccatcagaggaatcactatctgtggcagctatagccttatgaaatgcattacttaaggagaagaaggcttgaaagttgaaattactccttgatccatgggccacagaatggatgttgtgtttgcaggcatggaaacaacattcatctccttgtacatctccatcagagcccatgggtgactagatgcattgtcagtaagcagtgatattttgaaaaaaaatattttttctgagcagtaggtctcaacagttggctgaaaatattcaatgaacagataagctgttgtgcaagttttttttttatagagcacaggcagagtgaacctagcataattctttttttttccccacttcaataataatctgatatagtctagatttagttttttttttttttttttttttttttttttgaggcagagtctcactctgtcgcccaggctggagtgcaatggtgcaatctcggctcactgtaacctccgcctcccaggttcaagcaattctcctgccttagcctcccaagtagctgggattacaggcgcccaccaccgcacctggctaatttttgtatttttagtagagatggggtttcaccatgttggccaggctggttttgaactcctgacctcaggtgatccaaccgcctcagcttctcaaagtgctgggattacaggcgtgagccaccgcacccagctgatttagcataatttttaagggctctaggacttttggaatggtcaatgagcattggctttaacttaaagtcaccagcttcccctaacaacttaaagtcacctgctgcccctaacaagagagtcagcctgtcgcttgaagctttgaagccaggcactgacttctcctctctagctgtgaaagtcctagatggcctcttcttcccacgtaaggctgtgtcgtctccattaaaacacctgttgtttagtgtagccaccttcatcaatgaccttagctggatcttctgaataactttctgcaggttttatgttatgtatatgacatatttccttaaaccccatgaacccacttctgccagcttccaacttttctgcagcttcctcgtctctctcagccttcatagaattgaagatagttggggccttgctctgcattaggctttggcttaagggaatgttatggctggcttgatcttctgtctataccactcagaaactttctccatatcagcaagactgttgtgctttcttatcatttgtgtgttcactggagcagctcttttgatttccttcaagaaattttcctttgccttcacaacttgactgtttggtgcaagaagcctttgtaactgctgtggtttttccccacccacctgcaccttaagcttgtgggtttaacccgtcacctagttttgttgtggatatgatctgtagatctggggtttttaaaatcctacttttgttttcatttggggtgtattattctactaggtctgccataacagacttacacaatggcaacttattttctggaggctggaagtccaacatcaggtgccattagtttggttcctggtgaggcctctcttccagcttatagacagccaccttcttgctgtgttctcacatagactttcctctgtgcaggtgcagagaaaggaagatatctggtgtatgctgtgtcttcttcttatgaggacaccagtcctattggattagggccccacccttatggcctcagttaattgtaatttagacctttaaatctccataaaggtctatcttgtttcatttgtgctgctgtaagaaaaaaacaagaacaaaaacacccaagactatttccctccactggcaatgagaaaaagaaaaagaaaaaaaaacagctaagactagttttttttattaatttatttttatttcaataggtttttggggaacaggtggtgtttggttgcatggataagtcctttttttttttttttttttttgagacagagtctcgctctgttgcctggcgggagtgcagtgcagcgatctccactcactgcaacctctgcctcctaggttcaagcaattctcatgcctcagcctcctgaatagctgggactacaggtgcatgccaccacgcccaactaatttttgtatttttagtagagatggggtttcaccacgttggccaggatggtctcgatctcttgacctcgtgatccacccccctcggcctcccaaagtgctgggattacaggtgtgagcctctgtgcccagccccagataagttctttagtggtgatttctgagattttggtgcacccattacccaagcagtgtacactgtacccaatgtgtagcgttttttgttgttgttgtttcttcctgagacagagtctcgctctgtcgcccaggctggagtacaggggcacaatctcagctcactgcaagctccacctcccaggttcaagccattcttctgcctcagcctcccgagtagctaggatcacaggcatgtgccaccacgaccagctaatttcttttgtatttttagtagagatggggcttcaccatgttagccaggatggcccaatgtgtagtcttttatctctcaccccacttccatccttccccaccacccgccaagttttcaaagtccattgtatcattcttatgcctttgcgtcctcatagcttagctcccacttatgagtgagaatatatgatgtttggttttccatacctgagttacttcagttagaataatagtctccaactctatccaggtttttgcaaatgccattatttcattctttttcatggctgagttatacgtgtgtgtatatatatatgtgtgtgtgtgtgtatatgtgtgtgtgtgtgtgtatatatatatatttcaacatatatataccacattttctttatccacttattgattgatgggcatttgggctggtttcatatttttgttattattgttgttcgtgaccaagcagaagttttgatttttatgtagcttgaattgatccatctttttcgttctttcttttcttttttttttttttttgtttgtttgtttgtttagtagagatgaggtcttgctatgttgcccaggctagtctcaaacccctgagctcaagcaatcccctcaccaatgccaaagtgctgggattacaggcatgagccactgcacatggccctggtgccatatttttgtaatttcaaattgtgctgctatcataatatacaatataaacatgcatgtgcaagcatctttttcatatgacttcttttcctctgggtagatacccagtagtgggattcctggatcaaatggtagatctacttttagttctttaaggaatcttcacactgttttccatagtggttgtactagtttacattcccaccagcagtgtaaaagtgttcccttttcaccacatccacaccgacatcaattattttcttattttaaaaattatggctgttcttgcaggagtaaggtgatattgtcacattgtggttttgatttgcattttcctgataattagtgatgttgagcattttttcctatgtttgttggccatttgtatatcttcttttgaggattatctatacatgtccttagcccactttttgatgggaatatttgtttttttttcttgctaatttgtttgagttccttatagattctggacactagtcctttgccggatgcatagtttgcaaagattttctcccattctgtgggtgagactaagtaatttataaagaatagcaattttttttctcacagttctaaaggttgagtagtccaagattgaggcaccagtaaatctggtgtctggtgtaggcccggtgtatgctttcaagatggtgcctcttgctgtgtcctcacatggtggagcagatggaagggccaggaagctttctgaagcctcttttataagggtgttaatcttatttatgagggtggagccctcttggcctaatcacctcccaaaggccagacctcttcatatcattcctttgttttgggtttttgttttttttttttttttggtttgtttgtttgtttgagacagagtcttgctctgtggcccaggctggagtgcaatggtgccatctcggctctctgcaaactccaccccccaggttcaagccattctcatgcctcagcctcctgagtagctgaaactacaggagcaccaccacgcccagctaatttttgtatttttagtagagacaggatttcaccatattggccaggctggtcttgaactcctgacctcaaaccatccaccaccttggcctcccaaagtgctggattacagatgtgagccaccgcgtctggcccatatcattattttgggggttaaattccaacataaattttggagacacacatatattcaaaaccatagcagtaggccttttctccaaatatagtctctctgggagttaaggcttcaacatatgaattggaggtggggggcacaattgagtccatcacagggggaatatggagaaaggcaaaaactacattctgctatctttcatcttcccagaataagataggctctggagacagcccacacaggtcagctacccaggacgtggagcaaagtggagcaattacggtgctatggttgaatgtttgtcctctccaaaactcatgtttaaatttaatccccaaagtgacagtactgagaggcctttaagaggtgattgggtcatgaggtctccgcccattaatggattaatggatgaatggactaatgagttatcatggatgtgggatggtggctttataagaagaaaagagatctgagccagcacactcagcctctttgctgtgtgatgccctgcaccacctcaagactgaagggagtctctgctagcaaaaaggccctcaccaaatgcagcccctcaccttggacttctcagcctccataaccgtaaaaaataaatttcttttctttacgaattatccagtttcaggtattatgctacgagcaacagaaatggagtaggacatgagaagagatcagggggataaaggaagacgtccagagcattagaaagccccccgtggctgggtcctgccaacctctgcctctcttctcctcatgcctactccctccccctgcatgttccagtgacagaaaactgcttctcattttccctgcacataccaccctgctcctggcctcctgccttggctcacacagtcttcaaggcctgtaatgcccttcctccctcccctacccacttctctccatttcaactaagagcttgtccttattttacccttttgcacttataccttaggcatctccttctctagaaagtctttctagatgtccagatggctgcagggacttgcctgcatgcacatgtatatatatgcattcatgtgcacacacacactcccatgccacccacctatgcctcctcattgcacttgccttattgcattgtaattgttgctttatgaatccccccactagactgtaagctctctgagtacaagcaaagcttgtgcctcatcacttggagcagactggatcattgctctcaatttttcactcccttcctgacttatcatcattaattatccagctatgccatatcatggcttcacagtgggcagaatacacatctctgcctcagtgactttagatttgggtatgggatttgctttggccaatgatataagcagaagtcttcattgtgccagtgtggtttggcccatctcctgtattcatactcctgtgatctctcttgagaagaacatatcccagggtagccactgggccaagtagagtgtggagatatgagtagacttgaactcaacctaaagcctggtcctagcgccagccaactcctggtctgcaacagaagcctgcagacccactgacctgtgaatgaggaaaataaatatttggtgttgtaaaccaccaagatttggaggatgtttgttacatggcatcatggcagcaatagctgactaagacatcattcatccttgtgttcccaagcagagtcctggcccaaaagatattcactgaaataaagaagcaaatatgttcattaatccaaaacatgtagcatgagtgtgctcacaggtcctctgctacctcttcttttcaagcagatagtaatggcttttttcacagagttgatgtgaaagagctcctggcactttgtgctaagtcagtgacattttccttcctctccaccccttgatttctttaaatgagctcctaggctaaagatattagaggcaaaggaagtactctaggctactgaacctctgaaccctctgacctctgtctggggggagcctctttgtgttcttcctctccctcctcctcttttgcccctaggattcctccctgagtcactgcctaactggcttttcctggcctagaaaagaggatttgccctagatcctgatatggctcagcaacttcctgccttaagaggatgggcagcttacatttctccctcttgcaagctagccgatacaagaagtctgtctcctctgaaaccaccatgttgtgaggaaacccaaggtagtcacatagcttgagccatagaggccatattaagaaacaacaaggtgctatacatgtgagtgaagctttcttggactttctagcccagcccagcccagctgaccgaagcagagtgcatgatctcagttaatgccatacagagcaaaggaatcttccagctgaatccagttaatccacaaaattgtgagaaataatacatttctgttgttttaaggcattaagttttgaggtagttatgcaacagataaattaatatatggataaaactttataattatttgttatatatataatattacttattatttctgaaccatctgagaggaaatggcaaaaatcataaccctaaattaaaggagaccatctctcatattgttttctgcctaatttctgcctcaaaggaaagagaaagtaggagttaaagaaaaggcagaagtgaaattcaatagtcagacagcctggcgccacaccccaggcctggtggttaaagatcgacccctgacctaatcacttatgttacctatagattccagacattgtatgagggagcattgtttaactccctgttcagttctgttctgttatgatcactggtgcatgcagccccagtcacatagcccccgcttgcacaatgtatcacgaccctttcacttggaccccttagttagttgtaagcccttaaaagggacaggaatcttgacatcgaggaggtcggatcttgagatgcgagtctaccaatgctcctagttgattaaagcctattccttgctaaaacgggtgtctgagaggtcttgtctaagacaggtcctgctacatttcttggttccctgaccaagaagccaggtgattagtggacggttgaggcagccccttaggcggcttaggcctgccctgtggagcatccctgcgggggactctggcaggctttagtgacgcgaaaagagcgctcccgggtagggaattgcccgggtggaatgcctctccagagcagggcatggtagggccccgcggaggattaacgcagcggatgaacaccggcaaggaatcggcgcttggagtcgcttggtgtccggacatctggaatatggtaagaagcggtcttggaacttgcccactccatttgagtggaagcctggcctgatcacccacaacgtgcttttatcggtaccttggttttggttttgattttgactagattcgcactgttttggtttagatttcagtattgaccttcggatttgaactgttttggctttgatttcggttctgacttggctcaaattgcttaatgaatgagtaactccttatccgtactttggttttagtgtgaattgcttggttagcgggtgactttttgccccctctccccttccctctttgtggtaagagtgttgttttgtctcctgagagaggaaaatgagtaaaacacaaagtaagcctaccccgttaggaactatgttaaagaatttcaagaaaggattcaatggggcctatggaatcgctatgacacctgaaaagcttaaagctttggtgagatagattggccggcattagaggtgggatggccatcagaaggaagcctagacaggtccctagtttcaaaggtatggcacaaagtaactggtaaatcaggacacccagatcagtttccatacatagatacttggttgcagctggttttagacccctcacagtggttaagaggacaggcagcagtagtagtactagtggcaaagggacagacagccaaggaagaaagagtagctccactcccgtcggtcctttcccttggggaagaggaaggagagaggagaacagcagaatacgcggctcacagaggcaaggaaagaccagcagagagaaaaagagagagaggagaaagagagagaggaaagagagagagaatacaagaggcaaagagagaaagaaagacagaggaagagacagagagacaaagaggagtcaaagagagagagaggcagagagaggaagagacagagataaaaagaaagtcaaagagaaaaaaagaaagtcaaagagagaaaaagagagatatacaagtagttaagaaaaaaacagtgtgtcctagtcctttaaaagccaagctaaatttggaacctataattgataattaaaggtcttctccgtgaccatgtaacactccaataccactttgttgtcagcgtaaacaagggcatagcccaaaagcactgaggccactggcaatccgtagcctccctatcaaaatttcttagcccagtaatccacagatggcccatatacattcaatctgcagcggcaacggctttgctaacagaagcaagtagaaaaataacttttagaggaaacctcgttgtgagcacacttcaccagttcagaactatcctaaattaaaaaaaaaaaaaaagcaaaaacgtaacttcctgactcaaaaatcttaaagtatgaggctattctgttagaaaaagatgatttaatattaaccaataaaaattcccttaacccagcaggtttcctaacaagggatttaaatcttaattaccttacaaaggtccgaccagacctaggaggaacccccttcaagactggacgatagatggttcctcccgggaaattaggggaaaaaaaaaaaagagagagaaaaagcgggggggggggagaggggggcaggggggagtttatgtaaaaagaatgttatatggtaaattcttgtcctaaaataaattaactggttgtttaaagaaaaggatgtttgcaataagtcagaaaattgagacatgtcgaagaattgtctgtaaaagtcgtgaaagaagaaaaaaatgtgtgttataaaaaaggaatttacgcaagaaatgttgtataatttaaaagtaattaggcctcctgaatgtaaaactattgaagaaacagtttatatgcaaggtgtatgaggaaagtaaaatatacttttagtaaaaggattataaggaggcataaaaatgtggatttttatctacattaaaaagttaaaaaattgtttttgttttgaaggtttaagcaagttttaaaacgttaattgtaaaagaaattctgtgtataaacatattggctaaagttaaagaggtatcatccagtttttctgtgaactggacattaaagtaaaaacacaacgggtttttcttaaagcactaacctgctctttaacaaaaattataataggttaaaaagagtctataaaaatcttaccttatggtcagacatcaaaaattgaataaatatgtctacaaagttttattaaaactaagtttgacattaataacacactaatataaaggtgaactttagcttatctggtataaaaatcatacaggaagcatcgtcagatataaaatggtatatggctttctttggcctaaaaactaataaatataggtgctaaaggaaatttctcagtaaaaaggcaccaaggactataaaatctgctgctgatgaccccacatttaaaacaaaaggtcaatttcttagaaattatatacttggtttatcttccactttcctttccctcaaaactaaaagtcttttagcacatgtaccacccctagaatttcctgtaaaccagcaccagcctgaagattacgttctcatcaaagggtggaaagaaggaaaactccagccagcctgggaaggaccctactttgtgctgctaaccaccgagactgctgctcgtacagcaaaaaaggatggactcatcacacccgagtcaagaaagcgccacccggtccggagttgtgggccatagtcccaggggaaaaccctaccaaactaaagctaagaaaaatttaactctttcatctattctattactctttcttctttcctagttctattgctgaccatctagttattaacataaccaagtcaatttcgcctcaaactattgcatttaatgcttgccttgttataccctgtggggacttgccaagtctcaaagacagctctctacttcagaaaagtacctctgtccctcctgactgtcctcagactgggcattagtaaattgggatcatttaatccggggagattttgatagaccccagtgtcaacctggagtattgccccctgatgtagagcttttatgccatagttggtccaatgttctgtggatcactaaagagcaaggatgactgccccaactggtttttgtaatttcctaaaaccatacattcattttactagagtatcatagaagttaaagacttaaaacaaactttggcaattaaggcaggataccaagatgcaaatgcctggttggaaaggatcaaatattccgtccgcacgttaaacaaaagcaattgttatgtttgtgcacgtggcaggccagaggcccagattgtcccctttccactaaggtggtcctccagttgaccaggcgtgggctgcatggtagctcttttccaggattccacagcctgaagtaaaggtcatgccaagttctctctctgctatatcccgaagttcagtaccctgagggtcagcccccaagggccatccagcttccgtctcccaacactaagttcactttgtgtctctcacaacagggaggaaacttagttttccttggagacctgaagggatgtagtgagtttaagaactttcaagagcttaccaacaagtcagcccttgttcatctccaagcggatgtgtggtggtattgtggtggacctttactggacactctgccaaataactggagtggcatttttgctttacaccaattggctatccctttcaccctggcatttcatcagccggagggaaggcaggtgatagaaaaaggatggatctggttattggacagaagaatagccatgtcacaactgctaggagccgcagttgtactggctgtgcatgagtccacccacctgggccaagagtcacttaaaaagttgtacttctacatcttacatctgtcagcccttggcaaaacagtggtgccacagtgtgtcacctgccggcagcacaatgctaggcaaggtccaaccatcccgcctggcatacaggcttatggagcagccccctttgaagattcccaggtagacttcaccgagacccccaaatgtggagatctcatccctaggtttggactgcccttgcaaatcggctcggacaacgggttagcatttgtggatgacttggtacagaagacagcaaaggcgattgggtatggatcaaggattggaacgtagcccccttggagccacagtggaaaggaccccagaccgccatcttgaccactcccacagctgtgaaagtagaaggaatcccagcctggatccaccacagccgcctgaaacccgcagcacctgagacctgggaggcgagaccaagcacagacaatccctgcaaagtgactctgaggaagatgacaagccctgctccagttacacctggaagccaactggtccatgcacggccgaagtgtaatgaaactcaccatgggacttactttccttaaattttggacttgtacagtaaggacttcaactgacctccctcaaaccagggactgttcctagtgtatatatcaggtcactgaggtagggcaaaaagttaaaactgtcattttgttctatagttattgtaaatatgttggaaccctaaaagggacttgtttgtataatgccacccagtacaaggtatgtagcccaggaactcaccagcctgatgtgtgttataacccatctgagccccctgtggtcacagtttttgaaataaaattaagaacagtcacctggtggggtctaaaccatactaagaaaaatccatttagtaagtttcctaagttgaaaactgtttgggtccatccagagtctcaccaggactggatggctccagctggactatactggatatgcgggcatagagcctataccaaactacctgaccaatgggcaggtagttgtgttgttagcaccattaagccatcctttttcctactgcccataaaaatgggtgacctcctagccttccctgtctatgcttcccgagaaaagaggagcacagccataggcaattggaaaaatgatgagtggccccctgaaagaatcatacagtactatgggcctgccacatgggcacaagactgctcatagggatgccgaacccccatctatgtgctcaaccagattatacggttacaagctgtcttagaaataatcactaatgggccaggcgtggtggctcccgcctgtaatcccagcactttgggaggccgaggcaggtggatcatgaggtcaggagatcgagactatcctggctaacacagtgaaaccccatctctactaaaaatacaaaaaagcaattagccaggtgtggtggcagacacctgtagtcccagctacttgggaggctgaggcaggagaatggtgtgaacctgggaggcggagcttgcagtgagccaagatcgtgccactgcactccagcctgggtgacagagtgagactccatctcaaaaaaaaaaaaaagaaataatcactaatgaaactggcagagctttgaccgttttagccaggcaagaaaccctgatgagaaatgccatttatcagaatagactagccctaggttacttgctagcagctgaaagaggagtttgtgggaaatttaacctaaccaattgctgcctgcacataaagggcaagtagttaaaaatatagttaaagatataacaaagctggcacttgtgcccgtgcaagtgtggcatgggtttgatcctgggaccatgtttagaaaatggtttccagtgctaagaggatttaaaactcttataatagaaattataataggaacctgcctgttgcttccctgtgtgctgcccttgctccttcaagtaataaaaagttttgttacaacttagtccatcaaaatacttcagcacaagtgtactacatgaattgctattgatctgtcttacaagaaaacctagatagtgaagatgaagatgagaactcccactaataagtgaggttctcaaaggggggactaagggaggagaccacgtctcatattgtcttctgcctaatttctgcctcaaaggaaagagaaagtaggagttaaagaaaaggcagaagtgaaattcaatagtcagacagcccatcaccacaccccaggcctagtagttaaagattgacccctgacctaatcgcttatgttacctatagattccagacattgcatgagggagcattgtgtaactccctgttcggttcagttctgttctgatcaccggtgcatgcagccccagtcacgtagcccccgcttgcacaatgtatcatgaccctttcacttggacaccttagttagttgtaagctcttaaaagggacaggaatcttgacttcggggagctcagatcttgagacacgagtctaccaatgctcccagctgattaaagcctattccttcctaaaactggtgtccgagaggtcttgtctaagaccggtcctgctacaaaatctttaatgaacaaaacttctgtttataaaaccacagtacagctatcactcaggaaagttaacattgagacaatattatctattttgtccctattcatattttaccaattatctaaatagtgtctttcacagtaatcctttttttcagtttcaggatctagttcaggatgcatttagttgttgtattagttaaatttagctgcacaacaaacttggtagctcaaaacaatatttgtcatctccgtttccatgggtcaggaatctagacatggcttagctgggctcttgagctcagggtctctcacaagactgcaaccaaggtgtcggccacagtcatctcagaattcaagtgcaatacgatctgcttccaagctcattcagtgattgttggcaggattcaggtcactgcagactgttggatttagggcttcagttcctggctggctgttggctaggaattcctcagttccttgaaacatgggcctctccagagggcagctcacaatttggcagcttgcttcaccagaacaagcaagctgagaagagccagaaagagaattctagcaagatggaagtctcagtcctttgtaacctaatctcagaagtgatatctcatcactgacatctgcctatcacatgtttatgtctctagtctcttctgatctggaacagtttcttagcctttttattgtctttcatgtccttggcattttaaatattgcaggctagttgttttgtaaacatcctttgttttgtaaacagtttgagtctgtttgatgtttcctcataattccattcaagcaatgcatttttttcaggaatacctcacattcaatgttgtattcttagtgcatcgcatcaggaggtttgtccccttattagtgatagtaacttggattgcttgtttaaaatagtgctcaagctctttctttttatttttttttttttttgagacagggtctcactctgtcacccaggttggagtgcaatggtgtgatcttggctcacttcaacctaggactcctgagctcaagtggtcctccacctcagcctcccgagtagccgggaccacaggcatgcaccaccacacctggctattttgtaaatttttttgtagagatggggtcttgagatgttgtccaggtcccaaactcctgtgctcaagagattctcctgcctcagcctcccaaagtgctcagattacaggtatgagccatcatccccaggggccactcaagctcccatattcttaaccactatgcaattctgcctctggccaggaaagttctttccatttttcaaacagggtagaaaatgagactaattctcttggttgagaaactgtgggaagaaattgagcctggaaactattttaggacaaaaattccctatgtcctggatcagaccctctagctctcatttgcactcaagataccatcactggaggcccaagcattagctgtcatgccagtccacagcttggagaacgaatgtcctttcacacctgttttttctttttgttactggttccttcatctggaaagcccttggaggggccagtggtgcaatggataacacatctgactacagatcagaagattctagaaaagcccttgtcccacctctacctgttctctgcctctagaactcctgttcatctctcaagcccaggccagggttcagctccagaaataaggctgcagcattgtacaattccaggggtgcctggcaccccctggagttgtgctagcctgtggttctgctctggaaacccctccccagcctcacctcatgtgcacattttctcattagtatttgttaagacgtatgtgtgtcttctctagacagagtaggactaaggcttgtttcccctgtggacccggcatccagtatgtgctcaacaaggggtgggttaacacgggaatttttcatcccaccaccactctgccccaaaacagcagcacagtccttttctccttaatttgatggtgacacagttctggcatttgacctttgtatccctgaggtgcatcacaaagttcccgcaataaaatacaacactccaaatgtcccagtggaaagcccccttataaggccagcaggtgcagttagaatgtggcttcttgacaaacttgtgaggctgaaccatggccctcccatctgagacagaagagcgctgaaaagctgttggagagcaggcagactgattccaaggcagaggccaccggtagggtggggtggggtgagggcagccagggctgctgaagatgcagacagggacttggaggtgagctgggctctgaattctcagcaaacctctggttccctagggcaggtcacagaactattagtaataggaccaaggcccccaaacaggtttttctgctaaaagagactctttggtctcacaggaggatctggagtgcttcatccgggtccctcccccagcagtcttggtggaagctttagctggcctggacccagatgatgaactgggacttttgactcccaccgactgagaggctggctcctgggaaacgtgggtctaaggttagctgagagaaaggatgaaagagagacccaaggtcaggcaagtaagtttattaacctgccaggctgctccaccacagtcagaggaggaagccctgagcttacaaaatgaggggtttatatgagggagagagaccctggggttgttggtcgattaactttaccacatatcatcttgtgaccagcttacaatataggaatttacaagagggtgtaacttaggtttatccacatttctcatgaccttccccatgctgcctgttgggctgtaagcaagtctggtgaccttgctgtagcacctagataagggtccaggaatgcagcttcagagtattcagggtaagggtcagctgcattgtgtgtggggggtcctggggcagcttgtccctaacattccagccttttaataggtaatagaagaggggtgccattgttatctggctgcttcttgctggataggggcgacggttatggggagagtctgggtggtggggactgccattcctggagttgtcggtattcttggagcagcatcatatcctgtattgttccgtgggtgaaggctctaatacggtcctgtaaaaactgggtaaggaaacataagagacaagggccaaatgctaaaaggaggaagagggttatggcagggcctaggaagggcagtagccattgtgcccaggagttacgaaaccactggggccaggagtctgaaaggtgctgcctgatttcaaaagctttttcatttattcatcaggtggcatctcacactagtcctgaccagttagtatagaaacagcactcatctcctaaaaagatgcacagtccacctttcttggcagtgaggagatctaaacctcaacagttttgaagtgtcactgctgctaaagagtctatttgggattggagagcaaggatggattcagttatatcttgtaggctgtctgagagatcttttgagagagcgtgatagtaggacagggaagtggacaagcctgctatccttgttcctgttgcagtggtaattcctagtcctataagcaggagtattaactgtacggctccacgctgacagacttgagccttaacagggactggtaaactctgatttccaggggcaatgtcaattttggggcttaagaagaccagggtgcaggtgctggtccaattggcagagaagcagacataggttgaggttctgcacaagaaaaatatgccttggctgggcagacagaactggttatgtttattgaaaaggtgcgagagtatattgttttcattttcccacatgcctggagtccttactaaggcagctccagtgagtgactgaaaaggagttgcagggatagtttgagtggctccttgtgttttattttcccattggagaaagaatcgttttgtgtctattaggagccattcagaggagtaattgaaagagggtataaggaggcattcggcagggagggaagccatgctgcaaggggtccatgggtgaatggttatacagttcgtatatctgccattacaaaatcctgaatgtttatttagtaaagagctggtaatgacctttgggggtcctgaaaaactgacaagccgtttaaattcggctgtttgggtgaccttaaaattttggtggtcgtttgggacttgaagctgtaaggtatagttacattgatgggatggtaggtgacctaaagtcagacctgaggacaggttgtgttggatacatattagggcttgaaaagttagactggtgtcggtggtcacagggccatgaatgggcttgttattacttgtctgttgggtaagactggagatacaggagcgtaacaattgtactgtgttccctgtcagagtgctttttgtcatatctgtgatagaaaactcggccaatagctgcatgtctaaaagttgaaaggggctttttccttcataacgggtgtgataggttaattaagaacccagttttttgagtgaacgggggtggcaacataggtggtagttgataggactgtgggcagagcccacagtcttttgctaggatggggttggactggtttagcagggagtgagttaggttaagggtcttatagaggtagtcgggtactattgtaaggggagatgtggctacgtggggcagccaagggagtaggagaggtagacaggcaaagagtgagtaggaaagtaaataagtgcatttcatctgaggaaaagtcacatagggtgccttggaagagaacgtcatctatccactctacaagagagtcaagattgggagtttggggatgaaaccaagagatgtcttggcaaacggagatgaggaagagggtgaaacagcaaggtaggcaagaacagggcatttaagaaatcaggagtgtacttatgattgtcaggaagggaaggaggagtctgggtattgttcaatggtcttcttcaggacaggtgtgaggcggggtttggttgggccaaggagagtactggagaatcgacagaggatggcagttggtgggtcggtgggtgcttcgggggctctttttaatctggaaagatggtaccaagagatatgtcctgagagtttagctgcagtgggggtatgagaagaacttgaaaagggccttcccactttggtttaagggttgttgggttaagagtttttagcaagacatgctgtcctggaaggagattccggttggggggccttcgtggggttttgggagggcctggtcagcttgttggtggaggagatggtggatgagggagagtgttgggaggtattctcctagctgagagttagaagggggcctgttttgtaagaggaaaggctgtccatacattaactcaaatggactgaggaacaagggtgcttttggactggctctgatgcaggccagtgctatgggcaaaagggaggtccatgggttttggacttcaagaatgagtttggtcaactaagctttaaggatcccatttgccctcttgacttttccagatgactggggccagtatgggatatgaagtcaccactggatgctgagggactgagaaacctgttgggtgatttgggagatgaagctagggctactgtctgattgtatggagtgagggagaccaaatctagggatgatttctgttataagaatttgggggacatctgcggccttttctggaaaggtaggaaatgcttctacccacccagagaaggtatctataagagtaagaagaaattttgtcctcttgacgggaggcatgtgggtgaagtctacttgccagtcctgccctgggagtgttcctctgagctgatgtgtaggaatagggggagagcggagggccccttgggaggaagtaacacagcatatatgacagtttaaggttatgtcttttagtgacgtgaatagaaggggagaggagaaataagggcgatggagtaggtacaggggtgctcaccaatatggaaggattggtgaagagatgtcagaatttctttggtttgctcttgggggaggatgagcttttgatttttgactatccagtcccttgaaaggaggctccttgctgtagtagcgaagctttctcagtgagagagtacttgggttggattgctgagataatgaggaggagagggggaggggcagaagaaagggaggattcttttgctgcctcattggcctttctgttccctcttgagatttcatctgatcctgtttgatgtcctcgacagtgtataactcctgctttcgctgggaggtgtgcaacctgaaggagttggtaaataagggggctgttagtgatgggggttcctttggcagtaaggaatcctctctcttgccagatggaggtgtgggaatgacgaatgtgataggcatatttggagtctgtataaatgttgactcatttgcctttggaaagggttagagccctggtgagagctatgagttctgccttttgggaggaggttcctgggggtaggggcttggcttcaattacttgtcaagggaaacaaatgtatatccagcaattttgggggagctggtgggcccagaagaggagccatctatgaatagttgttcatcaaggctggtgagagactcggaggaaatgtttgggaaatgtagctgtacatggtccagaatgtcagtgcaagaatgagtaggaggggaagagaatacagggagtaaggatgctgggttcaggggagcacttttggcaagactggattcgggattttcgataaagagggcatggagtaattgaatccaggaaggaggaagggagcttagtgctcgggaggagaggcgatcttgtagattatgaggactgtggatggtggtattctggctgaaagttagtttcctgctttctagagctaaaacggtaactgctgctagtgctttaaggcaggttggccaccctttgactgtgttatctagttgtttagagaggtaagctacaggggcaaaggaaggatttcctttctgttgtgctaagacaccgagggctattccttggctttcggcagtatagagagtgaaaggttgggagatatcaggtaaggacagagctgatgcagtgacaagagcagtttggagtttgcgaaagctggggtgtatgttatgtgtggggtttaggggttcattgagagggcctttggccacttcatagaggacatcaactaggaggacaaagttggaaatccatattctgaagaagcctgctagccctaggaaggaaaggatttcgcttttggaggaggatgggggtagattatctattaatgctgccccagctggagtcataacccaggccccaggggaaagttgaattcctaagtaggtcaccatggaggtggagagttagttgggccttggagggggagaccctataccttttgatagtgagaaagtttaagagagtggccgtgtgaatttgagagtctcttagagagaggctgcaaagaagaaggtcttccacgtattaaacaagaagactgggagacaggtttaaggaggtgaggcctcagactagagcttgtcggaagaaatgagggctatccctgaagccctgaggaaggacagtccatgtgagttgttgtaactggagggtgtcagggtcagtccaggtgaaatcaaataggtttggggcatcagggtgtaggggaatggtaaagaaggcatccttcaggtcaattgtggtgtagtgggtggtgttggtggggacaagagagagaagtgtataggggctagggactatgggatggatagggaggacagcctgattgatggctcagaggtcctgaacgagttggtatgagccatcagattttttttttcttttgagacaaagtcttgctctgtcacccaggctggagtgcagtgatgtgatcttggctcactgcaacctccacctccccggttaaagcaattctcctgcctcagcctcctgagtagctgggattacaggtgcatgccaccatgcctggctaatttttttctatttttagtagagacggggtttcaccatgttggccagactggtctcgaactcctgtcctcaggcaatccacctgccttggcctcccaaagtgctgggattacaggcgtgagccactgcgcctggcccagagccatcatattttttaacagggaggatgggggtgttatatggagagtgtgtcggtctaagaagagtgcataagcagagcttgtttatgatgggttgtaggcctttttggtgagttaggcagattgggtattggcgaacattgagaaatttggaggggtcttttaactggattttgatggggtcatggtgagcagctatggaagggatggtggtgtcccacactactgggttaaagagagaggcgggaagtggtactggggagagggatcagaggctggactagtggagaggagcaggagggactctgcttgaggggagcaggaaaaggtgatagaagctttgaatttggctaaaaggtcttggcctagaatgggggtggggcaacgaggcatgataaggaaagagtgtgagaaaacggtatcaaacagggaacaagtaggaggtctgctggtgcatggacgtcagatgagtccatcaacccccacaactaagacttgatgttggtagagttgctgaggcaggactggcttgtctgtcataatataaaagagtattggaagatgtccggggtccgggtctaaaaccccttgtggcctttggaacaccaagctctgtgccaaagggtggaaggctgccctgccgcaccacaaatttaagcccagggcataaaactcctcatgacttggatggaatccagggctcagggcatacaacccctcgtagcctctggaatgtgcacagacttgttggttgctctcccaggctcataaacatgttctccattatctcaagcagcagagcatattcatatgtgtcaaagaaaatgctaaagtgtcacagctacgcttgatgcaccgctacctttctacccccatatccgcatgtcctcaccacctgcttctttgtttgatcaccaataaatagtgtgggttcccagagctcgggtgcttcacagcctccataccagcattggccccctggacccaccttatgcactcttaacttgtcttttctcattcatttgactctgccagacttcgtagcccccatggcctagtgttgggtctgatcaccctaacatttctggcgcccaacatggggctatgaagaccctggtgaaggaacactagagcatgtggaagcagaggacacattgtcagaggacacccgaggatgactgaaagaagctcggcaggtaagctgggcactcgtaagaaccagggtaacaatgggacagaatgaaagtaaacattctgcttatttacatttcttttttttgtgtgtgggtggcaagccacccaggcgccaaggcaagagactgaaggcacaagcttgttacagtataataaagaaaatacttaaaataagaatagttatattagacgtagaatatagacacgattatatatgaatattatcaatcattagtttgtagcattactctttattccaatattataataatctctgttttacaattataacctaggaaaaaccaggccatacagagataggagctgaagggacatggtgagaagtgaccagaagacaagaatgcgagccctctgtcacgcccagacagggccactagagggctccttggtctagcggtagtaccagtgcctgggaaggcacccgttacttagcagacggggaaagggagtctccccttccctgggggagttagagaagactctgctccaccacctcttgtgaaaggcctgacatcagttaagcccacccacagccatccagaggcctaaacgtctccctgtgatgctgtgcttcagcggtcacgctccttgtccactttcatgttcagccctgtacacctggctctgccttctagatagcagtagcagaattagtgagaatattaaagtctttgatctctccaagaaattcatagaagaaataatggcataagctgtcccctctctctctctctgcctcagctgccaaacagggaagggctccctgtctggtggacatgtgactcacatgaccttacctatcattggaaatgactcacattccttaccctgcccccttgccttgtatacaataaataacagcacagccaggcattcggggccactaccggtctccacattttggtggtagtggtcacccgggcccagctgtcttttcttctatctctttgtcttgtgtctttatttctatgatctctcgtctccgcacacaaggagaaaaacctacaggccctgtagggctgatccctacattttttgagacagagccttgctctgtcacccaggctgcagtactgtggcacgatctcggctcagtgcaatctctgcctcccgagttcacgccattctcccacctcagcctcccgagtagctgggactacaggcatgtgccaccatgcccagctaattttttgtatttttaatagagacagggtttcaccgtgttagccaggaatgtctcgatctcctgaccttgtgatatgcctgccttggcctcccaaagtgctgggattacaggcgtgagccaccactcccggccttagttatttaaatttcttaaggcatttattatggaaagggggagtgaaagttagtactcagaatttattaacactctttagtacagtagagcagtttgcccatggttcccagaacaagggacaatggggttggatgaatgggaaagaattggcagagattttaaaaaggtgcataaagaaggagccaaaattccagtttctgtttggtcagtgtgagcattgataaaggcagctcttgagccatttcaaacaatgacaagacagattcagatgaggaagaggcagacaagtgtaaaaaattaacttcagattctgaatgtgaggaacaggaaccagaggaaattaaataaaagagagggaaactgaaaaaggtacatttcactagcctgtcggttccacctgctgaattaagtgaatggccacctcctccctctccccttaatggacaagaacatgaactagctaaaaaactaaaaaactgctcctgtagttgcaacattaaaacctggagctattggtggcgctatacaaaattctattcaaaaggctagagccgagggagaccttgaagtatggcaatttccagttactataacccagcaaggagggcagaatatagctaattgggccacttttccttttaagttgttaaaggaattcaagcggaagccattagtcaatatgggccaaattctccttttgtacaaactttactaaaaaatgtggctcttgataatagattaataccatatgactgggatactttaacaaaacctgttctcactccgtcccagtacatgcagtttaaaacttggtgggccgatgaagctcaaactcaagcaagagaaaacacacaagcacagccgcctgtgcctgtttcctttgaacagttaatggggttgggccctaattggggccgactagacaatcaagcagtaatgaaaaacgttgccattgttcagttacacactgtgtgtttatgggcatggaaaaaaaataaatgttatggggaaaaaatatccttctttcagttctgtctgacaaggacctaaagaatcatatactgactttattgctcggctccaagaggctgtgcgtaaagccataactgatgaaatagctcaagatgtggtaatacaactccttgcatatgataatgccaatacagagtgtcaaaatgctattagacctatgagagggaaggctcatttggctgaatatattaaggcttctgatggcattggaggtaacttaaataaggctactcttttagcccaagctatggctggactaaaggtgggaaaaaatatgccccgtttctcaggctcttgttttaattgtgggcaatttggacacacaaaaaaggaatgtagaaaagaaaatcaaaaggcaaaaactattaccatcaatcaacagaaaagtcctggcgtatgcccctgatgtaagaagggcaatcactgggcaaatcggtgtcattctaaatttagcaaagatgggcaacctttttttgggaaacgggaagaggggcccacctcgggcccctcaacaaaccaaggtatatctggcacattcagtgcccttacaaatgtacaacagttgtcccctgccacagcaggcagtgttgctgtagatctttgcagcacagttcccatttccctacttcctggggagccaccaaagaaggtccccatgggagtcaggggccctttaccctcagaacagttggtctattgctaggaaggtctagtttaaattttagaggtgtcactatgcatgtaggaataattgattctgattataccagagagattcaattagttgctagttcctcaattccatggtctgcttcctcaggagaaagaatcgctcagttgttactgttaccttatgcaaaactgggacgcagcatagtaaaaagaatgggaggctttggtagtatgaatccagcaggaaaagctgtatattgggttaatcaagtgtctgataagagacctatttgtacagtaaccattcaaggaaagaactttgaagggctagtagataactggagctgatgtttctatattggtttgaatcaatggccccagcattggcctaagcaaaaggcatccattggtattgttggagtaggggctgcctcagaagtttttcaaagttctttaattttgccatgccaagggccagatggccaagaagggacaattcaacctattacacctattcctgtcgatctatggggtagagacttattacaacaatggggtgctgaaatacctattcctattgatcagtatagtattaacggtaaacaaatgatgagaaaaatgggatatctcccagggaagggactaggaaaaaatgaaaatggccaaccagaacatttagaactaaaaggacaaacagatcaaactggattagggtatcatttttaggaacggccattgctgagcctccggctcccattcctcttgtttggttaactgctaaaccagtttgggtggagcaatggccactgaaacaggaaaaactggaggctttaaaataattggtacagaaacaattacaaaagggacacacagagcctactctctctccttggaattctcctgtgtttgttattaagaaaaaatcccagaaatggagaatgttaacagatttgagggccgttaatgctgtcattctacccatgggtgcactgcaaccagagctgccctccccaactatgattcctaaatcctggcctctaatagtgataaatttaaaagattgcttctttaccattcctttagctacccaagattaggaaaaatttgcttttactgttcccgctataaataacaaagaaccagcagacaaataccattggaaagtattactatttgtcaaacttatgtcagaaaaggtattaagccagctagagaacaattcaataaatgttatattatccattacatggatgatattttatgtgcagctgaaactagggaggaaaaggctgtaacagcagcaaggttaatcatagcccctgataaaatccaaacttctactccctttcagtatttaggaatgaaagtagaacaaagtactattaagcctcaaaacattcaaattagaagagataatttaaaacctctaatgattttcaaaaattattaggagacattaattggattcatcccactttaggcagtcctacttatgttatgtctcacctcttttctaccttacgaggtgattctaacttaaacagtaaacactccctgtccaaggaggcattagagaaacttcaattaattgaagaaaaatttccacaggcacaagtgactcgagttgacccattgcagtcattacagtttttagtttttcctactaaacattcacgtacaggaattattgttcaacagaatgatctggttgagcggctttttgtacctcacaatacaaccaaaacgcttactctgtacttagatcaagttgctgtattaatgtagtgtgcaaggctgtgcacaacaaagttaatgggatatgatccaaatcaaattatacttccattaaacaaacaacaaattcagcaagcttatattaattcccaggaatggcaaattaatttggcaggttttattggcattcttggtaatcattatcctaaatccaaaatattccaatttcttaaattaatatcatggatattgccttccattactcaaaaagcccctattgaaggggccattactgtttttactgatggatctagtaatggaaaggcctcatttgtgggacctcaacaacaagtttttcaaactgactttgcttctgctcaaaatgctgaacttatggctgtgataacagtgttaaaaacttttaaacagccaataaacactgtttctgattcagcctatgtagtgcaagccacacaaaatattgaatgtgccttaattcaaaatgtgactaatgaccaacttaatcttttatttcattctttacagcaagcagtacaacaaaggcattcccctttctatgtcactcatatgagagtgacatagccctttaaatttaatcaaagggtggataattatatggggaataggatttgcttgtgtctctcaggtaacaatcaggtgcctgtatgagtgcccaccaaacatctgaaaatctatcatgagctacagcaggaagagaggactctgggaagagtcctctgaagagtccagagacgtggtttcacggtgttagccaggatggtctcgatttcctgacctcgtgatccgcccacctcgacctcccaaagttttgggattacaggtgtgagccatagcgcctggccattacccggcagctttgttaaggcctgcaatgaggcaagtaatcatatagttacagacgcccagctggggtctgtgggttggtactcccaggaaggctcttcctggggaacagcagtggctcctatgggcttagcaggatcttgcccatgaagatcgtcagtgtgtgcctgtgctacaagccacactctttccttctcttctggaaggagagtatagaagagaggataatgtagagatcatgccaagtgagttcataagattgggtaagatatttaaattctttgatataagtatcaggatcggaggagaaggacctgagacgtttttcaatctgtgagagattggagagggagaaagggaaatggacacggatgatccccttgctcctgctacttcccagagaggaagcaagggaactggttgctgagtatgttgggcccaagagcgggtgaggggtggagatggagaggactcagagtcagaagcggggtggttggagagagggggacagatgggtagagccagagcagggacataccgtgaagaatcatgatgctctggtggaggatcaagatgctgtcagggaggggcaaaattggcggggtcaaagaaagaggagttgtcggctggggctgttgcgggggtggtgggagacgggggtggtgggagacaagtctggtgagtaggatttggaaagtggagcagtactggcagagggaagggcggttacggagagtgaagaaagcctgaacataaggaatctcagaccatttcccactgcgatggcaaaagtcgtctaagtctctaagtatattgaaatcaaaagtgccattttcaggccattgggagccattgtccaattggtattgaggccaagtggtattgcagtaaaagataagtctcttagaacggacctctgaatggaggctgagagccttgagattgcagaggagacagccaaggcgggtggtcttgggatgggtagactgagaggctcccatagtgaatggagggtggggggtagaggaagaagagactgcagatgacaaggatggcgagagagggtgtcccctgtcctgcaggccttgtctggaatagaggcagccaccgagtcaggtgtccttcaggtctcctctattctggacaaggcccttgggtgaggggtgataggagagagagaggggaggggggagagggagagagagagagacacctctaaggacacgcagccagagcctgtccccttcctgggtttcggcaccaaaatgtaacgttagctgagagaaaggacaagagagagacccaaagttaggcgagtaagtttatcctgccgggctgctccaccacagtcagaggaggcagccctggagcttataaaatgaggggttcatatgggggagagagaccctggggttgtcggttaactttaccacatatcatctcgtgaccgcttacaatataggaatttagaagagggtgtaacttaagtttatccacatttctcgtgaccttccccatgctgcctgttgggctgtaagcaagtctggtgaccttgctgtagcacctagataagggtccaggaatgcagcttcggagtattcagggtaagggtcagctgcattgtgtgtggggcggggggttcctggggcaacttgtccctaacagggtcaggattagttctatctggttctctatttgctgtccatctgtaaatgctgagaatggcagagggaggccaagtgtagataatcaggttttagcttttttggattttcctacttctcctgtacaggaaataacttattgtctaaaccccatactatcccattaaatgtcaggagtgctgtcttaggcctgaattagctcatgacgttacgtactggaagtcccaggaggaatgcccagcaagtggaatccaagacgttctcgccttctcggggacagggccatcaccaggattcggaaaggaacagggaggttcggtttgtgttccagttctgagccctttacctcatccctcgagaagctggcctttgcaccccgcagccggtgctgcccagccgaccacgccatgcacgggaggcgactgggaccccacttgcctggcagcccggccggagacccagctgcctgggagggtccgaagataatgccaggcagccctggcgggccgggaagaccctctgtccctcccgtttcccagttcttgaattaggggagccttggactggctggcggcgcaggaaagtgcaggagggcggatgtgggacctgctgccgcccagggagacggtgctctgttctttggaaccagggaaaccgtcctccagcccacttgccccaggggggagcaggaagatcctctccgggcagagatgatggggaacccgtgcagccagagggtctccctggcaaaggtcgggggagggggcggccgtaacggccccgggcgctccggcacggagaagccaagggggttctccaagcagcctccacccaccagcctcgccaggagagcgtggatacccgagcggccccaagcgagtccccggggactggagggccgaggggcagcgcccggaacaaaggcccgcagaggggtcctggagacagcggctccccgggggcggctcccctctctcccctctctcccctcctctcctctcccgccagctcctccttctcctccccttcctcccccagaggcccggccggctcgcggcccgagcagcgccaacttcgccaacggttcccaagttgccgggcgcgcaggggtgggagctgggtggggtgaggaagaggaggaggaggaggagaagggctcccggacgccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggtaagtggggcgccggcgtcctggaaccgccgcccagcccgggggaggccgcccagccgggagcccccgccttccgcgtccaggcgcgcgcgccagactttggagggagaagggggcgaagcggacggtgggaggtggagttcccagctcggggaaaagcccaggcaggcacccacaacccgctgcaaccggatcacacctgccaggtacacacagctcatcgccactcataccccgcacacggcgcaggctgatctgcgcacacccacaccggccaggcacatgccacacaccgaaatgcacattcctgggagcgcgggggatttggcctctacagcaggcacgtcctcacacccctccgtcacatccacggcctttgtctgctgcccccgcagcccccaaggagagggagcccccaaagcgcagcgggcaggagagaggctgcctgggttttgaaaacttgtggccagaaccccgagaccaaggggagcagatgttgcagtcggttctcggagttctgcaggagcgaatttggtgtggaaactcggtgtctgggtgatgtgtgagtgtgcgaagcccttccggaggcgaggcccggagagaggagggagtgattcataaactcagagccggcgtgccagggtctgtgagcagcgtggaagaggctggcaggccgttgctgcgctagacagaagggtagtggccgtgacagtcttccagggaagcagggacccttccccccagcggatgtgcttcctccagggacttccaagggaaccgggtgagcagattccagtcctgggtgtggacggggtaaggggaggtggggggatttaagcctaaaaggttagggagaaaccaaggcaggcctgacgccttcattattttccttgcacctgaagttgtgtttggtttctgatgcgtggtgttgctgggccccaggatgtacgggggattgtcctgggcctagcatagtgcctggcacagtgggcactcagtcagtacttgcttgatgaataatgacaccggtaattatcattcattatggactcactgtgcggcaaggccagtgggcctctgctgggttgaaattgattttccagcagagaagggggcctgagtagctcctaggagccctgcctgatctgcttgggccagtggcccaggcactgtgtgttccactgtgtcccgtgggctggccttgggagactggagctcatcattggcctctgcccctctaagagggcagcaggaaaagcttcatttctgtatctggctaagatggggttgatgtgggttttggtagatggcaggctgtttggcagattctgtggggtctcaattgaagaataactttagatctgcagcagagagaggggttggttccatcaaccctcccatctcctggctgctggagaagaggggtgggtaagtggagaaagagatgggccgtgctgctgggcatgtgctgggggtaggaggaacatgggaacatgtagaatttgggggcagccgtttttcttcctggctcctgatggcctggctggagatgggtctcatgaagggtctaggagctgtgttctgcagcagtggcttggctctgtggtggcagcaggtagagcagtggtcacagtccctgtactgagtattgctgtgggttctcctgtgccagcttgcatgagtttcccagaggagcagaaacattcgtgttcctggaactggattgccagtagtcttgggattgagagtgcacaaagatgtgggggtggcctgggcatgtcatccaaaagaaatgtgtcattccccacccctgcccccttgtgaagagctctgactaggttcagtgtgcatttcaaacttctaaatgctgaaattagcaaggcatgtgggcggcaccaaggactggcctcagatgaaagaggaggtgatctgggcttgggcacccccaatttcaggtggaaccctgcagccagttccttccctatatcacctttccaccttcattatgccctctgtgaatcgagagttctgtatacattttctaattaaatcattatatccctatgaggttagcatttcatctccattttgcagattaggaaactgaggaccagaaaagttaagtaactttttcaatgtcacacaggtagtgagagacaaagccagtgtttgtgtatttggtttttttaaactttatgttaggttcagaggtacgtatacaggtttgttacataggtaaattgtatgccatgggggtttggtgtacagattatttcatcatccaggtagtaagcatagtacccaataggtagttgttgggtttgtttgagacagggtctctattgctcaggcaggagtgcagtggcacgatcactgccactcaccatagcctcgacctcctggactcaggtgatcctcctgccccagcctcccgagtagctggcaccaccatgcctgactaatttttttgtattttttgtagagacagggttttaccatgttgcccaggctggtctcaaactctggagctctagcgatctgcctgcctccacctcccaaagtgctgggattacaggtctgacacactgcacaggcccgagatgggtggtttttgatcctcaccctccccactgtctccaccctcaagtaggtcctggtgtctgttgttcccttctttgcgttcagatgtacccaatgtttagctcccacttctaagtgagagcatggggcacttgattttctgttcctgtgttagtttgcttaggataatagccgctaactccatccatgttgctgcaaaggacatgatctcattctcttttatggctacatagtatttcatggtatatatgtaccacatttctttatctggtctaccgttgatgggcatttaggttgatttcatgtttttgctattgtgactagtgctatgataaacatacgtgtgcatgtatctttatggtagaacaatttatattattttgggtatgtacccaataatgggattgcttggtagaatggtaatcctactttgagttctttgagaactctccaaactgctttccacaatggctgaactaatttacatacccatcagcagtgtataagcactctgttttttgttttttgtttttggtgggagtggtgggatggagtcttgctctgtcaccaggctggagtacagtggtgcgatcttggctcactgcaacttccacctcccaggttcaagcaattcccctgcctcagccccctgataggcgtgcaccaccatgcgtggctaatttttttttttttttgtattttagtagagacgaggtttcaccatgttggccagaatggtctcgatctcctgacctcgtgatctgctcacctcagccccgcaaaatgctgggattacaggcatgagccgcctcgcttggccagcactcccttttctccacaacctggccagcatctgttaatgtttgactttttaataatagctattctgactggtatgagatggtatctcattgtggttttgatttgcatttttctaatgattagtgatgttgaccgttttttcatatgtttgttggacacatgtatgtcttcttttgaaaagtatctgtttgtgtcctttgcccactttttaatggggttgttttttgcttgttaacttgttcaagttccttatagattctggatattagacttttgtcggatgcatagtttgcaaatattttctcctgttctgtaggttgtctgtttactctgttgatagtttcttttgctgtgcagaggctctttagtttaattaggtcccatttgtcaatttttgtttttgctgcaattgcaaagccagtatttgaacccagattgtctaactccagaacccaccctgtctccaccatgccaggctgtctgcaaggcccttattggttctccatggcaacagggaaacagccctgatgcttcttactaacgtggtcccagggcctctgcttgcattcttctttttccatacactctgccgagcctggatataccttaggctgtgggaatcaaaggctgggtggtaccaggctgctggagccttctgtgtggctctggagtcagaaaactgtggagattttgggggggcacacagggagatgttgcagtaattccagtgagacatgactcactgcttatctgagaagttgggacaaagctgcctcttgtgaccataccgtgaatagggaagaaattgccaggtagaccaaacatcctcaaatgggttactgtatttttttcccctttttggtcctctccagggtaatctattacctggggaaatcagccttcacctgacacctcctattgtcatttacctggtgaacataaggggccatgtcacagctgtccttcccacccctgccacgtgttctggagagctggactcctcagcagcacctggtccacaggagagaagaatggggcagagccggagcagccaggggaggtgataaccacacgctcatctggtccccagctcttgcttttacatccacgccccacagggagacagcaattatctgttggccccactttacagatgaggacatgaggctcagagaggtgcagtggatgcccaaggtcacgaagccaggcatctgcaaaggcctgggacagccacgttttcagtcggggtggtattttctatccccggccccaagggctgagagtggttatccctgctggggcagggtcctcactgctccacccaccctcatctctgccctgagagcccccagtacagatgtccatagaacgggaaaggctggcgcccttcaaaggacgcaaagagcattggatgagcactgcccagctgatccctgcccaccttccacaggaagcccacctgggtgagttcttagagccttcctagtgctgagctgcaaagaaactggagccctctccccctccactgcagaggggacacagtgaccaggacggaagttgggggactgggtgtggggagaagccaccccactgcaggggccggggctgtccatctttgtacccctggttccatcccagtgcctgaggcatgggaagttcttggaaatgtagtcagatgctgggtgaagccccaggaggggccgtgaatgcttctgctgggaactcctagagtggcggcacagagagggtctttgctgcgaaggaacactcagagagtctctggctttcgtgaggttatgcctcaggagaggagacacttctccttttcattcgttaaacagaaatgatatttgccaccttttcttctctaaggcctaaagagatgacagaatgctgctggtcctaccctgagcgcgtggactccacagcggggtgtggggtggcccctggcaggcctggacggtttgttctgtgcttgccggtggacacgcttcagccctctgtctctattgccccaaatctggcctgtggctgctgggccgccaccagcttggagggcagggtgggccccgggagcccctgaccaccagtgacttcttgtctccagctgccctccgtcctcttgatccccctcaccccccaccacctcctcacaaagatggctgtgtgctgagggactgtggcttccctgggccctaggaaatttatcactgaggtttcagaggactctatgaaaaggatttggagaaaaagtgtggaaaataaacaagccagttcccagttcagcctctcctgaatgccgcaagtaaacaaccacctcggaggccagcccgggatgttcttatttggcctctgtggttacacctgccccctccccgcccagtccctcctccttaactttaagagcctcaaaagtcagggaacacaccctccgctggccagtccttgtgctgcagggacgctggtggctgggcacaggaggaacatgtatatgggagagaagacggccgggggtcccagctcagccctgctccctctgagtcagtcccaagcctggaccctccccagcaggcagacggtgacgtcttggttggttggtgagtttaactttgatggtgcagaatgatgagacttttctccattttgtggcatctgagaagctttgcttcttaaacattgctttagggtggatagaccaaagctaattttcccgttatgtctctccaagacggggcctacctgtgagcaaaccctcatagattcatttactttgtaggctacctggacaaaaatgtcaggtttctttgctttgggctggagtcctatcagctcaggggtggtggtgtaaggtcacaccaatgatttccagaaactcaagcactattctgagtgactaagtctgtgggataggaagcacattttccatctcttaataacttcaatttacttagtgaccaactttaaaaccaggcacccggttagaagggggagagccagggcttggcagcggagggtcctcaccttgcatccagggagtggctgagggcccttctcgttctctgtggctgtgctgagctgagtcagcgagccctgaagcctctgggatttggggagtggggcactgctggaaggttctggttcctgctttgttctgctgctgccaggcttctggagagggtggttgtggggtgagtcctgcgctccgcacgtccacatgttcgtattctacatattgggcttctgaaaaaagttctggttcataagacggcttcacagcttagccgtctgcagaccagtctgcaggttgatcagctttctgtcatgtgtgtgctgttcctgttcacacatgctgcgccgatgcccgcctgtgcctgtgccagccccagcccacacagctacctgagatttagccctgggcatctcccctaccctttcccgcttccccctcctctcctcccttcctctccagctgcctcgccatctgcaagattctggaaagtgctaatgtgtctgagccaaacagtgctatctgaggaaatattttgaaaacacactgggccacccccgtccccgcactgtgactacactgattttcagcaaggaatttcactccagccacagggcagggccgcaggtgcctggctttcctctggagacttccaggggcttgttagagacacggagagaagctgagggcctgtcctgcaggtttgatgtgtctgaagaggccccgagaatagaaatctagaacctgccagtcacgaagcagtgtcacccaccagaggatgaagaactgactgtgacctcgcaggtcacccacttgctttctttttaccgagacatgctatttctctttcacttttcttccttctcttgcatctggtgtaggtgcctgggggtagcgtgcccaggaaacaataatagtaagagcagctggtgtgcctaatactgccctgagcacctacaaggcgtcctcaccgagttctcaccagaagctctagaggtggctccggttattcccaccattttacagatgggaagacagaggcagacagctggataagttgctgacatgccacagccggtgaggggcaaagccgggcctgagccccacagctgactccagagtctgtgctctcagtaccacctgtgcgtgcgtctgtcccgttgtggctgcaccgagaggagaaacagcacacaggcattcattttcaaaccgtggccagtgcatgtcattgcgttctgactgggaagctctggcaatgttggcgttgcatggcctattgtgggcactaccagtgagcctcggccttctccaggtctgactccagtacctgccggctgccctgggcagggcattttggatcctgcctcagggtcttttgcccgctctgctgatgccactcccctgtgccctgacctggtcacaggaagggtgcagatggcagcgagtgtggtctcagttagcaagggggagctggcagatccagggacttctgcctccctagtggccattccagcaagacaggaaccccaccccgagtgatgtctggccctgtgacctttcagcaaatatttcttccccagcctcacctggactcggtatcccatgttccaaattgtcctaatttcccagacacacacaccctgctctctgtagccttcccagctgccaagaacattccctccttcccccttttccccttggcttggatgccaccttctcctggaagcctgggtggtggccctccccatggctgcccacaggtccccctcactgccctttgcctgtggtattatgattgctggttcagtgatctgtggtctgcaccaggcaatgggatgtgcaagggcaggacagctgtctgccttgtccatccttgtagcccccgacttagcagtgaatgctgctacctgattatggaaggaatgagtgactgatgtggcacagagccctcagtggggcaggcccagtccaggatgcttctgtgagggagcgcttcgagtctggggagggtggcaggagtcgtggtgagcgggaggggtggctaacgtgggccaaggaagggacagacaggaagagtgggaccccggcacatggcctcttgaggtcattaccccatgggtattgggctgggatactgaggatgagcctgaaacccttccagaagcccctccagtcctgccacttgtctgcctgcctgccctggatgcccgtttttgggctggtggctggctgcactctgggcccactgctcaaccccaccagcaagtggagagccattcaacagccccagggtccagttcccatctgcaagtaacgaggcctgccgtggctgagtcgtttccctgagcagagagaaggaagccctactggccggctgcctccccaggggtgggtagaactgttctgtggccccacctccagccctcaagctgtctgtccttgcaaaagtagtggggcacagagtgctgggttcttgggcatcacctgtccaggtcctgcgcgcctatgctcatgctgacactgcaagatggtgggataacaggagggactttcaagctggaagagaggagagctgggtgccccagtaaccacctttgagtcccactgtgatgagcccacagaggtggacatgagggaagacttggggaagccttcctagaggaggcaggcattccagtgcatgagggaagctgggcaaaggcacgaggatgggaaagttccgattgaagacagggactggtgaggagtctggctggactgaactgaaatgtataggatacacgaggagagacaggcaggatggagttgtggttacgcacacaggctctagagccgggctgccttcacgggaaccccaactccccacttactggctgtgtggccgtggccaagttgcttaccttctctgagctcagttttctcactactggtaccccccacatggggaagacatgggaataaaatgtatttctatacaagtgttgagagcagtgcctggcacactgagcatcaggaagggtgagctattattatataggtatatgttttaatgcagctagaaaaggaaattgaggtcagatcatagaggcccttgaatgtcattctttccattcactaagcacctgccatgtgccagattcttcacagtcattctcaccaagccccctacaacccggcaaggttgttagcaatgtctccatttcacagatgaggaaactgaggctcagagaggttgagtaacctgcctaaagtcactcagtcagggagagtcagagccagtaataacacccaggtctgctgtcgcttgagtcttccctcaaagtgaagattggagagacatggcaggggcatcacagggatgagccctgggctggggccgcagccaggagcagagcaggaatgtggcaactgtgggtccctggggcagggtggagacggggagagatgccaggcgggcctggagggtagggaggactggaggctacagcatacagctcaccattcatagcccagggcaaaccattgagtcatttggggaaaacatgacatcactgagtctcactgtctgccgcccacctgctgtctgccctctatggttctcctgatgacctcagtgccccaagtcctgcaaggggacccgcacaccccatgtagcagggccaggtcagcactccagcttcctgcactgggttctcctccccagccactgtctcccaccttcccaccactcccttccctgcctgggtcccctgccccagccctactcatacacactgctgaggcagaagcttctggaagtggtgatgggcatgaagagcttccagaagggcttccatgccaagcccttgattggaattctgggtggggaggggacagctcagaagcctgtgtcgagcttttagagttgcttttccttgagaatggtgcctgctgtttgggtgggatcacttttaaaaagtaaagcctggtagagctatgtgaccagcactatgccatgacctagaggagattcagactgacgggcaggccctgccttcctgcagaatacagttgagtgtctgagagttctttctgtactaagcatctttgaactgagtgctttattttcgtccatctgattgcgcgaggtagtcttattttacagatgccatccccgaggcccagagaggttaggcaacttgtccaaggccacacagccaggattcacacccataactgtccaactccagatgtgctcttagccactctgccatccggccacaaataaagccaccagagaaccacagaaggtggaacatatccaacatttgcccgataaattgtatagtgcagacaggaagtacagggagttttcatctcaaagtgtaggtcactccccagagtggcttgaagtctgtagatccatttaggagaacatccagcttcactggctgtgcaaatcccacccatgcggctgtttggggtgagaagtttctttaaatgtctgttgactctcttctctggaaggagcacgggggctcagggggcgcctgtcctggcattggtggccacacctagaaacggactatgaatcaagccaggggcccagtgccagcttccttggcctgtctgtgggcgcagatgccagcctttgcagctgctgctgcaactcacagctctctcccggtgccgccctcagtcaggccagctggagtggaggggccagtggccgtgccctgtgcagaatgacatcctctcaccttcacaagggaagcgtgattatccttgctttccaggtgaggacactgaggcctagagaagttttctggctgtctgagctcccttggcctgagctcccgcggtagaaccgagactcaagtcttctttctgcaggcagatggccagtttcttcctggaggagggaggagccagcttgccctctgacactgggtagcacagccctgttcgattctctgttcggggcttgcacttctgattcattctgcagtcactggctctttgtggttcgggaaaatgaccctctagggtaggagaaaagctcttggagcacttttgaagccatagaggccctttccaggctttggaaaatgttccttctccacccagatgccaacaccaccctggtcctggcagtacttgtccctggaagggcctcactgcggtgactcattacccagcatgcagcacattgccattgctctcagtgggcaggtgctgtggggacacgggtctgcgggcctgctgtcttcaggggtcccccatgccttttaacgcgtgtatcagtgtaccccaagcctcagttctgtgtagtttgtacaactctggcccctaccccaaggatttctgggaagcccccaggaatgctgataagttcacagtctgccctccccagccccagtctcatcaggcttcaggggtggccattcctcccctccaggagagagagaactcaaaccagtaactacccctcctcaggctcaggcccaatggttgctgtaataatttctggggagctgtctttgctcttgcagagaaggcaggccttgaattcagactggaggggccatttttcttccagttgccctcaaattttcctttctgtgataggatttgtcctttgtctctgcttaaattcaaagacttgttaaaatgacttttctcaaacaagaggctaccctcaaaagaactttgcctctacggatagaaaactggaacctacttttattttggttttagttttattaaattgtataaaatcaataatacatgtccatggtgcaaagttgaaaaggcacaaaacagtctatgtgtggtctctttcccatgccggactcagacactcagcattgttagttttgtgtgtgtgtgtaagctgtgtttaaattgtccagctttaaaacaaaacccttccctgtttcacaattaggttgaccgaggcacaacctgaaaaataacctggaaatagcatcgggccccctgcagcgtccagctcttcccgaggactgttattatgataacgatcattgctaaggctgtcccttcccaaaaagtgttgctgcccacagtcccagcccccagacctgagcagtcacccacacagcatgaatggggccagccccagcctgcccgctcagcttccaagcctagcagtctcaggctctgggctaaccctggcctcccagctgccccttcaacattgtcccctcttgtcttgcagggcagtagccacagctggggctgtggggtcagggcatggcaagggtgatctgaccaaactatgctgcctcttagccagactgtatattcggagtcccctaagctcgatttttttttttttttttttgagacagggtctcactctgtcacccaggctggagtgcattggtacagccatagctcactgcagccttgacctcccaacctcaagtgatcctcccacctcagcctcccaagtaggtgggactacaggtgtgctccacctaatttttaaatttttttttagagaaggggtctttctatgttgcccaggctggagcttgattgtttgtttgtttgtttgtttgaagacagggtcttgctcagttgcccaggtttgagtgcagtggcgtgatctcagctcaccacaacctctgcctcccagattcaagtgattctcctgcctcagcctcctgagtagctgggattacaggtgtgcaccaccacacccagttaatttttgtgtttttagtagagacagggtttcatcatgttggccaggctgatttttttatttttttaaagaaggtctcccaccagctggatctgagccactggctgagaagtgaagtccatgaagcattcagcaatagtaacagcaccaccacctcctcatattgaacctgcctctgtgcttcttcctacgccttcctatgcctctatgctgacttctggagaagccagtcacttgcccggtcacactgtacaaagtggctcagggctggactcactggcttatgcctgtaatcccaacactttgggaggccaaggtgggtggatcacttgaggtcaggagtttgagaccagcctgaccaacaaggtgataccccatctctaattagctggacgtggtggcaggcggctgtaatccagctactcgggaggctgaggcaggagaatctcttgaaccagggagacggaggttgcggtgagccgagatcacaccattgcactccagcctaggcgatagaccgagcctccgtcttaaaaaaaaaaaaaaacaaagtggctcagctgggcttggatctccaacatgctgggccccagtcaccagattcctaaccccgtgctgccaggcttccccggacaatatcatgaactcaacaatccgctcccttcctctgcagggcaacctctcattccccagagctcatttaataacaagagtagtaatcatagttaaccttctttaccctttactatgtgcaaggcattgttctagaagcgcacacatcgatcatttagtcctcacagcgctcccatgtggtaggtgctgtccttatactctttttgcagataagcccaaggcacaggagcctgcctggtaagcagcccatgtctaaagggcagtgaagaaccggcctctagggaatgcagggctcctcttgtacccagaggggaggcgccctgcctcttctctgttgagcctttggaaatggcctccgaggggcccctgctcagcacagctctgtgggccaagagcaggagtgtttgaggcacagatagacgatgtctggacccctccccaggatgcctccccatgtctgaccttggggagtccagtgccaagggggaagttcaataacataccaggtttctccttggccctgggacaggttccttccctttccttccctcctccctgcatccttccttcctttcttccttctttccttacatatttattcagtgccatacagcgatagcgcacacgtgttacctctaatacaaggtgaaaagtgatatgaatggtgcaaggtagagagaggaatggtgctgggagaggaacgtgtggtaggaggccctcccttcacatcctggcctcaaacctccagccggtggccttgggcgggtcgctcagcgtgtctggacctctgtttctcatctggataatgaaggagagggtggaggtgaggacccaggttgcctgccaggctcttgtgagaattggaggtgtaaaagggctttcttttttgtttttttagacggagtctcgggaggggggttagatggcgggagaggggttagatggcaggagaggggttagactagtcccctgggggattggttatggctgtgggggaagtcggagggaggctctggggatgtgtagggtttgggctcggccttaagggatgggtggaatttggccaggcacagatgggggaggggtggtgctttgggcatcaccagccctaggctcatggttgccaccctcccttccggtaccgccttcccttttctgcatttccacccagagatggactctcagctttgaattctttttaggaagtgactttattgtttttattttttttctctatctaaggtagtcagaatattatttttgtgataatgctagatgcttagtatgtaaaattcaagtacaatgggtaaatacagagaagaatgcagcaaatcaccaccactcccaccacccagatggaactgtttagttatttggtccgtatgcgtatagacacctcagtaggcctacccggtgggtgggagtgggagcatgggggctggagggccagaaagttttataagcacagggaaaatgcacagtttaaatttaccttcaggccagagttggaaagattgtctcacctgaaacagtccttcccttctgtccgctgcctacatgactgtatcggatggggaaagagggaatggggaactttcaggccatggccttcaaaacctccccattcagacaaattacagaaaaggagccagtctcagtgagcatattccagctctagaacagtggctttccaacttttagactaaaacctcagacacagacacccacacataactgaaacaaaagccttatgaaacccatattttagctgggcacagtggctcatgtctgtaattccaaacactttgggaggccgaggtaggaagatcacttgagcccaggggatcaaggctgcagtgtttgcagcgttgtactccaacccgggcaacaaagtgaaaaaagaaactcatgcttatcaactcatgcttatcattatgatacagaggcattctgatattttctaatctacacaatgctgttgtgtttaaaaaagaaaaaaaaagcttatcttaacctaccaaattgttggcacagcctgcagtttgagaaatgtcactgttgaccagcgattttcaaacgttcgtgtgcatcagactcaactgcagagtgtgctaaaacaatctgctcccctctcctgaggttctgagtcattagttctggagtgggacctgaggattcgcatttccaccaagttcccaggaggggctgatactgccagtctggggaccccactttgagacccaccctcctggggtgtttttaaggcaacatgctcccttggcaaagaccatcaggggatttgctttattgaatggatgagaattgctgattgctaacatccgaacggtggatctctgagatacttgaggatgctggtcaggcattgtcgttgggatctttaacaccaccctcctaaaatccagctcacactattaatataaagtgttgcatgtagaaaaggcctgctaagcaaagggacatttatgcctagccctagttgaattccctgcctctcaaatcccagacctgcagaacataaaaccctcccagcctttctgaaaacactgttcttctaaaggcaatgaaaggcgctatttagcatgtgggtttcaactttctgttttttcaaagggaagaaggtaggtcaagcgtgactgccccatggggaaggctgtccccgctggctctggtaggggtctggtgggtttcactggcggtccccagtttcccagctttaaccggaaattttcctggcattgtatcacgcggcagcacctcggccttgcagcctgccagctttggagactggcctgtatcccaaactgcttctgctctccaaccagggactgtcagcccccacccctaagcctcctcctctgtagccttggggcctccatgggcccctccccagcctcgcagccctccagaagccagccctcagctgggagcagctttgcgagggaggggaatgttcagtgggcacagagcacttctgttccagtaacaatggcccgttgatgactagattctgcccaggtcagctccctcaactggactttgaggaggagaaaggactccagcccccccaggcagccatttctgggtgtgaggttgattcagaggcctgagcctctgtctgcccacagaacctcattcttcaggccctggtgcagcagggagaaacgcccatcccagggcagtgtaaggccccaggagtgattccgttctgtccaattcaacagtcagttattgaatagtcctggccactgaggtttggtgctaagtagctgtggggaataagaataactgctgacatgaattcaatgcttcttactgtcaaccccgcccctggctgcccagtagtctctagggaacttataaaaattcccaggcacagattcctcccacctcagaatcttcaggggtgaacccttggcactgatattttttaaaagctctcagagtgattctcatgcccagcagggatgcagcatcactggcctccagtctgtcagatgctgtgctaagcatttaacttggagtaccccatttaaggaagcaggtgcttatgggatgctgaaatgtggcccccacagatgtccacgtatgagccaccagcacctgtggatatgtgagcttgcatggtaaggactgtccagatgggattaagttaaggattttgagttgagagattatcctggattatccaggagagccctaaatataatcacaagtgtccttataagagggaggcagaagatttgactacagaagaggagtgtcagaataatgcatggtgaaaaaaactatcagccattgctggtttgcagatggaggaagggggcatgagccatggaaagcagatagcctccagaagctgggaaaggcaaggctgcagactctccagaaggaacccaggccttttggcaccttcatgttaagtcagtgaaactgacctcacacttctgacattcagaactgtacgataatcagtgtgttgttccagctgggcacggtggcttatgcctataattacagcactttgggaggctgcaacgggaggatctcttgaggccaggagtttgagaccagcctgggcaacctgatgaaacccctgtctctacaaaaataaaaaaattagctgagtgtggttgcacgcatctgccccggctattcagaagctgaggtgggagaatctcttgaacccgagagattgaggctgcagtgggccatgatcatgccactgcactcagcctgggcaacagagcatgaccctgtctcaaaaaaaaaggaaagaaagtaagtgttatttgaaggtactaagtttgtggcaatgtgttacaacagcagtaggaaacagatacggggctgtcattaaccctgctttacagatgaagtacgggggccaggcagtcacctgggctcacccagctagtgggctaccgagctggaagaaccaggttgtccgaccccttcttcactgcccaccacacctcaccacactgccccctcttggcagtcagacagacatgggttcaatctcagctctgtcatcttctgtctgtgtgtcctgtgctgctggtgaggcttgtttggccagggggaggccccaggaaggggaggggtggagaccagttggaaagatagggtgggccaggttgtccccaggtggaagagtttggacttgattttggaggaatggagcccacagggcactgtctggtctcctctgccatatttcttgatgatgcctcagacccgcaggcctgctcagtctttgagatctgacataatgcagcaacccagctcccattgagaacctcaggattgggaccagaatcatcattctactccttgtcacccacagccagtgacagccatttatctgggacggccagtgagctcctgtttcccaggaagccagcagtggccctggtgcctccaaaatgtttcttccaagattctcctagaaccatgcatttgggaccatgcctttttttttgaaaaggagtcttgttctgttgcccaggctagagtgcagtggctcaatcttggctcactgcaacctctgcctcccgggttcaaacagttctcttgcctcagcctcctgggtggctgggattataagcacatgccacgatgcctggctattttttgtattttcagtagagacggggtttcaccatgttgttcaggctggtctggaactcctgaactcaagtgattcacctgcctcggcctcccaaagtgctgggattacaggcgtgagccactgcgcctgcccaagaccatgcatattttttagagtaaaagtatgaaatacaaacaaatacagagagttttccagatgaggcaggaaaatagggtctagaggcagggaatgtaaggccaatcacacttcagctataacaggaaataccctctccatagctcgtgctctgtaaatgactttgtaactttacttcatcctctccatttacatagggcgtacccaaaataacaaatggaatcctctagagggtatttaaactccccaaaattctgtaacgggccttttgtttgtttgtttgttttgagacacagtctcactctgtcacccaggctggagcgcagtggcgcaatctcagctcactacagcctccgcctcccaggttcaagcaattctcctgcctcagcctctcgagtagctgggattacaggcatgcgccaccgcacccagctaattattgtatttttagtagagacggggtttcatcatgttgtccaggctgggttcgaactcctgacctcaagtgatctgcccgcctcagcctcccaaagtgctgagattacaggcgtgagccaccatgctcggctgacggccttttgagctcctgtgctcgggccgccccacgctgtggagcgcactttctcagtaaatcccttcatcccttccttgctttgtgcgttttgtctaactctgtgttcaagacaccaagaacctggacaccctccacctttaacacaaagccacaccacaagttggtgacaggtcctgaaagatcagttcctgactaggactctgatctgtccactgctgtacagctgctcccttctggctaaatcagcttgctcagacacagagcatagtggttgaatttgtggactgtggagccaggcttcctgtgttccgatcccagctctgcctttaactcagggtaagttttctcatccccttgcctttgatggggatggtgactattatccataagcattatccagggttcttccaaagattaagtacatttatgtacatgaagtacttggaacaattccttgttcactgtgttaacttctgttactattcagctcctctagggcaggggctgtgtcttttccttcctgttcctagtgcctggttccatgcttggcccagagcaagtcctcagcaaatgaatatacttgtttcatgtgagcttttgtcactcagagattctttaggtactttcccaaaagcttgcactcttacaaatttccatcttagttcttcaaatctttcttctcctccttcctgccgcagaattgccatagagcagcctgaagcttgctctgccccttgcaaagtccagtgagccgttcaaagataacccagatgtcccaagcctcccagccagagtgcctgtgctgcgcagctggcgtggttgccccagtctccttcgccccaaggccatgcttggccgaccccctgacccgctgaggttgcgcagagctttttgggccctgtagcagcactgcttgggcaccaagccttgcatggtctcatgggactcactgcctgcagccgctagtcccagctcccctccttaccagaacccacaccatgttgtccagctgatgggggatcacatatcatgctattccctccaggatcctgtcccctgtttttctccccctgccatgaggagtagcatcctcatttagcctttccctcagaaagtccccacgcttatcactacacatgaatagatcccaggaaggtcactttctcatggttctgcaaaaagccaaactccagttgaggtccagtttgaacccaactagttcactcctctgccctagaaaggccatttctgctcaatcttactgccccacctctacttccaacttgcaaagatctcttgaaaccctgcctcctgttgtgggagctagttttcttttcttttttttccttttcattacacagtttcattttgacataacagtagattcacacgcaattttaataaattgtacagagaggtctcatgaatctgttacccacttccccctatggtaacattctgtgaaagcctagcctaatgtcacaatcagaatgttgacttcatacagaatcccctgtggtgcccttttataactacactcacttccctcctgcccccaccccttccttgacccttggcaatactagtctgttctccattcttacagttttgtcatttcaggaatgttctataaatggaattatgcagtgtgtaaccttttgtgattggctgttttcactcagcacagttccctggaaattcatccaagttattgtatgtgtatcagtgttgtttttttttactaagtaggtaaaacaagggacacagacctgttctcctggcatccctccctggttagcaagagattcagcaggccgctgccactctggccttgctgatagctagtgtgtgtgcaggcagcagctcccgctgtctgtaagagcgccagggtagtgaagttgggtgctctaaaagtagtggctctccatctttgctgattctaggttagaatcacctaaggagctttaagtaatcttgatgcccaggccacaccaatgcaatctgaatctggaggtggcacccaggcctcagtgatttgtaaacttctctggatgattcttatgctgtcagagttgaaaaccagtcctctaaaacagccgcagcagattcacaatagctgtgccatcctccacccatgatagatgtcacagagcaatcgcagcactcgtattttcaaatacggcgctccaggcagccccttcccatctgtcagctttggcccggggtggaaattgacttgccctcttagctgagaaaccgtttggccatggccatgtccaggtgtgcccaggcccgaggcctgacatgttaggtgagtgtccctgtaagtaatgctggaaaggtgggcccttgaccgataggaatagttgcagcaggcagagatcgcctggggctggttctataagataaacccgaagtggatcagccagtgtccctcccctgcagcccagcatggggagagatgtacccaagaaataccaaccaacagtgccattggcatagacgggctctggctgacatttgttcagaccagcaataatgcccagcctgtgtgcaatcttcccaattttcggagctcacacagcttccttgatgctcacaacaaccctgtggggccagcctaagctcagagaagttaaattcctcacccaacgtcagcagagagtaagtgggagagctgggacccactccaagtctgtccgagttcagggccatctgtccaacgctcagagcagttagacaattgacctctgtttccactggcagaccgagtgtagatgggctcctctgtggccatagatcagtcagaggatagcagcagacacatgcggaccaagcctcctgctgcccaagacccctgtggcccctctctccctaaccgctgcttctcctacagatctagtgcagagatgttggacagaacacaagaggttgaagtcagggcgggagcaggaaaaaaaaaaagaataagaagaaaagaggctggagttcctcctttcatcacaggaataaaaccccttcctgctgtcaatgggaccattaagtgggagtttgaggaagctccagaggattcaaattctgttgccactgtatagaaacagaggagaccgacgcagtgactcacatctgtaatcccagcactttgggaggctgaggcgggcagatcacttgaggtcaggagttcaagaccagcctggtccgcatggtgaaaccctgtctgtactaaaaatacaaaaaaattagctgggcgtggtggtgcctaactgtaatcccaactactcgggaggctgaggcaggagaatggcttgaacccgggaggcggaggttgcgttgagccaagattgtgccactgcactccaccctgggtaacaagagtgagactgtctcaaaaaaaaaaaaaaaaaaagacagaggaaatagaagtagggttggaagaaaacagggagcagaagaaattctcctctctgtcctgtcccttacttgatcattctccaggatcagaaagcctccttagaaggtcaggaaggaggatagagcaagaattagggatcctagacttatgcatggagagtttttctctacccggttatctcagaaatcctgtaatggagccgtctttccagaggtgcagaacaaaatgggaagctgtggccattgtgtagccattgaaggctagcccatggtcccctcacagcttccatgggcttctcccgagcatgtgcacgtatgatgcacccattgcatgtatacgtacatgcacacatttctggtcaaaaggttgatgattgataaaactgacaaaagctccaaaccccacaaatgagcacagcgttttgtaataatgagcatgaccaaaatgggaaaaaatagggcacatgagggatgagggaagaaaaaggactccagggcccagaagattcctaggcttccttagccacctcctcctaaagtaggggtaataagtacatggcacatgtgccagcccttcccctgtgatatagttgggatatttgtccgcacccaaatctcatgttgaattgtaatccccaatgctggaagtggggcctggtgggaggtgtttgagtcatgggggtggatccctcatggcttggtgctgtcttcctcatagtgagttcttgccagatcaggtcatttaaaagtgtgtggcacctccccattctctatctctcattcctgcttttgccatttgaagtgcctgctcctgctttgctttccgccatgattgaaagctccctgaggcttcaccagaagccaagcagatgccagcaccatgcttcttgtacatcctgcagaaccaagagccaattaaactgcttttctttataaattacccagtctcaggtatttctttatagcagtgcaaaaacagcctaatacaccctatctatacacacagcagacatcactactcaactgccatgttctttcccacagaaaacaagcctgatctcaggattcttctcatcaaagtgctccaggctgccaattaccaacctattagcttttactcatgagatgaaaatgatttgccaggccgggtgtggtggctcacacctgtaatcccagcactttgggagtccgaggcaggtggatcacttgaggtcaggaattcgagaccagcctgaccaaaatggtgaaaccccatctctacaaaaatgtaaaaattagccgggcatgctggcactcacctgtaatcccatctactcaggaggctgaggcaggagaatctcttgaacttaggaggtggaggttgcagtgagctgagattgcgccactgcattccagcctgggcgacagagcaaggctctgtctgacagaaagaaagaaagaaaaagaaaggaaggaaggaaggagaaaataatttgccagcctcagcttgagcccaggagttcgagacaagcctggacaacagggaaagaccctgactctccaaaaagctttttttaaaaatagcgaggtgtggtggcacatgcctgtgatcccagctatttgggaggctgaagcaggaggatcacttgagtccaggaggttgaggctgcagtgagccatgatcacaccaccgtattccagcctaggcagtggagcaagacccgtcctcaaaaagaaaaaaaaaagttggaaacctgatacagtcaccatttttgtcaggatccctcttgcttgttctgggttaggttcatcacaaagctgcttagatggacttggttattcaagtaaatattaagcgctaactgtgtgtaggatgatggattgggacacaactccatatgctttttatttccattatttttataactttctcttatattgatattttagtaacatggtaacaaatttaaacaatagaagaaagtagaagttaaaagtcagtgacagttcccacccattccccagttccctcaaccactcttgtcaatctcttctttccatctccaaagatatccagcatttgcatggatccagtccagtttgtaggcagttggtagcatgccacgcatactcttgcccttgcttttatcactcatgtcttgaacagcattttatgtcagccctccagaacttcctctttctttttaatcattacagagtattgcactgataaatgtacctaacattgagctaacaagttgctgttttttgttttggttttggttttgcctattaacatgcattaatgtcatggttagccttttgtaattataatcgatttattgttgtatatgtccttgttgtatccatgcaaatatatcagcaagattagttcctagaagtggaattcctgggtcgaagagtgttatagcagtcctttggggctgctataacaaataccatacactgagaaacttacaagtagcagaaatttattgctcatggttctggaggctgggaagtccaaaatcaaggagccagcagatttgatttggggagggctgctctctgcttccaagatggcacctacctgtggcgtccttacctggtggaaggagcagacaagctcccttagggctctaataatttttctttttttttttgacacggagttttgctcttgttgcccaggctggagtgcaatggtgtgatcttggctcaccgcaacctccacctcccacgttcaagcaattctcctgcctcagcctcctgagtagctgagattacaggcatacgcctccatgcccagctaattttgtatttttattagagatggggtttgtccatattggtcaggctggtctcaaactcccgccctcaggtgatccacctgcctcggcctcccaaagtgctggaattacaggcatgagccaccatgcccagcctctaaaaagaacactaatcccattcatgagggctccacactggtgacctagtcacctcccaaaggccctacctgttaatgccagcacactgggattcgattacaacacaaaaattttagaggggcacaaacattcagcccatagctaagagtatgcatatttaaaacttgtgatggtttggccaaatcatccttcagaaaggacactcccatgaacattatgtattaggacgggacgggctatgctgtaggaacaattagtcccccaaatcttagtatttaacacagcaaaggcttgttttttctcttgcgtcacatctgatgcagatggggtggctctctaagcagcatcccagggatccaggctgcttccattgtgaactaagccagttggaacatgtggcctccactgttgccacagccaggggagagaggcctggatgaatgtgtgggaaaattttaagcaaagtggcttacatcactttcacccacatcctacctgtcagaaccagtcatatggcctcagcctgactgcaaaagagtctgggcaatgtggaggagcccctggccactcgatgagcctcacgtctctgccagtcggttccccagaaattcacccacacagtatattccagggcgttttgttcttcgctaattaaatatatgaaaaatggcgtcatgtagactgtcgttctgccctgcacgtctgtgctttctttgggcagttgccctccgcctttttctgctgaaatattcataggggattatgttcactccagacacactccagtggccttccccaaattttcccaaaaccccaaaaccttttgtggggaagccctaagacattctatattttggctgttacaggcatacctcagaggtattgcaggttcagttccagaccactgcaacaaaattaatatcacaataaagcaaatcacacaaatttttttgtttcccagtgcatataaaatttacatttacacggccgggtgcagtggctcgcacctgtaataccagcactttgggaggccaagtcaggcggatcacctgaggtcaggagttcgagaccaccctggccaacatggtgaaaccccgtcactactaaatatacaaaaaattagccaggcatggtggcaggcacctgtaatcccagctactcgggaggctgaggcaggagaatcgctggaacccgggcggcagaggttgcagtgagccgagatacatgccattgcactccagcctgggcaacaagagcaaaactctgtctgaaaaaaaaaaagttacttttatactatactgtagtctattaagtgtacagtagtatgtctaaaaaaagtacataacttaaaaatactttatttgctgaaaaaaatgctaacaatcatctgagactttagcaagcgacttgtagtctttttgctggagagggtcttgcctcaatgttgatggctgctgactaactgctgaagagtagggtggctatggcaatttctttctttctttttattttttttgtttttgttttttgtgttttgagacagggtcttgctctgttgcccaggctggagtgcaatgccacaatcatggcttgcagcagccctgatcaccttggcaatgccccgacctcagccttccgagtagttggaaccacaagtgcatgtcaccacacccagcctatgtttttattatttgcagagacacagtctcactatgtttcccaggctggtctcgaactcctgggctcaaggagttcctgggcccgcttgggcctcccaaagtgatgggattacaggtgtgagccactgcacccagccacaatttcttaaaataacacaacaataaagtttgctgcatcaattgactcttcttttcatgacggatttctctgtagcatgcaatgctgtttgattcacagtagcacttctttcaaaattagagtcaattctttctaactctgctgctgctttatcaactaagtttatggaatattctttttttttttttttttttgagatggagtttcacttttgttgcccaggctggagtgcagtggcacgatctcggctcactgcaacctccacctcccagattcaagcaattctactgcctcagcctccagagtaggtgggattacaggcgtccgccaccacgcttggctaattttttgtatttttagtagaggcagggtttcaccatgttggccaggctggtcttgaactcctgatctcaggtgatccacctgccccggccccccaaagtgtggggattacaggtgtgagccaccactcccagacaatttatagaatattctaaatcaagcttgtccaacccgcaggccacgtgcagctcaggacggctttgaatgtggcccaacacaaatttgtaaattttcttaaaatattatgagattttctttgcgttttttgtttgtttgttttctcatcacatatcgttagttgttagtgtattttatgtgtagaacaaggcaattcttcttccagtgtggcccaggaaagctaaaagactggacaccctgctccaaatcctttgttgtcattcacagcatcttcaccaggagtagcttccatctcaaaaaccactttcttgactcatacataagaagcaactcattcattcaagttttatcatgagattgcagcaattcgctcatatctgcaggcttcatgtctaattctagttttctcttattacttccaccacatctgcagttcatttctccactgaagtcttaaacccctcaaaatcatccacatggatccacttcctccatccacttcttagcatccacttcttctaaattagcatccacttcttccacattcctattcatgttgatattttcacctcctctcctgagtcacaaatgttcttactggcatctacaatggaaggttttcagtttactttgcccagatccaacagaggaatcactgtctattgcagctatagccttacaaaatgtatttcttaaataatgtaacttgagggtcagatatggtggttcacgtctgtaatctcagcactttgggaggccaagggaggaggattgtttgaggccaggagttcaagaccagcctgggcaacatagtgagacatctctacaaattaaaatttaaaaattagccaggaggccgggtgcagtggctcacatctgtaatcccaacactttgggaggctgaggtgggtggatcacctgaggtcaggagttcaagaccagcctggccaacatgatgaaaccctgtctctgctaaaaatacaaaaattagccaagcgtggtggcgggcacctgtaatcccagctacttgggaggctgaggcaggagaatcgcttgaactcgggaggcggaggttgcagtgagccgagatcacgccactatactccagcctgggtgacaaagcgagactccattcaaaaacaacaacgaaaattagccaggtgaaataccatgcacctgtagtcccagctacttgggaggctgagacaggaggatcacttgagcccaggagtttgaggctacagtaagccataatcatgctactgcattccagcctgggtgacagagtaagaaaaccctgtctcaaaaaaaaaaaaaattaattaattaaaaaacagacttgaaagtcaaaattactccttgatccatgggctgcagaattaatgttgtgttaacaggcatgaaaacattactctcctcttacctgtccatcagagctcttgggagaccaggtgcattgtcaatgagcagtagtattttaagcagtaggtgtcaacagtgggcttaaaatattgaataaatcatactgtaaacagatatgctgtcatccaggcctgttccatttacaagcacaggcagagtacatcttgcttaattgttaaggtccctaggagttttagaagggtcaacgagcattggcttcagcttaaagtcaccagctaccttagcccctaacaagagaatcagtctgtcctttgaagctttgaagccaagcattgacttctcctctctagctatggaagtcctagatggtatcttctttcaatagaaggctgtttggtctacatcgaaaacctgttgattattgtagccaccttcgtcagtgatcttagctagatccttgggataacttgctgccaattctccatcagcacttcctgctttaccttgcacttttatgttatggagatgtcttctttccttaaacctcatgaaccaaccaacgctagcagcttccaaattttctgcagcttccttgtctctctcagctttcctagaattgaagagagttagggacatgctctggtttaggttttggcttaagggaatgttgtggttggtttgattttctatccagaccactcaaactttctccatatcagcaacaagtctttttcacattattataatttgtgtgttcactagagtagcccttttcatttccttcaagaacttttccagccgggtgcggtgactcacgcctgtaatcccagcactttgggaggctgaggtgggcagatcacttaaggtcaggagttcgagaccagcctggccaacctgatgaaaccccctctctactaaaaatacaaaaattagcctggtgtggtggcaggcacccgtaatcccagttacttgggaggttgaggcacaagaatcacctgaacccaggaggtggaggttgcagtgagccgagatcacgccactgcgctccagcctgggcagagcgagagtctgtctcaaaaaaaaaaaaaaaaaaagaatttgtctttcgcactcacagcttggctaactgtttggtgcaagaggcctcacttttagcctttctggctttcagcattcctgcctcactaagctccatcatttctagcttttgattttaagcaacaaaagcgtgactctttctttcacttgaacacttagaggccatggcagggttattaattggcctaatttcaatattgttgcatttcaaggaacaaggagaggcctggagagagggaaagagaccagggaatggctggttggtggggcagtcagaacacagacatttatcgattaaatccattgtcttctatgggtgtggtttgtggcaccccaaaacacttacaatagtaacatcaacaatcactgatcacagatcaccataacagatataataataatgaaaaaatctgcactattgcgaaaattaccaaaatgtgacacagagacacacagagagctcatgcttttggagaaatggcactgataagacttgctcaagacagggttgccacaacctttgatttgtagaaaacacagtatctgtgaagcataataaagcaaagcacaataaagtctgtcctgtttgtattcacaaaaacatataaaggcatgtgagtaataatataaaattagctgggtcaagatcgttgccagctgtggtgtggaatggattggcagcagttctgtgccatttcccaggctctctgtgcctccacctcctccctcattcatgaaagacaagccaagcaagggacaaaggtatacaatagttgctgtaaatgtccctatttcacctatgagaaaactgtactcaaagaggtttaaattccttgcctaaggtcataggacctcaaagacaataagcaaaagcaaggaaactgaacgcactcatagctacacagagattcattgctaactttgtcagacgttgtgccaagactctctctctttctctccctctctctgtctctctaccaacccccccccaacgtatgtgtctctgcgtgtgtgtgtgtgtgtgtgtgtgcatatgcatgtatacacccacttttttttttataaaatagactgcaactggagatactggtgtgtcctattttttggtgcagcgtcataacataagcatctttctaggcaataaattaactttatgctggccttcttttttcagtggagtattaattaagcatcttgtatgtgcccaatattctgctggttctgggggaagaaggccagcctacaggaaacaacagctaactctttaaggcagtgcataagtccattcatttgcttcacaaacattcattgagccctgccacgtgccaggcactgtgggtatcgtggagaacaagactactgtccgaggcaagagctgggctcctcctagcttcctctgtccccctaacctcctctcacccacaggcattgctgggggtattttcctgggttggttggtttgttttgttttttgttttgttttgttttgtttttttgagacagggtctcactatgttgctcaggatggtctcaaactcctgggctcgagcaatctcctgcctcggcctcaccgtgcctggccgttgtttatttatttattgtggtcaaatgtacatagcataaaattgaccgttttaactattttcaagtgtacagttcagtggcactaagtacattcacactgttgggtaaccctccccactcttccactgcagaacccctttcatcttgcagaaccgaaactgtccccattaaacatcaaccccccggcccttcatcccagcccctggcagacacccttctgtctgcctctatgattttggcgctctgggtacctcatagataagtgagattgtatagtatttctcctttggtgaccagcttatctcaccaagcgtgatgtcctctgggagcatccgtgtggaagaggtgctagcatcattttgacttctcaaacatctcgtgggtgtcacctccccctctacctctctgccactgcctcgctcagccacctgctctctcctggacccttgcagaagggactgactgggctcctggcctccagtcctgccctcttctaatgtatttttcataccacttccaaagtgataatacattcctcttttgaaattttagatttggttactaaagcaatacaggtgtatggttaccaaaaattcaaacagtgtaaaagagaataccagcctgggcaatgtagagagaccctgtctccataaatttttttttttttttttttgagacggagtcttgcagtggtgggatctcggcgcactgcaacctccacctcccgggtcctcattcaagcatttctcctgccttagcctcctgagtagctgagattacaggcatgcgccaccatgcccagctaatttttgtatttttagtagagacggggtttcaccatgttggccaggctggtcttgaactcctgacctcgtgatccacccaccttagcctcccaaagtgctgggattacaagcataagccaccacgcccagtctccataaatgatttaagaaaaaatgtagccaggcgtagtggcacgtgcctgtgctcccagctccttgggaagctgaggtgggaggattgcctgagtgtgggatgtcgaggctgcagtgagccaagatcatgccactgtaccccagcctgggtgacagagtgcgaccctgtcccccccaaaaataaataaatcaaagggcataaggtgaaaagaatcgtaacattatgtttttgtagctctgcctctgtgatggtgccccctgcatggcttgctttcactgtgccaatgcaccacagttacccagcctgccggctctgataagatgctcgccatgcttctcccatgctggacttgggccacgtccttgggcatgaatcttggtctatgtccaggtcggttctgaatgagccagcagactcctcccggggctgcccggctacatggttgagggcatcctggacaccagcttcagccacagctcctgaccaggcaggtgcagtgaagccgggaggtgtaggtcagttcctacctctccaacctgaggtcctgcacttcctgcagctgttggaagggatcgtatccaatgggagcaagaaagtgtgctcccccacagccccactcaggcataaagggccgaggggcagccaggcctgtcctggctagggctggctcagagtctgtggcagccccacccctgccaggctggcccttagccccaagatccacctatggcactcgcccctttacagctacgtggacatccactgacactcaggtgacacacctttgcctgcttctactcagtcttggcagcagttggacaaaaggaaatcaaagatcggttctttcttgggagaggaagagcaagctggagccctggggtgctcagatgctcttgggagtaacatagccccatagccccggggctatactgggtgcaggggggtggaggtggtgggggagctgcagccaggcattcattcacttcccgttctttcattcctgctcttcttttgctcactgactcattcagcagcctctgggctgggcgtttactctcctgtcaggcaacacactcctgattgggtggccttggccttcccaagctgtctctggctgtccccaagtgaaacggaatctgggctggacaggccaccggatggacaagctcttctcatctaaaaccaaggcagttgacattgtgggctaaatgataagaacaaaattaaaaaataaaaaccaggcaggctggcataggagctccatttccctgccctactgtgccagtggcctgggggctcccctgccgcctctctccactctgcagattctgagaaaactcacaaaagagcccactccaaggtgtttggcaacaaggtgggggcagcctcccagcacccagcacacatggagctttcccgcagtgggtttcagcgctcccactctgcctcggagctactctgtcaccagctcttgccctcccttggctcctctttcccatgcagctcctcctccagctcgtgggaaaggccgagaggccgggccagcaacagctgagcatcccctcaacctctccctaccccaccccaccccactgtgctcttggccccaggcaggcgaggggagtggagttttgctgcctgatgcaatgtctggcagggccgtcccttatcacagccgacttgctgggacccccaccttccccggaggaggccggaacaggccgcagtccattttgggcctcagtggaagggcctggttggaggccatccaagtagaaaactcgttctctgggaggcaccttgccaagtcacgagggaggcctgagcagaaagacccctgggggagagaagggagggaagccgaagcctcacttgctggggcttgcctggcctcagctcgcagccccctttttccacagcgttctctccctcacatttgtctgcagatggcttaggctgttttctgccctcccccttgttaccccacagctgtgagaggctggatggaaacaagaattcaagagactaaagttatgtgcggtcccaagtgtgaagttttgcccacagttggtggccatggttcgcaccgtggtcccagcacacgccctcagcatgcacctgtggcccacacgctcatgctcacagccactcatgtatggagcaattgcctttttttcttcctcttcatatcttctgtcaacttagaacgattaagcatcttgcagtaggctcaatgctttgggaaggacattgattcgttcattcattcattcattcattcagcaagtatttatgaagcacccactctgtgccaggtacagttctgggcactggagatgcaagggtggagcagacagatgaagctctcctctcccggagtcaacgttctgggggatgagaggccatcagcaagtgcatttccatctatgaagggagtaaagcagggcgccaagagggaaagtgatgggggtggcccacattaggtcaggggtcagggaagtactccagagctgggggggcatttgagctgagtcctgattgcttagaaggagccagccagagcagatctggcccgggcagaggtaccagctgatgcagaagcccccaggtggggagtggcaggaagggccagggtgggggtgttgggagaagaggtgggaagggtgagcagggtctggatcttgaaggcccttacagggcttttattttaccaagtagtgcatagagtgtttgaagcagaagctgccttattgtctgtgcctccgagaagtttccatgtggctgagaagctgggtggcagcacagttataatcagtgctcaggtgttcccctgtctgggtggctgcccacatgtgatcccatagaagaggctgggcctgaggaagccagggaagcaggagggggtgtggggaggccagcaggggtgtgggcctcagcggggagggaggaggtgatgcagcatggaagatgagaagcccacaccagccacactaggcccccaggagattgtggacgccgtcgggagcattattcggtggaggggtgcggggcagaagccagatgagacagctgggaggtggcaggcaggtgagaatgtgagacagagggaggacagtgatttgagaactgtatcgtaggtgggataggagtccacatcccagccagcacctagaaggttgggctggctctgcccagggcctggcacgtggtgtgcactcaccagatggtcgccgccctgaaagaactcagcactgtgcctcttttcctgcctctggtgtttgctgtcaatatgcagagtgctggacaaaactgggccaagggagctgtcccactgcctgctgccctcaagcagagctgacctggcacatgcctctggcatacttcctgttggccctggcaccctgcaaagaggcccccagtgggcccaagcaggggataccacccgttccttgggctgttatgtagttgctggggcattgaggggatgaaaggtttttttgttttttgggttgtttttttttttgagacagagttttactctgggtgcctaggctggggtacaatggcatgatctcggctcactgcaacctccacctctcaggttcaagcaattctcctgcctccgcctcccaaatagctgggattacaggcgaccaccaccacacctggctacttcttgtatttttagtagagacagggtttcaccatgttggccaggctggtctcaaactccagacctcaggtccacctgccttggcctcccaaagtgctgggattacaggcgtgaaccatcgtgcctggccggatgaaaggtattgagtactaggggctaggagggaccaagagaaggaggaagagatttttcggttctacccatgaactaagcaagggaggcaggcctagcccttgcaccatggaagtgggagagaagtgatacaaaggtgtatctgatgtcacaggtgtcacaggcctgcttcttgtaaagggcctcctgcatggtgagttctgcgtggggctttgctgagtaacccccatccgggctctatccccttccctcatggccctgtgacttcctggcaccatgaccctctccccgcttctggctctgggaagctccaaacctctctcacctgcctgcccacctgcctgctaggtttccaaagctaaacagaggggcagctgtctgggcagggcaagggagccaacagcctgcctgggtttcctgtccaagtgtccagctttgcttcttcctcttagggcagcgtcaagaaggatcttaggaaagctgtgttgctctggggatgaggaggctggaacagcaacttaaaaaaagaaatagtccctggaagggagggaaggagaaggttcagaggcttgtcatttaggcaccccaacttctataccttaccaaggtgccaggcccagagggaagggggtagccagggcagctccccgacccgcacctgccttttcacccctctcctatttcacaagcatttaccatgcatcaacagatatgttcctcacagcacctttatcagcagggactgcccttttcatgctacaaacaggcccagagaggttgtcacttatacaaggttgcacagcatggtagagacacaggaaggactagagcccaggacttctaaccctagctccttctgcttccctcacatcatcagctccagacaacctgagattggagaggacagaaagtcaggatttcaacacctcgtactctgaaaactcagtggtggttctcaccctgtcagtggggcaggtggcctcacaccccaccacaggctaaacagggtgcatgggggacgtagccccactggccattctacacattcatgccaacagctaccaggcaccagcctcaccattgatttttggacagctggtctgtgccaagtgccattctagatgcgagtcccgactttggggtgcttgcattctgggaagggagatggtcagccagaaagccccaccataggagctaggttgggggtccccaaggtacaccaagaagctcaagtgacctggacctgggaggggtggccagaggcttctgctggaggaaccttaggtcagttacctaacctgtctcaacctcagtttcctcacctgtaaaatgggctagttgctgcctcacagggctttgctgaggatttgatgagtgcaagtgcttagcatggcacctggcacagagaaatatgcactcagtaaacttaagctgcccatatcattggttggccctcccaaccagagtgcaagccccgggagggcacagaccatacctgcttgttcaccgccatattttcagtgcctaggccagaagccagcacaaggtaaatgctcagaaaatattaacttaataagttcatgagaaaaggcccaggaaaattaggaagaggcaggactattccagttaggaatagactctcctatgccaggcacagtggctcacacctgtaatcccagcactttgggaggccgaggcaagcagatcacctgaggtcaggagttcgagaccaacttggccaacatggtgaaaccccatctctaccaaaaaatacaaaaattagctgggagtggtggcacacgcctgtaatcccagctactcaggaggctgaggcacgagaattacttgaacccaggaggcggagattgcagtgagctgagattgcaccactgcactccagcctgggttgcagagcaagactctgtctcaaaaaaaaaaaaaaaaagggaatagactcttctttctgcagctgtatttgctctagctgtaaacaactttgtagccaagtgcagtggcacacctatagtcccagctactccggaggctgaggagggaggattgcttgagcctaggagttggaggccagcctgggcaatatagcaagaccctgttagatattatctatttagataataataatgacctgtaatcccagtactttgggagaccaaggcaggtggatcatctgaggtcaggagttcaagaccagcctgggcaacatagtgaaaccccgtctctactaaaaatacaaaaattagctgggcgcagtgatgcatgcctataatcccagctactcgggaggctgaggcaggagaattgcttgaggcagaggttgcagtgagccaagattacgccattgcactccagcctggacgacagagcgagactccatctcaaaataataataataataatgatacatactatttcagtcgagggtcattttttcctttatccatctgttgttcaccaactgtgtatctcttgcctggcccaggattgagagataatgaggggcccagatgaactccctgtcctgcctgaagggatgttcagtattgaacaattgttgctttatggctttatgacaaagtcccaggtgctcatgataatctttgtacagtggtggggctgtagggagccctaacatagcctgggggaggctgcctagaaagtggagacctgaaggctgaggccatgttaaggatttaggtagaatttatgcgctatgatatttttttctttcgttaattttttataatttacgtatacacatggtaaaatgtgtaacaaggcacagtgttacatagcaaacataagcctcactccaccttctctctccacctacctgtccaccttctagatgcagccattgttaccaggccttgcgttttcctgcagccagagtccatttgtatcccgcatctatattttcttcccggcatttgtttctgaatgggagcttgctacatcggagtctctccaccttggatgatttgtcaccccccaccttcccaccccaggagacacttagcaatgtctggagatatttgatggttacagatgagcagtgggggccaggcgtggtggctcgtgcctataatcccagcactttgggaggccgaggcaggtggattgcttgcactcaggagttcaagaccaggctgggcaacatggcaagaccccatctctacaaaaaattttaaaaattagctgggtgtggtggtgtgcacttgtggtgactaagggggctgaggtgggaggatcaattgagcctgggaggttgaggctgcagtaaactatgatcgtgccactgcactccagcctgggcaacatagtgagaccctgtctcaaaaacaaacaaacaattattggcaattagtgggtagaggccaagactgctgtcaaacattctataattcacaggacagtccccacttacctggtggaaaatgtcaacagtgctgaggttgggaagccccgtcctgcataagcacagggtctgcacctttgtgtgtgtgtgtgtgtctgtgtgtgtgtgtgtgtgtgttctcatgtattttctggatcattcacatttatacatccacctcattattctttgtggccacataaaaatccattacctggatgctccaccattttcatttaggtgtttgcactctttttgctattataaacatttatgctacaaaggttattcttttccgtgcacaggcctttgatgtgtgaggtcaagggagaaactgatggaggtgggatggatgaacccgatggttcattagcattttaaatgacctattaaagagaccttcagtgtctctggggcacagtctgtctggagagtgggtctggggtcctggctgctaaccagggccgagatcctcaaaagtctggtggagagacatcctctgcattcctcgtgtacagacaagggtgttctgaccacctgtctctccgcaggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaaggtgagggttgcaagcccaagtcttcatcttcctttcaaggtggggtgggtggggacagggaggtaactgcagggctctctgtggacctgcaaatgcattccttcaacgagccatccccaggccccttctatgtcccaggcagtggctcctgcacacgtcctcatgactgcacaggggtgagacttgggctctggactcaaacagcctgggttggagcccccccatgttggccctctacagctgtgaaaggttagacaagatacttaacatttctgagtcttcggttcctcttttgtaaaacatggctaataatgggaccagcattgttgtaaagattaaatgagaaaatgtaaaagcatttagcccactgcctggcacatagttggtgtccagtatttgctggctgtgactattactgttaatttacctcctggccttgcattagcagcacatcccctatagaagtcttgatgtcactgagcccatggaaaggcaaggtcctagtatggatactctgatgggcaaggctgccaatgtgcagctgccaagttgtgtactgctcaactccaggggcatgtccctcaaataggctaatctgggaacgcccctttacccctttgaattggcagcatacagctatgtgcagtgggcctgttagatgtagaaagatttcttagcctgttctcctcccaggcacaagccctgcaagaaagcattagctaagatgggtgggtcagggattgggcaatatagtggacaccgtcaatccccccccttgggtcactgagcaaggaccgttctagcttgtgcctattgggttctactgcaagcccctacagctctgcacctgagagctttctctccactggcacactggcaagccggaagtactagggagtaactgtcccccccagatccccatcagactaagcctccgatgcccacacctgctcctagcagcacatccatcatgcacctctttcctcccctgcctcacttccccatccagtacttcctgtgatcatgtcccaaataaacttacttaaacacaaatccttgcctcaacgtctgcttttggggaaacccaactgagacaggttttggtgatctgcttggaggactgcttagggttgcccaggagacggggtccccagtcagccactgaccctgatcttctttgtcctcacagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtaccgcttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccgcctgcggccctgccatgcgcctcttcggctacaaactggcgcgggacgccgccgccctcaccaaccgctcagtcagcctgctggaggagaggggcaccttctgggtcacgtaggggggccggggccccgtatgcccctcctcgtgaaaggcctgccccgtctttctgccgcagccctcgcagagggcgggtgcacagcgccatgagcgggcagcgcctcctgtagcagtagggcccccagccagcgctccagccaaagcggcggccccagggttaattgcggagaacaggacagtgcccggtccccttgagggccatcacacccagacccaacgggttgcagcctcctgagcaggcctaggcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgcttaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctggaattcctccttagggccctgggaagagtattgcttaacgcaggatgtgctgggtgttttgtttcgggcttttatttatggcttggtgtctttcttgtttcatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgcttctggtttcctggacaatttctctgtcagatacggcccattgtaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcggaggggctgggactggggagggggcagccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccagtctctgtcacatacaccgcaggtggtcaccgagttattttccaaaagctgaggaacataaagcaaatttaggcttttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcagttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacttgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgcagcgtgtctctgccttttcctttgcatttgttctcagcagcaattgggtcataatttttttttttttttaattaacagtggtagaaaggaggtgacttccagcatgaagcaggacagagaatccccctgcccattcccaagggaccaaaggcactaggggaatatggggcaggatgaatgtaccttgcgtcaccaggctggcagagctgatggggactgcgctgagcggagagagagaaaacccaggtatttgggggcagagacaggagtgttgggccagcggtcagggggcctggggatgagtcccagctttgccactgtctggctgtgtgaccttgcataagtcacttcccttacttggacaccagtttccttttagaatgaaggtgtaatcagttgttcacaaacattgttcccaaaaagccccattagggattcaaaagtcagctgaaagggcaggcggcaccctctcaacaagagtcactgtgcgttttgatctgcttcacgtgttcagatagcatttcagatttatttggccttcaactaaatctccaaaaacacataagaaggttgccaaggaccctttcagctaagaaattgaatggagtcctttcaaattgcagttacatccgtcataacaactttagttcttactacatttcagccctgcttgtctcccaagagctgcctgcagagcatgggtgtttccctggggagaagggagagagctcattttggaacacagaagccagagctggtggggctttgtgggtctcaggacacaggggtagcaggaccagcagctgcaggaagaggcagaggagggctgagcacggggacagtggctcctggagtgagggaatgaagactcagagaggctcaatgtgagggaacaggcccccctccccaaatcttaacctgtgtctctgccagttcacccagtccaggcttgggaagctcaagccagctccctcccacctcttaaagtatttgagccggtgcctgtcatcccaacctgaacagaagctgcccaccccagtcaggtgctattgctgtctcccctacgctgggggctggatatagttagtttaatttctgggctgtgtttcctaccacaaatgaccccctggggaaacaaattgcactaatcacagagcagagaagcctggacacctccccacccacccacccctcagctgccaggccggaaccgtctctcctcctcctcctttcccccacccccagaccccttcaggatcgtcagtcttccttcctacaccccaatttactcaaccctggggaggagtcaagcgccccgtgggctctctgggacagggagagttggctgggactctctggaaagcagtttgatcagcagggggctggggtcagggacctgtgccattgcccacagagccctgccaggcccagcactggcccagccctggagcctgcagcagcatcctcaagtgtgtttggagaaactgtggtcacaggattgctcttgggaagttacagtgcacatttgcgattacaggctccaggtaggccgctttcctttgactcacccagcattaaggattaccttctagaaagaaccatttttatggaattcgtttatcatgaaaaacttttttccaaacaacagtctttttcaagactctggccttctttattttttaagactctgtcacccaggtgggagtgcaatgacgcaatcacagctcactgcagcctggacctctcaggctcaagcagtcctcctgcctcagcctcccaagtagctgggactataggcatgcaccacacttgctagcttttttgtattttttgtagtaatgggatctcgccatgttgcctaggctggtcttgaactccgaactcaagcaatctgccggcctcagcctaccaaagtgttgggattataggcatgagacactatacctagccaagactctgtcattctgcaaaagagttagtagctaccagcagcctgcagctggaagtgtgtaggaccaaaagccaccctaagcagccattaggtggtgggtgagttggctgggagaaaaaatctagggttgggtttaaggcccatcccccttcacaccatcctccccgagctgccaggctaagaggagccctcagagattgcagcagcctcaggggcactgagagccagggttcggggcactgagggccagggttcaaggccctgagacttgctgtccccaaacctccctggttcttggcttcctcaactcaacccacgctgtggggcctccgtggcatgacccaaaagatgtggaacaccccacagagagtgggaactctggagaaccaggccaggtataaacaccacgggatactatttatctgagaaataggagtttgagattgctcttaaaggagccatttctgaaacagtgggacaaaggttaccagcagtaaataggtttcctggaggtgtaatcctctagtagctagtaaaaccttcgctgaaatctgcgggccgtttattggaagaagaagcaggtagtaagtgcccagcaggagaggcccgcccaagaaaattagaagggggaaaaagaaggaagggagggagggggaaggaaggagagggaagagaagaggaaagaaggaaaaaagggaggaagaggctgggcgcggtggctcacacctataattccagcactttgggaggctgagatgggaggattgcttgcggctaggagttcgagaacagcctggtcaacatggcaagatcccacctcttaaaaagaagaaaaagaaagaggaaggaagggtggggaaggttgggaaaggaagggagagaggaagggagggagggtgacagtgggatgcatttcatgccaatgcagaggaggaagacagccaagttgttgaaaagaacacccttggggatagccacagccacagtgcccaagagtttagagggtcaggccaagcccaggtacactcagtcctgtacacctttggccatggggctaatttgccccatggatatgtggctcacaccatgtttgtttctgtttttaacaatcggcaggccagcacggtggctcacacctataacccccagcaccctgggaggccaaggcaggtggatcacttgaatccaggagtgtgagaccagcctgggcaacacggtgaaaccctgtctctacagatacaaaacaaaatattcaccgagtgtggtggtgcgcacctgtagtcctagctactcgggaggctgaggtgggaggattgcctaagcccaggaggttgaggctgcagtgagctgtgatcacatcactgcactctagcctgggtgacaaagtgagactctgtctcaaaaacaaacagttggcattcaaggacaacactaaaaactgaaggggttttatataaaaggcagacttggctcctcttgaaaatcaggtgtcttggtttgggttacaccggcagctgacactgggacaagggcaaaatggtttctttaggagctgtggatggtccggcaagggaggagaggaggcaggcagccagcagaaccgtgccgctgagccagctgccactttggggaactggagccgaatccctctgggaaccacagtgcaaagccggtgccttggactcactccaccccggggtgaggagagggagtctgaaggttcctacaccagtgcctgtcagcttctggctgagactgctcttggagggtattaatttcacagcacagccgctggccccagcagaacagcattcccaaactctggaacaaaccattagactcagaggtaaagatacaggtggctagaagtttccagagcacagtaaaaggttaggtgtaggggatagggcacggtctgacaacatctacgccctggggtgctctcattcccacaggaaaaataggctctggtgggagggggcagcagcctttttaaccggagaaggtcagggtccccacctgcccatcccccggtctccccaattactgaggcagcaatgccctttgccatgtatcatagcacttgcactgatgtttgacttccaacacaatatcttctctgtgaattcatgtctgtccaacatgagaaagtgtcaggccaagagggccacggctcccaagccattcactgtgacagctccccagccactacgggtatttgggtttgcagccctggcttaaagtcctggaatgctaagggctgggctggctttcctgacaacattcactctaggcttctttttttttgagacagagtcttgctctgtcgccaggctggagtgcagtgctatctcggctcactgcaagctccgcctcctgggttcatgccattctcctgcctcagcctccccagtagctgtgtctctactaaaaaaaaaacaaatacactctaggcttcttaatgcttagacctcaggaatgaggtggttgctctccctggtctgcacaccatggaactcaacaccccctggccatctctcacggcacctacctagacttctcccgcccacctaagcagatggccagaataaacactgaagaagaggacagctggttttgcccacctggaggtgaacagggctaggcctgcatccagtccacgccagagctgccccctggaatgttttcaactcatttctgcctcggtgcacacagtggggcatgctcctctgtggggcacacagaccccttgggcacgcgctcactgtgatcagcatggcagttcccagtgcctgggctcaaatgcttctccattctctcccacacaagaaagctcaacagagtgacagaggacactgtgtgtgcaaagacctggaggataaaggggacatgggaagtttggagaccaagaagcagtttgctctggccgagatggtgatgagacaggaagctggagaggaaaactggggcccgaatgtactaagaaaaagaggtctgacttgctcctaagagctatagagagccattgaaaggcagagtgaagcagagtggtttggtctgatcaactgtattctattttacagagagaagagtgaggcacggagagctgaaatgaccagcagcgtcagaacatgaacccacgccactcatccttggattccaagcctagatcctcctgtcctatcctttgcctcacacctcccacccaatgtattaagaccccatgggctgtgtgctatggtttgaatgtcccccaagattcatgtgttgaaacttcatcaccagtgtgatagtatcaagaagtgagatgtttagaaagtaaatcatgaggagagagccttcaagaatggaattagcagctgggtgcggtggctcacacctgtaatcccagcactttgggaggctgaggtgggcagatcatgaggtcaggagtttgagaccagcctggcccacatggtgaaaccccatctctactaaaaatacaaaaattagtcaggcatggtggtgggcccctgtaatcccagctgctcgggaggctgaggcaggagaatcgcttgagcctgagaggcggaggttgcagtgagccgagatcgcaccattgcacgtcagcctgggagacagagtgactctgtctcaaaaaaaaaaaaaaaaaaagagtggaattagcaaccttatgaaagggctggaggaaactagtaatcactcctttttgccctctgccatgtgacagcacagcactcgtcgtttccagaagaatccagagtaagacaggaagcagagaacatccctcaccagacaccaaacctgcagcacctggatcttggacatccagcctccagaacttgagagataaatttctattgcttagaacttgcccagtctgtggtattttagtatattaagttggtgcaaaagtcatgggttttttgccattactttaacgtaaaaaactgcaatttttttgcaccaacctaatagcaacacaattggatgaagacactgtgtacatgctatgaaacccaagccagaatcacaggcttctctctggagtcatacagggcaagccccagctctctcttgggtgctaactttccaaagtctgcccctgagtctgctcttctccacgcttgaatagcaacaatgtgtcctagctgtgggaccttggaccagtgacttgccctctctgagcctcagctagctcatgtgtagaatgggggataatatcgacgggaagggtagggtgctgtatggcgcatgcctgatttgcagtgagcctgaatcaacaaatactttgaagtctggaatggaggcccaagtggagcttatcatgcaacctagggccacatagaatgagtccctcggcatctgccccaggcaggcaggctgtaaacctggacaaatactgaaaggacaaatactgcaggacaatactgaaaaccagaattgaggttccagggaccaactctgagacaccccatggagcaattcccagagtttgaacaagtgagcaggggagagttttctcgttccttttgggagtgttcattcattccacttctgtatttttttaacattctctttcccctgacttgaggttgatttatttaagcagtttcccttccaagaaaaaatgccctctgcctctgtctctatcagtggagagaccgacacttagaaccaagaagaccctggtttaaatcagttcactcaagacattggctgatgggcagtgcttctccctccagccctggctcttgaggggtctggccagcccaaatagtggcatgttcacacttggcctgacccaccacttcctgacacatgtcctattcggctggggagcagggaaacagttgagaagacatgtatcaagacttgctcatggaagcaggaatccaagatgcccattacaggggaatgctcctgacatcttacttctagacgccagtgcctttctctttctctttgaggggtgtttaagcctcggtccctgacctcagcattcacatagcctgccactgtgcctgacccagcaagatcagtggttgaatgaattaattaattaatggtgataaagttctagaagcatttggaataagaacttttttttttggagacagggtctcactctgttgcccaggctggagtacagtggcatgatcatggctcactgcagcctcagcctcccaggctcaagcccacatcagcctcctgggtagctaagactacaggtgcacaccaccacagccagctaattttaatttttttgtattttttgtagagaaagggttttgccatgttgcccaggctggtctcaaactcctgggcttaagtgatcctcctgccttgggttcccaaagttctgggattacagccatgagccaccacacccagccatgtctttttaaatacacagtggtgcactgtctttgcaaatgtcagtgtttgtatgacatggaagacaagagtgtggaatctggagccaatctgcctggtctcaagtcctggctctgcccatttcatggctgtgtggcctagggcaaagtacccagcctgtctttgctgcagtttcctcatctgtgaaatggggataaagctggtatctacctcatgaggttgttgtaagtattaagttaatgcatgaaaattggcgcatagtaagcgctcagaaatgattactgctatgctaagagcctggccggaggtagaagagggtaaaacaggaagttctaatggtttttctttcaagaaattgttactgaaaccacaggggttcgggctaggtcctgctgcttacaacacagaaagccaatcactaagacaatgaggattgccggggaagaaggcttcaactgggtaccgcatccaaggagatcagtcccaactctgtctccctgaccaattaaacttaggggtttatatagcaaggaagaaatgtaactacatctaggaaaacaggaattagggaggggtaaggaagaggagttggtcaacaacaggcaggcgttggcttaggaaatcatgaagggtgagaggtctggcatctcattgtccagatccagtgagtttcaatcagggaggcctgatggttggtttcctgagaaatgaactcagataagacaaatgtaactttgccaagtttcaagactgggaggtttcatttcaatatttattccaaagtagccataaatgtcagttctatgggataattgggtctgtttcaaaaatgacaagattgcagctggacacagtggctcacgcctgtaatctcggctctttgggaggccaaagcagacagatcacctgaggtcaggagttcaagaccagcccggccaacatggcgaaaccccttctctactaaaaatcacaaaaattagctgggcatggtggcaggtgcctgtaatcccagctacttgggaggctgaggcagggagaattgcttgaacccaggagacggaggttgcagtgagccgagatggcaccactgcactccagcctgggggacagagtgagactctgtctcaaaataaaaaaaaaataaaataaaataaaagaacttggcttttgatgccagtgatgctgtgcaaaggcagggaaacaccacatgaagagctcctagacaaagtctcctgttccattctagatgcaagcccaaaataaacacaggaataaagctcagacccagtggagatcaaagaaaggcaaacccaaataacagtgacctcttacactggcaatattttttttttaaaaaatagcaaaacctggctgggcgaagtggctcacgtctgtaatcccagcactttgggagccaagatcatgccactgcactccagcctgagcaacagagtgagactccgtctcaaaaacaaacaaaaaaaaagcaaaacccagtgctggtgaaggtgtggggaaacattcattcttttgatgggagacttctgaagggcagtttggtgacgtgtatcaaacatcttaacatgtttcctaccctttcatccagcaaatccagttacaggaatttattttattttatttttgagacagggtctcgctgtgtcacccaggctggagtccagtggggcgatctcagctcactgcaccctctgcttcctgggttcaagctattctcctgcctcagcctcccgaataggtgggactacaggcacatgccaccacgccctgctaatttttgtattttgtttgtttgtttgtttgtttgtttgttttggtagagacagagttttactgtgttggccaggctggtctctaactcctggcctcaagtgatccacccacctcggcctcccaaagtgctgggattacaggcgtgagccaccgcacctggcccagttacaggaacttatcctaaggaattaactgtggctgaatgctaatatttaatgttattaaacattaaatgttgtttataatagtaaaaaactggaaaaccactcaattgctgaatgacagggggctggttacatcagtatggttacacatatgatggattctctgcagccattaaaatgatcatgcaggttttttcatgacaaaaatgtttaggatacattagatgacaaaagtgggctgtaaaacaacaagcgccatatgacctcatttttgtgaaatgaagtattatctctaatatgaatatatctgcacagataaatgattggaaagatagaaaccaaagtgttgacggccgggcgcagtggctcacgcctgtaatcccagcactttgggaggccgaggcggtcggatcacgaggtcaggagatcgagaccatcccggctaacactgtgaaaccccgtctctactaaaaataaaaataaataaaaataaataaaaatttgccaggcatggtggcgggcacctgtagtcccagctactcgggagactgaggcaggagaatggggtgaacctgggaggctgagcttgcagtgagccaagatggcgccactgcactccagcctgggggacagagcgagactccgtctcaaaaaaaaaaaaaatgtagattaaacacaactaaaaagaaaacaataaatctaaaagagagagctgaataaattatcatggcataaactacccagaatgcagcagagagagataaaaacatgaaatgctagttaaaacacaaagacaaggccgggcgcggtggctcacgcctgtaatcccagcactttgggaggccgaggcaggcagatcacgaggtcaggagatcgagaccatcctggctaacacggtgaaactccgtctctactaaaaatacaaaaaaaaaaaaaaatagccaggcgtggtggtgggtgcctgtagtcccagctactcaggaggctgaggcaggagaatggcgtgaacctgggaggcggagcttgcagtgagccgagatggcgccactgcactccagcctgggtgacagagcgaggttctgtctcaaaaaaaaaaaaaaaagaaagaaaccaaagtgttgacagtagatggtgagtattttatggttttccctctctttatctgaattgttaacaatttctttaacaaacacgtattccttgtgtcatcacatagcagttaagagcttgggcttcagagttaggctgcctgagttcaaatcccaattccatcatgggttagctgagacctctctgagccgcagtcttcaggtacaagatggagagaataataataaagccaagacgctggctgggtgggtgttggaaggctctaagtgagatgatacaacccgtgtgctccccctggcacagtaccccacagttatccattactgttactgttatcaccatgactaattactgttataattattaatataacctttgcaattaggaaggtgagaagccttggcctctgcccatatcctctggccacccagagtccccgagagctgtccccaccagctcttccctgccaggttggcgctcgctctcagacttactgtgaggccttcagcccacacttgccagaactcccgtgttttctcctccgtgcccttttctgcagagaaggcttggaagaaacagcccagcaaacaccagtctcctggccccagagcgagacgtggaagtttgcagaaatgcatcaccaaatgtttgatttgggaggagaggaagagcagagctcataccgagagcaaaataggacagaaaggagatttttcagtaagggctgaggagagaccatcgttcatcactggggcctccttgtttcctcacttagtttcttgacttcagtcctgaccacctcatttgctgtggaacatctggccccaatatggggctgatttaataaatccaagacatcttcctttgcccagcagacttagaagaagccaaggagaaaccctgtggggttgccagcaaggacccatagaggcaaagagacagacaggaaagaggaggatggtgaataaccaagtgggaaccggggcgcatctggcaggtgagctgagacccatgtgttcagaaatcaagattatgggccagacagaggcatgcccattgaagccagcagcagcctccagaagcgaccacctgcccttggtttctatcctttcctgttgttcctcactaggcaggaactggctttatgtaggtcacagattttccagatatgggagaacaggatttgggacaccttgtagttgttacacacacacgcgcacgcgcgcacacatacacacgccccctcctcccagactggagggcagaagggtcatggagcttcagctagagtccctcctcctgttggtctggcctgtagggatactgtagcccctctgcctgcggatgtctcatgaccccagacaaagcagagtgactgtggctgacgagcatgtcggaagggctgacgggagcatcaggttgaaaatgagagaaagaagtgcatgaaagaagttgtgattcctagaagttcccactccacccacttcccacaacaactccactactccaaatgagaaattaattccttcaggatcagggttgcgaaggaggtgccaaaacctaagaaaaaggctttgtgtttgcagggtgtgaacttggtttaagagaagctagccatgacgcagctatgggacggggtcctggacgtctcagcatttcaggagagttagcaaggctgccctgcgcgggggtggggtggatctcttctgttactggtgttggagatagaacagtggtcagggacattaattgtggcgatcgattttccttattctcacttatgtatgtagaagagattcaatgaatggtaaagtcattatacccattcccctacagggagtagagagagaccagctttcctcattctgaactctggccctctacagggaagaaagagtccccaaactcaatactaaacaaacccagtggttttcagcaccggacacaagttaaaatctcccactagttctcacactttcctgggtatgcgacgccctgctcctgaaggccttgttaaaacacagatctctggaccccaccctaacagctttggattctgttgtcagggtggggcctgagagtttgcactttaacaggtgccctggtgatgctgatgctgctggtccccgggtccaactttgagaaccaccaccccacccccggtcctcagagactgatttggttggtttggagtggggtttctttggcagctgttgtttaaaagcacccagggtatcccagaagagccatggttcacaccatcaaggccagttatggagaatcttctacgagagcacattataaaaataagcactttcagcaggacgtggactctaaaaaaaataaataacataaaagtagaaataagcagaaacatccagctctcagttaagtacttgctaagctccagctgcttcaacctcatctaattcctgttccctttccacatcctggtcttagcccctctgcagctttgcaggagccgtctccacgtggcctggcctggctgagctctggggcaggagcgcttggtggcatctcttggctctgagtctacagtttccttgacatcttattgctctgattttctctcaagtgcctccccttctttcctttgttctgggagaaacattccctcatcttgtctatgtgcagagatccccaatgacttgccttccttacgactgagcagatagaaagcgacttgccttggtctgtggaatagccgatatcctatgacccttatccctccgcctggcgagacccacatggacataaatcacaaggatgccaaggcaagactgtggaccctgcctccagccgaggcctggcagaggggagctgtgggcttccagccccctgtgggaagatttaccaaacaaagagcagatgcttcaaacaatgacttcattgcagactgggtcccagtacattcaggaagggagtggcccatggatgctggccaatcctactcagaggagcctcaaagagaaaccaagcaggcaagccagtgaccaagcagccacggtgaggactggggaggaagacatgcacatctcacctctcctgggccaggcaattataggcaatatcctaattaatccttatgacggccaggcgcagtggctcacgcctgtaatcccagcactttgggagtccaagatgggcagatcaggaggtcaggagttcgagaccagtctggtcaacatggtgaaaccccgtctctactaaaaatataaaacttagccaggcatggtggcaagtgcctgtaaggagaattgcttgaacctgggaggcagaggttgcagtgagctgagatcgtgccactgcactccagcctgggcaacagagcaagatcccatcgcaaaaaaaaaaaattaaaattaaaaaaaattaatccttatgatgccacagtagaccttgatctggaagatgtgactgctgacctatcctgcctccttgggtctgatacaaacaagccgagtgggaactggcaaaagggcacgggtaagcactcatgtatgtgcatacaggtgtgtgtgtgcctgtgtgcatgtgtgtgttgattcctacccctcagtcttcccagccccagcgcacacagattccatcttcattttcttaaatcttcgtctttgcccataacctcccccatggagcctcccagcctaattgaaaaaaacaaaaaaagagagagagagagagaaatgttgaactgttatatgattccccttatctcaaatgggaggaaaatcgctggaaagttttaaagtctaggtgtcaatagtcctgtgagtcattttacgactgggttcgggcagccccgcagccaagccctcttgcctctctgaatctgttttaccatctataaaatgcagtcaagggaggtggggagggcttccagtcaggttagtttcacatccatgctttgaggccctgtggtcccagaaacagcaataaacgggcaaaacattaaaagggaaaatttatttttttaatttttttaacgtatgttttttgagacagagtctgactctgtggcccaggctggagtgcagcggtgtgatctcggctcactgcaacctctgcctctaaaagggaaaatttaaaagcaccccgtctatcagaaaataaaagacacagtcacactcaaaatcattttagacctatttgtggtacaaaaatggaccgaaaccccaatgctgtaaggtgccagagacctgacctcttggggctctgggtcagcgtcagctgtctaggttgggtgcggtggctcatgcctgtaatcccagcactttgggaggctaaggtggcaggatcacttgagcccaggaggtggaggctgcagtgagtcatgattgtatcatctcactccagcctggacgacaaagcgagaacctgtctcaaaaaaaaaaaaaaaaagaagaagaaaaagaaaggtgtttctttattgtcttatcgtctttcctggcatctcttacagctaggtgtacctatgtgactaatgtccaaccaatggaaagtaagtggaagcgttaggtgcgatttcataaagggagagtggtactcttttttgcttcttccacctcatgacagctcaaatgcagacataatggcaagactcaagccgccatattggagtgtggggtaaaagccactcactgaggacagcagaactggatagacgtctcctgagtccttgataattatggaggcaccacgctagccttggacagcctatctctggaatgtgtgtgaagtttgtgtttcataatgttgctgtaattttgggtgctctattactcaagagtgaatctaatcctcgctaaatcagaggtgtcacacgtcgtgccactactcattaatttggggcattagatttactttcaaattgttgttattctaaatagcataacatgaacctctttatgtaaaaaactcaatctgcatctctggggtttttttttctcgtactctattatcttcctaggatacatttctgttaacagaattttagcatcaaagaatatctaggctgggtgtggtggctcacgcctgtgatcccagcactttgggaggccaaggcgggtggatcacctgaagtcaggagttcgagaccagcatggccaacatggtgaaaccccgtctctactaataatacaaaaattagcccggtgtgatggtaaatgcctgtaatcccagctacttgggaagctgagacatgagaatcacttaaacccaggaggcagaggctgcaatgagccgagatcgcgccactgcactccaccctgggcgacacagtgagactctgtctcaaaacaacaacaacaaaaatctacattttagtatctctcaattcatgctgccaactaatgttctttttgttgttgtttttgtttttaaaaaataatagacatggggtctccctatgttgcccaggctggtctctaactcctgggctcaagcagtcctcccacctgaacctcccaaagtactgagattacaggcctgagccactatcccagcctaccaaccaatgttctgaaatggttgtacaaatgacattcctgccagttgcatatttgaatgcctatttcacagttcctgcactagtacaggaggcaagggagtatacgctttctgtcccccagccatgccctttgaaccactctggacttgagctgcagctgggcagtctctcctgtccccactcacagcttccccctctcaggtgccagtaacatctcccaatttcctgaccccagactttctccaaagctccagaagcttactcagctctcatgcaggtgaagtgtggcaaggagttagtgccccaaggagacgagagatgctgaaacacacctgggtgttttttatttgtttgtattggtttttttcccttttattttcaattgacatataataattgtatatatttatgggatacagagtggtgttttgataagtgttggttttggtagtgatttataaaagaggaataactgagtcaactggagctatttttgaggatagaggtgaggaccagataataacaaaataacaatagcaattatttgtttaacacctactctgtaccagatactgtttcgctgttgacgtaaaacaatcttggccaggcgtggtggctcacgtctgtaatcccagcactttgggaggctgaggtgggcggatcacctaaggtcaggagttcagcctggccaacatggtgaaaccccgtctctactaaaatacaaaaattagcccaacctggtggtgctcacctgtaatcccagctactcgggaggctgaggcaggagaatcacttgaacccgggaggcagaggttgcagtgagccgagattgcgtcattgtattccagcctgtgcaacagagcgggactccttctcaaaaaaagcaaaacaaaacagaaactaaacaaaaataaaacaatctctcagcaactctgcaaactagattattttattattcccactttgcagatgaggaaaccagggcttggaggtgtaaagtaacttgctcaaggtcttgaagttatgaggctgaagcaatacggcttgaacaaagactgagccccacctcgtctgaggtggcggaatatgaggaacatggtcttaggagggaggaaagagtggatgatccgaaatgaatcccagtttcccctacaaaatatgagggtcatgtgcagggaaccctgaccagtcctcctgtgagtgtgtgtgtgtgtgtgtgtgtgtgtgtgtgtgtgtattaggatggatgggacaaagtgatacattacaaaaagccgggagaaggagcttggtccaatgctaaccggcgccatgggagtgaggctcctatcttcctacagagagtgggagcaggggccctatcttcggggcttggctggaacaaacagttctggcggcagccttgtgtttgttctctcgggcaggcagcttaaggggaggcagggtcatcctggactgcggccttgagctgttgcaaacactgcctcacctcccgcctcaccccacgcagtgctggaactctgggcagggggacaatggtgggtctgtgagggtgtcaggttgtcaggaacaaggctggtggctttgagcaagttgtgcaaccccttccagccccaggtactcatccttccagtggaggatgtcacggctgccttcacaggagatggaaagatcagcccctctcccagcttcttgtggttcatttgcctgactctcctgagcctccgctcaactcctccccatttccttcttctcccagtttttttgtttttgttttttttgttttgggggttttttgtgatggagtctcactctgtcgcccaggctgaagtgtagtggcgcaatctcggctcattgcagcctccgcctcccgagttcaagcaattctcgggcgtcagcctcccaagcagctggaaatagaggtgcccaccaccacacctggctaactttttttttaatctgaaaagccagtaaaaatgctgagaggtccctctgctaccaaggtatgtgggcacgtggaaggggtcagctgccttgtccagatgctgaggggctggtagagagaaacatcagcagatgggagggctgctactgtcccacagagaagggccagcttgaagccatgggcttagggacccaatgtttgggctgactgttgttaagaacacagttttgacgttcccctgagctgagttcccgtcccggctcacagtgcttccctggctgggcaacctggggcttgtgattgtccctttcacagcctcagttttctcagccctgaacgttgtgaatgttgtgagatttgaatgagataatgcagacagagcttaaaaagaggccggatgcagcagctcgcacctgtaatcccagcactttgggaggccgaggcaggaggatcatttgaggacaggagctggagactaacctgggcaacctagcgagatcccatttctatggaaaatttaaaaattagcccggcgtggtggcatatgcctgtagtcccagctacttaggaggctgaatcgggaggatcacttgagcccagaacatcgaggctgcagtgagctgagatgtagccactgcactccagcctgggcaacagagtggtaccttgactccaaaaaaaggcggacaggagggcttagaaaagagcttggcatgtagaaagccctccaaatgttaatttataattatggcagggatgaatttcaaaatcataaagtgctcacagacaacaagctgccttgtccacagagatggctgcaattcctctggaatactgggggagggtgaacagtgatgactaaatccccctcctctcaggccccaggactccagggcagcactcttcttagccctgggtgtgtgggggggtaaagcatgggaccctccttccagtccccactgccagcctccctggccccccaacaccctgtcctgctctgtgccaggaggctgctcacaacccccggagcaccttattcctgtgactgggccgaaagacgaggctgggcgcaagcccggagcccagtgatgtgtcacacgtgaatctgtcacatgtgaagacacagaaacagccccttggctgttactaaagggaaaagaggccagcaaggtgactcacacctgtaattccagtgtcagaggcatgtgaaccagagcagctccatcttgaatagaagctgggtaaaatgaggctgaaacccactgggctgcatttccggatagttaagacattctaagtcacaggatgagacaggaggtcagcacaaaatgctggtcataaagacctagctgatgaaacagcttgcagtaaagaagccactaaatcctaccaaaaccaagatggtgacgagagtgacctctggtcatcctcactgctacactcccaccagcgccatgacagtttacagatgccatggcaacatcaggaagttaccctatatggtctaaaaaggggaggcatgaataatccaccccttttttttttagcatatcatcaataaataaccataaaaatgggcaaacagcagttctcagggctgctctgtctatggagtagccattcttttattcctttactttcttaataaacctgctttcactgcaccgcagacttgccctgaattctttcttgcacgagatccaagaaccctctcttgggacatggggtggggacccctttcctgtaacattggcactttgggaggtcaaagtagaaggatagttggagcccaggagtttgagaccagccctagcaacatagcaagaccccatttctacaaagaaattaaaaaatgtattagctgggagtggtggcatgaacctgtagtcccaggtacccaggaggctgaggcaggaggatcgcttgagcccagaagggcgaggatgcagtgatctgtgatcgtgccactgcactccagcctggatgacagacctgtctcaaaaaaataataataaaaagaaaaaggaaagaaaagaaatgctccttttccaaacctttcccctgaagagagcctagccttagactctggcccgttccctcccaggcactccagactcttgtgtcatgggatgacccccccccccacacacacacacaccagccctgtgtctctccctgggtgcttttcatccccgtattaattctccaacctttgttggtgaatcctccccactccccgcatatgatctctcacatggggctttaactgattttaaaaaataacatgaacaaacagtgaaactaaaagcacagctatgttgaagcctggtcctctaacctagtttcaaataataataatgataatgataaatacagctattatttattgtgctttgttggaaggacattagacaataattcaacattcacaaaaatcctggggtaggtatcatgatcacctgcattttacagataggaaactgagtcatggagacattaagccacttgcccaagatcacacagatcaagggaagattgtataaagccccttcccacaccagctgccgcttcccgactgcagaggctcagggtgctctctctgtcctcagaggcttgtgtaaccatctctgtgccccgttgcccggcctggacattcttgctttcaggcgtgggcacagggatccctccagttggccacaggcaggagcattctgagtgaaatgccaagcctgacttagaaaactctgccccagacagcagcccgatcatccgccactggtcgccttcctgtgtttattctgaggccaccatgcctgacaaaggccccttgtcctgtccaagaaggggacagatttttaaggacatggattgaggatatgggctatttattaccaggactggttccctctcccggaggcgtaggagttgctgtcacggtctgtgtggaagtcgatgctggccttgccgccccctcccctgcttgctggcccagctccctgcccacactcagatccacctgacagtttcctccacacacacatgcacgtgtgcacagcttgccagggtgcagggcaaagcgaaagggtatctcctgagtctataatggcctataggattcctgcacacctaaagtcatttgcaaagtggtggtgcatgtggacatgtgtgtgtcagtgtcgcatatgcaggacagactacagaagttgcagggcccggggcaaaatgaaaatgtggcaccccttgtacaaaagcattaagcatttcatgatggcaacagcagagcattaaaccaaaaatggggcttttgtgaatttggggtcctgtgcaactgcccaggccatatgcccaggaagcaggccctgcacacacatgttgtgtttacaccaaggcacttttctggttaaagggctccaggcttccattagaatctcaaagggtggcagcacagtggctaacacccataatctcagccctctgggaggctgaggtgggcggatcacttgaggtcaggagtttgagaccagcctggccaacatgacaagaccccatctcttctaaaaatacaaaaattagccctgtgtggtggcacatgcctgtaaacccagctactccagagctgtactcttgtgcctcagaatcacttgagccggggaggcagaggttgcagtgagctgtgatcgcaccactgcactccgcctgggtaacatagtgagactctgtctcaaaaaaaaaaaaaaatctcatagaggtccaggatactccaaaggttataaaccatttagtagcagaaggtcagtgtcagacaggcctgggtttgagtcccaggcacgttacttatcccctgcaggactggactaagttctgtgcccttccgagcctgtttcctggtctgtagaagggggattgtcataacactgacctcccagtgcaggagagatgggagccagctcgatacagtatgtggcatgtttcaagctcccagtcagtggttggttagttaacctttagttaggtctgttctgcttgttattgtgtgatgtcacctagaagtttctaaatcctcctgccagtttaacctcagctagctgtgccttccgtggatgtccccagcaggcccagcacaaagcatggcaggagctctcggggacccgagttggcgtttctgtcacctggtctgctgtgaaaaggggtgggctgcacaggctcagctggcctcttcctccggccctgagcgttcgttggctgacctgacggatctgctgtgcagtatctgtactgtaagaacatgtgacggggcagcagcctgagaggacctagggctggcggatgcagggttctaggctgagctcaaagggtctgggcccctacctgatagcttctgagtcagtgtcactctggacagagcctttttccaaagcaggacacccaggagagggttctcaggagacctggggcccagtggcccttggtggctgtatttcccctccagtgtggtagctcctcaggggtctctgtgctgcctccccagttgtccccactgggtctgctagcatcacagggagaagccccctgttacctagtcaccccttccctcctttccccagcctgatctcctagtccctcccctcctctttcagggcagagactcccagtggagaggaaggagggggacaccaggctctagggcctgaaaggaggggctgagacgcctggtgtgacctcaccttgggacattacagcccctcgggcctccatttccaaggctgtagcgtgcaagtgaagtcttcgcttctgccccggggaagccctgccctgtgcatccagggaggcttttccaacacacacaatgtgcatttcttttctttctttttttttttttttttttttgagacagaatcttgctctgtggcccaggctggggtgcagtggtgcaatcttggctgactgcaacctctgcctcccaggttcaagcgattctcatgcctcaacctcccaagtagctgggattacaggcgcaagccaccacgcctggctaatttttgttttttcagtagggatggggtttcaccatgttgtccaggctggtcttgaactcctaatttcaggtgatccacccgcctcggcctcccaaagcgctgggatgacaggcgtgagccaccgtgcctggccacgcaatgcgcatttttgaactgatgagaaatggaaagaaccaaaggtccaccacgaggggaggggcagacacatggctggagagtcctattatgaaaggtatgcagcagtcagaagctaggtgggctgacagagaaaggtgtccaggaattttttgttttgttttgtttttttgtttttgaggcagagtctcactctgtggctcaggctggagtgcagtggcacgatctcggctcactgcaagctccacctcccgggttcatgccattctcctgcctcagcctcccaagtagctgggactacaggtgcccaccaccatacctggctaatttttttgtgtttttagtagagacggggtttcaccatgttagccaggatggtctcgatctcctgacctcgtgatccgcccgcctcagcctcccaaagtgctgggattacaagcgtgagccactgcgcccggctgaaatatttttaagtgaaaaatgaaaattgcaaaacaacacatacagtataaataatttatatgaaaacaaactgctatacattctctaaacatactgatgtgcagggaaaggtctagaaagatatattttacatgggttatagcggttacccgaaggggctgaaggggtgaccaaggaggattttcaccctccggagcccttcccccaggcgcagcgagcctatccaggcgcccagaccccacaaaaggaatggaatttctaatcccagggctagggccaggttgtaccactggcactcagagtgggaatcctgtgtggcttgtaaataactaacttcctggccactgatagtaaaactgccacagtcaccttttattaaccacccaccaagggcaaggcacggcccggcatctccctcacagcaacaaggtgagtattataagcatggaattgaccgtcaagaactgcagggtctgagtttcaccctgcttttaggctagcaaggtagcctgccatggtttcatggatgctggcagaagacgcaagactcctgggacccagacaaagggctttattgctcaaacacaacaggcaacaggagttcatgttcgccttggttccccttgtctcgtggggcagatttggaggtgggcccatgttcagtgggtttagctgaagaaccccaaacctggaaaactcccagtcttaggagggggcttccagcaaacttgcccaatctttgccctgatgggaagcattgtttttattcccctggaaagcaaacaaataaatcttccctcttccctggagggagacgccaaaatcgctaagccaaagggaagaatcaagctgggaactaagtcaagcaggtccttaacctgggaactgagtagtgcaaacctgcctcccaagacaaagctacatacctccctcacaatttgcctacaaggaaattccttgtcctccctcacaatttgcctacaaggaaattccttgtggacaaaggacagacagagttcagagtcatccctctgctcacaggagacaaatgcaggtctgattatttcctctgccctattgtttcactaagccagactacggcacaagtagctattcctgtaaattgggtattcagtgaaaagctaatcagaaactcaaaagaatgcaaccttttgtctcttatccaccctatgacctggaagccccctccttgctttgagttgtcccacctttccagactcagccaatatacatcttacatacattgactgatgtctcatgttttcctaaaatgtataaaaccaagctgtgccccgactaccttgggcatgtgtcctcaggacctcctgaggacgcatccttaaccgtggcaaaataaattttctaaattgattgggacttgtctcagctactctgtgtacacttcctaggctgttgactacacaaacgtccttgaaaagataatccagaacaaaagctgtcacaagacaagcaggaatgcaaggggccctggagaacgatctcccagcgtcaacagactggggaagggaggcgctcagaagttgagtcacttctaaaggtcacacagccaggacacacctgaccccaaagcccttgtctttccctcctgcctccaaaatgggctgctggtctagcctgggaaccaaacacccacacgcaagattgcttccaagtgagtgtccatggtgtcatggttatcacggtcacctagcaatattgcttccacgggaaaatccgctctgagttctgaacaacgacttgtagcagaatcgtgggcacagggcctgtctgtggcttgtggagcaggcgccgcccagatgtgcctgatgctgggatcgagtcatcccagaagaaaaaattcctccctggctgcccctgggtgatgtcagaggagctggaaagaagaaatgagcttctggaggtgggataaatgctcttttcttttgcagaaggaaaaaaaaaggtcacgttgttccatatttatttaaatatgaaatttatttatagagcaaaaagagttggtgttgacttccagcacccggccgggaagtggtttggccttgtttttgtctcctcagagcaccctgtcccctggtgacctaatgtgatttttcagagttggaggctagaccctgtccccaggctttcagacctccctggtcccacccagtctctggagcccatccatccccgcctggagaatggcaggttggggctcaagcttggcactgggctcctctgtcactcagtcctcatctgcaaaatggaggcgcgcacatctgcctcatgccgccctcgcagataaaaagcagtcaaatagtaagccaagcagcttctcacttggtaaattgctaatatgtgcatctgtatttatagagaagggagctgaggtttcaaggcttccctatctgtagtcagccactgtcccatagtagcctttgaagaaggtacgtccctgtcacagcgcccctctcgacttcctcccggccacccaggaggaggtgtcttccacagctgtgcctctgagctgtccctgagtcgcatgaggtttgtattctcagaggcttgggcagggctgagactggggcctcgtcctgtagagagtgaggactcttacccaggagatgctccctacaagaccctttaacattgcttattgcattttaacttcacagcaaccctgggagaaaaaaagctttaacgccgttttacagatggagaaacctaggttctgagggtcttgtgtggccaggcctcacggccagtgggggtcagagatgggactagaacagggacaagtcttccactgtctaggcctggcttcctgtccccacactggaaagcttctgaaccgtgacgccggactgagtgcctgcacccctgatgccatctctgatgtctcacgtgttgtggtacagcctcagtttccccctctgtgccctgggatgatgccgggcttctcgccacctgagattctcatgggattctaagttctcctcagttgaactgtgtggagttagtttggaaaagtccagagagggtcagtgatgtacccagggtcacccagtgagctgaagcatgccaggacaaggtccgagccccccgccgtagggtcagggctctgccagccacacctccatggcacaggcctctgcagggaagtggtggtggtggatgggtggccgccctgactcagggtgagcactgagaaccctgttcttgccttatgtgaaaccattcctgggtatgtcccaaataagctcccatggcagacagggaaattacagggcggggtggcggtgaggaggccaggaaagactaggaggacagagaggatggaaaaccaggaggagcaggccaaccgcccacactttcctgccaagggatgactggcagctgtggagatggcacctgcagcaaggtgcacccaggggccttggggagggccaggcccccatctcgggagatgcctatctgacccaaggctggacagctggggctggagatgaccccatgacatctctcaccacccaggcagggtaatgaaggtgtccccttcgcctggaacacttgctgctccctcatacttcaggccttagtttctctctttaaaaaaaaattgtataaatataagaggtacaggtgcagttttgttccatgcataaggtgaagtctggggttttagtgcaaccatctcctgaatagtttacattgtacccattgagtaatgcctcacccctcactctctcccaccctcccgagtctgcagtgtccttcattcccctctgtgggtccatgtgcactccttttttttagctcccacttacaagtgagaatatgcggtatttgactttttttctgagttgattcacttaagataatggcctttgaccaggcgcagtggctcacacctatcattccagcactttgggaggccaaggtagatggatcacctgaggtcaggagttcgagaccagcctggccaacagggtgaaatcctgtctctagtaaaaatacaaaatttagctgggtgtggtggtgggcacctgtaatcccagctacatgggaggctgaggcaggagaatcacttgagcccaggaggcggaggttgcagtgagctgagatcacgccactgcactccagcctgggtgacagagagagactccatctcaggaagaaaaaaaaaaaaagataatggcctttggttctatccatgctgctgtaaaagacatgatttcactcttttttatgcctgcatagtattttatgagcatatataccatattttctttatccaatcaaccattgatggacactgaggttgattccatatctttgttattgtaaatagtgctgctataaacatacaaatgcaggtatctttttgatacaatgacttcttttcctttgggtcgatgctcagtagtgggactgctggattaacagtggttctaatttagttctcagtttcgagtcaccttctcaggagggccttcctgacctgcctgggtagagcagcccagcctgctgggtgctggtgactattttcacatgctttatttctgcctcatcgtcctggatccacaaacttgtgaaatccatggagctcagctttgtctggcttcccccactgcctccaacacccagcacagggcctggcttgcaaggggtgcctggtccctctgcacgaggcccagaactatcatcgtagttcacttgctcacaggacaggatgacaggagggcaagctgcaccagtaggtgttcacggatgcatgggataaaggcagggccccacacaagataaaaatgcagggctctagttcaaggattcctgagcaaggttaacgtcagtggtgaggccatgtttgtaccatgtgcctttggtatgatgtgaggggaagagcactttacctctggggtcctcccaaaaccccataactcagtgggcacagtggctcacacctataatcctagcactttgggaggctgaagcgggcagatttcctgagctcaggagttcaggacaagcctggccaacatggtgaaaccccatctctactacaatacaaaaaattagccaggcatgatggtgcatgcctgtagtcccagctactcgggaggctgaggcaggagaagctcttgaactggagaggcagaggttgcagtgagccaagatcgtgctactgcactacaccctgggtgacagagggagactctgtctaaaaaacaaaacaaaacccataactccagtctaaccaggagaaaatcatcagacaaatccaaattgaatgacattctataagataacttaccaacactcctcaaagactatgaggaatttcaagacgacagcagagtgttaaaccaaacgccaagcccttctaagcacagggcctgggcgatagcacaggccacatacctgggaagcagcctgggcaggaggcctgagaagcaaatgtggggtgccccaggcccccacagcccttggaagcaggaaaggcgtccctgtgaaggaaccctgtgggtgggggtgaggatgggggaggaaccaggggcctgagctgcagaaggggtaaaggtgtgactgcgggcaggacccagggcccctctctgagggtcctcagcacaggggggctgccatgaagttgggcactgcccatgcaggccatgcagcccatctacaaagagacccccatagctgcagggccccagcagctgggacatcagagttcagccacccacaacccatgagtgtcccctgcatcccgagtctgctcctgtccccagcaacaagcaaaacaaagatggaaggagccccctcagtgtcagagacccctcaccgtgagggttcagctctgacccccactagggcgtgcagaagcaatgcccaatcaggaacaagaccagcactttaaattagacaggactcattcagaaaactatgtcagcagaaaaacagagaatcttctcaagatatctccaaggggtagaaattggggcatttggctttccccagctgatagcagtgtttgggtggaaagtaacatgccttcatattcaggtcaaactggtacagattcctcagcagttcccaatgaactctacggggaatgcaaagaatgttctaatgaggaaggggtcaggaggcctgggctctggttctctgttgccaatttgctgtgtgattgggatgagtccttagccctctctgggcctcagtttccttggctgaacagtaaggaagctgtttggggtgagctctggcaggcaggagcctactgtcctcactctcctgcagggctggcagggaagggagagagataggctgggtgagaaagggtctctggggaaaggaggagaagaggggctttcctggggctgatagaggcaggggagcatccgtgcagaggtgacacggggcgccgagggggaggttccgctgtggttaggagctgagttcagaactcacacttgggtttggatcctggctgtgctgtctacttgctgggtgactttgggcaagcagcttaacctctctgggtctgttttcttatctgcaatatagatgaaacggccatccctatctcacgagggtgctctaattagatgaggcagggcctatgaaaggcaaaggtggtcaggatgattgagggcaatggcgctttgcgagctgatactaccttacaacaaccctgaaaggtgacactgtcaatccttgagccctgaagaaatggacaatcagtgcaagaaagtgtcacccagcaagaaagtgaacaggaccaagctcccctactccacgagggttccccagaggcatgtacaatggaaattgacaacaggaaaatcagcagcccagtcaccatttgaaaagaagctcatggcccgatgcagtggctcacgccagtaatcccagcactttgggggccaaggcaggtgaatcacctgaggtcaggagtttgagatcagactggccaatatggtgaaaccccatctctactaaaaatacaaaaattagctgggcatggtgacaggtgcctgtaatcccagctactcaggaggccgaggcaggataatcgcttgaacctgggaggtggaggttgcagtgagccaagatcttgccactgcactccagcttgggcaacagagcgagactctgtctcaaaaaaaaaaaaaagaaaagaaaaaaagaaagaaaagaaagaaagaaaaatgatgaaagaaccaccccccacaaaaaaatgaaagggagacagacaggaaagaaaggagggcaagaaggaaggaaggagggaggaaggaaggaagtgcagacaagcccctgacccatagcactgcacacagcctcttcccaaatgccctggtgcaaccatgccaggacggcctggagcagcacctgctggccacttccctggccgcacggtgctggcatcctccctgcagtccagcagccgtcctccactggccataaaggcccctttctctggtggctgtttgtgttgggccctacccacctccacgggcagcctccagacactgctggcaggcacgaggacacagtccctgcccgctgctgaagggccgcctttgtggacacatgaaccagccggctggtgcaccctggcccttggaagccagctgcttccccctcctgctcatccaggaggtaaacaggaccgacagccagcctctgccacgttcccagccccctccccacccagctctgcgaggtcctgaatccaggaatgaacacacagcccctgttcttcctcaacccacaacataagtcactgcttctctggccaggcagcatgtatcacaggcaccactgacgcgtgctgcctggaaacagggcccagtcctgcttccgcaggcctcctggagctgtgggtgaggcaggaccgggatccgcctggggccacagctagggacagttccaaggtgtatttctcatttttaaaacactgcatgtatttaaacatgccctgccttgttccagagaagatctaaagcagctacaaggacacatcagatgcaaccagtgtaaatgaagactcggatgaaatgctcagaatgacttttttttttttttttaagagacagggtttcactctgttgctcaggctggagtgccgtggtgggatcctagctcactgcagcctcaaactcctgggctcaagcagtctccctgcctcagcctccttagtagagactataggtgcacgccaccacaccaggtcgagattttgagtatagtttaaaacagaggaacatcagaagccatgtaaatgttcaatgatagggaattgattaaataaattacaatatagccacacaattcaattcataatatttattatgcagtgattaatactgaagttataggtatagaacctaattaatttactacttatgtatttatagaacctaatggcaagtttgtatgtataggcctaagaggatttttcctcaaagggagctagaagtctcatgaccttcttgaaatgactatggcctccaagaagtcaagagtcacagtataaactctatgtattgtaaaatcccacttttacgtatgtgtgtagtctgggaggctgtaccacaaacttcaaagtgtccttatctctgagtattagaattgtgtattttttcatcattcttctaccagcgtgatctatgcccttatcatggtaagccacaactgtggccatacatcttcaagcaaccaaagcaaaaccaaaaatgtggtcagttactatttcccagtgttcataggagaaaataagtgactgcttttggcattaaagagggtagagagttctctggagaggcagggcaactgggaaggaggctggctcatagagtgtgaggacagggtgcagggaagcctcgatgaggggctgaggcatctgcaaatatcagacaatccatctgtccaggggaacacctggcagcctccctcggctggccccattcaggaaaggggctgactcatttcttcaaaataggatagagtgagatggggtcagacactcgctgttcgcttcttcataagaaggacaggtagcaacatcgcaaagagtcagccaagagttgtcgactgtctggcacaagtagaagaatatttggaggttactgaaatcagaatatacagaaagctgttcactccacccaagcctaggagggcttttccaccaacctcagaggaaaatctacagaacatattcaaaagtgttccaaatatctattgctgagtcacaaatcaccccagaacttagtgaactaaagttcacaacagcaatccttttattatctctcatagtttctgaggtccaggaaatcaggatgggctcagttgggtggttctggctcaggaaggatctcataaagttgtagtcagatggaggctggtgttggaatggctcaagactggaacagctagggatggccgagtgtctctcttcatatagtctcagggcctctccatgtggtctcttcatgtgtgacagcttgtgcttcctaacagcatggcagcttcaggatggctagtctacttatatggcagctcgggcctccaagcccaagtattctaactgaccaagcagaagctgcatcacatactataggctaggattggaagtcatccgtgttacttccattgctttctattggctatgagcaagcaacaggcccaacagattcaaagatgcaggacacagacctctccatggaaggagtgtcaaggtcactcaacatcatgtagattgagggatgttgcaaccatctttggaaaatataatcttccacacagagccatcaccaatatccagagcaggtaagaacaaactgaggcaaatgcaagtcccgaaacctttggcctttgaacatttgacattgacaccctaagactaccttttatctacaccaaattcagccatcataggcctcagttaacccacaaacactttgagctgtgataggcccaagtgtcggccaagaaatgagctttggcagtggccatctttgtctgtcagcaaggctgagtttgggcaattatttaaatacactgttgaggctgggcgcagtgactcatgcctgtaatcccatcactttgggatgccaaggcgggtggatcacctgaggtcaggagttcgaggcgagcctggtcaacatggtgaaactccgtctctactaaaaatacaaaacttacccaggcgtggtggcacacacctgtaatcccagctactcgggaggctgaggcagaggatcatttgaacatgggaggtggaggttgcagtgagccgagatcacatcactgcactccagcctgggtgacagagtgagactccatctcaaaaaataaataaacaaaaataataaaataaaataaaatacaccactgagttttacccatactatctgatttttgaaaaatgagtagaggccgagcactgtgactcacacgtgttatcccagcactttaggaggctgaggcaggaggatcacttgagcccacaagttcaagatcaacctgggcaacatagtgagacctccatctccattaaaaaatttcttaaaaggtggaaaacagaaaagtggacctacagatggaaattatggaaaaggtgtttgctcccacccctaagacagctgaggctgagacgagttaagaggggctctcatccgcccatgttggatgagagttagctgtgagttagttctctggtggaaaacaaagaacaacagcaacaataaaagaacaaataaaacaatgtgtctatctaaagtattttgggatacagttatacaatgcctgggatttgctttaaaatattccagcaaagaaacaaaaagtacatagagggaccaagatttgtcatgagttgctaattgttgaagctaggggtgggtacatgaggggtgtttgtttgtttgtttatctgtttgttttctgagacgaagtcttgctctgtcacccaggctagagtgcagtggtgcaatctcagctcactgcaacctccacctcccaggttcaagcgactctcctgcctcagcctcccgagtagctgggattacaggcgcatgccaccatgcccggctaatttttgaatttttagcagagatggggtttcaccatgttagccatggctgatctcaaactcctgacctcaagtgatctgcccacctcggccctcaaagtgccgggattacaagcgtcagccaccgcacccagccatgtgtcaattttcttaagttaattgattgattcataatcaagaaaagtcttcaaatggttattgttggctgttcctttcttttccctgtagtattcttttgctgtttttgaacttgttttgtctgccaagggagcaggtatctttagtggacaaggggtaccagtcataaaagattaagagacaattatggaagagtaaatgttaaatagaatgaattttggtcattagcctaatcccagacctcccccgatcccatccactccctgacttgaaaaacctccgttggatttccctggccacctcctgggcctggttgccagaggcgttttctgacgcaatgcctagcacgccctctggtggctactggcagaagtgcataggtccgtgctgtctttctgagctcacagaagccaagttttagagcttccactagaggtcacaaactggttgctctacaggctgaatgcgacctatagatgtgctatctataaagcatgaatatagggaccaggttcttaatatgttaccagcatttaaaaatctagatattttacgtacaaatccagatttctggcttctttggaaagccaagtctgacaatgacaggcagagacccgcactctccagttacccgtctggcctctgtggtttatgttcagtttctccagcacacaatccctgtagtgggcggaataataagtcccaaatatttgtgtccgccaggaaccttggaatgtgaccttattttagaaataagatctttacagatgtaattagtaaatcacctgaagataaaatcatactggatttggggtgggccctaaatccaacaatttatgtctctataggaagagggagaataccagctgggtgcagtggctcacatctgttatcccaatgctttgggaggccgaggaaggaggattgcttgaggccaggagtttgggatgagcttgggcagcatagcaagacccagtctctacagaaatttttaaaaattaaccaggcttggtggctcacacctgtagtcctagctgctcaggaggttgaggcaggagggtcacttgagcccaggaatttgaggttacagtgagctatgatcataccgctgcactccagcctgggccacagaatgagaccctgtctcaaaaaaaaaaaaaaaaaaaagaagaagaaagaaaaagaagaagaaggaggacaagaagaaggataaggagaaagaggagaagaagaagaatgaggaagacgaggaagatagacaggcacagaggagaaggccatatggaaatggagacagcctagagtgaggcatctgcaggtccaggaatgcaaggatggctggcaaacacagaagctggggacaggcctggcacagatcctccccaagaacttcaagaaggagccaaccccactgacaccttgagtttgaacttttggctgccagaactgtggaagaataaatttgtgttgttttaaaccacccagtgtatggtcatttctcatgacagccctagaaaaccaacatgcaatccccaggaaacccttgcccttctacaacatcccgcaaacaggcctctgctctaaagcctcaagggagggagagctcacatctcccagctgagtgatggactaatcattggaaagttctttctgctaaaccggtacacaacacaaacaacacaaaatcaggctagagtctataaaaagtggggggaagtgtacctggaaaacactgaaaaaaagtgggttgaaacaagatcataaaaagaaagaaaccctgctggtagtgggatcagggagggcttcatggaagaggtggcacctgaactgggcttcaaggatggctatgacaagacaagcagaaactggtgggagtgcaaggcatattccaggcgatagagcagtgaaagacccagaggaggaacgtgtgggtcatgcacagtaacattcatccatcccttccttgaatatttcttcaccaagcagtgagcaatgagcttagttggatgaagttatgtggccaagtggggtcagt

SEQ ID NO: 122 - DNA, 467222 bp, Homo sapiens
actgtcagttatctcaatcccaccaatctctacagtggcagtcacctacagacccagatggacttcctcaaggaggtgaagcccagggaggaagggaaggcgggcttcagccaggaagaatggcacctgcaatgatggagaggcctgaaagagcatggctcactgtgcaaaccctgcagggagcctgcagtggctggagatacagggtgggtgggagagagactggagagggaagtcctggaaatgaagccaaggggacagagctttaaccaagaggctttcataaaccagttctgatgtttgtttttgttgttgttgttttgttttgttttgtttttgatggagtctagctctgttgcccaggctggagtgtgatggtgcaatctcagctcactccaacctctgcctccccggttcaagcgattctcctgcctcagcctcccgagtagctgtaggaatagtgagaaagaaaatgagaggaggtatttcagtagcagcattgacactgggaacccattagtaacagctgtcatgtgatgagtgcttaccatgcaccatgtagggtgatcacttaacctctccaacagcctgttcttatgcccaatctacatgtaggaaaactgatgcacagaagggtgaaaggatgtgtccagagtcactactcataagcagaggatctgccattcaacccgctcaactcctgattgagcactgttctccttgagttagctcttccaggcaccatcaaccttcacaacagaagtctgagatccctgattccaagctcggatttcagagttggtaaccctgagatgcctgtggggcatcagggttggctggaaccttggagaacactgacactcaggaaggagagtgctgccccagcagtcaagagaagccaagagctttacggattctacaggggatgaaaagtgttggcatagccgaaagcagcagggaggtctagcaaaataaggactggaaacacagcatgggaaaggccctgctaaatttcaccccagcacttttaggagtggaggaaaagcagagtttggattaccatgacatgagaagggaaggtgaggttgggagtggaaacttggattctggaaaatttcatgaagcttggctgtgaaggaagggagattggatcgcaaggtctagagaagtatttatggttgtcatttgtttttgtttttgttttaaacactggaaaacacaaccatgcttacagcctgagggacaggaggaagacaagagaacccaaggaatgcacttcctgaattgatgggaggccctggatccagagcgggtgggaacacatctggaaggaagacagagggaatgaagcaaaaatgggcaaaggtaaaccatctaactagagggccaaaaagtggagtgagctcccacctgatagcctctatttactcggtgcagtaagatggagatcacgtagggaggagagctagatgttaaaatttcaagaattctatgagtaggttgctaaaaacagacattaaaatagtgaccatggtgtctggaaatggtagctcatgcctgcaatcttaggactttgggaggccgagtgggaggatcacttgaggccaggacttagagaccaggctgatcaacatagttagacccctatctctaaaaagaaaaattttttaagtaaaaaaagaaaaaaaaattgtggccatgatgagaacatttacatcacagaaatcaacaccccccccgtcctttttttttttttttttttttttttttgagagccagtccatcagtgtaccactaggtaagggacttgaataaaaagagggcttcaaaaggggatgtgcagaatgagggatgcagtggaggaggaccatgaagaatgagctggcatcaacaaggaatcctggaagcacaagtcctcccccagcagtgctccacagtctgggtgcaaagacagatggccggatggagctgaaacctaggagtctgcaggatggatgtggtggaagcaaggggccaaggaactgagatttggccagccaggggtttaggagaggagccctggaatccagctgggataaggaaagaaatgaggccaagaagagggccaataaattgggagaaatgggggctgaagagactggaggtcttaggaatcacaggaggaacaagaggtaaagaatattgcaattttagcttttagagttagggcagcttcagatagtgacaatattaaggctgtggccatggatgtgggcatccaaagctcagctgggggagagagttatggaacggatctctgtacatgcagtgtctgtagctgtaaggccttggtgttggatgggttggccaaggggtcatctgcagttgtctagaagtggggcaggtcttgagataggatggagctggtgatggatgtgtaactctgagaggccgagtgatttgtctaaggtcacaccatctgcaaatgcctggaactcaggcaccctcacctccaggcctcatctcagcaagatggggccccctgccctgtgattttctgatttcaactctatctagctctcagctcttccactcagggatgagaacaagaccaggaacaaaacgtccttccactctgagcatcttttgtggagaacaatctgtttttcaaattctccttttcattatttccctccactgaacttagaaaagattctgcaaaagatcatggtgttattgctgaatctggggagggaggaggacattataatggtgctttggttatttttttatggtgagtcctttaaagacctatactgaaatatttacagatgaaatgctatactgtctgggatttacttccaaataatccaggcctgggtggggatgggggagaggcatgcgtggatatttagagcaaagaggatgggctgacagttgctaattgctgaagctgggtgatgagcacacgggggtgcattcagcaattctctctacttttgtgtgcatggtttgaaatgttccataacaaaagctggctgtctggcggggttgtcagcagaaagcagcagccatggtgggctgcaggcatccatgtaaaatattcagagagagagaggccactgggggctatgctccatcctggccccacattctgagaaggcccttgagaggcaggagcaggtctagagaaggctatgggaagggactccttttttttttttttacagggtctcactctgtcacccaggctgaagtgcagtggcacgatcatggctcactgcaacctctgcttcccaggttcaagtaattctcccacctcagcctccagaatagctgaaactataggcacacattactgagcctggctaagttttgtattttttgtagagatggggtttcactatgttgcccaggctaagctcgaattcctgggctcaagtgatccgcccgcctcagcctcccaaactgctgggattataggcatgagccaccgcacccagtctgggactccaaattttaactcaattgtctcagctgaaactgggctgctcggcttggagaggaaaagctctgaggaggcccgaagagctgttctcacccacagagtggccgacctgggagagggcctgtcatcatgagtctgtggatacacacaccccctgctggctctgtccagaggcctttggccaagcctttccccggaggctcacctgccctctcccagaccctagccactctcccctcacacacctcccccaagctcagaccaggaggacgcagtgtgaccctgccagccaagtgggagtctggctgctttggaagtcaggagcaaccagagcctgctcctctccactggcctaaaacaccctgttctctacgtgtctgtgacaaggtctaacttggctccaaaacccctccagggaaaaggctgggctgaggtcactccccacatggctcagcactaatccttcacatctggacacaattgtgctctgtgcaccctggagcaactgtccatgaggtcatcaaggcctccacggagtgcatctgagagaacaagcttggagcagggcctaacattgtactgcctgctccctctgcaccagagtcctcaccatggcgctgacttgaacgcatcatggcagaaaacatgctggagacccctgttctcagcctggttcagccactaatgattgtgggattgtgagacagttccttctcctccctgagcctctgctgcctcctccataaaatgggggtagggtaggcttgaggccctgaatcccccatgtagctcatccttaattcttctctgtctttcagaagctgcagagaggcctcaaaaattagctacaggggctgggctcagtagttcacatctgtaatcccagagctttaggaggctgaggcaggaggatcgcttgaaaagaagtttgaggacaccctgggcaacatagtgagactctgtttctacaaaaaaaaaaaattaaaaaattagccaggattggtggcttatgcttataatctcaggtatttggaaagctgaggtgggagaatcgcttgagctcaggagtttgagactacagtcagctacgattgcaccactgcactccagcctgggcaacagagaaaaaccctgtcttgtattaaaaaaaaaaaaaaaaaattagtagacacgcacatgcacccacggggctgtcagtggctcagacaaggggagtggaaaggctgaaggattatgatgattaaccctgagcagccaaggctgtggctccacagggctcccttccttcttttcttcccgctctcccaggcaccgccagttgggaaatggacctccttggatgctgcattgttttctctggcccagctcctgcttggggcctgatgtacaccctggatggtggctacaggtggggcaccctgtgctggtgagtacaggctgctgtggagcccagaagccccaggggacggctgggctgggctggctgccccagttaaagagacgtggcccctgggtcccatcctttgaggcagaagtaccgctccatctacttccaggccttatggggagaccttttgtatctggacccaaacagtaagaaagtgccacaacgcagatgatttctgcgtgctcggtgatgagaaatgttttctcagtggcatctgtgaaaggtgctgctgtatcttccgaattgtcaaaatcacactctgctttgaaaaacaaccctgaccacctgggggttaattatatttgaccacattcaatacaatacaataataaatttaccacatccaatatttgtattaaaatgtatgattcattcaaaatgatccatgggttttgattatttttgaaagcagcagaacactattcttcaagtgtttctataaaaaactccaaaatgcgggccgggtgtggtggctcatggtctaaaaagccatcagggataaaggtttctctgagtgctgctaaaagaaaccaagactggggcccagtgtggtggctcatgcctgtaatctcagcactttgggaggccaaggcaggctgatcacttgatgtcaggagttcaagacaagcctggccaacatggagaaacccccctgcccccgtgtctactaaaaaatgcaaaaattagccaggtgtggtggtgcacacctgtaatcccagcacactgggaggccgaggcaggtggatcacttgaacccaggagttcgagaccagcccggccaacatggtgaaaccctgtctctactaaacacaccaaaattagtcaggtgtggtggcatgtgtctgtagtcctagctgctcgggaggctgaggcagaagaatcacttgaacccgggaggcagagtctgcagtgaggcgagattgcaccactgcattctagcatgggtgacagaatgagagcctgtctgaaaaaaaaaaaaaagaaaacatacaatgcctggatttcctttaaaataatccagggaagggagaaagggtggagactatagataagaaaaaactgcccatgaactgatacttgttgaagcagagttaatagtacattatatcattctttcatatactattattttgtattttttgtatccaaaagttttcataataaagagttaagatatatcatctaaaatctgaaagaatatgcacaaaaatgtaggaagtcaatgtgaaattacactaacacatgaatactttcctccttttcttcttcattttttttttttagacggagtcttgctttgtcacccaggctggagtgtggtggcttgatctcggctcactgcaagctccgcctcccaggttcaagtgattctcctgcctcagcctcccaagtatctgggactacaggcttgtgccaccaggtctggctaattttttgtatttttagtagagacagggtttcactgtgttagccaggctgatctccatctcctgaccttgtgatctgcccgcctcggcctcccaaactccttttcttctttatctgtagcaatgagcatgcataatcagaaagaaaaataacgtttaaaagtgggtttaaagtctctgtacaagttgtggctaaaaggggcaccaaaagtagccacttgtgggcaggctgctccctcctccctccgggagaaacacaggtgctgctttgtgcccttagctcctggagcctggggctgagctgggagggagtaaaggggaggggggtggcagggtgtgtactggggcctgtattctatgctgagcagagtcccagccactcctcgtgcagcttgtgaggaagccattggtggtcatctttaacaggtgggtaaactgaggctcagagagatcagtggagtcatctgagagaatgtatgttgatgcatgttccctgctgggcacttcctctcttatctaatctctgaggccagccctgtggggtgggtatcattctccccaatttatagaggaagaaacagcaccagagaggggaagggactcacccaaagcaggggatcccgagggctggtctggatcctttccccaagtgcttaatcccacagttcaccgggccctgaaaggcactaggggcttctatcttagtacaggacacttctgccaaggtcggggcaacgacttgtgggggcaggaggcctggatgctttgtgagggctctgcgttggcaccatcatgagatctgagctttcccctcacctgggcaactggaatgagcaatagccatccctggctaagtgggattgtggcttgtaaactgtaaagtcctgtgcaatgtgcagggtggtggaatgagcatctgtgtaccgccccagactgcagtctagtaagtcacttgacatgagtcaccctgtctgagcctcacctgtgaaggggcaacattaagctgaggggggaggtggggggaagaaaggggacagcgaaaggcaaggaacccagctaatggagtaccgagacagcctctccctcccacacagctctgcatctccatccagtcccccatctccacccaaaacagctcagttccccagagaagctccctggaaaccgggaggctgacttcttcaccaactgcagaaccacctgaggccacctggcaggtgagtcggtggcctttctcctgggctcgcctgcctggctccttaaggctgtgctgggctggcctgggtcactcaccctttggagtctggcttcttaagcaatgtcctataaagccaggcctgagcctccgcaggccctctgagatggagctggcctccggggctgccccacccagcagctgtgacctcccaccccggatcctggctccttctctcttgcaagctctactccgggcatcgagcttccctctctctctcctttttggtatctctcaaatctttctcttttcttatcctctctccctccaccccttgccattttagtcactctttctctttccttcttctcttttgtctctcaaactcttttttatttctatcttggttcatatctgttcagggaaagcctctttctgtctcggcctctccttttttcctgttcactgtttattcttccctctctcctttatctctccgttgctctacttctctgcctttttctgagtctgtttcctctcaccatctctctctccatccctccctccctgtatctgcctctctctccatctcgctgctgtgtccagctctgtctcttgctcattccttcctcaccatctgcggatctccccggctccgtgtcccctgccatgccccgcgccccactcaccggccaaagcgcccacggcacagagcagggccagcccggccagcgcgcaaagcaggggccgcatggtgccagcctggctgaaagcagcgcggcttgcgaccgcagccgcccttcccggatcgcgcccggccggcccagaaggaaatgctctcagtccgagccaaacttcctgggcgactccgggctttctggctggagagaacccgccccctccagaggctcctgcgcaccccatgggcagcgcagaacccagaaacccccgggacctgaggcactgacgtgccacccgggagcctccggaggaaagggggccgcccccccccccgagtccccgcgcctcctgggggcacgggaggaaggagaggggttgggtgaggtcatgggctcaaggcgactgagcctgggatcaggagtttgttataagcccatttcacaggcaggcagactgagactagagagaagtgtcttcctcagcatcactctcagccatggcacaagatctgaactctcgtctcctgggagtgtggaaggttttctctgtctaccgagaacaagaaattaattctaatcacatggaacagtgtctgcccctaagagggagacccagacactcactgctctggtaagggagtgatagcaatgtgaaaaggtacttttcaaaaaaaaaggtaaaatcatgactcttgtaaagatatgaaattagcatatactaaaggttttatttaattcattattaatgaggggacaagtaagatggtacaagcagtccaaagtttagaacacagtagtggaaacttcccctatgggacatgcccatccaacaagtgcaacaagaaattaagttttagtgaaaacaccaaggaaaaaagctacagctccaacttctctgctgcagagccctgagtgccttgcctggctgtaagaggaatactttcatcaccaagcctaggagaatgcctttgtccattgagggtccccattggggttaactggagcccttgcagatcaaggctgcctctgccttctgtgttcctggctgtggctgtgcagttgtccataacagtcaccaccctaaccagtgatccagttctcactccctcctccagagcaagataatagcctcaaatgaagaaattcagattctgagcccgagaatctgagacagactcagatctaaatctttttaaagtcttcaaggagtttatgatgcccagtgagctggctcagaagaatttatttcaggaatgccaagaatttctcatgcttgttggtaggacattccttgataatttagccaggtgggaagttgtcaaagaactgccaaacccataaggattcttgtagctcacagccaggggacgaccttatattttgaatttaagattaagggaaaaaaagaaacacaaaaaacatatacagtacattcttgttgtggtagagcacaaagtaattaagtatacagagaaaaacatgaaagtcttttctgttacaaattccctctgtccaacgattcaggtccagttcccttggcttggtaggctctgcctgttccacatctatgcattccccgtctatctaatgtgtattcagagacaaatgtatatacatgagatcaaatcataaatattttgaagatttgctttcattcatgtttacctcagtcataacattaaatcttggctgggtgcagtggctcacacctgtaatcccagcactttggtaggccaaggtgggtggatcacctgaggtcaggagtttgagaccagcctggccaacgtggtgaaaccctgtctctactaaaaatacaaaaattaactgggtgtggttgtgggtgcctgtagtcccaggttcttgggaggctgaggcaggagaatagcttgaaaccaggaggctaaggttgcagtgagccaagattgcaccactgcactccagcctgcgcaacagagcaagacttcgtattaaaaaaaaaaaaaaacttggagatcaatctatgtgagtacagataaatctaaaatatctcatgaatagatgcaagcagcattatttatccaaacagtcccctattgacggacatctagattgcttcctttttctctccaatataaaataaactttaataaatatacctttgcatatatttttatgtacatagtacatattcatgtatttctgaaaggctggaagaggaattattgggtcaaagggtcttttacattttgccagataggccaaaaactgttccccaaattgtcactaaacccacagaagggacaggagggacaggggtcttccagcgcggttccaaggtgcactggagtacatgtttggtctacgtaagaattgggctgcagggggcgccatttacataaaatacttcgggattggagctacctgaagtgtaaacctagcggtcacctacattctccaacattggatatttatcatttaaaattttgacagctcgatgatggaaaatgttaccttgttgttatttttacttacatgctatttattatgagtgaggttaagctttatttgcctcgattacttttttctattttcctccttttcctttatatactctgattattaatgcaatgcctgttatatatgttggcaatgtcttcttccagccttccattatctttacgtttcttggtggtgtctttcattattcaggagttttaaatattaggtagccaaatctaatattttcttttctggcttatagtgtttacaacttgcttatgattccttgaatcaaggctgtaaagatatttttctatgttttcttcaaattgttttaaggttttctcaaggtctaatgtctaatccatctaaaatttttatgtggttgcaaggaaggaatcaaacttaaaattttccctaaatggatatctaaatgtcctaattctctgtattgcgtggtccaaactttgccactactttgaacataaagtagtttgctagctactcatttccaaggggagttctgggaaaatctctgtacatcacatctgtcacaaggtcaaggaaacaaaaatgcaaaataaacataatttcaataaatactgaaaccatatttgatgaaattaaacaaccctccctaacttaaaaacagtaatagcaacaaacttacgataaaaataaaagaaataatgggacatttccttaacaagataactactttttaatttttacacttataatttttcaaattaaaaaaaaatagagatgaggggcttgctgtgttgcccaggctggtcttgagcacctgggctcaagtgatcctcctgcctcggcttcccaaagtgctgggattacaggaatgagccaccgtgcccggccaactacttttatcttaaatagttcacatgtacatacaagaaaaaggagaaatgtattctttattaaatcaggaatgaggtaaagatgccatattgaccaggcattgtggctcatgcctgtaatctcagcactttgagaggccaaggtgggaggatcacttgagcccaggagttcgaaaccagccttggcaacacagcatgaccccatctctactaaaaattaaaaaaaaataataaacattagccgggctttgtggcatgtgcctattactggggaggctgaagcaagaagatcgcttaagcctaggagtttgaggctgcagtgagctatgatcataccactgcaccccagcctgggtaacagagtgagacactgttctaaaaaataaataaataattaaaaaattaaaaattaaaaaaattttaaaagatgccactatcaacaagtgtttggctgggtgcagtggttcatgcctataatcccagcactttgggaggcagaggcgggtggatcagttgaggtcaggagttcaagaccagcctggccaacatggggaaaccctgtctccactaaaaatacagaaattagccgggcgtggtagcacacgcctgtaatcccagctactagggaggctgaggcaggagaatcacttgaacccagagggcagaggtttcagtgagccaagatcgggaaactcctgggcaaaatgatagtatggagccagtggacccagttaacaaacctcctccttccaatattctctaaagtgaccagtgaaattaaagataggggagactggcatcagtggcaggaactagagaaatatgccaaccatatgccaagcctcaaagcaagggggtagccagctggatctaataatacctcttattatttattattctattatttgctaaacttctctgaacccggtattgtgctggggctgtatatgcattatcctatttaatccttgcgtcagtaagcctatcaagtagatatccttatccccattttaaaaaataagatctattaaatatatttgattcaagggtggagggtggcagatcccagtttggaagctaggtagatctggttccaaaattcatggtcctcagcatgatcaggccccttgactctcaagtcccaagaagggcactaaatagagaatctggaaaagagtggaggtgagaaagggacaaatgggatatagggggcacagaggggcaagacctgtgcagttaggggaaaacgctcataaccacctgcatgaatgaagtgtcctaatgtgcagacgttcctctttcacttaatgctcccatgaccctggcaggtagcctcataatccatgcagattgtgacagtacctgccatggtcatgggagcatgtagaatgtgaggcttggagaagttaggaggtggcccagggcacacaggtactatttaggaatttggggatttgcctcccaggcgcctgtgttgcctccacaggcaatgctacaggatgtgcacaggtcctcccagcctggctgggccggggcacaagtggtggggaatctggcaggggcttgctctcccaactcatacccaaaggcaaagggcaaaggaaacaggaaataggggctggtcatctctctggggagagaagtacgctgagaggacagcccaattaaaagagcctcagtggttgggagggtctgagctgtacaaagcctccttgtcttctccctctggcacaagagaggatttccagagataccaggaagacccacaatgggagagttctcagtgagcactgggcaaggctagcccgctctctgcacagatggacaggggctactaacccaaggcacagaagttatagccggagaaagtgagccagtgaagtgtgaatgtggatgtctctgttgagggaaggaaaaggagggggcgacacgacaggttgagatttaagtttttttgaggttggatgcagtggctcactcctgtaatcctagcactttaggaagctgaggtgggaaggtggcttgagttcaggagttcaagaccagcctggacaacatagtaataccctctctctacaaaaaaatttaaaaattagccgggtgtagtggcacacacctgtaggcccagctactcaagaggctgaggtggaaggatgacaagctcgaggctgcagcaaactatgattacggcactgcatgccagcctaggtgacagagtgagactcgtctcaaaaaaagaaaaagaaggttttttgtttgtttctttggttcgcaagttttattcaagaactcatacaaaatattccagataaatgaaatttaatcctcatcttcctcctcttcctcatcctggttaatttggaagtaacataactctgctgttagcagctacacaaaccaatcacatagattattcttcttcaaaattttttggtgtgatatttcaaatatcttttggaaaaaggcacctcagatgtcatggtgatcttgctcttgctcctttcgatggtcaccacccctccaccaggtttcccagcttttcagttcactttgatcctctctcggaaaggctgttcaaaattggcagcgtccatgattccgtcttccacggggtggctgcaatctagagtgaacttcagaacctgcttcttttttttccattcaccacaagctttttcccaggcgccatggcggcagtggaggcagaaagagagctgtttctttttaaattgttattaattttgtaaagtttcagtagctttgggggtacaagttatatttggttacatgaatgaattgtaaaacggtgaattctgagattttagtgcacgcaccacccaagtagtgttcattgtacccaatatgtagctttttatcccacactccccgcccatcctcccccttctgagtttccagggtctattatatcactctgtatgtctctgtgtcctcatagctcagctctcacttaagtaagaacatatggtatttggttttccattcctaagttacttcacttagaataatggtctccaactccatcccagttgcttcaaaagacattatttcgttcctttgtatggctgagtattagtccatggtgtacatataccacattttatccactcattggtcagtgggcacttaaggtggttctgtgcctcgggaattatgaactgtgctgcaataagccccctttctttttttttttttttctttttttagacggagtctcgctctgtcacccaggctggagtgcagtggcgcaatctcagctcgctgcaagctccacctcccgggttcatgccattctcctgcctcagcctcccaagtagctgggactacaggcgcccgccaccacgcctggctaattttttgtatttttattagagacggggtttcaccgtgttagctaggatgttctcgatctcctgacctcatgatccgcccgcctcagcctcccaaagtgctaggattacaggcgtgagacaccccgcccggctctgccccctttcttaaatgtggccctgaatcctcccaggtaggataagctgtaggaagatggggaggtctgcttggtacagggagaagccaagtgtagcgtgagggtagaggtttaatactaagagttatggctgggcgtggtggctcacacctgtaatcctggcacttcaggaggccaaggtgggcagatcacctgaaatcaggagtttgagaccagcctggccaacatggtgaaaccgcatctctactgaaaataataataataatacaaaaaaatacaaaaattagccatgtgtggtggcacacacctgtaatcccagctactcaggaggctgaggcatgagaattgcttaaacccaggaagcggaggttgcagtgagctgagattgcaccactgcactccagcctgggtgacagagcaagactgtctcaaaataaataaataataataataatattggccgggcgccatggctcatcttgtaatcccagcactttgggaggccaaagtgggtggatcacttcaggtcaggagttcaagaccagcctggccaacatggtgaaatgctgtctctaccaaaaatattttttaaagttagccagatgtggtagcacgcacctgtaatcccagctactcagaaggctgaggcaggacaattgcttgaacccgggaggtggagattgcagtgagccgagatagtgccactgcactccagtctgggtgacagagccagactccatctcaaaaataataataataataataatattaacagttataataccaatagttaaaacagccaacattaatgattttgacttcatgtccaacctggtgtgtagcactatatagtctgtttttttttaatttgtaaaaattatattatagatttattttttctgattaaaatgtgtttaatttttaatttttatgggtatatagtagatatatctatttatggggcacaagcgatgttttgatgcggcatacaatgtgtaataattacatcagggtaaatggggtatctgtcacctcaagcatttaccatttctttgtgctacagatattccagctgtactattttagctacttttaaatgtacatagaaaaggtacagtaaaaagaaaaagaaaaaaacataaaatgtgcaataaattattgttgactgtaattaccctgttttgccatcaaataatagatcttattcattttaactatatgtatttcaatagtttttggaacaggtggtttttggttacatagataagttcttttacatatatatatatatttcaatagtttttggaacaggtggtttttggttacatagataagttcttttttttaaattatactttaagttctgggatacatgtgcagaatgtactggtttgttacataggtatacacgtgccatgttggtttgctgcccccatcaacctgtcatctatattaggtatttctcctaatgctgtccctcccccagcacctcaccccctgacaggccccagtgtgtgatgttcccctccacgtgtccctgtgttctcattattcaactcccatttatgagtgagaatatgcagtgtttggttgtctgttcttgtgttagtttgctgagaattatggtttccagcttcatccatgtccctgcaaaggatatgaagttgttttcttttctttccttcttttttttttttttttgagacagggtctcactctgtcgcccagactggagtgcagtggcacaatcttggctcaccacaacctccacctcccaggctcaagtgattctcctgcttcagcctcctgagtagctgagattacaggcatgcgctactaccccccagctaacttttgtattttttgtagagagagtttcaccatgttgaccaggctggtcttgaactcctgatctcgaatgatccacccaccttggcctcccaaagtgctgggattacaggtgtgagccaccgcacccagccaacatgcatgagctatttagtggcaatttctgagattttggtgcgcccgtcacctgagcagtgtacactgtattcagtgtgttgtattctatccctcaccccctcccacactccctttccccagtccccaagtccattatatcattcctatgcattacatcctcatagcttagcccccaattataagtgagaacatacgatcttcggtttttcattcctggttacttcacttagaataatgttctccacctccatccaggctgctgctaatgccattattttattcctttttatggctgagtagtattcaatggctacatagtctatttttcagttaatcttggctgctaccctatgcaatgggttctgtgattctcccagagcttagcaatagcagttttccaaccagtgtcttttgaattgataaatccacatttagaaggggaggaaactggcctaaattgagggcccagcaaaagaactcagccacccgcagtgcctggtgtccatgtagtcggttttgagatgttttagctgcagattcacattgctaagtgtcaattcagttcactgtgaaatccgtcgctatttcctgaaagtgcatcaagctatgaattccctgtggcttcggcgggtagaagtgggttggcatttccctccagctctttgagaattttctctgcagtgctctctagggagatgatcttattttggctccctgaggtgagagtcagagtaaaatataaactgtctgaagacattgcttggctgactgttcagagcatttccgagttagtatctcttagtaagggaggcaaaggaattgagttcaaatcgtgactttgttcttgctagtggtgtagcttcaggcagttcacctcctctctctgagcctcaccaacaaagagggagtaataataacaccgatgatcacagaagaatgtgaattctcttgctccctgcctctaacctgctttcctgggcctgtcactatgttttctttgctgggtgtacttgcaggttataagtctcctgagggcagagagggttgtgagtaatgccagctaggcctgcagaggccccggaagaggatcaaggtttccaggagagatgactgttgaccaaggaagagctggcagctaactctgcttcctgaaggtgtaaagtaaaggccccccgaaagggtctttaaacatgagtaggagtttctaagcagtgcatccttcatgccatggagattgatggaggtgtgtgggcggcaggagaatgggcagtaaatctgggggaaattttggtcagattatggggggccttgaatgccactctcaaaagagtaacccttcatgctgtaggcagaggtgccagcagagtttttggctgaagaattacacaaacccatccaattccctctttctttttctttttaagtatttttccttggaaataattttgagtttacaaaaagagtacagcaaattcttgtacaaccttcaccagcctccccaaatattaacatctcacatagctacagaattatcaaagccaggaaatgaacattaatgcaatcctgtctgtgaatctacagacttcattcagtgttgccagtagccccactaacgtgctttttctcctccagaatgcgatccaggactgcacgtggcattccgctgccgtgtctcagtgggatccttccatccagaacggctcctccgtctttctcctcctctcataattttgacagttttaaagcatccaggctatttttgtctttcataaccttgacactcttgaagagtactggccaattattttgtagaatgtcctccaacttgagtttgtctagtgctttctcacaatgagaatgaggttttgtgtttttggtgagaacaccacagaagcaggttatacccttccccatgcattatatcaggaggcacatgtgatattgctgcatcccattactggagacgttaactttgagagatgatgtagcaaagatttctccattgtaaaatcctatttttccttctgaacttaatgagtatcttacaaggagctgtcttggagactatgtaaatatcttgtttatcatcatactttcaccaaccaattttggcattcattggtgattcttgtctgcaatattaattaccactgtgttttccaacagatgatttttctactttcataattccttctccatttattaattgtaattcagtggtaaggaagagctgtcccttctctcccaattacttatgcaattatttcagtatagactcatggatatttagtttattctaccagtgataatccatgaccaacatcatttgtatcattgttccaactgtcccaggtatggccaatgtaagcatcttcaagtcaccccttgtgtttgtttgaaatgcccttattctattttgagcacttcctttctgacataagatgttccaggattattttataatttcactgaccccaccctgtacttaatcatttctccaaagaactctgcttcctttattgagggaatgtatttagaatctaagatctgggtgctggatgtcctcattgttactgaggtgtcactgtgtctagggcctctcagcagacagagctagggaatatgggttaccaactctgaaactattttatgggtattctgagattgagcaaataagtaaatacattgtatttagtgggagggaggcatctcactgtcaaagagagaactacaaataaaaagggaagggcaaagtgaaccctattgtgttagattagaatcagaggcatcagcatgagctcctgatttttagtgtatgtacagattgacagatatagaaataaatatgacctggcaattccattcctaggcatatacctagcagaaatccatggtcataaaaaaaaacatggacaagaatgatcatgctgggagtggtggctcacgcctgtaatcccaacactttgggaggctgaggcaagcagattgcttgagtccaggagtttgagaccagcctgggcaacatggcgaaaccctgtctccactaaaaatacaaaaattagctgggtgtggtggtgcatgcctgtagttccagctacttgagaggctgaggtaggaggatggcttgagcctgggagtcagagactgaagggagccaagattgtaccactgcactccaacctggggaacagagtgagaccctgaagaaagaaagagagaaagagagaaagagaaaagaaagaagaaagaaaggaagaaagaaagaaagaaagaaagagaaagaaagaaaaaaagagagaaagaggaagaaaaaaaaagaatgatcataggatcatagctgcactattatcatagtcctaagctgtaaaccacgcaaattcccgttgacaccagactaaagaatgaatgaccgaccactacatgcaacattatggatgaaaatacaattgcggaaagacattttctcaaaaaatgctgtgtgataccatttatataaagcacaaaccaggcaaattaatccatgtcacaagaactcagtatcaattttctgcaagagaaacgagggggtttctgagctgctggtagtgttctgtcatttggtctgggtgctggttgcattggtgtgtctaattcttaaaatgtatatacattattcatcagtaaaaagttttttaaaatattcatctcctggctctaagcttcattttatcttcatttcaactcagctgctgcagggaccccataaaatgaatagagtaggactaacttctaaacctgctctgcttctattcccttccagactaggattgatattttccctccaggattgagactcctgttaaattttcttttatttccccttcttttctttctttcttttctttctttctttctttttttctttttcttttttttttttttttgacggagtctcactctgttgcccaggctggagtgtaatggtgatctcggctcactgcagccttcatctcctgggttcaagcgattctcctgcttcaccctcccaagtagttgggaccacaggtgtgtgccaccatgctcagctaatttttgtatttttagtagagacgggggtttcaccatgttggccaggctggtctcgaactcctgacctaaaatgatctacccgccctggtctcccaaagtgctcatgattaaaggcatgagccaccgtgcctggcttcccccttttcacaagttcgatttttttctttttcctgttctttttgttttgtttcgtttttcttttcttttcttttttcttctttctttctttttcttttttccttctttctttctttctttttttttttttcaggcctaggactcttgatccagtcccacctgctggtgtaggtcaggaagagattattttagccccacccaactaggaagctgcgtagatgtaggggaggaaagcaacttgccaggggctaccctaggtaggagatgtggctatattccagagttgttgaaggttaataccagctaatgttctttcagttactgccttccaggtattcacaacaaggattaaggaagagaattaaactctaatgcaataggcttccatcatttgtaatgaattaacttccattgtcctcattgttaaaagatacatttattaaaatggataaaaatcatcagcctggagtggctgctcatgactataatagcagcattttgggagactgaggtgggaagatcgcttaaggccaggggttcaagaccagcttgggcaatatagtgcaacccccctctacaaaataataataataataataacaattagccaggcatggtggctcaagtgtgtagttctagctactcaggaggctgagtcagagaaccacttgagcccaggaggtcaaggctgcagtgagccaagcttgcatcactgcactcaagcctgggtaatagagcaagaccctgtctcaaaaaaaataaataaataaaataaaatcatgactctcaaacagcagattataactgactcaaaggagaagtcaaaaaagctacatttgtatggagcaaaggaatgttgaaacaaacgcaccaacagagctcaagccagcttcttccagggtggcaaagggaattccactgaacctctactggcaggactaaatgtacaggtctagagccaagaattatttttcatttctatcagttatctacattttacaagctgtaaaataactcccatggagtcaaaagcagataatgtgaaagggtggactataggcaatatttaattttccattgaaaggaaatttttcctacactttccctctgttttgataaaaaataacctcatctattcccgggtaattcaacaatagtaacatatcaaatatacctgtttatttctggcacctctcttttcatacggagaagtaacaaatcttttgcgattttcaatggtatttctgggaaagctcagctatcattccttttattttattttatttcacatttaggaattttgggaatacaaaatccaaaatggtcaggagatttgaacacttaatgtaggatcataggtgtctgagaaataatatttgcctacccatttgtaagggacaatacaacatttaaaaataggccgggcagcccagtgctgtggctcacacctgtaatcccagcagtcttgggggccgaggccggtagatcatgaggtcaggagttcaagaccatcctggccaatatggtggaaccccgtctctactaaaagtacaaaaattagccaggcgtggcacgcctatagtcccagctactcaggaggctgagacagaagaattgcttgaatccgggaggcagaggttgcagtgaaccgagatcatgccactgcactccagcctgggcaacagagggagactccatctcaaaaaataaataaattaattaaattaaattaaataggtggggcacagtggctcactcttgtaatcccagcactttgggaggccgaggcaggtggatcacctgaggtcaggagttcaagaccagcctggccaacatggtgaaaccccgccgtctctactaaaaatacaaaaaattagctgggcgtggtggcgggcacctataatcccagctactccggaggctgaggcaggagaatcgcttgaatccaggaggctgaggttgcagtgagcagagatcgtgtcactgcactccagcctgagcaacaagagtgaaactctgtctcaaaaaaaaaaaaaaagaagaagaaaaagaaaccaaactaaataaaaatagatagaaaataacatgattgtaaagaactttagccctctcctaaataacaaatgttgtttctttaaatagtcaagggcataataaaatcaacatgaaaatcaaaaaattattctggtaaaacactgaatctttgctatctaggtagatttacatagaaaagaagaataacccttcataatataggtgaagacggcaaacagtaaaccagggaaacaaggccatgaatattaaacaaaatttttaaagaattttagtaaatttaatagtgttaaaatgcatatgatgtattttatatgcattatatattataaaatattatatattatatatgttttatatgataaagtgtatgttgttataaaagcaaacttttataagaccttaagcaaatttcatagtgtttaacatatttcagactaaaatattttatatatatataaataccagtctggccaccatggtgaatcctcatctctactaaaaatacaaaaattagctggatatggtggtgcatgccggtaatcccagctactcagggggctgaggcaggagaattgtttgaacaggagaagtggaggttgcaatgagccgagatcgtgccactgcactccagcctgggcaagagagctagactccatctcaaaaaaaaaaaaaaaaaaaaaaattcatgtcggcatgctcttttgcattctacaataaactcacccttgactttaggaccaagctcaaggggcccatgaggtcagaactaatttcacaatgctgctgaggtgtatttattgtacttcattcattgttgctatttttaaatgaaccattaaataagctttcttaaaagttatgttttatagcgtccaggcgtggtggctcatgcctgtaatcccagcactttgggaggcccacatgggtggatcacttgaggtcaggagttcaagatcagcctggccaacatggtgaaaccccgtctctaataaaaatacaaaaattaggcgggtgtggtggcaggtgcctgtagtcccagctacttgggaggctgaggcacgagaaaagcttggacaggggagatctctagttcagtgagctgagatcgcaccactggactccagcctcagtgacagagagagatgccgtctcaaaaaaaaaaaaattatgttttataggtatgtgctgagaggaatgaaaaaatattttttagaaatttatgtttaaatgtttaactgtaaatactaatagctataatacacaaaaaaaagctctttggtgtcctcattatgttggaggtgtgtaaagaggtttcaccaaacaaaccaactaaaaacaaactcccaaacccattgccccaaacctaatctgagtactgcagctttaagacaaaaccacagtactttattttccttagaaaacagaagtatacccaggggcagtggctcacgcctgtattcccaacactttgggagtccaaggcgggtgcatcacctgagatcagaagtactggaccagcctggccaacatggtgaaaccccatctttactaaaaattagccctgtgtggtggtgggcacctctcagctactaggaaggctgagagaggagaatcgcttgaacccacaaggcagaggtttcagtgagctgagatggcgtcactgcactccagccttagagacagagtgagactctgtctcaaaaaaacaaaacaaaacagaaacacatacacagttgtatttctctgaaactattgctccaaagcatagtgtcaatcactcacattaatgataacttttaagtaaagcaaattccatttcacagagaacacgggaagttggacacttttaactgtgactgtcacttaacatatagcagacaagcaaagctcatgaatgcacatgacacaactctctgcagccatatgaatcccttatggtataacttctccaagtggcaaaaagaaacacgttcattaacagatccaaagatgtaagctcttcgtagcatataaaaaaagaagcaagggccgggccggtggctcatgcctgtaatcccagcactttgggaggccgaggcgggtggatcacttgaggtcaggagttggagaccagccagggcaacatggcaaaaccctgtctctattaaaaatacaaaaattagccaggtgtgatggcacatgcctgtaatcccagctactcgggaggctgaggcaggagaatcgcttgaacccaggaggtggagattggagtgagctgagattgctccactgcactctagcctgggcaacagagcaagactctgtctcaaaaaataaaaacaggccaggtgctatggcttacgcctgtaatcccagcacctttggaggctgaggcaagtggatcatctaaggtcaggagttcaagacgagcctggtcaacatggcaaaaccctgtctctactaaaaatacaaaattagtctggcatggtggcaggcacctataatctcagctactctagaggctggggcaggagaatcacttaaacccaggaggtggaggttgcagtgagccgagatcctgccactgcactccagcctggccaaccaagagtgaaactccgtctcaaaaaataataataataataaggctgggcaaggtggctcatgcctgtaatcccagctcttagggaggcagaggtgggaggatagcttcagcccaggagttcaagacctgactggacaatatagcaagactctgatctccacaaaaaggaaagaaaaaagtataaaaaataaaataaaaataataaagaaataaaaataagcaaaagtttatacacttaaattatgcttcataatgcatattttagcctttcatttttcctagaaattatttatgtaactagcaaatatccatcaattaaatgagtagaaggttttaagttacctaaagatctttgaaatctaaagtggacataccatgaaagataactttttttttttttgagatggagtttcgctctgttgcccaggcttggagtgcagtggcacaatctcggctcactgcaacctctgcctcccgggttcaagcgattatcctgtctcagcctccaaagtagctgggactacaggcccacaccatcacatccggcaaattttcatgtttttagcaaagatggaatttcattatattggtcatgctggtctcgaactcctgacctcaggtgacccacccacctcaccctcccacagtgctgagattacaggtgtgagcgacctcgcccagccaaaagataacttttgaaataaaattcatcagtgcaatatatcaattttgttaaacacagattgacatttacatatttaaacattatgtaaaagcaatgctagcttattttatcagtaaatatgtataagttcaggaaaaaacatatataagcagaataaaaatgcatgcttgcattatacaataatatgggtgtacatttccagagttctcgtattcatacactgtataagaagatgacaaacaattttgcaatgaaaaatcttgtccatacgtttttggcatgcatcagaatatatctgtattcctgagtcaaagggtttgtgcatttgtgattttgattgataatgccaaattgcctcacagcagtgactttaatatacactctcatcctcagtgtatagaaatgctttcttcctcacacagctctaacaagcacgtcataaaactttttttttatttttttatattttgagatggagtttcactcttgttgcccaggctggagtgcaatggtgcaatctcagctcacctcaacctccgcctcccggattcaagtgattctcctgtctcagtctcccaagtagctgggattagaggcacgtgccaccacgcctggctaattttgtattttaagtagaaatggggtttctccatgttggtcaggctggtctcaaactcccaaactcagatgatccacctgccttggcctcccaaagtgctgggattacaggtgtgagccaccacatccagccataaaactcttaaatatgttcctcaacatgataggtggaaaattgttctcttagtacaatatttttttttttgttttttgtttgctcattagtttttgcttgttgttgttgttttgttttgttttgttttagacggaatctcactctgtcaccaggcggtagtgcagtggtgcgatctcggctcactgcaacgtccagctccaggttcaagcgattgtcctgcctcggcctcccaagtaactgagattataggcacccgcaaccatgcccagctaatttttgtgtttttagtagaaacgaggttccacaatattggccaggatggtctcgatctcttgacctcgtgatccgcctgcctcagcctcccaaagtactgggattacaggcgtgagccgttgtgcctggcaatttttttaattaaaaaaaataaaataaaatgtccagaactgtttgtatttccttttctgtgactaaatgtttatatcctttacttctgtttattctttttgtgttggtaggcttcttcctattgaatagtagaagctctttatgtattagggaagttcacctctgcctgtgatatgattgcgcataatttcttcttgcaggtatttctcccagtttcatgattgttttctcagtttgcttacaatagttttaacacagaacttttttatatttctatattgtaagatttgccagtatttccattaatatccctttatgacttttgtggagaacagagctttgggccccagctgagtggcaaagggcacagtccctcagtgtggaagacccactgcaggtgaccttgatgccaacaggcggcgggccagggggatgatgttgatgacaatcttcaactacacttgccgatgaagtgagacatggggtctgacttccacagggtaagaatggattggcccagaaaccactcgtttctcctttcagcaaacattctttgtgaggttgccacagtctttgcctatgttttacaaatgtgattgagaacagatgaaagatctgcccaaggtcacactggattctaaaacctgtttctaactgtgtcatcctccagaaagtgaatgtgcatcttggaggatgatccccaaccaacatgtgatctgaaagtacatattgcccataaaaaaaaaaaaaaaaaaaaaaaaggccaggtgcagtggttcatgcctgtaatcccgacactttgggaagccaaggtgggtggatcacttcaggtcaggagttcgagaccagcctggccaacatggtgaaaccctgtctctactaaaaaatacaaaaattagccgggcatggtggcgggcccctgtaatcccagctactcgggaggctgaagcaggagaatcacttgaacctgggaggcagaggttgaagtgagtcaagatggcactactacactccagcctgggtaacagagtgaaactccatgtccaaaaaataataataataatagcttatgtggggaatggggttgcttgtttctgactgaggtataagttcatttgtaatgcagtgttgaaatgattgcttctcctaaaagcagatcttgagaaaaaaaagaagaagaagaagaaagaaacagttgttcaattctcagtgctgtccgatcgtgagttcccagcaggccagataagcagagaggactgcggagggaattctgctgggtgacagctggggcaaaggttaatatgtaattgggggtcaatgttagtgaggaaacttgcctcaaaggagcagaagtgtggattcaggaccaacaagagatgagtttcttgtgacacaggggtgaggttagattagaatttttagaatatcataggcagagagtttcgttttgaataattgccactcttgggaatctccaatttgctgtagttgatgcataggccttgattaaaaaatacatatattcagaacagaaaactgagggactgtcacatgtaagcgactgcagtaatgtgatttagttaaaaacaaaacagaagtccgaggcgggtgaatcacgaggtcaggagatcgagaccacggtgaaaccctgtctctactaaaaatacaaaaaattatccgggcgcggtggcgggcgcctgtagtcccagctactcaggaggctgaggcaggagaatggcgtgaacccgggaggtggagcttgcagtgagccgagattgcgccactgcagtccagcctgggcgacagagcgagactccgtctcaaaaaaaaaaacaaaaacaaaaacaaaaaaaacagaacatcaagcactggcccggaagtgaggactccaggcagatgtttcccaactgtgccacttgttcgttctgtgactttgggtaagtagcttgccatttctgggtgttagttttcgccttctgtaaaataaggctgccggtgaagggctcagagcatttgcagcccaagcagcggaaagcagcccctttctgctgcaggccgtgggaaagaggccttgttggcaagcctgccgtctgcattccatgctcaatttcctgcctaggagggagatgggtaggaggcaggcacgtcaccttgcacccagatcccaggccagcggaaagacatgcccatcccagaaccccgaggctactgacagaattgggtggtgattaggacttgctgggggccacagcaatctgatttccaatctctgtctctctctagctgtgagctctctggttagtgctgcccctgatctgagtatcctctgtacaatggggatagtacccactccccttgcagttaccgaaaagatcaaatgagacgtgtgtaaatgcttagagcagtgctgggtacatattacatactcagtgctattttttattattggcttaattattgaaatcaaatattaacctccttacctaatgtaggaattctctctacagcatatcagacaactggctattctcactctgcttggatgcttccagtgacaggggactcactacttctcccagcaaattgtttcactagtagatagtgcttctggaattttatggaattttaaagctgagaggaacgttataaatcaagtgtaactgcctcacgagaaaacccaagttcaagaggtgaaatgaggccgggcacggtggctcatgtctgtaatctcagcactttgggaggctgaagcgggtgttcgagaccagcctgggcaacatggttaaaccctgtctctactaaaaatacaaaagttaaccaggcatggtggtgcatgcctgtaatcccagccacttggaagctgaggcatgagaatcacttgaacccaggaggtggaggttgctgtgagccaagattgcatcactgcactccagcctggacaacagatcgagactccgtctcaaaaaataaataaacaaacaaataaataaataaataataaaattctaccttcaaaattactgtctcctaatactttataactactatgtagtttgaagatgatctgttctctctctggaagcttttagagctttctctttgtcatattattattattattatcattttgagagagggtcttactctatggcccaggctggagtgcagtggtgcatgatcacagctcactgaagccttgacctcctgggctaaagtgatcctcctgcctcagcctacccagtagctaggactacaggcaagtgccaccatgactagctatttttttttttttaattttttcgtagagatagatagggtctcaaaatgttgttcaggcttgtctcaaactcctggcctcaagtgatcctcctgctttggcctcccaaagtgtaggattacaggcataagccactttgcccagtctcctcattatttttatttattattattttttgcttattatttttaaattttatacttgtacctaggaattgatttttccttatctcttgttagctctttataagtcctttcaaataaggtcatttttttggaaatgtatctccattatttcttcaagtatttcctccactctatttttacttcttatgccatctgaatttattgctcaggtgttcgcacttttatgtttatcatccacatttccaagcttttcttctctatttcttatgttttagtcttattgtgagaccaccacaatcatgtgttcatatattctttcttcaactatatccattctatttcatttgtcaaatttgattaatttccatttatcaaattctttgttttagctattttatttttcctacctaatattttcacttagtttgttttaatgatatcttgttcttgctgcatattgctaacattttctcttgtctcctatttaaggagcattattagattttgggaccttctgcttcaacatgtgtgatcagatgatacgtgctgcttgtgtagacttttcctcctcaactgtccagttatttggctgtgggctcattttcctttgggaaaatgtttggtcatacgtactgggaggggccaaggccagcctcatctatgttggttccggccatgtgaggactgagaatccagggatcacagaccccttagtgaatccctgtctgaggccaatccactaatcactcctttggctggagttttcacttttaaacccttaggaggaaataagataatctatagtcctagcaatttggttggaagcacggtgaaggaactacctgagggctgtctgtgactatttttgtgaattctctcccatgccccccgcagagtttgtgttgctgatatcagtggacaatgctccgggcactgttaactgtcatgctgaaggagtcaggctgatgactatctctctcaaggcaacttgaaggaacagagcagaatgtaaaggctgcccaaccagttcttcatgatgcccaggctacacccccacactaatttcagtagtcttcagtctcggagagggtagtgagaaattccctaatttccccacttagtgttagtgtatctctctcctgtccttccactatctgtttagggttgattttgaagatctttgcagggattctctaccatgtagtatcttatttatgtatttatatagaatgaatgaatgaggtggtgtgttattgtctttttcttttccttttttttgagacagggtgtccctctgtggcccatgctggagagcagtggcataatcatggctcactgcagcctggacatctctgcgctcaggtgatcctcccacttcagcctccccagtagcggggatcacaggcatgtgccaccacgcctggctaattttttgtagagactgggtctggccatgttgccccaggctgttcttgaacttctgggctcaagccatcctcctgcctcagcttcccgaagtgctgggattacaggtgtgagccactgtgcccggccagtgtcttcatctttataatattttatagtatcttcaactataaaatggggataatggtcacctcaaagagcagttgtggattttggatattttatatcagtttccagaacaaaataaatatttgaaaagtattgagttttttttactttcaaaagacctaatgcctaatttttcttctccgggagggagaagtatgtggataggtcagttggctgattccatcagcattttcagccctggagcaacgttctttgctggattgtgttatggctccaaatactattgacattaactactaacctcccaggaacagtgcctagaagtttttcttattgacggtgttggtacatatagaaaccaacgctaagcctcagaaatcaaggctgaaccatgtgatttctagttctaaattttctctattttgctactcaaagtggtctatccatccatgtggtcaagtttgaggagcacaggctgcaatgtgggcaatcacaaaccttccaggaaaactgtactcgtgctttacgtgttatagtttacaaagtttctttctttctttgctttattttccctccctcccttccttccttctttccttcttccttcctttccctttctctttctctgtctctctctttctctctttctttttttctttctccttctttccttccctccctccaccctcccgccttccctcctctcttctcttctcttctttttcttttctttctctccctccacctccagggttcaagcgattctcctgcctcagcctcccaaggaactgggattacaagcaggcaccatcatgcctggctaatttttgtatttttagtagagacagggtttcaccatgttggccaggttggtctcaaactcctgacctcaagtgatccacctgctccggcctcccaaagtgccatacaaattttgggattttttttttatttctgagaaaaaatatcgttggaattattattattattattattattattattattattattattattttgagagggagttttgctcttgttgcccaggctggagtgcaatggcaccatctcggctcaccacaacctctgcctcctgggttcaagcgattctcctgcctcagcctcctgagtagctgggattacaagcatgggccaccacgcttggctaattttgtatgtttagtagagacggggtttctccatgtcggtcaggctggtcccgaaatcccgacctcaggtgacccacctgccttggcctcccaaaatgctgggattacaggcgtgagccactgcgccctgctctatcattggaattatgatggggatggcattgaatctgtagattgctttgggtagtatggatatttaaacaatgttaaatctttcaatacatgaacatggcatgactttccatttatttgcgtcttcagttcctttcatcagtgttttagagttttcagtgtagagatctttcacttccttggttaaatgtactcctaggtatttaacttctttttaactactgtaaatgggattgcttgcttgcttgctttttttttttttttgatagcttgttgttagtgtatgaaaatgctactgatttttgcattttgactgcatcttgcaactttactgaatttgtctattagttctaacaggtttggggtggtacttcaattctttcaatgatgaaaccaaggtccggaaaggtgcatgtggctagagctaggttaaatcccatcttcaatctcaactagtagggtaatactttctgatttttaagtgtgtcaaatgtatcaacagtatgcatggtgattttaggtaataattatcctttctttccatatatattagaaaaaatgtaatgaacaaaccaagtctggaatttcatagttattcttgtttaggaaatttttttaaaaagtgaatttctggccaggtgcagtggctcatgcctgtaatcccagcactttgggaggctgaggccggcagatcatttgaggtcaggagtttgagaccagcctggccaacatggtgaaaacccatctctactaaaaatacaaaaattagccaggcatggtggttggcacctgtaatctcagctacttgggaggctgaagcaggagaatcgcttgaacctgggaggtggagactgcagtgagccaagattgcaccactgcactctagcctgggaaatagagtgagactcagtctcaaaaaaaaaaaaaaaaagaaaaaagaaaaaaaagtgaattgcttgaaatcataaataataaattcagctgtattgtagacatgattaaagttgtggaggtgaccccatgtgcttgagatttaggtaactcttccctaccttacattatagatgccattcctctcatttataacaatgttaagatttcttcaatttcatcctgtgcaatgtattaaaacaaggaaaaagtaagcaaaagttcattcatgaatatttccctgaacagcatttttattgcttccttacttttaaaaattacttttccatttcccacacaaatgtaactgaacagtattcattgtataccaggagtatttcccttaatccaacataatgacttactacaaatagaaatgaggcaattgatgtacttaatcctttataaaagcttagaagccatcttaaaatacttcgcagaatttgcaaatacagtattttgagtaggattttcaaacgtttactgtggaatcagagcacaaatctcctctccaagaagagaaacgtgaatactaaagactcctattgtgcagtgtggatgaaaatggaaacataattcacaatttgttgtggacaaggagcctcacagagagaatgtttccatggtcttcaagtgtattactcagctaccctactagcatttttttcactgtgctgacaagaaagggaagaaaaaatattcacaacccaggttgctaaactaagagctttaattaatgagactccagaaagggccctagcaagataaaaatgtgattgcactgtgctctctgacctcagttgcaggttctttgacttctctttcatgttctcagaccctcagtgtgaagatataagggctgtctgagattgcaagttgttttgctaaaaagcctctttacacatctgaaatataacctcttaaacctaactcaggcttatgttaacaccgtggctttaaaccatgcttagactgcatggaatcataaagatgttgaatataggaaacgctgttagtttatcaattgggcctactattaagttcttgaaggggtggattgcccctccacacctgtgggtgtttctcgtaaggtgtaacgagagacttaggaaagaaaaagacacagagacaaagtatagagaaagaaataaggggacccaggggaccagcgttcagcatatggaggatcctgccagcctctgagttcccttagtatttattgatcattcgtgggtgtttctcgaagagggggatgtgtcagggtcacaagacaattgtggggagagggtcagcagacaaacacgtgaacaaaggtctttgcatcatagacaaggtaaaggattaagtgctgtgcttttagatatgcatacacataaacatctcaatgctttacaaagcagtattgctgcccgcatgtcccacctccagccctaaggtggtttttccctatctcggtagatggaacatacaattgggttttataccgagacattccattgcccagggatgggcaggagacagatgccttcctcttgtctcaactgcaagagtcatgccttcctcttatactaatcctcctcagcacagaccctttatgggtgtcaggctgggggacagtcaggtctttcccttcccacgaggccatatttcagactatcacatggggagaaaccttggacaatacctggctttcctaggcagaggttcctgcggccttccgcagtttctgtgtccctgggtacttgagattagggagtggtgatgactcttaaggagcgtgctgccttcaagcatctgtttaacaaagcacatctcgcaccgcccttaatccatttaaccctgagtttgacacagcacatgtttcagagagcacggggttgggggtaaggtcacagaatctcaaggcagaagaatttttcttagtacataacaaaatggagtctcccatgtctacttctttctacacagacacagtaacaatctgatctctcttgcttttccccacatttcccccttttcttttcgacaaaaccgccatcgtcatcatggcccgttctcgatggtcactgtctcttcggagctgttgggtacacctgcagactaacaacagacaaaacaggcacacaaggattaatatgagatttataattgtagtacttccgatggtcttaacccaagtgacagggttaagatttgcgagaccatcagcaactcctgcaattgcctcagttcctggcaccaaatttaaatgggcttttgatgcttcgaaaatttgttcttttaatttggaaatgtctaaagtgagattatcttctcttccctgtagatagcgtctaaccatgtcccagtgatgctcagactcattataaatttggggtgtaatacaaaagtctgacgtattccagtcacactgtaactggaaacgatgttctaagctcatgagtctgtctcccatccaaatgacagtttgtctaagatcattaatttgatttgccaatttttgatcaatactagattgtgaattccacaatcttgtagaatttttttgccaatcattaacaaagtttaccgactgaacagaagagtgcaatgcaactcctgctacagcatccgtagctgtgactgcagttaatcccataatcactgcaattaaagtaaaagtgaatcttttggatctatttaaaacgccttttaatacttcagtcaaaatatggacggatggcgaggcctcccacggtcggtccatggacacagggatccacacgccctctcttgctctcaccagcagaatacggtgttgccaattaaaagttgaatcaatgcaagtaaatgatctacaatttgcacaggttatagtctgggagtctggtttaataactatatttcctaaaactagcatataagggggctttacgcaactttgtaaaggaaccgttagactggaatttaggtcgatagtataaaatggcttacgatatcttgtttctaaagtttgacttccagaccaaattctaatgtggtgtgaggccacagtaagcctccataattctggatgttcaggaccagaaacaggacttattatttttggtcttggggtagagattcctttttctccccattcccaatggtagaaagactgcaattttttatgcttacgtttgtctagactttctgttaagtcgctatcaacagctggactcacttgtgcacttggacatgactgagtttgtcctgagcaattgtggtagaattgacctcgaggtgcccaatctgtaatagttccgaattcattgttttgtaatatcaccgcactattggccacacattcttcccaaactaaaacgtctgtattttttgattctttgggaatttccttggggcaaggtttccctttaggtctgaattttaatgatctttgataagaaaagtcttgtaaataatttacccgtggcctgagtgacatcccgcttaccatgtgataagtgaatctactgatgggactgacagtaggtacttctaccaaccagttttggactgcagacattaaacatcctggtgctctccctaggcaaataggaggataacgatacccaatggaaatgtttatcatcatcccttcttcctcaggtttggcagggcagcgatcatctgtggggccaggtacccatacactatcattaacatatacttctataggattatccatccatgtgactggtgttaccatctccgtggaggcgcttttctttgcatctccgatgggttcattgtagaacttcaaatgtctggtgggtatccaaacaggaagctgattttctcctggtgaaacacaagcaaaacctctcccccacgttatcaccttccctatttcccatgtcttatttttattatctttccaccaaattagttttccttcatgtgggctgttctttttaccagtaagacgttgttctgcagaagtagtagtctgatttctataaatgtttaaaaaatttaaactatagagtgctagattaagttgcatctgaggagtggtacactccttactgtctcccccttctttttgtttaactaattgagttttgagtgttctattagttctttcaactatggcctgtccctggggggcaccagatgtaggggtgggttgcccctccaagttctgaggtcattagtttgttttgttttgtctttgttttttttttttgtcggttttttgtccttttttatttttccaaactatatgtgctttggaaatctaaggagtgggtatgaaaacagtttagcctggtttttttccatggttgcttccaccaagatgcctctggccttttctcatccaaaatcaacataaagctgtttctcccatatcaccaccatgactaccacacaaagccaagatgtctccatttttaaatttgttgcttcacagacttactactaaactcctggatgatgggggaggtgggcaacacgaggcccagaatcatgcctctctgtgtgatactgggcaagttacttcacctcactgagatgtttatgggtctatgaaaggaacgatctgcaccatttgctcactagatccccctttgcatctaagccatgataataccccaaataagatgaaaggattttatacaggcgtgcctgcatattgacgttttgatcaatgacacacagcacatatgacactggttccataggattagaacaccacatttttactgtaccttttctatgtttggctatttttttgtttgttttgttttttgagatggagtctcgctctgttgcccaggctggagtgaagtggcacaatctcggctcactgcaagctccgccttccgggttcaagccattctcctgcctcagtctcctaagtagctgggattacaggtgcccaccaccatgcctggctgttttgtatttttagtagagacagggcttcaccatgttggccaggctggtcttgagctcctgacctcaggtgatctgcccacctcagcctcccaaagggctgggattacaggcgtgacccactgtgcctggcctgtttgtctattttttttaaaatcccatcctaaagaaaagctaggtgcacaaatatttaccattgtgttacagttaccttcagtattcagtactactctatatgctgtacaggtttgtagcctacgggcaacagactgtaccatatagcctaggtgcgtagtcagctccgccatctaggtttgtgagtacaccctgtgatatctgcacaatgatgcactcacctaataatgcatttctcagaatgcatccccgttgttaagtgatgcatcctggacttcgtgcattaaaaaaatgccagaacactccttacttagtgcatagactttatcaaatgttgaataaaaacagaaacaaaaaggagacaatcctacaatgaaaaggagacacttatgtctaccgtagtgattcactgtacgtggaggaggtaagtggggcatggacaggtctacaaatataatacatatatacccgacaaccacagtgctttgcatttctttatcagtgaaaaacaaactgggatctgaagtgtataaacagttccctagtaaagtctatttgagataaagaatcaaatgtgcatcaatatatcaaaactgacaaatacaagaaaagcattcagctagagataattcacagcattttattcaagttaatccatttcattcaataatcttccatattgttcccagcaccactattactatcattatttctcttcggagaagaccaggtattaagaaatcgggtttgaatttccatgatgcataactctatggtcaaaaatccttttccttaccaaaaaccaactttttaatcaccagagaaaagagagaaagactgagatatatttgcagaaatttatatccactagagacaattcatagttcatcatctttcaggcttgtgctttacttggtggctctattttggggagggggttgtttcttataaatatttgtctaatacaaatcacttgccccactggaccacagaagggaaataagggctagtccccagaaagcaagcaggcagtcctcctgggaagaagccctaatggctcctagtggtgacacagtcattctgccagggtgaggggacacagtcattctgcctccccaacctctgagcaataataaagtataaccaagtgaacaggagaggtactaactagccggataatccatgggctagaatctctaaacaggaatgtttgtgtgttttgaataaatcagagctggaaagagacacttttggagaagtgatggagaatagaaaagtatgaaaaagataaaggtttctcaccaaggaacccacaaaaaaggtggtaccagtcagaggtagtcttgggcttttcttttgagatgagtgtaccccaaatgggttgtgccattttcacataaaaattggaatgataatgaacaagtgaaagtgaaatcagtttccctcctttgttcaataaacacggatagagtacctgtgtgcaaggtagtgggacaggtgctgaggggaaaggtaaagctgtttaagctgtggccctgagctgaaaaagaaatctagcagtgccatcagactgcacactacagagtagagtgtctcaggggccaggtggagggaaggatgacttccagctgcagcatcagggaaggcactctgcagtctcccctgtaggttctcagtgtgcctctgtgcctgtgtgaccactcagcctgccccattccaggcacttgctcatcttccttatctttctctctagtgtgagaagtggaagtttaagaggataagatcctgcttcacaggtacctaataaatgtgtgtggaattgacgtgtggtggaggtgtcactatcttagtgcagcaaggcggaaagagttttgggaaaggagagcaaagatggtggtggtgagggtaaggtgttttcatcagaaggcgagagcaagggtatacaaaccaaaaagtcaatttagtatgtggcttagcccagagcacatgagggcaccaacacagccaaagaccataagaaggtagctgaagtcctctgccaaataggactgaaaagctaaaatcttttcagtttctttcttaagcaacaactggtctattcaagctcaaccagagcatataagagaaaaaatgactaatgagaggctcttaaatagttttgaaggacagacactttctagaaagtagaaagatcactgagtaaacactgcacctcccctaccccacaaacacacacaaaaaagatgaggatgaatgtagaagtgtagagcaagcttgtggacatcctcaagtttggttttggcgcttctgttggtaagcagtcaagatggtgagagacgctatcccaaaggggaaagtctgtaggaaccagagtagctgagcctgaccacttgtgttgcctttatgcctaaaaaagaaaaaacaaaatttaaacaccagaatgttaatcttacagtttcatgggagttattgtcttctatattgttttttaaaatgtataccttccattactttcattggatttattttgctgcttttctctggcttcttatcttggatggtttgtttatttttcttctttcttgttttctaataaatgtattttggatggtacactagtccctgagaaccagtctggctggctactctctggggcacagtattataagactgtttctcatgtgattcggatggctgcatggagtaaaacgcactggtatggcttcagatcaaatgttttcaagatagaccagatttaaatcctagcgtggctacctaccagctgtgacctgggcaaatcactcagtatctctccaaatcagttttctcatctgaaaaacaggaatggcagtagctagctcactgagtgttgagatgatttatgggataatacacacaaagtgctcaggaaggagcctggcacacactcatgataaacacctgcttatattgtcattgaaattcaattgcttaaaacgaagtgcaaaaaaaaaaaatgacccaatggaagtgaatggcttgctacagtctcatctgtatggaaataagtctcatttggatgacttttatttataattttaaaaacaatatatgtaaaaacagtataattttctacagtaacagataaaaggagaaagatcatatgaatatcttaataaatgcagaagtggcatttgataaattccactatccattctttttccaccccctcagggatgggggtctcactctgtcacctacagtggagtacactggtacaattatagctcactgcagactcaaactcctgggctaaagttatcctcccacctcagcctcccaagtagctgggatcatcacaggcatgcaccaccacgcctggctaggttttttgttttttatttatttattttttttgtagggacagtgtcttactttgttgcccaggctggtcttgaactcctggcttcaactgattctcctgcctcagcctcccaaagtgccaggattacaggtgtgagccacctgcgtccacacctaacatccatttttaataaaagttctcagcaaatttagaaatacaatggaacttcctaattttgacagaggagatctacaaaactctagaataaacacgatgcaaaatgttgaaagttctcctttgaggtcaagaacggggcgcacttctagtcagcactgctggaagttctaggcaatagaataagggaagaaacataaataaaaggtatacacaattgaaagaaataaaactgtatttctggacagttttatacctgaaaaactgaaaataatctacaaactattagaattaataaatttatttagcaaggttgctgggtataaggtcaatataaaaaattgactacattcataaaaactaccatcaaacaattagaaaatgaaaaaaagtgagctgagatcatgccactgaactccagccagggcgacagagctagactccatctcaaaaaaaaaaaaaaacagttggtgcggtggctcaggcgtgtaatgccagcactttgggagactaacacaggcgaatcacttgagcccaggagtttgacaccagcctaggcaacaatagtgagaccccatctttttaaaaaagtcatttataatagcatctcaaagtacaagtagctggaaattaatctaacaacgtgtaaaacctcttaaaaattatagatatattaaaggagatctaaataaatggagacagataatttcatcgtttagaagactcagtaatagaaatatgtgatgctttcctgaccttaaggaaaaaaaagaaaaaaaaagtaatggaaatatgtcaatgttctccagattagttcacatggtcaatccaataaaaatctcaacagctttattttttgtttttgaacacaggacaatgcatagaatttgcaaaggtgtaggaaagggcaatcctattgcacaagatgagaggacatactttatcagctaacaatgattataaagctgctgctattaagacagtgttgtgttagcccaaggataaacaggccaatggagcagaatagagtgttgagaaacagatccatacatataagtaaagacagggcacatcaatgaagactgaatgtctcaataaatagctctgggataattgggcatccagatggaaaaggtaaagttggaaacctctctcttacaaaaaaaagctctaggtagaatgaaaacttaaatgtcaaaaaaaaaattctaaaactgttagaagatactgtaaaagaatataactttaggccgggtgcggtggctcacgcctgtaatcccagcactttgggaggccgaggcgggtggatcacgaggtcaggaaattgagaccattctggctagcatggtgaaaccccgtctctactaaaaatacaaaaaattagccgggcgtcgtggcgggcgcctgtagtcccagctactcaggaggttgaggcaggagaatggcgtgaacctaggaggcggagtttgcagtgagccgagatcgcgccactgcactccagcctgggcgacagagcgagactccgtctcaaaaaaaaaaaaaaaaaaaagaatataactttaatacaaataaatgaataaaattgactaaattcataaacttctgtttatcaaaaggcccaacagaataaaaagaccgtgagaaaggatatttgcaaaacatctaaatgacaaggtactgaagatcagaaaaaacaaggagcgcctatgaaaaggtaagcaaaggacagacagcccattagaacattggtgagattgtggggaaatgggcactatcatatacttcggttagaagcataaattagtcccacagttttgaaggcagtatggaagaaatacatatcataattaaaaggtcattcttttttttttttttttttagatggagtcttgctctgtcgcccaggctaaagtgcagtggtgcgatctcggctcactgcaacctctgcctcccagattcaagcgattctcttgcctcagcctccttagtagctggaattacaggtgcctgctaccatgcccagctaatttgtgtgtgtgtgtgtgtgtgtgtgtgtgtgtgtgtgtgtgtgtgtatttttagtggagacagggtttcaccatgttggccaggctggtctcaaattcctgacctcaggtgaaccactagcctcggcctcccaaagtgctggaattacaggcgtgagccacaatgcccagacaaaagtattcattctttaatcttcaaattccagatcttggaattttttgtaagagaacaaataccaaagtgggacaaatacacgaaattcatgttcattgctgtattgcttgtaatagtaaaaaagtagagacttaaaagcccatcagaaggaggatttcttaaatacattaaggcacatctatacaatagaattctatgcactaatattaatggatgaataactttatacgtataaacatagacaggcatatgttagtccagtgcagtggcacacctatagtcccagctacttgggaggctgaggctggaggatctcttgagcacgggtgctcaaggccagcttgggcaacatagtgagacccatctcttaaaaaataaaataaaatacaatttaaaataggcatatatgaccatggaaaccaattatagaagagattatatctatatgtatatatgtaattggattacaggcatgagccaccactcctagcaactttcaattttataagctgagtttttaacaacattattaacttaaaaacaaacacgtttgttttgaaatgggtgaaacaacaaaaatattttgttttggaaaataaatttatatgatcctgtaaatgtgtaagatacttaggaaagaaaaataaagatgagttggcatcttggaagagcaggctcactgaacagcagtgcttgtttcctcctccttcagaggggtcacagctggtggccaggtaactcggagaagggttttcctggggtcatcataacttgttctcattcacacacctttatctgtattcttagctcattttgcctatttgaaagacaaaagccttttaagaaagttttcttaatttaattcacatttcccttaatgattccaccaagacccaggcagatgtaaaaatctctttgtgagtatactgtttcctgccttaggaaaaaatgttacttctgatacttgaaaaatttcacaatttacctgttttgttcactcgaggctgccctatcacagagtacttccacttgtcaagaacttctgttctgtttctacatggtaataaaatctactctacatacaaatgtttgcaagaactgaaaaacctttctcagggctgcagagccaactggggtaaacaagcagcaagaatctaatttctgaactgagacaataagccatatattctgaatggaaaattccagattgtaaaaaggtaataatgaacatgaatgttggcctcaaagagatactatgttatttaccctaaggaaaaaccgttctatttttcttgttaaaatattattatgtaacaagaactacaagcaccttcaaagaagagttgaacctcactttgtaatcaaataaatacaagttaaaatggctagataaccgtttttaatctaccaaaatagcaaaaggtttttgccccccatcatcaaaaatagcacttttttttttctttttttttcttgagacagagtctcactttgtcacccaggctggaatgcagtggtgcaatctcggctcactgcaatctctgcctcccagtttcaagcaattctcctgcctcagcctcccaggtagctggaattacagacgtgcaccaccacgcccggctagtttttgtatttttagtacagacggggtttcataatgttggccaggcttgtctcgaactcctgaactcagttgatctgcccgccttggcctcccaaagtgctgggattacaggtgtgagcctggccagaaatggcaatttcatagaatggtagtggaaacgtaaaatgctaaaacccgactgaaaagcaattttgcagtaagtaccaagagctttataacggttctttcactcagtaattctatatccacggatttagcctaaggaagaaaataagaaatacataaaatggttaaagagtaaatgtgcattgttagaaggttaaataattatgggatatacaattacaggagtcttttgcaaactttgaaattatttaccaagagattttaaaaacatgggaaattatttcgtattatgattatggcacttataaagtcaacatgtagtccaatcgtatctctagtgaaaaggaattcaccaaaaaatgatttactgtattttttaaaacatgggatttaagagacttcatatgaatatcttgactatgcattgaaattcttatttagggcctaacacagaggaggtgtttgctaaatgttgatttcttgctacctgtttttttcctccaagattgttgctgtatgtatctagggtccagaggagtccagaatattgttttgcgcatgttgcttattgaattaaaaaattaacacattcatgaaaaataaagaaattcacccaaatgttacaagtagttatttggcaggctgtaaatgtatacatgtcttcattcatctaaatttattcattcatctcataattccttttttttttttttttgagacatcttgctctgttgcccaggctggagtgcagtactgtgattgtggctcactgcaacctccacctcccgggttcaagcaattctcctgcctcagcctcccgagtagctgggatcacacgcatgcgccaccacgcccagctaattttttgttttgttttgtttttttgtatttttagtagagatagggtttcaccatgttggccaggctggtctcgaactcctgacctcaggtgttcagcctgcctcagcctcccagagtgctgagattacaggtgtgagccaccacgcctaaccatcatctcataattcaaaaggagtatttattctgatttatagtgatctcaatgatacattctaacatgttagaccataaggaaatgatttcaaaggccaggcacagtggctcacacctgtaatcccagtactttgggaggctgaggcgggcacatcatgagatcaggagatcgagaccatcctggctaacacagtgaaaccccgtctctactaaaaatacaaaaaaattagccgggcgaggggtgggcacctgtagtcccagttactcgggaggttgaggcaggagaatggcatgaacacaggaggtggagcttgcagcaagccaagattgcacccctgcactccagcctgggcaacagagcgagactccgtctcaaaaaaaaaaaaaaaagaaatgatttcaagaacgtaataatagtgacctaacctctatgcctgttctccctctgcccttcaaaaaaaattgtatattaaatttgagtattttggttttcatcagatactccaaatgccaacaacaaaataggtgtcaggcactcctacattccaagttgaggggctgggccggacacttacaatccgagattccactgggatgctgcagaggccattggaaagaggtcctagtgagctgtggcgtttcctacaagtcaagcccagacaatggcttcaacaggaccatttgtagagcttgacatgagtcccctggaatttggggaatgatttaacatctgattccaaagagtaaacactggtttggactgcttgctgggagagaaggaagcaccaccgcactgtgaactgcatgcacttgcagattatcccactggaggggtactgaagttgtttatactgtgagccatacagatcctggagaaggcactggacatgagtaggtttaaaagggaccctgtaccacaggcccacctgaaggatggaagtgatctcaataaaagggtaattcttcccggaacacagactctgagggtgaaactgcaagtggcactctggaggaggtatctgaacaaccatcaaggaaactgcagaagggagatcccaggtgatgaacagtgtctcaaaatctactacattccctctaaagagaaagagccaatagactggatacacagtgtacacagcacccagctgcctgatcacaaggcagcaactgtttattgtttttttaatttttttttttttgagacgaggtcttgctctgtcacccaggctggagtgcagttggctcactgcagcctctgcttcccgggttcaagtgattttcacgcctcagcctcctaagcagctgggactgcaggcacgcaccaccatgcctggcttttttttagtattttttgtatttttagtagagatggggttttgtcatgttggccaggatggtctcaaactcctggcctcaaatgatctgcccccctaggcctcctaaagtgctgggaatataggtgtgagccactgtgcccagccagcagctgctgtttaaggatgatccttgttctccctaactattcccaccatcccaagggaccacaagcagcgattactagtgaatagaggagaaggtgaagtcaactgcatccttctccccactgcaggctcctgagcctctcccagctggaggagaacagacattctgaattagaagaaagtttatagttgtaacaaatagaacgggctagaatggataatatcagatggtgactggaaatcctatgatctgcttgaaattccatccagagatacggtggaaggtggggaacaatccacaaagcaaatttacttggagaggggtgagaaagaaataataaagttactttctgctcctcttcatagaaagtctagcttgtggccgggcacagtggctcatgcctataatcccagcactttgagaggccgaggcaggcagatcacctgagaggtcagaagttcgagactagcatggccaacatggtgaaacctcgtctctactaaaaatacaaaaattagctgggcgcagtggtaggctcctgaaatcccagctactcgggaggcggaggagggagaattgcttgaacctgggaggcagagattgcagtgagccaagattgtgccactgcactccagcctgggcgacaaagcaagattctgtctcaaaaaaaaataaacaagaaaagagagtaagataattctatttaacatacttagcagtctctgacatagtggtacacaatcaatattgattatttttattattgaaacatagtaatagagtatcttattttccacttttagaatagaaaaataatagaggtcatagtatatcttgaccagaaattaattcaactaattaactaatatcttcataagaaattaattggaaggcaatttggcattactataaccatgtttttcattgtaccatactttctgtatatgcttatagaaaatacaaacataattttttctagcgttctcacacagtattaacctacactagcatctgctgaatggggtctgatttgggggcttttaactggcattgcctcctaaaattatctgtggagcttttaaaaagaacacattcccatctctgaggcaagacttacccaatcagaatctctgggtctggaaaccagacatgtgtattttgaaaaagctcctcaggtggttcaactgtaaaacgaggattgcgagtcatcagcctaggtcagtcacttagctcttttgaaaactagaagccaggctcctagtcttttggtctctgaaaaagaaccagagacacagaatacctattaggtcacttaaaacctgttttgttgttgtggtggttggtggtagtggtggtggttttttcgtttgtttgggtttgtttttttttttttttgagaaaggctgtgaaacaatacaaaaataactacagaccaaagaaactcagaacagtcatttgggcccccattcttgacttctattttctttttcctttttttttttttttttttcttgagacagggtcgcactccactgctggggctggagtgcagtggtgtgatcatgactcactgcagcctccaccatctgggctccatccatcctcccacctcagccttccaagtagttgggaccgcacgtgcatgccaccatgcccagccactttttaaaattgtatatagcgatggggtctcactacgttgcccaggatggtctccaactccagggctcaagcaattctcccaccttagcttcccaaagtgctgggattacagcatgagccactgcgctgggatgacttctattttctaaaagcaactctactgggagatttatgctgaggaaagtatgtggttatcagactcagtgcccatggtggatgacttcttttttttttttctttgtagagaagggatcttgctttgtcacccaggctcgagtgcagtggcatgaccacggctcactgtagcctcgacttcccgggctcaagtgatccccccaactcagctcccccaagtagctgagaatacaggcatgggctaccacaattgtctaatttttttttttttttgagacagggttttgctctgtcgctcaggctggagtgcagaggcatgatcttggctcactgtaacttctgcctcccagattcaagcatctctcgcctcagccttgggagtagctggggactacaggtgtgtgtgggtgagtctgggtgtgtgtgggtgagtgcaggtgtatctgggtgtaggtgggtgagtatgggtgtgtgtctgcgtgtaggtgggtgagtatgggtgtgcaggtgcgtgtgagtatgtgtttacattgtggtatgtgtctgttgggtgccgccattagggatttggaagagtgaggaccataaacttgtaaacatttctacatgcctggtccataagaagtgtaccaagcatgatcaaaagtaactaaaccaagtaaacaaattagacattaattaaacttaatgctgggcaggaaagaagtattcaaggccaggtaaaatgaagaaatataaccaaataaatgaaattttaaaattagtagaatgagacagaaatactttttaaagtttttaatttctgatgaatatcagtatataaaactaacaattatatggccgttaattgactaaaaacagtactttagatttcagctagtgaaacagccatatatgatcttctaattccatttttatgtctcaagaatgacttgtttaaataattttttttgaattgttacattttcatcttgaaagagcttcacaaaacttacatgagaatctggattgtcataagaggtctgagtttttaatggtatgttcgtatttctgttatgtacatcgatgtcaaacattcatttcctgagctgttctccagaacacaatttgacttgtaatgaacactcaataaatggttgcttggataatcaaatcaacaccttagtttcatcaattttcatttcatataaaagtgactgatcttccatactcaccaatgaaacagagagagatgagggagggatagcagtggagactaagaggatgacaagcagacctcattttgcagtggatatcctacactctccacttctgaatgcttggaaacacttgccatactcaaaaaacattgctatttcctaggcagaaaatgggagttaaagaaaatccatatttctatattacaataacttacactataatacatggacgacatacatttctaagctcttcagttcatagaaaatgtagatacatttaggtgagcaagatgcaggagaagggttaataatcaggctgagtgtgattgtgagattcagtctaatacaagtcttgggtaattgtatcagttgacatttctgttcaaatgcaaggtgggagagttttgcaggagctactgaaacttcctgcctgatgttaggagagatgttggtccatgtgattaggccagatgtgtttgcttaattgtggcttagaaaagttaggtttctgacctctcacagagacggggagatagggacgttaaattttataacatttctatttaatatatatttaataatacataataaagtttttaaaatgtcaattttgtcctttttctagtttgcattattttgttttcaccgcaccattgtttttagtacatatgttttgtgtatttaaaaaactgtgttgaggcgccctggctcgccctgcgccagaggctcgcgcactcagcaggttgggctgcggcggcggcggctggggaagccgaagcgccgcgcgtgagagatcccggatacatctgcggtttgggctccgccaccctccgtctctctcccgcaggtctctgagccgggtgcggaaggagggaacggccctagccttgggaagccaaagcacacccctggctcctgccgacaccgccctccttcccttcccagccgcgggcctcgctccgtgctcggctactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcatcggtccgggaggtctctgggctgaggcggcgacagctcctctagttccaccatgtccgcgggcggagacttcgggaatccgctgaggaaattcaagctggtgttcctgggggagcaaagcgttgcaaagacatctttgatcaccagattcaggtatgacagttttgacaacacctatcaggcaataattggcattgactttttatcaaaaactatgtacttggaggatggaacaatcgggcttcggctgtgggatacggcgggtcaggaacgtctccgtagcctcattcccaggtacatccgtgattctgctgcagctgtagtagtttacgatatcacaaatgttaactcattccagcaaactacaaagtggattgatgatgtcagaacagaaagaggaagtgatgttatcatcacgctagtaggaaatagaacagatcttgctgacaagaggcaagtgtcagttgaggagggagagaggaaagccaaagggctgaatgttacgtttattgaaactagggcaaaagctggatacaatgtaaagcagctctttcgacgtgtagcagcagctttgccgggaatggaaagcacacaggacggaagcagagaagacatgagtgacataaaactggaaaagcctcaggagcaaacagtcagcgaagggggttgttcctgctactctcccatgtcatcttcaacccttcctcagaagcccccttactctttcattgactgcagtgtgaatattggcttgaaccttttcccttcattaataacgttttgcaattcatcattgctgcctgtctcgtggaggtgatctattagcttcacaagcacaaaaaaagtcagcgtcttcattatttatattttacaaaaagccaaattatttcagcatattccggtgataactttaaaaattagatacattttcttaacatttttttcttttttaatgttatgataatgtacttcaaaatgatggaaatctcaacagtatgagtatggcttggttaacgagcagtatgttcacagcctgctttatctctccttgctcttctcacctctcccttaccccgttccctatttccgtgttcttacctagcctccccccacttcctcaaaacaaacaagagatggcaaagcagcagtccgaccaagcccactggaattatcctttaattttacagataccacttgctgtaggctgtggaccaagatgtccagaattattcttgagcactgatgtaaattacttagatcttctttgaggtcagaattcagcgatcacggtaggcagtgcttgaatgagaaaagcctcctggtgcatcttcaaaatgagtcctaaagaacatactgagtacttataagtagcagaacataaaatgtatttctgactaacacaaatggtcctttcacatgtgctttattagactctgggagagaaaagtaaccaagtgcttcagaacaggtttttagtatttacttcttcatggtaagataatgaagttctaatgaactatttctcccaaggttttaaaattgtcaagagttattctgtttgtttaaaaagtaagaaacctctgtaagcaatagattttgcttgggttttctttcttaaaaaaataatactatgcaggcaagacaccataaaagtttaattccttacagaagaaccagtggaagaatttaaatttggcactacgatcaaaactactgaattagcagaaataacgatatctaaagcttaccagcaaaagaaccctcagcagaatagcaaaaactttgctcaggacatttgaggtcaaattgaagacggaagacggaagacggaaaccggaaaccgttttcttgtaagcccctagaggcagatcaggtaaagcatacatagtagagggaaaggagagaatggaaataaaactgaatattatgcagatttatgccttattttttagcattttttaaggttgggtctttcaggctggttttggtttgtattagatctgtatagtttaactagtgatttagttttatatttaagctacgattaatattttttctttggcgatatttctttgctttttttttttttaacaactttccatttttagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggaagaaaacttcgagttacaggtcaggaaaagcctgctgaatttatgttgtaaacgttacttaacacagtataaagatgaaaagacaacaaaagtatcttcatacttcctcatcccctcattgcaacaaaaccttaaactgggagaaccttagtcccctctctttcctcttcctcctccacttcccacttattgtcactttgtaatattcagagagcacttggattatggatctgaatagagaaatgcttacagataatcattagcccacataccagtaacttatacttaaagatgggatggagttataaagtgcttttataatacaatataattgctaaaggcaagggttgactctttgttttattttgacatggcatgtcctgaaataaatattgattcactatggcagatgggtcatattctttatttggaagaagtcatgacttctgacatgggggtgattttctccctacactgttgcatttgattctttttatgtatttttaagaaagtaaccagttatactgcttttaatattgattggtctttttatttggcttggagttcttcaaagcagtgaagtgtgttcatagtccagatttttttttagtaaacacaattttgctgccaaaaatatataaataaaacacaaaaggaaacaaaaataaaaagttttgaaaatgttagatcatctccctttttaccgcctttcccttttaccttttactgccatttacatccacacatccacacacacaacgtgcacacacataccgactaaaattaatttagatgccagttcgaattatatttattatcctcccacacacacacacaccttttttttttatacggagctttgctcttgttgcccaggctggagtgcagtggcgcaatcttggctcaccacaacctccgcctcccaggttcaagcaagtctcctgcctcagcctccctagtagctgggattacaggcacccaccaccaggctggactgatttttgtatttttagtagaggcagagtttaaccatattgatcaggctggtcttgaactcctgacctcaggtgatctgcccaccttggcctcgcaaagtgctgggattacagttgtgaggcaccgcgtctggccttataatccttttaagaagaaagaacatccttaattttttgaagagactattctgtgtccgttttataattttttggccaccgaaaaagatatgtccaatcacagacacagtgaatataacaggtggtagtttcaagtgttgacttttggtcaggtgtggtggctcacacctgtaatcccagcactttgggaggctgaggtgggtggatcacctgaggtagggagttcaagaccagcctggccgacatggtgaaacctacaaaaattagctgggcgtggtggcgcgtttctgtatcccagctactcgggaggctgagggagaagaatcgcttgaacccaggaggcccaggttgcagtgagccaagatcacaccactgcactccagcctgggtgacagagtgagactccctctcaaataaataaataaataaaatgttgaatttttacaagtcgttgttcccattccaatttttgaatgcaaccgcagcctcttacaaaacagccttgttaaactaatttgctgatattaaattcttaagtaaaaggggaattccacagggatttatattgctcttttataaatctcttgaacctaggagaaggaggttgcagtgagccaagatcaggccattgcactccagcctgggtgacagagtgagactctgtctcaaacaaaaacaaaaataaaaaagaggaaaaatcaggcacaagtatgcagagaaaggtgaagtgagtaaagggtctaacccataactctgaattccaaagtttgagctaatgctccaaaacacaggaaatggtatttgcttgtgaaattgtgcatgtttttcataaaaagtagaaagtatttgcacaggtttctgcagtcctgaggggcagagatgaatctgtcatttgcagatatgaagacagctcaaggtagtgatcctggacattcaggaggggaattagacacgagatccggggctggatgctcactcaattagccagtccctgggtcactcaggggaaacctatgctgatttctggagctctttctttgtatagttcgttactttaaatttgagatgctcacttagccctcctaaaataatatttgtctctcttcaattcagggatttctccaagctctgtctgggttctgctgccaatggtgttgtccagtaagtatccccaggcagaaataaggggctattgtagggcttacattgcttgtttctcttctcaactggagaaaaacagtccttagttgctgattgtctaatgtttgaaaatgatggttttctatagtttgtctagttttctagttgtttatagtggaatcagtcattagcccctgattagagacagaatctctcatctactcaactttttactttaatttaaaactttttaaaatgttatattttaattttgttacagaatatagtaatacattatcctagtgtaaaatttaaaaagtaagtaatatttagtaaaaaaaaatactcctcccactttcactcccagaagtaactgatgttacaaaatctttctgtcttttagagttattatatgtatctacaaaataaaacacaggaaactagccataataaaataatggggtctaaaggaattcaatcacataaaatgttaggtcaaatttattgtgagattaataaaaattatacttttgttaaactattactctcacaaaaagcataaaatgattgtgaaacttacagcacacattactgactagtgaattgagtaaccgccattgattgtgaggcagtgacttctatgtccccttccccatctcattacttacaagtcatgtataagagtttcctttgttctgtaacttctctgacagttgtgattgaaattttaaatttttgtcaagctggctaatgtaaaacatcatcctgttctatgtttaatagcatttccctgattaccaatatgaagcattatatattgtctgttcatgtttcatattttgtataatgtctatatcctttgttcattatttgttatttgtattattctttatatattattctttaacacattgctgtttatatgttggttatattttacattttcttctagtttatgggaagtctttttcttttcctaagacaatctattgataaatataagctgtgaatattaaagttataattaaagttatcaaatgtttgagataactttattcattagctctttatgagtttttggttttttttcagttaaatgaaataacttctttttttgttttttgatgtgaagaacttggtggagaaattaaaatttcagatgcagaaaaagaagcaagaaaattgctggaatgacaggcatgggtagataacaggtgtgatggttaatactgagtgtcaccttgattggattgaaggatgcaaagtattgttcctgggtgtgtctgtaaggatgtcaccaaaggagattaacagttgagtcagtgaactgggagatgcagacccaccctcagtctgggtggtcaccctctaatcagctgccagtgcatctaggataaaagcaggcagagaaatatggaagggctcgactggctccacctttctcccgtgctggttgcttcctgccctcaaacatcaaactccaggttctttcagcttttggactcttggacctacaccaggggtttgccaggggctctcaggccttcagccacagactgaaggctgcacggttggcttccctacttttgggatttggggactcagactggctttcttcctcctcagcttgcagacagcctatcgtgcaacttcaccttgtgattgtgcgagtcaacactctttaataacccattttatatatacatttatcctattagtcctgtccctctagagaatcctaatacaacaagacacagcacccagtcacagtaagaggggtggacattatttagaagcaaagacagttcacccatatgaaaaggagagataacagaatgtaggtatagatatatgaagatgagcagatgtagagactggagattttgaaattcttgtcaaatgaccacttttttttacaagtgaaatagaaaataaagtcatcagcaaagagcaaagatgggaaggagagaaaataaatatgaactgttactctgggaaaggatgagaatgaatggagcagggaatatttttttctgggaagcataaagacatgagctttgtgatcatgaatttcagttgaaacaaatcaacctgattccctcttactctattttaaatttcagttttatttaaaaatctgaacataatatccataattatagtattatacagaagagtttcactgccctaaaattcctctgtactccatctgctcatccctctgtcccccataactcctggcaaccactgattttttttaactgtctccatagttttgcctttcccagaatgtcatgtagctggagtcatacagtatgtagcatttcctgattggcttcactcagaaacatgtatttgagattcctttatgtctttttatggcttgataggtcatttctttttaatgctgaataatatttcatgtatacaatacatgtattacagtttatccatttacctaatgaaggacatcttggttgcttccaagtttggcaattatgaattaagctgctgtaaacattattgtgcaggtttttgtgtggacaagttttcagtttctttaggtaaatactaaggagcattaatgctagattatatgataagagtttgcttagttttgtaaaaagctgaccaactgtcttcgtaagtggtgtaacatttgcattcctaccagcatcaccagcatttgatgctgtctgcctttcacattcatcaggcttaaccttcataattttgctgcacttacttttaaaatgaaagtcttcaattcatcccgtgctttgtttcttaaacaatcttgaatgagttctttaaagtctaaaaatctccagaaaataaaagtgttaactatatattgagagctgaagtttgcagagcaaaggagtgacactacattggtgatgatgtaaaacctcagctgaaaattctaatagctacagaagaggtatgatattttcatatatagttccttctcatttacatgtgtaaacttaagagagtcaggagtattgtattgttaggaaaatcagagcacttcaaaaaattgctgtttataatgtttagaaatttagacctaacactttcatgatatagactagagtagacttagctaaacagaaccatttattagtctgttgtacatattgtttttgacatatttattatattataaactacaaaaggagaataaaatagtgtaaaactattttgagaagggatctaataaaaataacataattatgggatttctattatccacactcaattaagactaatatttttaatttaaaaaaagttttttaaagaagaattcctgaatggtaattgatagtacattaatttgtttttttgataaaaatcctcaaagaataaaaataatttcttcctacctctatattacaatcagcataattgaaataatatgcttcaattgttagtaaagtaacatttatgttttggaatcaatgaagctaagccagcactaagaattttattactattcctccactacatttcagagggttatttctttatccttaaacataccacaataacgagtctgctaggtccatttagattatcaacccaaccctaaaagaaagaagatttctattggttacacatttcagaagattgttgtatctttggaacatctgcagtctcatcttaataaatttcaaacaagagcactgaaactccagccaatagaactatctaattcagtcttattaagatcccaaagatcaatggcaaagcattggctattttctgcactttgcgcaagaattaaaatttggccaggattgttgttcatagcaggagtcaggaatggttttgtggtgttttatgacatcttaagggctacattgaaccttgtccttatatcatgatctgctaagcaattcaccaaccatacttctccacctcagtcctgactttagcctccttaggagaatattggagacatgattggtagtaatggcccatttcttgacatttttgaccagctacagatacacattttgaccatgccagatacacacatatatatgtgtgtgtgtgtgtatatgtagtgtgtgtgtgtgtgtgtattgtgtgttgacttgcttaaagacattacagggaagattatatttaagaccagttagagggaaatgtctttttgagtttgttccctaaactctaagccattcagctgaccttattatgtctgtttacctcatagtgtagaagtcaaaatgtgtgtgtataatgggaaaggagagaggcaggaggagaagatgaagggattaatatccatgaaccttgtagtaaggacctgccttttactagagactgagcactcctcatacattgtctcattaaaccacctctccaaaatagtatccctcttgttttatggaagggacaactcaaaaattttgcattgccagtaagtgatggagctggaatttatctgccccaaagcttcacagacttgctttaaagaagatggtataattctatctcacaccagttagaatggcgatcattaaaaagttaggaaacaacaggtgctggagaggatgtggagaaataggaacgcttttacactgttggtaggagtgtaaactagttcaatcactgtagaagacagtgtggcgattcctcaaggaactagaactagaaataccatttgatccagcgatcccattagtgggtatatacccaaaggattataaatcgtgctactataaagacacatgcacacgtatgtttattgcggcactattcacaatagcaacgacctggaaccaactcaaatctctatcgatgatagactggattaagaaaatgtggcacatatacaccatggagaactatgcagccataaaaaaggatgaattcatatcctttgtagtgacatggatgaaactggaaaccatcattctgagcaaactaccacaaggacagaaaaccaaataccgcatgttctcacttataggtgggaattgaacaatgagaacacttggacacaaggcggggaacatcacacaccagggcctgtcatggggtggggggatgggggagggatagcattacgagaaatacctaatgtaaatgacgagttaatgggtgcagcaaaccaacacagcacatgtatacatatgtaacaaacctgcgcgttgtgcacatgtaccctagaacttaaagtataataaaaaaaagaagatagtataattcaaagtactttcaaaaggacatagcgctatactgaggttagaaaaaacagtgttcccaagctgagatccttctgtgcactttgtaacccttgtttaccctggcagttgcaatactaccaatttaccattaagaacattcggtatgtttaaactacagtgggaaagccaagatatgaaaccatcacccatgggaattttgaggctagagtaattagaagctaatttaagatctccattcaactctaggacagtcagggtaactgccagagaagctgcatgctgggtaaatcctgatcccaaagtggaattttgccctagtacaatgggttgatatatgattggctgcacttagctatacatcctgaggaggaagaagaggaggagaaggggaaggggaagaggaagaagaagaggaagaaagaagaagaaggaagagaaggaggaggagggggagaaatgacatcagaaagtaattgggctagaagaactttaatttggaagcaaaatacagaattcaggtgagtgggcttactgggaaagggtcgtgccacgtcgctcccacagtggagggccttatgatggcgatggttacatttctgctctcctgctgcaccaccatttctcccaaggccttgcggtaggtgcaagaattgggcagatctctgatcagcttgggtgtgatctcgtcaataacagcgttatctaaccacctaaaaagtagtcagagtaaaaagaattctagcagcatatgttagacaatagaccaaaaggaaaatgtgacacacaaatagtcaaaacaaaacttccaccttttagccttggttctggaattcagaagagtcacacgataccaagtttgtgtgcgtacctgttcaaagcatgcatgagctctttgctctccactgctaagcccaatctcatcagccaaatcctacgccctcccatctagagagataggtaggtagacagaccaatagaatcaatagcaataccactttattgttactactagtatagggctattagtactacttgattagtatgactttagcactactattactttatcaattactttatcaatattgttactttatctgtagtagtgctaatttgaggtaattacatacaacctctttacttcctctccaagaagctcataaataaattcattgcatgcatttttgagtcccagtcattctctcagtagtgtgctagatgctatatgttcagggagtttgaggctctcatccaaggtgtttcagtggcagccctgttcagtgttgtcccatagaaaccagtgcagtgatcctgaagagtttagctttacattttaaaaatttcattcaatgcaaatcaaaccaaagtgactatggcagactgacaatctcttttagcaaatctatgtaatgcattttgaaggtctgtttagagtctgggctaataacttgctaattatttccagagatttccaatgaattctgaagtctgtgaagtggggtgattatagtactctgaaattgcttcaaaatcatgaatattgaattctcctacttataatatgacatgtatcatgaataactgagttaccatagcatttgcctaatctttctaaaaatatgtcagaactggcctggcggagtggctcacacctgtaatcccagcactttgggaggccgaggcgggtggatcttgaggtcaggaaattgagaccatcctggccaacatggtgaaaccccgtctctactaaaagtataaaaattagctgggcgtggtggcacatgcctgtaatcccagctacttgagaggctgaagcaggagaatcgcttgaacccaggagtcagaggttgtaatcagccaagatcgcaccactgctcaccagcctggtgacacagagagactccatctcaaagaaaaaaaaaagaaccatttgataaacccaaagtgtatctacacgtctctaagagagcaaaaaattattgtcaattaaatatgtaacatttattctaactgacagatctatgtggttaaattattgatatagcattttaaaaattaagctgccattctagctgctgtgtgatggtatctcactgtggttttgatttgcatttctctgatggccagtgatggtgagcattttttcgtgtgtctgttggctgcataaatgtcttcttttgagaagtgtctgttcatatcctttgcccactttttgttggggttgtttgtttttttcttgtaaatttgtttaagttatttgtagattctggatattagccttttgtcagatgggtagattgcaaaaatgttctcccattctgtaggttgcctgttcactctgacggtagtttcttttgctgtgcagaagctctttagtttaattagatcccatttgtctattttggcttttgttgccattgcttgacataggaacgcttttacactgttggtgggagtgtaaactagttcaaccattgtggaagacagtgtggcgattcctcaaggatctagaactagaaataccatttgacccagcgattccattactgggtatatacccaaaggattataaatcatgctactataaagacacatgcacaggtatgtttattgcggcactattcacaatagcaaaaagttggaaccaacgcaaatatccatcagccatagactggattaagaaaatgtgacacatgaggccagcgccggcggcggcggcagcggtgctgggggcgcagagggccgcgcaagcggaaccgggcgagcacgcgagctaccggagagcgggcggccttgcgggaggcggcggcggcaccccaggccaagccggcgcgggaggagttccagggcgatggggccgcggccgggcctgatgctttgacagctggaaagagcgcggagccagcgcctgctcgggagggaggggagcgctgctaggagagcgccagccagcgagagagggagggagcgcctgggagggggccgggggcgaggggcagctcgggagagcgggagcggtggcggctgtggggaggctgggcgccctcttccctgcaaaccatgtttgccaaaggcaaaggctccttggtgccctcggacgggcaggctggggaaaagttagctttatacgtctacgaatatttactgcaggtaggagcacagaaatctgcacagaccttcttatcggagattcgctgggaaaaaaacatcgcgttgggagaaccgcctgggtttttgcactcgtggtggtgtgtattttgggacctttactgtgcagctactaaaaggagagacacttgtgaacattcaagtgaagcaaaagcctttcctgattctagtgcagcagctgccctgagccccgtgcttggcaacattccccccaacaataggatgcggggaggccgagtcccgccagggtcctccggggtcacagccctcgccgcacgcacagcctccacctcacaatcctagcagcatgatgggaccccacagtcagcctttcatgtcaccgcgatacgcaggcggccccaggccccccgatcagaatgggaaaccagcctccgggaggagttcctgggacacagccattgctgcccaattccatggatcccgcacgacaacaaggccatccccacatgggaggatcaatgcagagaatgaaccctccccgaggcatggggcccacgggtcccagcccacagaattacggcagcggcatgagaccaccacgcaattccctcggccccccatgcccgggattaacatgggcccgggagccggcagaccctggcccaatcctaacagtgctaactcaattccatactcctcctcatcacctggtacctatgtgggaccccctggtggtggcggccctccaggaacacccactatgcccagtccctcagattcaacaaattccagcgacatctacacaatgattaatccggtgccgcctggaggcagccggtccaacttcccgatgggtcccggctcggacggtcggatgggcagcatgggcggcatggagccacaccacatgaacggattgttagggtcaggcgacatagatggcttccaaaaaattctcctaacaacgtaaatagtattagcaatcctccaggcacccctcgagatgacggagagttaggagggaacttcctccactcctttcagaatgacaattattctccaagcatgacgatgagtgtgtgatccccccttctccaagacgctgagagagcctgcattgcaggcgggaagatgccagaaattatgcaagaagtgaggtgtcattatccaggagctggtagggagggcatctcctgctcccctcaaaccctcccaccccattcactcccacctttcccaattttagtttcatgcaataaaaaggctgaactttttattccataaaataaaacaaaaagaaagaaagaaagaaaatgtggcacatatacaccatggaatactatgcagccataaaaaaggatgagtttgtgtcctttgcagggacatggatgaagctggaaaccatcattctgagcaaactatcataaggacagaaaaccaaacaccacatgttctcactcataggtgggaattgaacaatgagaacacttggacacagggcggggaacatcacacacaggggcctgtcctagcgtggaggctaggggagggatagcattaggagaaatacctaatgtaaatgacgagtaaatgggtgcagcaaaccaacatggcacatatatacctacgtaacaaacctgcacgttgtgcacatgtgccctagaacttaaagtataataataaaaaaattaagctgccagaatatgctagtgtgatttttctgaccaatgtggtacatttatttctattttatacaacagaacataacaatactattttgattgtagaaaatcttcactgttaccaccttgctgacatgacacatttttgaacaactaagatgtgcatgaggttaagacttattcagaatcacaactctcagtattaatgcctcatttcatcctggggtagaacatgggcattgactataatgtttccgtttttcttgctttgcttctgagtgctgagtgtcttctggatactcaaatgtcttttcatttaagttgaatagagaaagattgaggggttctagaattaaaaacttaaactacatagaaatatcaaggatactttaattatatggtcacctggaggctgggaaaaagtgtaggatgatgcagacacctctccgtcttaacaataatcctacctcatttcatttgtgggtcaacagcggattgactgacctgagatcattttccctcaactgcaaaaatatacagtttataaaaaccaggtcttcagaaaatagagcttaatatcaataaggctgtaaagaaaaaattcctagaaaacatcagagcccaacaatgtgctgggattgtatgtcacaaggctagtaccagttgcggtcattaatgttggggtacctggaaaggacaatacttggggggatgggggccttataaagcttagtaggtttgcttgtcttagaaaatgttgtttttggttgttgttgttttggtttggtttggtttatttggttttttttttttttttttttttgagaaggagtctcgctcttttcccccaggctggagtgcaatggtgtgatctcggctcactgcaacctctgcctcccaggttcaagcaattctcctgcctcagccttctgagtagctgggattataggtgcctgccaccacgcctggctaatctttgtacttttagtagacacggggtttcaccatgttggccaggctagtctcaaactactgaccacaggtgatccacccgtctcagcctcccaaagtgctgggatttcaggcatgagaaaatgttggtaacatgcatgcaagaaattttaatattctatagatggcttgcctctgctgttcttacttacacctgtgttccactgttttatcttctcattccaattttacttgtgaaaatagcaataattatattcattctaaattctcaggctattatgagggtaaacaaaaatattcacaactgcatttaagatctttgataaaacaaaatgagccaaaaacctaaggcattcctattttgaaacaaaacaacaagggagcatcatacatctgtgtaggtaatagttggttttaaaatgtcatttctggccaggtgtggtggctcaaacctataatcccagcactttgagaggccaaggaaggaggatcgcttgagtccaggagtttgagaccagcctgggcaacataataagaccctgtctctacaaaaaaagtttttaaaacttagctgggcatggtggcatgcacctgtagtcctactcaggaggctgaggcaggaggattgcttgagccttggagttgaaggctgcagtgagctgtgattctgccaccctactctagcctgggtgaaagagcaagaccctgtctcaaaataaatgaatgaatgaatgaatgaattaattaattaataaaacaaataaaaataaattattatttataatacagccaaagagaccatctgctagctcattcagccagttcctaggttcagacaggagattatgtaaacacgcacatgcaccgattgggcaaagcctttctcaggactttcactcaattcagggttgctgctgttgtttgttctcagtatgtttttaaacagtaaataagttaccatggataaaaaacactatataaaccaaaatacatgtctgaaattaatccaaatgttcttcagtatactcaagaagatgttttgacccatgggtctcaaattctaaactcgaattgcttcagaagaagcataaagtcattgaaaatttcagaaagcaatatgtatatgtctatgtgtgtacatgcatagacacatacacaatttcttctaaagattactatcaattttggggtttcaaacttattgaatcaacatgattatatcattaatagtttcattatttatgtatttatggaatgaaatactaagaagcatatgtatttcccctcccctgaccctccaattttcttattcaacaagttggcaagcctagtggtttatgaggaaatctgttagagagtaagtagtggacacactgtcttatgataacatttgttatctctttctctagtctaaattatataattcacttgattgttttagttatcaagttgtatttgttcatctatctgtctccccactggacagtgagtccaggagagcagggattatgatttttatctctgtgtccaatcacttttctgccccgaggagccagctgccttattcagtaaatggatgctcttccacatggtaatcttaattggtcaatttctgttctatataaggttttgggaaacaaagatggacaaataatgagacagagtggatgaaaggaagatgaggttatagggagaatgtgagaaaggaaggaagggggtatcttcacagagcaggaagcaaaattggaagtcaaagtgtgcagttgcagtggtggaaagtgttgaccaacctcggtttggtgaaggtggcgtcaaatcaatttaaacttttcacggggaagcagggtatttctgagcctaatggttatggagaattggcctctgtatttccctccagactttcacggactactcagcctagagcaaacatgatccagatgccgaatggactgccaatgtgaaaattatttgatttgattaagaaacaatttaatcttactctggtttgtatttaaagcctgctaatatcaaagcacacagaattttcatttttatatcagcaacttagatgccatttagaagctgtgccatcctgaaattaaaagcacaagttgtagagtcagctttccccattcccttagaagagatcagcttttttggtgttaacaatgtgttctatagcaggaaggcaagactactgtccaacgtctgacctcctttcatatctcctggaggactgtgatgagggccactgctgctggctgtgggggtctccattcccctgcctgtcacctctgcaccctcagtgcacacacaacctttccttttttacatggcagactagctgtgtcttctggtggccacgtagattcagaagtgtgggttttagtaggtacagatctactaggaacttccattcaattaaagtttctaagaactgaaagacaacaggaggtgaggaaggcaggagaaagaggaagcatggggtattagaagataagtgatcctcatttcaaatgaagactgcttaatgaaaaatctctttaaggcactatttcccaaacttgcctgttcaccaatgtgaattacacaaggcccctgggaaaaatccagactcctgggtgccattttagaaccactaaatacatctgcagaggtaagagcctggataatctgtattttcagtatgccctggaaattccagcagtcaggcaaattagggaatccctaatttaaagaagtccactccatcaacttaagtcattaagatttgaatagatcaggattagctctcaaaaacgcattgcttcttgagtaaacatttcaacagcattgaattttaaaagaattaaatcccctgagggtggagccaagatggccgaatatgaagagctccggtctacagctcccagcgtgagcgatgcagaagatgggtgatttctgcatttccatctgaggtaccgggttcatctcactagggagtgccagacagtgggtgcaggacagtgggtgcagcacactgtgcatgacccaaagcagggcgagggattgcctcactcaagaagcgcaaggggtcagggagttccctttcctagtcaaagaaaggggtgacagacagcacctggaaaattgggtcactcccaccctaatactgcgcttttccaacaggctcaaaaattgcacaccaggagattatatcccgcacatggcttggagggtcctacgcccacagagtctggctgattgctagcacagtagtctgagatcaaactgcaaggcagcagcgaggctgggggagaggcgcctgccattgcccaggcttgattaggtaaacaaagtggcagggaagctcaaacggggtggagcccaccacagctcaaggaggcctgcctgcctctgtaggctccacctctgggggcggggtacagacaaacaaaaagacagcagtaacctctgaagacttaaatgtccctgtctgacagctttgaagagagtagtggttctcccagcacacagctggagatctgagaacaggcagactgcctcctcaagtgggtccttgacccccaagcagcctaactgggaggcaccccccagtaggggcagactgacacctcacacggccgggtacttctctgagataagacttccagagggacaatcaggcagcagcatttgcggttcaccaagatccgctgttctacagccactgctcttctacagccaccactgttctgcagtcactgctgctgatacccaggcaaacagggtctggagtggacttctagcaaactccaacagacctgcagctgagggtcctgtctgttagaaggaaaactaacaaacagaaaggacatccacaccaaaaacccttctgtacatcaccatcatcaaggaccaaaagtagataaaaccacaaagacagggaaaaaacagcagaaaaactggaaactctaaaaagcagagcacctctcctcctccaaaggaatgcagctcctcaccagcaacggaacaaagctggatggagaatgactttgacaagctgagagaagaaggcttcagacaatcaaactactccaagctacaggaggaaattcaaaccaatggcaaagaagttaaaaactgtgaaaaaaaattagacaaatcgataactagaataaccaatgcagagaagtccttaaaggagctgatggagctgaaagtcaaggctcgagaactacgtgaagaatgcagaagcctcaggagccgatgcgatcagctggaataaagggtatcagtgatggaagacaaaatgaatgaaatgaagcgagaagggaagtttagagaaaaaagaataaaaaaacaaacaaaacctctaagaaatattggactatgtgaaaagaccaaatctacatctgattggtgtacctgaaagtgacggggagaatggaaccaagttggaaaacactctgcaggatattatccaggagaacttccccaatctagcaaggcaggccaacattcagattcaggaaatacagagaatgccacaaagatactcctcgagcagagcaactcccagacacataattgtcagattcaccaaagttgaaatggaggaaaaaatgttaagggcacccagagagaaaggttgggttacccacaaagggaagcccatcagactaacagtgggtctctcggcagaaactctacaagccagaagagagtggaggccaatattcaacattcttaaagaaaagaattttcgacccagaatttcatatccagccaaactaagcttcataagtgaaggagaaataaaatcctttaaagacaagcaaatgctgagagattttgtcactatcaggcttgccctaaaagagctcctgaaggaagcactaaacatggaaaggaagaactggtaccagccactgcaaaaacattccaaaatgtaaagaccatcaaggctgggaagaaactgcatcaactaacgagcaaaataaccagctaacatcataatgacaggaccaaatacacatataacaatattaactttaaatgtaaatgggctaaatgctccaattaaaagacacagactggcaaattggataaagagtcaagacccatcagtgtgctgtattcaggaaacccatctcacatgcagagacacacataggctcaaaataaagggatggaggaagatctaccaagcaaatggaaaacaaaaatgggcaggagttgcaatcctagtctttgataaaacagactttaaaccaacaaagatcaaaagagacaaagaaggccattacataatggtaaagggatcaattcaacaagaagagctaactatcctaaatatatctgcactcaatacaggagcacccagattcataaagcaagtccttagtgatctacaaagagatgtagaatcccacacaataataatgggagactttaacaccccactgtcaacattagacagatcaatgagacagaaagttaagaaggatacccaggaattgaactcagctctgcaccaagcggatctaatagacatctacagaactctataccccaaatcaacagaatatacatttttttcagcaccacaccacacctattccaaaattgaccacatagttagaagtaaagcactcctcagcaaatgtagaagaacagaaattataacaaactgtctctcagaccacagtgcaatcaaactagaactcagcattaagaaactcactcaaaaccactcaactacatggaaactgaacaacctgctcctgaatgactactgagtacataacgaaatgaaggcagaaataaagatgttcttgaaaccaaggagaacaaagacacaacataccagaatctctgggacacattcaaagcagtgtgtagagggaaatttatagcactaaatgcccacgagagaaagcaggaaagatccagaattgacaccctaaagtcacaattaaaagaactagataagcaagagcaaacacattcaaaagctagcagaaggcaagaaataactaaaatcagagcagaactgaaggaaatagagacacaaaaaacccttcaaaaaattaatgaatccaggagctggtttttctaaaagatcaacaaaattgacagaccgctagcaagactaataaagaagaaaagagacaagaatcaaatagacacaatagtcattgatattttgataaggattgcattgaatctgtagattgctttgggtggtagtatctacattttatcaatattgattcttccaatccatgaacctgaaatacttttccagtttttggtgtcctattcaatttctttcatcagtgtattatagtttttattatagaaatctttcacttctttggtcaagttaattcctaggtatttaactctatgtgtggctattttaaagggtgttactttaaaaaaaattctttttaatgtccttgattcttgttcactgaaaagactcaaattttgcttattgaattaaaattaattcttgtaagaacagtaacagaactattactacaatagaatggaagcctgattcttgaagtttgtatgactgtgatgagagttcgcaggtagcaactgctaaatgaggacacaaagcgttccctaaatcctctgtattaactgccaatgagagcttcatttctcccatctttatagcagaccctctatttttataataatgacaagactgaagggacaagatgaaatggtgcaaatggatcctggataagcgccagttcttctaaaaggttttttatttttgctaatgtgaaagattaaatttagaaaaatatgaagtcaaaatgaataaataaaaaacataatttcaaaaatttcattgaaagcccatcaattaagaacaatataattagtttaaaatctaagagcttatcttgtttcttcccattgcataaacttattttctctacttgacagcataagactgagaaggtaaagagttgaataactgctaaccatcatcaaaactcaagcagagggattgttttttaaccattttaggaaaccttgttcttgacacatttatgtgatcactgaaagatacagctgaaaggtgatctaagcatttcaaattataacaaaactatacatttctcttggaaactgacagtgttccattgattttccattacacaggcaagtattctgtgtcttaatttgtttttaaacatgagatactattcaaattatatgaacagttacttgtagcccagaggcaagagagaaactgcaaactctaagtaaggaaattcagcagatgagaaaaacagaaagagaaattctttggtttaaataaactccttgcgggccaggtgtggtggctcacgcctgtaatcccagcactttgagaggctgaggtgggaggatcacaaggtcaggagtttgagaccagcttggccaacaaagtgaaacccagtatctactaaaaatacaaaaattagccaggcatggtggcacatgcctgtaattccagctacttgggaggctgaggcaggagaatcgctcaaacccaggaggtggaggttgcagtgagccaagattatgccactgcactccagcttgggcaacagagtgagacttcatctcaaaaaaattaaataaataaaataaaaaataaaaaaatgaactcctcatgtgtgacttctgtagtcagacactaacactgtatttttattagaagcaggaattggggtgggggcattaaatttatatgatgtttttgaaacaattcagaggcctttaatgtggtctcttacaatcaacaagttagccacatgacctcattttggaaatatccacaggagatttggcctgtaattccttgggctcactgaaggtaatcaaatcttttccagtcataagaatctttgatctttaattattttactaagtcttgctcttcaaaaataactgtattatttagtcccattaacccaccaagacctgctttacatatatatgtaaaagaaattatatatatatatatatatatatatatatatatatatatatatatatatatatgtatgtatatgtatatttgtcaaagaaaagagtaaggtcccttaaactaaggggcagtctctgtggaatatttggtgtcccaaggtgaaagagacactgtaacgttttatagaaaatttgtagagtgctgagtaaaagcaaataaatgaattctacaaattagctctaagttgagaacaattaaacacaaataagtacattctaatttaagcaaaaaccattatacccaatgtacagattaacaaaaattcacaaaatgttaaaatttttgctagttcactagtaactcccataagatgtaaagattagtctacatgtttttaatgttttagcaaaggatcatttctataactccataaggcagcatggtatagtagtatggccgtcaaacttcggcatatagcagggttgcctaggaagttgctcaaacaaacatatgtcctgaccctggagattctcattcagcagttattggtcaaagcttgggcatttagctttactttgaacacactctctggtaattctgatacactctgtagttgagaaccatcggtgtattggaaagaactcaggccctttggagtcatgaaagactggatttgaattctgattctgccatttatttgctatgtgactggggcaagttatttacctctctgcaccatcatgtctaaaatgccaatcatgtgactaacttatcacgtgatcgcagagaagtaggattaagcacatattatgctgttcttatagacaattttgcatttaacaaaattttacttcactttgcgtaataatctataataaatgctaaatgcagcacaatgtttgattcaccatcttgttatgctttcttcccacaccaaaggtcaatttcacagagttctttaataattctttcttgcagctgggcaggaatggaaccagggtggctaggaagttgaacaaccttaagattatttctgctctccaacagaattggtggtgtctctacattattcatgctagatgatggaagaagtgttgatactaagaagtgacaagcaatagtttccccttcttcatgatattgtcatggaggaagaaatttcctaggagaggcaataaactacagtagagaaagtatgggctttagagattagagaccggcattccaattttgtatataactgggcataaattacataaccttggatagaggacagctttcatgaactaatatctcatctgtgatataggaatgggcacactacagagatttctgaggattagagtaatgaagtcagatgtttgtcttagtgcctaccacattgtaggtccctaataacaggaaaatcccctttctactttcacagcagtactccatttccaaaagctgctgatcagaaagctgtgtcgtgtgtgtgtgtgtgtgtgtgtgtgtgtgtgtgtgtgtatgtgtgtgttgggccatgccaagttttccaattctatcctgtgatccagagtgtatgccaaaatcatgttgaacctcgtggcttttgaataaaataactatgggaaatttgaagcttttaagaaaaagatggtgtgattggaagagatttttaagaaaaggaaagaagctggacatgtaaaaccatgctggtgattgaattaattagtgaatgatagtgtgaaagaaggtaagaaagaaattgagaaaataaattgcttctatttctggaactgttagtgtatccccaggactacatttctttctttcctccttcttccttcctttctccttccttccttcctccctcccccccttccttccttcccctgtaactggcccacaggggagaggttgaacatgcttcagctgatctgacttgagtaacaggaaaactgaaaactagttacactagaggcctcttgctttttgtgggataatttctcaggaaaaattaaaaaaaaaagtaatgaacacaattggctttggaagtttcaatgcaaatatttataattttggaagtttccaaatgcctttccaaatgttcccaattgcctttgccttatatagagatttaacagaatcattaatgtcaatcagaaactcatttttgaaagttgagaaaaagcagctttcacacagggaagcctggggcaagcataaacacattacttttctttcctacaaaagagtctaaaaattatcaaggaactcgtaaaataaaattagcacttctattgtgtgcttctttaataatcaacaatgttgctcgcagtcccagcgctccgaacgacggtgcctccggttgacagcaacctgagcggacccgcgcctaggccctccgccaggcctgcgctgcctcgccccgggagaggaagactgagcccggctcaggcggctggagcgcgcgggcccgtttcctttcagcgatcagtcccctggcgtcccagcagcgccttccccgcgatcgcgcgtccccagcgcacgtcgcggctgccagctgctgccctgaccgccggcccagacgtgcccgcggacgccgctgacagcgcctgtgccatggggctgcctactctggagttcagcgattcctacttggacagcccggatttcagggagcgcttgcagtgtcaggagattgaactggagcgaaccaacaagttcatcaaggagctcattaaggagggctctccgctcactggggcgttgaggacaggtaatgttgattgcctacccagttcccttaccctttcaccctttccaaaggaacacacctctacccaggttggggatctgtctatggcagtgcagaaattttcccagtcattacaagatttccaatttgaatgtattgataatgctcaaacagatgatgaaattagtattactcagtcactaaaagaatttgcaaggctactcattgcagtagaagaagaaaggcgaagactgatccaaaacgctaatgatgtattaattgcaccacttgagaaatttcgaaaagaacagattggtgcagcaaaaggtggaaagaagtttgacaaagagtgaaaaatattactctatccttgaaaagcatttaaatttatctgcaaagaaaaaggagtctcatttgcaagaggcagatacacaaattgatcgagcacatcagaacttctatgaagcatcattagaatgtctttaaatggctcacgcctgtaatcccagcactctgggaggccgaggcgggtggatcacctgaggtcaggagttcgagaccagcctgaccaacatggagaaatcccgtctctactaaaaatacaaaattagccaggtgtggtggcacatgcctgtaaagccagctactcgggaggctgaggcaggagaatcgcttggacccaggaggcagaggttgcagtgagccaaggctatgccattgcactccagcctgggcaacaagagcaaaactccgtctcaaaataaatgaataaacaaataaataaaaataaataaaagaaaaaagaatgtctttaaaattcaagcggttcaagaaaaaaagtttgaatttgttgaaccgcttttgtcatttcttcagggtttatttacttttttaccatgagggatatgaacttgcccaggatttgcaccgcataagcaacagctgcagttcgacttgcagaatacaaggaataattttgaaagtactcgacaagacgtagaggggttgatgcagaggatgaaatctgccaaccaggactacagaccacccagccagtggacgatggaaggctatccgtatgtccaggagaaacgaccgcttggttttatgtggattaaacagccttgttactagctcaccggaaatgttcaaaatcttgtatccgacgaaagacagattcaattgacaaccacttctgcttcgacatacaagtagttgaaaggcatgggatcatcacattacaggccttctcagacgctaataggaaactctggcttgaagccatggatgggaaggaaacgatttatactctgcctgacattataagcaagaaagaagaaaggtatttgaatgaagcagggttcaattttgtgagaaactgcattcaagctgtggaaacaagcagtatcaccgttttaggcctctactgaataggaggagtgaactccaaagttcaaaaacttgtgaatatcatattttctcctaaatcccctcctgatattgatattgaactgtgggacaataagacaatgagtgggctgaaaaactacctcaggtgctttgcagcaccactgatgacttacaagttacacaaagatttgtatcattgctgttaaatctgatgaccaaaactacagggtggaggctgtacatgcattggtgtgcaaattgccagagaaaaacagagagatgctggacatcttaataaaacatctggtcaaagtatcactgcacagccaacaaaatctcatgactgtctcaaatcttggtgtcatatttggcccaactctaatgagagcacaagaataaactgtagctgctatggtgaatattaaatttcagaatattgtgttagaaattcttacagagcacgatgaaacgatttttcatactgctccagacccaagcactcctcttcctcagcctcagtctcgatctggatcccaaaagacacaagcaatctgcctctctacaggctctaggaagtccagagggacgggtactccatgcctggctgaacctgatagtgactcctacagcagcagcccagacagcacccccatggggagcaacaagtcactctcttctctttcctcagaacaaaatagcactacaaagtcagcttcctgccagcccagggagaaatctggagggattccttggattgcaaccccgtcatcttcccatggacagaaaagccttggtctctggacaaccagtcctgaatcaatttctagagaagatgcaacaaagacagatgcagaatcagattgccagagtgttgtttcggtcactagcccaggggatgtttccccacccatagacctagtcaagaaagggccttatggactttcaggactgaaaagagcttctgcttcttctctcagatccatctctgcagctgaaggaaacaccagctacagtggatatattcaaagcttagcttctgtaggttccaaggagacacccaaagcttcaaacccagacctgcctccaaaaatgtgcaggaggttaagactagacaccgcctcaagcaatggctatcagcgtcctggctcagtagtggcagcaaaagctcaactgtttgaaaatgttggttcacctaagccagtttcttctgggcaccaagccaaagccatgtactcctgtaaagcagagcacagcatgagttttccttcccacaaggagtgatattttccagcgtggcccatcagtggaaccaggatggttaaaggcaacttatgaaggcaaaacgggactagttccagaaaattatgttgtcttcctctactactatttagtggatggcagtatcttcatggtatccatggtaacaaataataagtgctatgattttatctgacacagatacaaggggatcagcccactaactgaaaacagtcaatttctatcaagttcttcaccagcagactatgtagctccttattaatggaaaaaaaaggtttaaaaggttggccattcttttttggttggtttattttaaaatttcttgtttctgaaaaatttatttttggataatacgtaactctccagaatgtctcttccatagcaattgtagagtttcaaataccgtattaagtactatctcccagaaatttggaaaccagaaatctgctgtatggattttgagatgcgtcctttactgcctggcattctctgaggatctgtgaaactgttacttaaaaatgttactgaaaagctagttacctgccctttgagtgccacagtcctgacctgcttgttcttgacaccttacatattacttcagagttccccactgtgcagactctcaggtattaactgtataaaactctttacatgctattataatctgtaatctcgatctcttctactatttctcttctactatcttttctactgtttctagaataggttaaatacacatatacaccacaactatgcctcagaaaagttatgcttttacaaataaaaagaatagattagaattaacaagtagggtgaataacagtaggcagagtcagaatcagaaataaatatcaggggatcaaaataagagaatgaaaaatattctgtaataaaaattagcaatgtaatgtaaaagtctgataaaagattatctttttcttttacctctttctgttgacctctgtacactgtaataaggtgttgctggatggaacttcttggtctaggtccttggagatcttagtagtaataacagcattcctgacactctaattaccctcggctgaaacagaaggtagtctttcaatgtaccaatcccttagtctatacttggtttaaacacacttgccatcatctggtatcctgctagattagaacctcttaaaagcaaattggttttctttcaaagaccaacttgactccaaagagagatacagaatcctacttctgctgctgcataaagaaatctcaaccttcattttacttgaacacagaccaaagtgttcctgcttctgagttgtctgtgagctagttctatggatgttccattcagatttaaagcttttttattgcacaggacgtggatatgaagcctaactcttgtatctgatggcaaggcatatgttgtagccacagtgctggcgatggtccctttgctgaaagaagctacagaagcactgattcaagctgtgtttgtgctaggagttttaatcttgtagatttgtgaggatggctctttttccttcataatagattacatgtataagcaagtcagggccatgtactggagacaggctaaagctgcttttcccttaaagaaagtttcctacagacaaggtatttatgagcattgagaaagtcgggacacgtactctaaatcacacagaatgttaattccacaggaaggcaatgccagacattggaagaggatcacattcgacttctaatagtagttcaataacaaaaccttagcttttcagaaacaatgttgatacattagaattgccacatccataccttcaaaacatgcaatgtgtgcaccccaatcactgcttacagtataatcagtatgacgatgagattgagggggtctaaatttatcatctcctgtgttatgtgaaaatatccctcagtacaaaacatttgtgtatttcacagatgactcttgttttgccataacgctacaaagtttatggaaactagtcaactgaaggatttttctgttgtgtgatatgtaaaggtctgaatagtacaatcatctttgtattcctgcagtgttaaaaagtaataatcaacatgtcagattgttgggcttttcttagcagatgttttctaattcaaagtttttggttgtgtttttgttttttagttcaaagttaatttgttggcctcttgaagattaatttgtctaagctttctaggaacttccaaacagtgatattctcaaaaggattcaataaactagttcaaaaaatgttcctatcttctattgccttaaatctaatcatgttctgtgaactgcagtcctagtgtgtaacacggcgtgatttatcacccagagttctccactgtatttcaaagttgatttacctcaggaaaactgagggtttattgagtaactcaaatttttccagagaaactggtttgaagtatccagtgcaacctgccaagctctgtctttgtttataaacccacttactggtgacatcattcagggagtccctctctaaaaatcttgaattttgtctggtcttctcggatgaggaattctgaacctggtacaatctcattctaactcttctcttatgtactaagtacttatattatatacctttctataacttaagaggaaaaggctgacatttttggtattctttcagtgacatatttttcagtgtctaagctcacaatcattcttaattaactacatgatttttaatataattcctactactttgggttttatttcccaggtatggacattgtccttttaatgttttcttaaggaactattcagagtacattattaacaacttaaggtcctaaacagatatacatgggacatggttgttgtaaaaagaaacaaatctgtaagacactaggaaattcaaaatgctttcaagctttctttgaactttactactgaatgatttatttgcaacttgttatctggtatagtggggaagagccacttatgtctctttaagccaagatatatttaagataacaataaagataaaatatcagtttcactatctagatttgattttgacacaatgaaaagctgattggttcataatcaaatgaacaaattttccacaagtaagagatgaaacccctggcttggaaatcctggggattgacaggttgaacgtccttggtctgtggtgagcatgttcacgtttcaacacatgagatctggtgtgctttccgtagcagctcctcagattttgagaaaaactagaagataattttttaaaaagcaatgttgaatacttagaatcgtatttctaataaaaataagtcaaactatttaattttgataaagtttcaaaactaaacatgaactgaacttatacttgatgacataattttataaattcatgatgaatttcttattctgatttatttactattttaaaagataggtgtttcttttcttccactgtaaaagtgtaatgtgttcattgtatttggaaaacgtggaaagtagaagatgactgttcttatttattcacttttacagagggtaattttttccacaccatagaagtagaataatcatacttctaatttgaaaatttgaaaatgtaaaaaaaaaaattaatccaagatcatatcaacatttagggctaagagttgagattatactgaatatggttttgcattgaatatattacaagcctttttgtgtcatttactatttgataaaacatgatttttaatgcctgaatacttttctaacacttgtatgtattgttgtttatttaatcactcctctattgtggaacattcaaattggatccaagtttaccataagtaatactacaataaaaatatctatacattatttgtgatgtctctggttgttttcttagagtgccaccttaattatctttgtgagaaagtcctcaagaatcctgccattaattcagatactttccccgctattgatatgtctctttaagagttctgaaaatacttaagaaacttagtaagaagaaagaaaattaatcctctcttctgattcttcagttccaattctctgtggccactgtatttttaaaaatcctgttgtccaaagcatctcccatttaattgtttctctctgacagcagggaaactggaagttagaggtgataccataaaaggaaatgaatgaagcagatgtatgaattttgatacatataacagatgtcttttgatcacacttcctgggcaatatagtagtaatcaaaggaaaactggtaacatttttcattactatgctttaaagaaaaatttctaagcctcacagagctgacatggtttattaccttcagaaacacggtagtacttagcgtaagttagaatccattcattattatgtgtgactggagaggtatattgcttaaaaactataccaggccctacttaggaacaagttccaactgcatttaaatcactctgtttatgtcaaaatacttaaagttaaatagcagaatctagaggggtccttgattaacatgagacaataaatatttgcagaatctgatgcctaccagaggaaacactaacccagacaggaaagttcttcagagtaaaaatcaagaagggtgagattatctatgcaatagaagtaagtcttggcctggacccagacaagatcattgcacaagagattggttttggaagtagatttggctgagattaaagtctcgagtgacatgaagacaatgttaaagataaatccaaactcttctttattgcttgacacttctccaatcagcatcaacttcattcctggtaagttggtgtagtatggtgagttctgccttatttcatactttatttggttagaatctgggggagggggtaaaggtgtaggttggttatttcaaatgtgcagacgacctccaccaattttgcagtatagtgctattacttaagggaatacacccataaaactttgatttcctagtaattctgcttttgtgcattcttaatttgagactcagtgagggtgcaagagctgtagatttggcaaacactgcactattttctcacattttttcgatttgctaaaaccagtaacaaatgtattacccctttttttcctttaatttttaaatccacggccttttcactgcctttactttccatgtgttgccactgtatcctccactgaatcccccacattgggcccagcacttgacacttagtaggcactcaaccaatacttgttgaatgaatgagtttaatgcactgcagtttttttagtttttagatgatgttgtacctaatgcacatgccttccttctttcactccttcattaatccttttgttcatgtcttttacttatgccaagctgtcacactgtgttcatgaactgacagatttattttttcttccacagccccagagccagcaaatgactgaccttaaacctaaaactgtaggagtttggtcagtgtggtgggaaaagttgtaagaaaaggttatagggaaagacacaaaccttcttggaagaacgggaggttttgcaaaagcttcaaaagagaatttagctgaaggcagttaaattctcttaagagcaagggttagataacaagggaatgtaaagaaacttatctagataaattgttctactcatatctctggaaaccaacctttgatcattcatgtgcaggactgctctctacttggggggttgacaatgttaattacccacaaattgtgtttgctccaagcccttgtcattaaatctgtactaaataaatgcaagtggggccagcttagggaagctgcactcctttcggctgctgcactctctcatcggcagcactgagtggtgcagtcccctagccacactgtcaggaaaaatacctgtgtcagcgaactcctttcattcatcacttggccagtctgcgggacagatcggcataaaacacccattggttttcgcctttactcttgcagaatgagttataaagccaaagacctcaagaaaagcacactccttaacagccagttcaggggtgacagccagggaataagaaaaaagaaccttccagaggatggagccaccaccaaaaatgatggaaaagagggttcctcccagagagcagattcagaggctatttaaggaatttccccatgccctgtgtagggagcttctcactacttgctactcatgatttccttatggttatactctagggactgctgcttgcctgtcttctctttcttgcatagcaggtttgtttaattttatttttttcttcaattatggtggtgttttcactgttctaccatgacaagaggtagaacagagatattttttacctctacatgggaggcagaaaattggcctttttattcaagaatgccaaaccagaagctgacatatcagaatctgatacagagtacagtctattcccctttggactttggaccttggaatttgaactggatgcaataatggtatgagacccttgggtaggaatgagtgtcttgtatgtgtgggaaagacaggaaggcaggtatttggtgacctaaaaagaaggccatggcagaacctcattagttgttcaataatcctattttcctttcctcctgggcacacagctatgtattttccagccatcctcatatatagatgtagcccagtaacacttctgaggatggaatatggacagatgtgatgggcactgctggacctggaccataaaatccttccacatgatgtcagtgccccttttaccccattggcagctggatattgtcatccagagagatggatgacttagaagccacgtgcagaagatggcaaccttccatcagcatggatccttgagtgactgtggagtgcaacgccttctaccagttagaactactgtgattgacaatcacatttcatttgtattaagctactgatttggggggtttatctccttcagctcccacattagtacaactcatgcagaatggagagtgactgtgaacacatgtggcacaggctgctgaaacctaggactttatagatgaattcctgattatactctcctttcttgcaaaaagcttttttcaaattaaatgttataatacaaatgtgagtacttaaatgtctttctaatgaaatgatgactaactgtaggaaagaaaatgtaggaatgtatacatccttgataagagtgtgaaactgatacaggcaatgtagagagtcttgcttagggataatgaacaaaagaacatacctgggtaaaagaaatgagaggttactgataacaaaactaatatttatattgcacaatataaaacattattttatacttaggattacatttgatttttgcaaatccctgtgaaatagctattattatcagatccactttatgcataataaaaacaagactcatatgggttagctaactaggctatggtctctccaccaagctctacttctctgattgaggagatagtagtatctagagcttcagtgttctttctactgccctatgctaccgcccagtgcagatgtaagaacaaaacctactagtaaactgctattgactgtttagacctttagcaactttaattatccaaaacatagctgtgagaccaaaaagaggaaaacagtttgcaaaagcccacatttattacaccatgaaagagccaggtctgtgaaatgttgcctagaatttgtgtactaaactcagcaaaatgaattaacaaactcagtgacctcattttctcctaaattacagtaaatggaagatttaaaagatgagaaaaataaacacagaaaacttcagttaacagggtagaggatgacgcattgaaagattgggtgtccatgtgtggtatgtaaaggcaggtcctatgagtcttaggcaggcctaggcacgtgttctctctttttgttgtttgattctcaatttacgacaaatgaagaacgaggcctttacctggtctggatcgacttgttatggagcccatgtgaaatgaaaatgattcataaacaaaactgattccatccccagcaacagcagagatgaccatgaacaattagccacctgagaatcctcaacaattcttggggaattcattaattacattttattaaagggcagggatatccaaggtgacatatgggttacaaaggcaaagtataatttctttatgggttttgttaatgtgaaatataaattaataagctttttgattttactaatacaaacatacccatcaattggtcttcttcaattcagaaataactagagtttgagggtatcttaaatccaaaaaataaaaacaaaaacctaaccagcagccatttgctgaattcctgagtgcttgggactctccatttctagtctagcaaacatcttccagttgcaattttaaaccttttttcccagatctttcaagaaacctctaatagtatcaagttcagcacacaaagctagctttctgtaagcaatcagtctcatctacccacctttactttagacaggctcctaaagtcaacctgagaataaaaaggacttttcttttgttattaaaatctgttctctagccaggtgtggtggctcatacctgtaatcccagcactttgtgaggctgagaccagaaaattgcttaaaaccaggagttcgagactaaccaattgcttaaaaccaggagttcgagactagcctctacaatgtagtgagaccaccatgtctacaaaaaaaaaaaaaaaaaaaaaaaaaattagccaggcatggtgtcacacacctgtggtcccagctacttgggaggctgaggtgggaggatcacatgagcccaggaggttgaggctgcagtgaaccatggtcatgcactgccctccagctatggtgataagagcaagacagatgtttcaataatttaaaaaaaagtctgtcctctgcctcaaatggactttgctgtcatattaaaactattgaaatatgtataaaccaggtgtggtggctcacacttgtaatcctagcacttttaagaggctgaggcaggaggattgcttgagaccacaagttcgagaccagcataagcaagatagtgataccccatctctacaaaaaatatgaaaactagccagctgtggctgtgtgtgcctatattcccagcaactcaggaggctgagacaagagaatcccttgaacccaagaatttgaggttacagtgagctgattgcaaactgtactccaatctgggaaccagagtgagaacctgtctcaaaaaaaaaaaaaaaaaaaaaaaggaaacaaaagaagaagaaaatatgtataaatgaatgttttaaattggaacaattactatagcatgaaaatgcccatttgatgagacgtgaaaatttcttctaaagtatttatccatttctggttttgtagcaaaggcattattatacttctataacttgtcttacagagtcagatagaatcaagcaaagttggcagagcctaggcatctacctaaaagaaatgctctctcccatttccatgaatactttaactcctgagttccagtggcactatttctggagtcctttccaaggcacataatcctaaagcaggtgtcacttgttactctctttcaaagcgtcttgctctttttcttcacagtacttttcaaaatatttaatatacatttatttcctgtaaaagttgcctacctcactggactttaagatctatgaggttaatcccatgtctgttttattttctaccttattgcccctgctccccaggcacagagcaatatgtacctgatgtgtatttggctctcaatacacatttgtcatatttgtgtgtgtgcttgttcaacttctctcgctctgtgtgcaggtgtgtactttcttgtcatttcaggacacttaggaatttccttattttgccacaagttcagctgcgcattaaaactgtttcataaaaacatttttttttttccagaaagagtttcactctgttgcccaatctggagtgcagtggtgtgatctcggctcactgcagcctctgcctcctggattcaaaccattctcctgcctcagcctcccaagtagctgggattacaggcaactgccaccatgctcagctaatttttgtatttttagtatagacagggtttcaccatgttgtccagactgatatggaactacttgggaggctgaggtgggaggattcagctaccttggcctcccaaagtgctgggattacaggggtgagccactgcaccaggcttaacatgtttaggtgttttgtatcagaagacatttttctggtcctctatttcaggagttggcaaacttctgtaaagggccagataatattctcagctttgcgggccatgtgatttatgtcccaactactcaaataattcacatttcctatcctcatcagcatcacttgagttctaattttttattattatttaagtagtaggaaatcttccagctgtcaagatacaaaagaccttcaatgggagtgtcagactctaaaagataaagttcaaactgcctcccatatttgagtatgaatttaaagctaatatttgctgagcgcttactgtggttcaggcactattctaagtgcctttcctgtgttaacccctttacatctcacaacggtatgaaagacaatgaccattataatctccacttggaaactgaggctcagttacataaagttacaccacccactggtggataaaggacaccaactcaggtctctctgactccagaaaccatgctccactcagaatgctaaccccctaacacccagtcttctatctcttgatgagttctgaattatcacgcaggtattcgcccttctccagtagccaccttgcctcagaaacacataatctcaccccagcttcagagaaaagctgattgatctccatgcgctcttacactctagacagtgattggcttacatctgaggtttctcaacaaactagtacatggcataatctcaggccacaggggctggccagaaatggacaggtaaccttaactaggctgatgcgatgggagggaaatttgctgagggtttttagaaaacaagtttcatcaatcttgggagaaaatcttggagagggccagcctctcttcatccagtcattgccatgtatgtgtgtaaagcttgaagctacagcaaacatcttattcatcatgaagataaaaccagaacaaagtggcagagttgagactcacaaagaccaaggcagccagagctctagttgaatcacagctgctcaccactctagtgctggattttttccattgtacatcaatacaccacatttgtgttttaaaccagtttcaactgggttttcattcaatggagtgtaacctgactgcagttatttgaaatctttcaagatctggcctcagcatacgtttctagtccttgtttttacttgtctagggccaaataaattacccagagtttcccaaacacaccacaccgttcatggatttgcaagcgtgattctttctgccttcattgtcctttgctctcctctccctggagaattcatgttgggttgcaattatgttttaaatgtctgtctccaccacttgatttggctacatcatttttgtctttacactctttgcacttctcatgcacttaagacataataagcgctccaataagtgtctataagattaataaaaaagatgggcaacatggaaatctgaatcataatataaactttctctacaagatacttgccctggcgcactggctcatgcctgtaatcccagcactttgggaggccaaggctgttggatcatgaggtcaggagttcaagaccagcctggccaagatggtgaaaccctgtctctaccaaaaataaaaaaattagcgagatgtggtggtgggcacctataatcccagctacttggaaggctgaggcagaaaattgcttgaaccttggagacagaggttgcaatgagctgagactgcaccactgcactccagttaaaaaaaaaaaaaaccatttagatcaatgctgtctggttaaatattctgtgataatggaaatattctatacctgccctgtccaataaagtagccactaggcaagtgtgtctattgagcatttgaaatgtagctagtatgatgcaagaaatgaattttaaatttcgtttaattataactgattaaaagttaagtagctagcagctactatactgaataccacagatgtagacaacaaattttaataattttccacacatgggaatgagtcacctaaaatgattttagataccaagctaaataaaaacatctggagatggtactattttgactctaataatttttttgttgaaaacagtatctacatattatatatacacacatacatatacacacatatacatataaatatatacacatacatatacatataatctagaaatttctttcctttcaaagatacttcatacctataacttaaaaaatataattttatctttgtctttattttgaattttcagtcatttcaaagttaatatgagcaataatatcattaaaaagtgggcaaaggatatgaacagacacttcccagaagaagttggccaacaaacatatgaaagaaagctcaacattacttatcatcagataaatgcaaatcaaaaccacaatgagagaccatctcatgccagtcagaatggtgattatttaaaagagtcaggatacaatacatgctggcgaggctgtggagaaataggaatgcttttacactgttggtgaggatatacattagtttaatcattgtggaagacagcatggtgattccccaagtatctaaaaccagaaataccatttgaccctgcaatcccattactcggtatatacccaaaggaatataaatcattctacttattgcagcaaaatttacaatagcaaagactggaaccaacccaagtgcccatcaatgatagactggataaagaaaatgtattacatatacagcatggaatgctatgcagccatgaaaaatgaatgacagcatgtcctttgcagggacatggatgaaactggaagccatcatcctcagcaaactaacacaagaacagaaaaccagacactgcatgttctcattcagggggggttgaacattgagaacacatggacacagagaggggaacaacataaaccatggtctgttgggggatggggtgaggggagggaacttagaggacgggtcaataggtgcagcaaaccaccatggcacacgtatacctatacaacaaacctgcacattctgtacatgtatcctctttttagaagcagcaataaagaaaaataaatgaccgcttcgtttcaggaggtagagttttcctcttaaagtttttcagatttttatctcaaggctttggctttttatgcatctcactacgtgtaatttgcagttaatacttcaatgccttatgctcttcttctctccttaaaacagtacatctttttgcttaactaaagtggtgactctcttttttttttttttttttttggtcagttcctattgcatttttccgcatttcgcactcaggtattataacctgacactgagaatgttagtctcaaaaaaaaccggaaaaacgtttttccagtatagattaattctgtactcttggctttttctgatgtatccaaattgttctatgtaaccaggaaacttcacatgctcttactttttctaaaagccatccattccccctggtggaggtactacttgtgtgtgtgtgtgtgtgtgtgtgtgtgtgtgtattattattctataatatggtttacttataaccttagacacacactcttccggcatctaattgaattaaagtagtttttcatggggtttaatttccagcttactcaaaagggcatataccaagagaaatggtcatactacaaaaggttttttctctctctctctaagtattctacctaacaagcagatattttatgttttaagatagcttcttgtggtttgggctgtcttcattcgggttttgagcagctgaaaaaactaagtcatctctaatacaggtctaagtatttttttttgtcttgactatgtaacttttgaatttgtttttgaagtctttccattattactctggttaaataagtgaccattatctctcaagaatatgtaattccactttaattaaatatttttaggctttttgcatccaaacaaatgacaaacttccccagaatcaaattcaagtttaagtctttttcacctaaaattgactaagggattttctagttgggctcctgggaagtctcaaaagatttgtctcccattaggcttgtttgaccagctcccaaaatcttctctagtgtccgtgagctttctttcaaaacaatatgtagcatttcccttgctagtaaacccccaatcttctctttgtccttcacacatatagaagaccaccatggttttcagttttgttcagaactacaattctgtgattcccaaataaattgtatactttagagatccatctttattttgacttcaatagtggtgataaattcatacaatattcaagaatatgttttataacaatactgtcaatttagaaatgcattttactgtgatataaaatccttaactattctactccactgacattttgtatgattttcttactaatttacaagcacttaaaaattctttatttacataaggtttatattagatataattttgtgaggaaaataaaaggtcggttttctatttgcattgtgctaattcagactgcacttggtttttcatgcacaccggtataagctaaagtttagacaaattattgtaaaaactgatacacatatagaccattatagtgttatttttaaaagtacaagaaactactttaaaagatcacaaggagattacagcaaatgaatctttatattcattacctcaatgaaatataatttaacactagtttcaatgtctttttttccaaaagactaattttcaagtgaaagctttagatctttgaaataaaattaaagatagaaaagatacataattcatttcagcagttttctgagaaataccacatcttccaaaatatatgtgttcttataagaaatggactctctttaggcaattagaatatcagtcttctacaacaggccaattttcaaagcactaggcctaagttcactcaaccagtctcatgaagcaaaaactgaattaagatattccatttattttagtgcacatatttatcaagcaaagaaactatggaacaaagactctttcttgctgaagttgttgggatttccatggtgcttaatgcgtgtttttttaaattgtgagatcaaagtttgaacacaaatcttgagccattgtatatgttacctgggtaaaaacattaaacttgatcttttcaaatatctaatggaatcccaggcacagtgattaaaatatgaagttaaatatttaagagaaaattaatcactaataatgaaatgagttgattttctaagaaaagcaagtatgtaattaagcagacactctcaaaaccattacaacattcaaaagcaatcaacattacaagtcttaggttgtgttttaaattcctcataacctaaacatatacattcattaattattcacttgccatgatcaacaatgaaagatgagttagaaaaaccagaggctttaattcaaaaattacagtctttggtattgcagcaaggaaataacttgctggtgaaattaatgactccacctggctttatcttggcaatgttctgaaatacatgcaatgaacaacttgacattgtttgatgttcttaattctttacagccatctctatgggtggtcataatagataagatcaatcagaaatgatcatattatgaaacataaatcacttcacatgacttatctggaaaatgtgctggtacttacttgcaccatcatctcaagttccaagagccaaaaacatatacatgctcaaggaggagaatttcctttctgattttagaacagtctgaaagggggtgaaaaaatgaaaaagggggagcttacaaataacaaaaatgtatatcccaagtgaaaattagaatgtctatggaactagtagcagtaacaacagtagacgaaagataggctgtagatgtgaagaagatgtctacaagggaagcacaagactccaaatgctcttgctactaaaacgcagattcaagctttaccatctgtaatactctgctgccaagtacatctatggccactggtactgtctaaaatgaggatgtatattattaaatcatcaaaaaggactgcatagcagaaacttttctgatatcaagggatcgacttaactacaattatatacaggtgccaatttcctctggagtaaactaccacacggggcctcatgtaccagttagataatccaagtcagcctttattgcataacctatctaaaagattggactctacattctggctctgcagaactgagagaagaaatgtataaaaaggatagtgatattgcctttgtctatgggaattcttgagtctaataaaaaaatctgggaaaaacctaacttcatgattacacttgggcacataggtgattaatatgaatgaagtaacaaccataaatacaatcgtaaccacaagaacaacagtaattcaatttttctcacttcataggtgttcttatggtatcttgtaggtgctctccgcaagcctcaggtgttcttccataatctcagttgatgcaaaggcaaacaccacactctcctctgttcaatgtctgccatcactgtctttttggcctctgactcttccctatactactttctatgcacttgagatcttcactgacatagctgggctctgtatttattgataagagtatctcttttctcttagactaggcatgaccaaaaggttaatctggcttcaaagattaatgacaatgaccactcagtttttattcaagatcaattttatttgttgtaaaaacaaacaagcgttatgttccagacagatataagtgagtagacttatgccctggtgcctccttggctcttcacaggatgcaaaaacaaatcttgccagcaggaggtggcaggctgcagaggtggctggttgctctttgagccatcttggccttgcctggcatgcacaggtcccagcacagcaaaacattcagggagttagagtgttgcacaaaggattttaccaacctctcacattaagcagcattcaaggatttgctgaccaccacttatgcaaattttgtgttatgctatagcaatgaacttacttgttctatttctaaacaaaatattgggttcacacacaggcctggacaaagcttcccacttctgaactatttactgatcttcttattctcaaagaatgcaagatgaatgatgtgcaataccatggctatggcatgtgacttttctagacctggatggttagtgtcccaatatttaactgatttttgggggggtgaaaatatgccataagttcttccttctatcatccccatcactaccatacatgtaatggcataatcatgtcacagtgtgtcctcagaatcactattcctagctgagtatactaaggctttctatctaggtcagttcattgtgtctgtgtctcctctaaaccctccttcatcatgcctacctcgaagaattcagcaagtgatcattcacgcaagctaaaggattttagctttctctgccataaagattattgctaaaatacataccatacaacaaaccaacccacttccaacaaatcttactgacttctcacagaatacataatgacttttattgtgtctcttccttctgtgtttctctttcctaactgaactttgttctttatccatgccttcttccaatcctgacatattttaaaacctttagcatttctgcctataatatttgggttttcttcttttcctatctttatttgataagtcccgtcaaatattttccccataatcacaatgttttcttttcactttgctcaagaactgagttatgagctccaaatttggacaaactctacattggctaagttttagtcatttgcactgctaagaaagatgacaattcagcatgctgaagatgatatcctcccttataaaggggctaacacagagggcaatactgttcgtgcttctgagtcttgatcacaagaattgctttaggcaattacaatcatgtctcctctgacatatcatattagtcaagtgagacagagaaagaatatgtcctatgtcacacagctgggtggtgacagctgctttagcatcagcacactgcgttccctctgatttcttcattcatctctaagtagcagtaaagccggtcctgaatactgactttgacactcagctttctccacatccttcctgtcactgcctttgagactacttcagattcttcccttaacttctatttctccatttgtaaaattgggttgatgagggtatcttccttcggtagctgtgacaataaaaatgggatcatcatgcatcctccttagccccacgagtaagctcccagtaagtgaggctgtcatcattactggatatttaagattctttacctatttgaaaaaccctagtgacagagtctcagttgcttttctttttgcgtgaatgatcacttgctgaattcaccaagcaggcgctttaacatttaccttcctttattatgctggagcatttttaatgtaggaggcttctgtggcttctcactatgactgctttgtttgttcaaaacttatacaggttgagtatcctttatctgaaatgcttgggtcagaagtgtgttgggtttcaactgttttcagattttggaatatttgcttcaatgcaatgaggtatcttgggaatgggagccatgtctaaacacaaaattcacttatgcttcatacacacttagccacatacacataacctgaaggtaatcttatacaatattttaaataattttatgcatgaaacaaagttttgaatgtgttttgactgtgacccatcacatgaggtaagatgtgcggaattttccacttgtggcatcatgtcagcactcaaaacttttggattttggagaatttcagattttggattttcagagtaggtgtgttcaatctgtatatatgggtcagattcagttgtctcctttaatctttggctgaaggaagccctaaagactttggggcctcaatctcccatatgcagtgacattctcaaagccattgactcagcttctcacctgggtttccttccagtgagccacagatagaagtcatagatgatggcaggggcctgctggctgatggcattccagtactgggttctgaagttgctggtggtgaaatcagcatatggcctcgtcaaagctctctcaaatggaattggaatttcaaaggttgccaagacctggaaacctgggggaaaaaagagagtaagtgctagaggagaataggagaatataagcccatcatagtggaaggtatttataatgggtcacagcaataaagacgaaggatttgctgtgtagagtcaagaatcaatttctgagaacaacgtaaagatttttatgctaggcaagtggttatctgcaaaatgagacaatgtgaatgggttaagaattggaccctttatttgaaacatctactctaaaacaaattcttggggaaacatgtagtcaataaaagggggtactgttcagaaaaacataaatccacatttaattctaaggttatctagtctattctgaaagccccaagaaagaggctagaaactttatttccctggctggaccattactgtcagaaccatttagaaagtttcttaatattttatttgaatctttattaaaagtttaacttaaaaattctaaaggcaagattttcttgtgttagcttactttaaatatttctctgggaatatgtaagactcaactgtccactctggtatccagggttttatccatagtagtgtttttatattaatacttagattaagctgaactaagaactgtttacatacatttgtgaattcagcagttcttttgaaaagatactcatttgaattcaattttatttaaggtatgtaggtttttgcaaagcatatgcctaagctcattattcaattatgatgtcagttattatagtaatacgattattgccctacttaaaaaaattggcatttttttaaaatctaaaaatctatctgaaaaatataactcctcttcagagaagattctcaagaatcatctggtccatagggatttatactttaaaaagatggtggtaaataagaaagttatgtacaggttgatagcataagagattctgatctcaacactgatgttctgatctatatatccatatacttattcaacatttccacctggaggtgtaagagacattcacatttaacagctctaaaatgggcctcctgatacacccactgctaaccacccccctcccaatacatacacaaacttgctatttcaccagtcttctacctctaaccaaatgctaattcaatttgtttagtagttcagccaaaaactttggggttatccttgattcttctctttctttaacaacccacacacaattgaacaaaatctatcagctctgtttgaaaaatacccagaatcataattaccacctgctatctctctgatccaaaccactactgtagcctggaatgttgcaatactgtcctaagtggtctctgccactacccctgtaaccctagtcggacctccatgtagcagccagagggattcttgtaaaatgtaactcagagtgtattacaggaacgtccccattcagagcccttcagcggaatctcttctcatttagaggcaaagccatggtctgcaagggtttgcactctctgcatcctcactctctctgcccaccactctgacttcacctcttaccgctctccctctcggtgcttctgctgcagccacactggcctccttgctgtccttgaatatgattaaagaacttcagcacttgctatttcttcaacttggaatatttcatccacgtgtccctctgatttgccctctcacttctttcaggtctctactaagatgacaccttatcagagagactttctttggccatcacatattaaatagcagccttcccacaatactgtttacttctttaatctgttttatttttctgcaatcactcaaccatatctgatgtatatttctcctttctaagatttaagtatcataacaaaattttgtctgttttgtttgaacctatacagtaccttgaaaagtggctgaaggtaatcagtgcctaataaacattttttgactaaacgaatcaatagatatctcagcaacatacacttactttccttttcctaaatctgtatcaatccttcctttagtcatttcaaatatatttatttagcatttaacacttgccaggcactgtggtagatgctgaggtaaaaaaaaattacatatgatatattctttgtctttaaagaactggcagtctggtgggagatgtggacaattcatgattacaatattttgcctgagtattctgctagaggccagtacaatatgctctggaggaatacaaaagaagcatctagctctgtctgggtgccaggaaggggaggggtggggctaggtttggaaaggctttctaagaaagctgtccatatggtaatagcaagcatttactaaaatgttcactgttctaaccactgtactaagcactttgtctcactacgttctcccaagagctccctagaatagaataattattattctcactgacagataaaaaaattcatctacagggagaaactgagagactttttccaactgatacaataagagtggagtctactaaatggtgggacgcatatcagcatataacatctatgtgagcatggatttctgtttagtgatatatcctcagcaccaagaataatgtctatttaataaatacaggagtgagtgaatgagctatgatttgaatccaagtctattagatctcaaagcccaagacttttaaccattaagctaatgtctgtctgatgtgagggacaaggagaaactcatgcacatgtagaaaatgtaatttggcaattggaaactgcactctacatcctcataggtcaaagaagaaattcaaatgaaaaatgttgaaggattagagagtaatgataacataaacattatacaacaaaatgtgtgggatacagccaaagtggcacttgagggaaatatgaagccataaatgatgtattagacaagccaaatattcatgggctatatttctaagttaaagagaagaaaaacataatcaaagaaagcaggaggaaggggaaaaaagagataaggcaatacatctatgcaatagaaaagaaagcagcataataaagagtcaataggctgggcgcggtggctcatgcctataatcccagcacttttggaggccaaggtgggtggatcacctgaggtcgggagttcaagaccagcctgaccaacgtggagaaaccccatctctactaaaaatacaaaattagccaggtgtggtggcgcatgtctgtaatcccagctactctactcaggaggctgaggcaggagaactgcttcaacccaggaggccgaggtcgtggtgagccaagaaaatgccattgtactccagcctgggcaacaagagcgagactccatctcaaaaaaaaaaaaaaaaagaaagaaagaacaaagaaaaaagtcaataaagcctgaagaagttggttctttcaaaaaaagaaataaaataaaccctttggagactagctgagaagaaaagagaagacacacaaatattatgaattaaaaaagaagcataattacagatacagtttaggacaaaaatattaatataaaaaagaatgtaaatacattttagaacaaacaaaatcttagaaaaagagacaaatataatttactaaaactgattccaacagaaaatgaagcctgcaaaattctttaactattaaagacactgaagcaataaaaaatcttctcacaaaaaattataaatcaagataatttaaaggtgcttttcccaagttttcgaggaatacattactccactattacaaaagcactttcagataatagaaaaacaagggaactatatgattagcaaactgaattaaacaaaatataaaaaaagataacatggtatgaccaagttgggtttatcctaaaaatggcaggtgagtttaatatttgaagtcttccgcttaaaatgagcagcaagacaataatacctactattgccatttttattcaccattatagtagaagttcaacaagaaggctgggtgcagtggctcactcctgtaatcccagcactttgagaggcgaaggcaagcggatcatgagatcaggagatcgagaccatcctggctaacacggtgaaaccctgtctctactaaaaatacaaaatttagccaggcgtggtggtgggtgcctgtagtcccagctactcgggaggctgaggcaggagaatggcgtgaacccaggagacagagcttgcagtgagctgagatggtgctatcaacaagaaaaataaagacctaaagcttgaaaaaatggggataatactgctatttttgcagattatgattatgttaggaaattatgaggaaattttatacaattgctagcaataataagtttagcaagatagctgaatataaggtcaatatacaaaaatcaattgcatttgacatcatccacaaacaattagaaaatgtatttttacaaaagacatttaaattagttaaaaaaaaaaagcatcaattacctaggccctaggtataaatctgataaaagatgcttaagatctatatgcaggagattaaaaactcttcttaagggacactaaaggagacaattcaatggagagatagcccatgttcacccacccagctgtctatcactccttgtaatatcacctgagactatatatgctcaacctcctgttaacatggctactgctcctagtaggaagcatttttatccctctgaagagtccccaataggaaacacaaatgagtttaatttgaatgcaacatcaaattaatagtaatagcttccagaaatgctgtgttagaagggaatctagaacagagccttggcacagggataaccaatgtcgtatcagcccgcagtgtttgctataggtgtgagagaggtagaggaaacatgcaggccaggtatttttcattgtggaaaagcatttttcaattcaaacccacaatatataaatgagccacagtgtccagctgccctgcaatagaactttcagtgtggtaccatggcttaccattggaatatgaagagctagtggtacctatgtaacagggatagaaggggtgcgttagttagtaggtactaagaaattctacagaatagcaaaactccctacttttatcttctaccatcattagatgtttaagttgtactcaaattgatttccatggtttttgtacattgatcagattaaatcccttacattcagacaaattaatcatttgtatagtacagggtttctcaaagaccatttccacaagcatcaagaaacatctagatgcttattaaaaatatagttttctcagcatcacccaagaccttggtcacagggtccaaggaatctggctgttgtttttattctcccatagtgattcctattcacttttacaaatcactagtagagtagttaatgcacacccaagagaaacaagttgcataaattagtgatcactattacacactcaataaggaaggaataatatcacccgacttttctaaatctcattggtcattgatcacgtcgcattctcagtgacatatcaacaagggaaggggtgtgtataggacccactgccccagcagggaggagtatttcagtattttatcactgagattctttataactgccaacttttgctttatttcatcattgttttttaaaatctctatagccaatggaccccctactgcttacaatcatgtatgtgttcccaatgactcctttccttggtaaccacagtacattctagttaactaccacacatttacaatttctcattattttgtctctttgcttactttttgtcctcctccccatgtaggctctaatctccatgacacactgtctatttcttctctgtgtcagacactagtaattatgcagttacatggctaaagtacttacccattttgccccggttgcagggattgaggttaccagatgtacagtggtagactaacactgacttaggtctggaaaatgaaataaaaattaaataaatacaactgaatgaaaaactaatgaaagaaaaataagggaaaataatatttagacagagtggcttcaataattcatctgattaaagcaacctatgcaagaaggcttctgtatttttttctttctttgggttaataagcaaaatggaagaagactagcaaaagggtgtgtgcggaggtggggggatgtgtgtgtgtgaaagagatgttaaataggagtgacatattatgaagcacatatgtacgagttcacataaaaaaatttaattctgtttaccacatactaacacagccaaatgtatgaacaacctgtttttttttcctttgtaccaggaaacttccccacacatagtgattgaacacttttggcattaaccagagttcaattaaagaaaattctctcatttcatccacttctatctcctttgccctaaaaaagaaagctgaatgttaaactactgagtagaaagaaaagccttttggttatcaagaattgtatggttaagtgatttaaatgttttattactttgtgagtagccaagtactaaactgtattttgaaaacaactgaatgtatatatgatggcatattaggaactctataaaatactgaaacaaacaccctctcacatttggggtcttgtacaatgaaatgcctatatttggaaaatgtgcctaatacaataaccctccctctcatgacatctttgaaagcccacttgagcatccacacctgtgaactgcagcacacacaccatcctacagctagtgggagattgacggctgtatcacctggaattggaattaagtctcccacagccattggagtagcttttatggacagaagaaaccctttcccagcctgcacaggaaaaagaacataaaatgtgaaaccaggtcttaagtaacagctggggctaaagtatgtatcatcaaactgattatactagtgcaataagtgaaaacagctaacatcgatccactgcttaacaggttcccacactaagtctgacttcgtcagcctatcctagcttcccagccaagcgcatcttcagcattttcttgaactactcgtgttcctcacgttcctttagggaataaaattcctcatatttttgagatattaataaacttagttaattaccaaacaccaagaataaaccttcacatttaaaaaattaactcataagacacgttaagaattaaggttacacaaattccccattaatgtttgttttccatttccttaatgattttgttttctgctagggtttactaacctacaagcaatagtaagcactaaaagtttaagaaagttttatttgaacaaaaattaatttgtgaaattccacaattaatgacaaaaacttttttggcttagaaaaatggccttattatttactttttcttcagaatctcatttcacctcacagatcactgatgttatatagatacaagagtttggacttatttatgttaataatttgttgagtttatgaaattcattctttctgctttgcatgtttcccactttaatttgaaatgattagcactttcttatgttactcaattctcttttcttataactagctccccttcttttggacataagaaaccaatttagaacattttttaaaatgtaaataaatatacagctttgcatataatgaaaaccgctttgggatcacgttaaaataatgatgttctaagtcaccaaacttcaccccaactgaacttttttaggagaaagagttgaaggcaggtgggaagcagaaagaaaggggctgctagaaaaatccggaattcgaaggaaggtctttgtcactaccataattcattgtctcatatttctatttgaattcatgttgaacccagctctggtaggaatagagacagagtctgaagagcagtctgaatccctaataagatttaaactcatttagatcactgatttcccattcattgtacaaaagagtaaagtggggtttaggccctgaatgcctcagtgtgagctgtgaaccccacagctctgccggatcaatgtggacttcagggagatgggcactgagggctgctcacctagaggagccacgtttctccttgtaagacattattgaaaaggcgttgccggcacatgtctacctatgtaacaaacctgcacgttgtgcacatgtaccctagaacttaaaatagaataataaaaaagaaaaggccttgcctatattcactgatgtttgtatttgaaaaatttgccccaatattggtagttctttcttgtattcattaagaattattgatgtatacctgctttccatatacacacataaactcttctatgtgttttataataacgaatttaataatctttgaagatatttttactgcatcctcaattcactgcactaattcatgcaattataaactgaagaaaggaggaaataccccatcttgcgataaataaagcaaaatccttggcagaaccatgcccgcctgtccgcgccccgaccagccctcccgggcagccactcaccggtgtccgtcttcccagcttcgcgccatgtggccaagtgaatccatcctgccgtccatctccactttcaccagcccgtaccgcaagcgccgcctgcaggtgcgctgaccccgcgcccagcccgaggccaggggaacccacaactacctcaacagcgtgcgggactccattcggtccacagggctggatggcctggggccgaggccaccccgaagcccccggcgaccccgccgtctgcgtcctattacccgaacactgcacaccgctgccctacggcgccctggagctggacccactgccacatggcccgcgctgctcagctggtttttgttgttgttgttcttttgagatggagtctccttgggttgcccaggctagagtgcggtggcgcgatctcggctcactgcaagctccatctcctgggttcacgccattctcctgcctcagcctccggagtagctgggactacaggcgcccgccaccgcacccggctaattggtttttgtacttttagtagagatggggtttcacctgttagccaggatgttctccatctcctgacctcgtgatccgcccgcctcagccttccaaagtgctgggactacaggcgtccaccaccacgcccggctactttttttttttttgtatgtttagtagagacgcggtttcaccctgttagccaggatggtctccatctcctgaccccgtgatcggcccgccttggtctcccaaagtgctgggattacaggcgtgagccactgcgccctgcctgctcaaccgctttcaactggcgctgcccagccacctggtcaaagcccagcaccctgaagcagatggcggcagctgcggctgcgcacccaggttcaggtatgcatcgcgcgtcctctcaaacactagggcgccccgggcctgcagcttcatgcatgcgaggtcccgggtccctcccattccgcccccaacacctgcccctcagcccctacgacccgcacgcctccttcccgctgcccttccgtggccctggtttgggacacccagcccggccttcatgaggcgccccccgcccagctccgcccctccacgcccctgtctttagtctcttaggcggtggccgccgccgccacagccctgggcctggcacccccagtcgcccgcggcctccttgtggtggcaccggcgtccccgctggagctgctggaggccacgcccaagcgtggcagctgctcctggcctgggaactgcaacaccaggcatacctatgtggctacggccagacctacagcaagaattctcccctgcaggcacatctgcgcagcacacaagtgacaagcccgaccactgccactgggatggaagcagctggaagtgtgctcactcagacaagctaacgctccaccaccacaagcacaggggccaccggccatttcagggccattggtgccaccacgccttcttgcgctctgcccaccttgccctgcacaggaagcggcacatgcagcccagaggcctccccacctgcacgcggccccctcccaaactgtgactggtatttattgcacccagagaactcggcagggcggtgtggctccatagggtctacctcgacgacgaagacggcgccaccgccccagcccccatctgtgactgaagaccaggtgggaaaagaccactatccgccttgacgagttctgtttttcaaaatggtgcaataattaagtggcatcttccctcccacggggcataagacttgatgtcctttgagaaataagggccttaatttgtactgtctgcgacattttttataatattgtacataataactgggacagatattgttattactgtacatagagtggcagggctacttgcctcattttcctaagacttttgcttcttttatttttaatttttaaaaaagttttttttaaaaagaaaagaaaaatccttaattctcacttttcaaaatagaactcttaaatagtaattgatagcactttacctctgttttcctgataaaaaaaattctaaaagaataaaaacaatttcatcctgcccccatattataaccagaataattgaaataatatgcttcaattgatagtaaagtagcatttatgtttttggatcaatgaagctaagccagcactaagaattttcttactattcctccactacattacagttacttcctcatccctatacataccgcaataatgagtcagctacatccatttagattatcaacccaaccctaaaagaaagaaaatttccattggttacacatttcagaaaattgttgtatctttggaacatctgccgtctaatcttaataaatttcaaacaagggcactgagactccagccgatagaactatctaattcagtattattaagatcccaaagatcaatggcaaagcgttggctattttctgcagtttgtgcaagaattaaaatttggccaggattgttgtttgtagcaggagtcatgaatggttttgtggtgttttatgacaacttaagggctacaatggaccttgtccttatatcatgatctgctaagcaattcaccaaccatacttcacctcattcctgattttagcctccttaggagaacattgaaaacatgattggtaataatgtgtgttgacttgcttaaagatgttacaggaaagattatgcttaagagtagttagagggaaatgtctttttgagtttgtttcctaagccctaagccgtctctttaccttacagtataaaagtcgaaatgcatataatgggagaccagatatacgggaggagaagatgaagggactaatattcgttgagccttttagtagggatctaccttttactagagactgagcactcctcatacattgtctcattaaaccaactctccaaagtagtatctgtcctgttctaccgaaagaacaactcaaaaatgttgcattgccagtaagtggtggagctggaatgtatctgcccccaaagcttcacggacttgctttgaagaagatggtataattcaaagtactttcaaaaggacatagcagtatactgaggttaaaaaaaattagtattcccaaactgagatccttctgtgagctttgtaaccctggcagttagttgcaatactaccaatttggccatcaagaacattctgatatgtttaagctacagtgggaaagccaagatatgaaaacatcacccatgggaattttgagactagagtagttagaagctaatttaagatctccatccaactctaagatagggtaactgccagaagagccacatgatcccaaagtggaattttgccctagtataatgggttaatatttgattggctgcacttagctataaatcctgaggagaagaagaagaagaaagacatcagaaaataattgggctagaagaaccttagtttgaaggcaaaacacagaatccaggtaagtgggcttaccaggaaaagctggtgcgacgttgctccgcacaatggagggccttaggatggcaatggttaggttcctgctctcctgctgcaccaccatttctcccaaggccttgctataggtctaagtattgggacaatctccaatccgcttgggagtgatctcgtcaataatggcgttgtctatacataaaaggtagtcagaataaaaagaattctagcaacatgtgttagacaatagaccaaaaggaaaatgtgagacacagtcaaacaaaacttccaccttttagccttggttctggaattcagaacagtcacatgataccaagtttgagtgcatacctgtccaaagcatgcatgagctcttttgttttcactgctaagcccaatcttacagtcaaatcctatgccctcctatccagacaggtaggtaggtagacggatagaatcaatagcgatgccactttattactactactagtgtagggctattaatactactttagcgctactattactttgtcagtgctaattactactttatctgtagcagtattaatttgaggtaattacatacaacctctttacttcctttccaacaaggtcgtaagtacattcattgcacatatttttgagtcccaatcattctcccagtagtgtgctggaagctgtgttcagggagtttgaggctctcatccaaggtgtttcagtggcagccctgttcagtgttgtcctatagaaacccagtgcagtgatcctgaagagtttagctttacattttaaaattttcattcaatgcaaatcaaaccagagtgattacttttggcagactgacaatctgttttaccaaatctatgtaatgcattttgaaggtctgtttagagtctatgataacaaattgctaattatttccagagattttcaatgaattctgaagtctgtcaagtgtggtgattatagtactctgaaattgcttcaaaaccatgaatattgaatactcctacttacaagatgacatgtatcatcaataactgagttaccatagcatcagcctaaactttcttaaaaatatgtcagaaccagccgggcacagtggctcatgcctgtaatcccagcattttgtgaggccatggcaggcagatcacgaggtcaggagattgagaccatcctggccaacatggtgaaaccccgtctctactaaaaatacaaaaattagctgggcatggtggcgtgcgcctgtgatcccagctattcaggaggctgaggcaggagaatcacttaaaccagggagcaaaggttgcagtaagctgagatcttgccactgcactccagcctggtgacagagcaaaactccatctcaaaaaaaaaaaaaaaaaaagtcagaaccatttgataaccccaaaatctatctacaactctctgagagagcaaaaaaaattattgtcaattaaatatgcaacatgtattctagctgacagatctatgtggttaaattgttaatataacatagctttttaaaaattaagctgtcggaatatgctagggtgatttttctgatcaatgtggtccatttatttctattttatacaacagaacataactatactattttgattgtagaaaatcttcactgttaccaccttgctgacatgacacatttttgaacaactaagatgtgcatgaggttaagactcattcagaatcacaactctcaatattaatgcctcatttgatcctggggtagaacatgggcattgaccattatgtttccatttttcttcctttgcttctgagtgctgagtgtcttctggatactaaatgtcttttcatttaagttgaatagagaaagattgaggggttctagaattaaaaacttaaactacatagaaatatcaaggatattttaattatatggtcacctgggggctgggaaagagcataggatgattcatacatctctcaatcttaacaataatcctaccgttacctcatttcatttctgtgtcaacagtggattgactgacctaagaccatttcccctcaactgcaaaactatacagtttatgaaaaccaggtcttcagggaatagagcttaatttcaataagtctgtaaagaaaaaattcctagaaaacatcagagcccaaaaatgtactgggattgtatgtcagatggctagtaccagttgctgtcattaatgttggggcagccggaaaggataatacttggagggatgggggccttataaagcttagtgagtttccttgtattagaaaatgttgggttttgttgttgttgttcttgttgtttgttgttgttgttgttgctgttttgaaatgaagtcttactcttgtcgcccaggctggagtgcagtggcacaatcttggctcactgtaatctccactccccgggttcaagcaattctcctgcctcagcctcctgagtagctgggatttcaggtgcccaccacacctggctaatttttgtacttttagtagagacggggtttcaccatgttggccaggctagtctcgaacccctcacctcaggtaatctgcccgccttggcctcccaaagtgctgggattccaggcatgaaaaaattttggttttatagatttctaacaacacacatggaagaaattttaatattctatagatggcttacctctgctactcttagctgcacctgtattccactgttttatattctcgttccaattttacttgtgaaaatggcaataattatattcattctaaattctcaggttatgagggtaaacaaaaatattcacaactgcatttaagctgtttgataaaacaaaatgagccaataaacctaaggcactcctatttttagataaaacaatcggagagcatcatatatctgtgtacgtaatagttggttttaaaatgtcatttctggccatatgtggtagctcaagcctgtaatcccagcactttgagaggccaaggaaggaggatcgcttgagtccatgagtttgagaccaccctgggcaacataataagacccagtctctacaaaaaaaggtttaaaaattagctgggcatggtggtgtgcacctgtagtcccagctattcaggaggctgaggcaggaggattgcttgagcctgagagttgaaggctgcagtgagccataattgtgtcaccatactctagcctggatgacagagtgagaccctgtctcaaaatgaatgaatgagtaaaacaaataaaaataaattatcatttataatgcagccagacaggccatctgctagctcattcagccagttcctaggttcagacaggagattagtgtaaacatgcacatgcactgattgggcaaagcccttctcaggactttcactcaattcagggttgctgctgctgtttgttctcaatatgtttttaaacagtaaataagttaccatggataaaaaacactatataaaccaaaatacgtgtctgaaattaatccaaatgttcttcagtatactcaagaagatgttttgacccaggggtctcaaattctaaactcgaattgcttcagaagaagcataaagtcattgaaaatttcagaaagcaatatgtatgtctatgtatgtacatacatagacacatatacaatttcttccaaagattactatcaattttgctttcaaacttattgaatcaacatgatgatatcattaatggtttcattatttatgtatttatggaatgaaatactaagaagcatatgcatttcccatcccctgaccctccaattttatctcattcaacaagttggcaagcctagtggtttatgagtaaatctgttagagagtaagtagtggacacactgtcttatgataacgtttgctctctttctccagtctaaattatataattcacttgattgttgtagttatcaagttgtatttgttcatctgtctgtctgcccactagacagtgagtccaggagagcagggattatgatttttatctctgtgtctaatcacttttctgcccccaggagccagctaccttattcagtaaatggatgctcttccacatggtaatcttgattggccaatttctgtactatataaggttttgggaagcagagatggacaatgatgagacagagtggatgtactcaaaaaaagacaaggttgtagggagaatgcaggaaaggaaagaagggggtatctttgtacagcaggtagcaaaattggaagtcaaagtgtccagtggcagtggtgaaaagtgttgaccaacctcggtttgatgaaggtggcgtgaaagtcaacttaaacttttcactgggaagcaggatatttctgagcctaatgcttatggagaattgccctctgtatttccctccagactttcatgaggcacccagcttggcccaaacatgagccagatgctgaatagcctaccaatggcctgccaatgtgaaaattattcagtttggctaagaaacaatttactcatattctggtttgtatttgaagcctgctaatatcaaagtacacagaattttcatttttatgtcagctacttagatgtcattttgaagctgtgccatgatgaaattaaaaacacaggcctggcacaatggcttatgcctgtaatcccaacactttggccaaggtcaggaggtggagaacagcctggccaagatggcgaaatcccatctctactaaaaacataaaaattagccaggcacacttgcgggcacctggaatcccagctactcgggaggctgaggcaggacaatagctggaacccaggaggcagagcctgcagtgagctgagatcacgcattgcactgcagcctgggaaacaagagcaagactcaaatctcaaacaaacaaacaaaaagcacaagtgctagagtcagctttcaccattcccctagaacagatcatctttttcagtgttaacaatgtgttctatagcaggaagtcaagactactgtccaaggtctgacctcctttgatatctcctggagggctgtgatgagggccactgatgctggctgttggggtctccatttccctgcctctcacccctgcgccttcagggcacacgccacctttccttttttacatggcagactagctgtgtcttctggtggccacgtagcttcagaagtgtggtttttagtaggtacagatctactaggaactttcattcaattaaagcttctaggaactgaaaaacaacaggagacaaagagagcaggagaaagaggaagcatggggtattagaagataaatgatcctcttttcaaatgaagactgcttaatgaaaaatctccttaaggcacaatttcccaaacttgcctggtcatcagtgtgaattacacaaggcccctgggaaaaatccagactcctgggtgccattttagaaccactaaatacatctgcagaagtaagagtctggataatctgtattttcaacatggcctggaaattccaactgtcaggtaaattagggaatcactaatttaaaagaagtccactccatcaacttaagtcgttaagatttgaatatatcaggattagctctcaaaaacacattgcttcttggagtaaacatttcaacagaattgaattttaaaattattaaatcccctaatgctatccctcccccactcctctagccccccacccactgacaggttccggtatgtgatgttcccctccctgtgtccatttgttctcattgttcagctcccacttatgagtgaacatgcggtgtttggttttctgtttctgtgttcgttaactgagaatgatggcttccagcttcatctatgttcctgcaaaggacaggaactcatccttttttatggctgcagagtattccatggtatatatgtgccacattttctttatccagtctatcactgatggggatttgggttggtttcaagtctttgctattgggaacagtgccgcaataaacacatgtgtgcacgtgtctttatagtagaatgatttataatcctttgggtatatactcagtaatgggattgctgggtcaaatgtatttctggttctggatccttgaggaatcactacactgtcttccacaatggttgaactaatttacactcccaccagcaatgtaaaagcgttcctatttctccatatcataatgtagcaccaaatgtagataagcgcctaatgtagatgagaggttgatgggtgcagcaaactaccatgtcatgtgtatacctatgtaacaaacctgcatgttctccacatgtatcccagaacttaaaatataataaaaaaagattgaaaattttaaattttaatacaaaattaggacttagttatttgcaaaatacactgtattttcaatgtgaaaaacaaagggttatcgtatgtattatcaataaagttatatagttttccataaaaataacattaataatggaaaattctaaaagaaaaataattaaatttcttttaggacaatttaaaaatgtatctgtcaattttaacatgaaaattctcttacatttatacatcccacattctaataaggactaatttttatgagcagtaaagaaatgtgtgtatgcgtgtctgtatacttataggtatatatctgtttctgtgaaaatctctcttttagagtcagaaaatctgtttggtcccagttcttactaataatatatgatctcactaaagatacttaaattcaataaactcaataaactttactctcaatgaggtaagaatgagaacacaggtgccagccatgagctgcggttccactggcacaggcttcagagatcctacctttaacatcctcctttcattcatttgagcctgataagaaaggagtctcttgggagagaagcaagcatacaccttggggccagacagcccatggtcaaagttgaactccaccactgttcagctgtgtgactttgggcaagtgacttttcctctctgatcctcatgatcctttttggtaaaaacagcagaatgacaggtctatgaagattggaggaaagaaaaatgtgtgtcttagtttaagtttcctggaagtagatcctgaggcaaagattcaagtataaaaattttatctggagatgactccaggacagtaattctactgtcagttcttccttagagtactaattgcaggcaacaccagtagaggagtggggaactgagacaggaatggaatgtagcagttaaagggaccttcatcaagaaagtttccactgtgggcagccaggactcagccctgccgggtacctctgagagacagcatagaacatgtgcctcagagtcatcccacccagagcaagggagttggattatttatccaccaatacacaccagtcactcctcagggcttcgtccaaggacatgattcctccagaatgccctgcctgcactgcaagaatgagacctggagggtcaatggcaagagccctgacagcgcctccagcagtgagcaggaccacagcctggtgtggagagtttcagtccctcagtgaccccaacacacacacacacacacacacattctcacacacacacacacacacacacacaccatactccaacaccaacagagaacatacacacatacacatacatgcatagatgactgttacccacttacatcctggtgaatccatgggatagaagataaggtgggaatcagagggaaaagcaaaattaaggggagtgagggtcttgggaacaaaatgaaaatataggcagaaaatcaagggggaagagtgctctggacaccaaacgcctgctggctggcacctgctctacatacactgtcagtcattctccaagcaatctcgtggagtcgaaggaattcccctcaattacagatggtagaaatgtagttcagaaaagaaaactgattttactaactgattttactgcttctgggttctgctccttttcttgctaggcaatcatgacagaattgacaaaaacattttcccccttcaccacctggagcagagccaatgagaggggctggggaacaggccatgaggccctgcacccaccattcaatgtcttcaggattaggactcttgcatcacaggctggcagcactcccgatgtctgggtgttttgtgaggttgtacaggatctagtagaggccactggctctgctgtcatatcctaagaggcagccaggcagacttgggtctcttggctgcttcagcaccagaggatgaacagcgcccatacactgaggctttggggagaatgggaggagggaaaggaagggcagaatggagtgatgtagggtccatccatcatatccctggatggagagacccctgttcccacagtagtcccacaccgggaccaccaccagcactcatgaatatgccagcctccatttatatgtcctcgtctgacaactccttcccattttcatcctggaggcaagactctgaacacactagctctgaggacacctgtgtgtaacctgagacagtccctgaagacctttcatccaagcaggatccctcctttgccatctccagacctgccccacaagctccctccctggtctcctggctcttgttcactccttccaggcagccttctatagtcatctcgaaaacatagctgactgtcactcctttatccagcaccttccatggctccccagagccctccagatcaagttcaagtaccttgatcagacacttgatctcaagctccattctacctcctgaattaagatcctggagaagccaccttgctcagcacaagcgcatcaataaagtccgaagccttgaatgtggccttggccttgaggaagtcatcaacaccctggctagtgagggtgcggtgctgctgcaagatgatggtgtctgaagttgtgcaccaagtcacaggccctgcagaagcatcgcccctcaggaatgggtagtacaggaagtccaagcacaggcagatctactgacgccgttacactatgagggtactgagctccaagatgtcagcagtatgttcactggcattcctgcagggtgaggctagggagaggaagcagctccgtaacagatatgaaactctggaagcccttcccagccaaaatctctggaccacattacacccagaaatgggtgccctctcagcacacttctctctgcctccctctctgagctgcctcctggccccacatgccccagcctggaccagggcttggagcccagcaggtgttcagttcatggtgttgactgcttcctggcacaggagagcccttggtagctctgtgactcctcctgtggaacccctgcctctgcctcaggacctccctattcccatgggaagaccccaaggattgccccacctgcccagggatcctccaaccccataggccttacttgatgccttatccctcccagaacatgacatgtttctcacaaggtgacttacttccaaggccatctgtggatgtttgctggggacctcttgctgttctcctttatgatctgtagggcaggaccaagaggagaaaccagcccaacctcagaacaaacaaaggctcactgccacaaatggcaaccaccaaacagtcagcagtgcttctgggaggaaaggaggtttcattccgcacaaagctccttgtttggtttctttctgaatccggggaggggtaggtaccaagcccagcttacctgtggtgtctacattaccatctgtgcctaggatgtgcaaagggcccctactcccaccgcagggttgacgttccctccagctggagacctgggctcctgacaccgcctggcctgtttgtcctgctctggatgagcggggaaaggctgtagctggtatttccctaggtccttggtttctaccacctagacatccagcaggagtgaccatgtctagcaccacacctgaaaggggactcccttgtacagcagcccagacatctacagatggaagagtgctcagtgagacaggccacaggggtccccagggaggatcagggggtggaggattctggaggtttccagccttgggctctgtggttcctcaaagaggttaggtctacctagtaccaggcctcccctcccacgattcaaagactgaatgagtgtccagcatcaggaactctgttctggacctgttttttcatttaggtcaccaagggacaacccctaacccgagctagggatggtccaagctctggcatgagattttcctccagcaatgtgatgcttacagggacaggtagaaaagctggtgaccaggcctgctgtcctctggttaaggagtgtgccacccaccctctgagaggcaggtggtgccaggccacagcactgggtgcctgtacccctggctctgcagacaccggtcatggaggtccctccctccacattaccttcttgctgctcctagatttcttctagtcattaagcactttgagtcacttttctgtgcatccaattttacatttttgctctcagatgaaacaggataaagtatgctgagctgccaggattcctggaggggaccttggatgctgagtcttgggatccagggccctgatgggactgaatcagaaggagccagggaaagacaaagattggggctgagcccctatgacccaatggccattggtggcctggccttatggtcccaagacaccttgttctcaggccagaaacaccatgggctttggtcgggtcccagcctcccagtagtgtcctggcactagcaggagctgacccctgagccacaaccgcagttctgggtttgggatttggtaaaaccacctcaaggacagagtcttgggatcgggtttgccaggaaccatggtgcctcccagagatggtgtgtcattcccactcgccacgaaatgtgcacacaggctgtccccatgtccatcccatcccgctggacaggatggaggaagtcagggaacaggcatggtggacagctggggtgcagggagaggcaggtgcatgctgggaggtcagaccctgcgagggctgtggaggcatcaggtggagtgggctccaggtgcaccttcagtgtactgggcacgtctgaggccaggctcactggaccctggacgtgtgatgtggtcaatcactgggggaatgttgtcaggtcccagccacccgccctgggcagcactgtctcatctcaggactggactttctgagtcctaagacaagacagtgctgccaggcctcacagcctgggaggacctgttaagtcctccatccctagactagcctcccaacagcagggacagtctcttatcttcaccttcagggaactgactgatccatctcactctaagccagtcgaggcagagctgaggacctgcaccagtctgggagccagtcccctccccaaatgggcctgagggaagcaccatccctgtcccaatctgccacaagtttcagcctaggagacacatggggaagggaggatggggcatccctgctggctgacactggaaaagtgggacctgggagaatggggagcacaaggctggcaggggatgctccaggcccatggagagctcaggctgcaccatgcggttgcccctcctgggtggagtctgtgccctctacaggatctgagaaagtccagtcctgagatgggacagcgctgcccagggtaggtagccgggacctgagagcagtcccccagggagtgaccacatcacctggctggggtccagggagcttggggtgatacccacccagtgcactgagggtgcacctggagcccaacccacctgacaccctcacagccttcacagggtctgacgtcccaccatgcacctgcctctccctgcaccgcactgcccaccctccctgttccctggctttctccatcctgtgcagcccatagactgtgaccatctctccagccactctgaccctttcttcacctttgtcctgtcagaatctctgagcaacatctcccaggtccatccaaacaactgctttgtctacttttgaccgggccattgggcatcactgggccatcccagctgtccagagggccctcgataacgtgcaatgcacctggcttctccaagcagcgctcagcagtccccactgaccaggttcctgctgaccagaccccacacatcaggtcttccctgaccacaccctcactgattagacccccatcaccaggacccactaacaagacccccgctgccaggccaacaatgaccatgactccactgaccaggaccttactgacaaagcctcacggacaaggcctcactgaacaggaccttactgaccaggcctccctgacaaggcctcactgaccaggtccttactgaccaggcctcactgacaaagtccttactaacaaggcctcactgaccaggaccttattgacaaggcctcactgacaaggcctcatggatgagctccttactgacaattcctcactgaccaggtccttactgacaaggcctcacggaccaggtccttactgacaaggcctcacggaccaggtccttactgacaaggcctcacagaccaggaccttattgacaaggcctcacggaccaggaccttattgacaaggcctcacggaccaggtccttactgacaaggccccactgacaaggcctcatggaccaggtcctaactgagaagacctcactgaccaggaccttattgacaaggcctcactgaccaggtccttactgacaaggccccactgacaaggcctcactgacaaggtccttattgacaaggcctcagtgaccaggaccttactgacaaggcctcactggcaaggcctcaaggaccaggtccttactgacaaggcctcactgactaggtcattactgacaaggcctcactgatcagattccactgatcatgaccccactacctggacccacagatgaggccccactgaccaggcctccagggaacaggctgccactgatcaggcccctactaaccaggcctgaggtgaccagatgcccctgactgggaccctagtgagtaggccccactgaacaggcaccgactactcaggtccccgctgaccgggtcaccccgtagaccagtggtacaaaagccaccactgaccaagtcatcactgaccaggcccccactgatgaggttccactgaccaggctgccctgatcagggccccactgacaagggactcactgatgaggacacgcccaccaggccctgctgactaggtcccatgtgaccagtcctccactgaatagcaccccttgacctggtcaccagtgacccagcccatgctgaccaggccaccactaagcccagctgaccaggtcgccaccggtcaagccccacagcctaggtctgcactgaccagacaccaagcaactggctgccagtaggtccccacttgccaaaacccccactactggatccccctaatgagaccctccctaagcagacccctgctggccaggttcccactaaacaggcctcactgaccaagtcccaactgactaggtccactgagcaggcccacactgatcaggcaggcccctcctaaccacatcagaaggccaagtggcaatgagatgtttcatatggcagaaatagaagcaagacacagagagaaaagaggtgccacagcccattatacaaccagatcacatgagaactcactatcagatcagcatcaagaagattaaccactggtgaaggatccaccacacacaccaccgcctactgtttccaggcagaagcctcctgcagaggcagagcctcttgggaaacttctactatggcagtgcagaagggaaatatgggcttggagcccccacacaggaggccaccatcctccagaccccagattcataagcccaccaacagcccgcaccctcagtatgcaaaagcactcaacaccagcccagcccatgagagcagccatgggggctaaagcctgcaaagccacaggagcactgccctagcagaggttttccatgaggatgtgactctgcagcaggctactcccccttcctaatacccaccatcctctcaccaccctactgacaacccactcctcccaacactatccactttatttccttccaactccaaccccctcccatccatggttaaatcaccttccaccaggccccatctccaacattcaagattacaattcacatgagtttctgtagggaaacacagccaaaccatgttattcttaccctgacccttccgaatctcatgtccttctcacagagcaaaatacaatcacaccttttcaaaagttgccaaaagtcttaactcattccagcattaactcaaatgtaaaaggttcaacgtctcatctgagacaagcctacagtcccttttgcctataagtccctgaatttaaaagggtgttcttttaagacacaatgatggtacacccattgggtaagctttctcagtccaacaggaagaaatttccgagcaaaataacacagatgggaccacaggaccaatgcaagtccaaaacccaggagaccagtatccattcaatctcactgctccaaaatcatgaagagaactcaccatcacaaggacagaaataaagagattgtgtctaatcatttgtgaaggagccaccatcacttttcacccctcacccccaacataatctcccaattctccctatcccccacctcccaacccccacactccaccatgattaaatcactttccaccaggccccacctttaacattccccattacaattccacacgaattttggtagggacacagagctaaattttattattctgtccctggctccccaaatctcatgtccttctcacattgcaaactacaatgatagcttccctacagtcccccaaagtcttatatcatttcatcatttatacaaatgttcaaagcttaaagtctcatctaacacaaggctgcagacccttaggctcatgagcctctgaaatataaagaaagttaactacttccaaggtacaatgcttatacaggcaatgggtaagcattcccagccaaaaggaataattttgccagaaagaacaaaagacagaaaggacttacagaccccatgaaactccaaacccagaaggccattcaatcctacagctccaaaattaccctttttgaaaccttgtcccacatccagggcacagggatgtaagggctgggctcccaaggccttgggcagctctgcacctgtggctttgcagggtttatgccccacggctgtcttcatgggctgggctggtgttgagcacctgtagcttttacccactgacggtacaagctgttgcggggtctattaatctgcagtcttcatgatggtggcctccagtgtgggggctccaaccccatattttccttctgtactgccctagtagaggtttcttatgaggttctgccttttaggaaggctttcgcctggacacccagacatttccatacatcctccaaaatctataaagagcctcccaagcccctaggctcatgctccatacaaccagtggcttaacactatgaggaagttcatgagaactcactatcacgaggtcagcatcaagaagatggtgcttaatcattagtgaaggatccgtccccaacccacctccaccccctcctgtttccggacagaagcctgaggcagagcctgagcctcttggaaaacctgtactatggcagtgcagaaaaaaatatgggcttggagcccctatgcaggaggccaccatcctccagagcccagattcatagacccatcaacagctcgcaccttcagtatggaaaagctaccggcactcaacaccagcccagcccatgagagcagccacgggggctacaccctgcaaagccacaggtgcacagtcctagcagaggttttccacgagcctctgcctctgcagcaggctactcctccttcctactacccccaccctcccaccaccctacagcgagcttactcctcaccacgctacccacctctttttccctccaaccccacccacctcccatccatgattaaatcacctcccaccaggctccacctccaacattcgggactgcaattccacatgagtttttctagggaaacacagccaaaccatattattctgaccttgaccccctccgccgaatctcatgtcattctcgcagagtaaaatacagtcatgccttttcaaatgtttacaaaagccttaactcattccagcattaactcaaatgtaagaagttcaaagtcttatctgatacaaggctacggtctcttctgccaatgagtccctgaacttaaaatggagttcttttaaggtacgatgatggtacaggcattgggtaagctttctcactccaaagggaagaaatttcccagaaaaataacacaaatgggaccacaggcccaatgcacatccaaaacccagcaggccagtattcaaatctcaaagctcctaaaccatgaagcaaactcactgtcagaaggacagcattacaaagatggtgtttaaccatttgtgaagaatctgccccccatctctgcctttccccacaaccccaacacaatcccccacaatgctcccaaccacccccaccttccaaactccactctccaccatgattaaatcaccttccaccagtccccacctttaactttgcccattacaattccacgagctttggtagggacacagagccaaatcatattattctgtccctggtccccgaaatctcctgcttcttacattgcagaatacaatgatacctgccctacaggcccccaaatcttaaataattccagcatttactcaaatgtccaaagcccaaagtctcgtctgagacaaggctacagtccgatctgcccctgggtttctgaattataaagcaagttatctaattccaaggcacaatgattgtacaggcaatgagtaagcattcccagccagtagaaaaaaaaaatgccagaaagaaaaacaaaacacagatgggactcacaggatacatgaacatccaaaacccagcaggccagtcattcaatccgacagctccaaaatcatcctttttgaatccttgtcccacatccatggcacagggctgtgagggctgggctcccaaggccttgggcagatctgcacctgtggctttgcagcgttcagcacccacagctgcctctcatggacagggctgttttgaatgcctgtagcttttccacactgagggtgcaagatgttggtgggtctatgaatctggggtttggagaatggagcctccctgtgagggggcttcaaccctacatggcccttctttgctgccctagcagaggttttccatgagcctcttggaaaggctactgcctggacacccaggcttttctctacatcctctggagtccagacaagaggctccaaagcctctagtctcttgctctcttcacctgctgccttaacactatgtggaagccatcaaggcttggagccacatgtgaagtagtgacccaagctgtacctgtgcatcattcagccatggctggagctggggctgcagggatgcaggcagcagtgtcctgaggatgcacacagcagcagggccatggagctggcccagtaaaccattcttctctgctaggccccagggcctgtgagagcaaaggctactgcaaaggtctctgaaatgccttcaaggccttttaccctttgtcttggacacttgcactaacctcctttttatgcaaatactctaagccttattgaattttccccctgaaaatcagcttttctttttaaccacttgactaggctgcaaattttccaaacttctgagctccgcttctcatttaagtagaagatccaacttgaggtcatttcttagctcatacataacaacacaggctgttcgacgcagacaggacacctcttgagctatgctgcttagatgttcattccacaagatacatcctaaatcatcacccccaagttcatagattcacagatctccagggcaaggtcactgtgcagcctctgttgggcaaatcaaatgtagctttggctcctattcacaggaaattcctgatttttatccgagaacttttaagtctggccttcactgtccatccttctgtcagccttctgatcacaagtatttaacaattctctacaggggtccaagcttttcctcatcttgctgtcttttaagctttcccaactctcccgacctctgtcttttacccactactgaacctgcttctacattatcagctctctgtgtcacagcctggcaatgtggtaaaagaagaaaagtccattttcagggaaaaaattcacacaggcttcagatatttgcatgaaaagaagctgagtgctgcttgccaagacaatggggaaaaggccttgaaggcatttcatagggaaaaggccctgaaggaatttcatagcttcacttcacagtactaaccttctgtatgatcaaaaagaaaagaggtttcattggctcacggttctgcaggctgcaaaggaagcacagtggcttctgcttctgggaggactcaggtgcctcccaatcatactagaagaccaaggggcaaggagatgtttcatacagcaggagaaggagcaagacagagagaggaaagaggtgccacatcatgttatacaagcagatctcatgagaactcactatcacgaggtcagcatcatgaagatggtgcttaaccactggtgaaggcttccaccctgcaaaactacctcccactgtttccaggcagaagcatgctgcagaggcagagcctcttcagaaacctctgcgagggcactgcagaaggaaaatatgggcttggaggactaacacagggagccaccaacctccagaccacaggtgcacccttgcagaggtgactggttgctctttgagccagcttggccttgcctggcatacataggccccagctactgacacgctgctccgagtgagcttgtcctgccttggcacaaattctgagtctggccagggccacagaaggccgagtcccttggatggtaatcctggctgctttctgcacttgaacatgaagtcctcctcaagagggcctgtggtctgcctcttggcaaccaagaagcctgcagtgccattcgacccgaggcatggactggagccccaaaggcagcgcacatcctgctcctaactctgccgctcatttcctctctgtggctccatttgtagcacagttgttgcactgagacttgtgcatgccaggcaaggccaagctggctcaaacagcaaccagccacctctgcgagtgtgtgccaggagcagccagaccagccaccaacctcactcgctgcgggacatggtacattggttcttctaccctaaaggtagggccaagaggcagaccacaggccgccttgaggagcactttatgttcaagtccagaaagcagccaggattcccaccaaggggactcagccttctgtggtctgcactgccatacaagctctgagacatggactagtgacatctgctttatagaaaaattaacctaagatctattaaagagttaaacatgccatctgattttactcaggcctctgctccatcagccctcaggtggcagccactcaggctgtgggaacctggccatccctgcttccttcagtgggtgaggttggtggctggtccaactggtccaggcgcacccttgtagaggtggctggttgctctttgagccagcttggccttcccggacatgcacaggccccagatactaacacgctgctctgagtgagcttcttctgccttgacacaaattctaagtctcgccagggccacaaaaggccgagtcccctgcgtggcaatcatggctgctttctgcacttgaacataaagtcttcctcaagacagcctgtggtctgcctcttggcaaccaagaagcccacagtgccatacgacccgaggcatggactggagccccaaaggcagcacacacccggctcctgagcctactgctcgtttcctctctgtggctccatttgtagcacagttgttgcactgaggcttgtgcatgccggggaaggccaagctggctcaaagagcaaccagccacctctgcaagggtgtgccaggagcagttgtaccactcacccactagcggccggacaaggtacatcagttcttctaccctaaaggtgggccgcagtgccatctgcttttcctaatgcctctgctccatcagcaattaggtggcagccaaggcaggacaagctcactcagaacagcgtgttagtacctggggcctgtgcatgccagggaggccaagctggctcaaagagcaaccagccacctctgcaaggtctggccagggctacagaaggccgagtcccctggatggtaatcctggctgctttctgcacttgaacataaagtcctcctccagacggcctgtggtccacctctaggcaaccaagaagcccgcagtgctatatgacccaaggcatggactggagccccaaaggcagcgcacaccctgctcctgagcctgctgctcctttcttctctgtggctccatttgtagcacagttgttgcactgaggcttgtgcatgccgggcaaggccaagctggctcaaagagcaaccagccacctctgcaagggtgtgccaggagcaggtgcaccagtcaccaactagtggccggacatggtacatcagttcttctaccctgaaggtgggccacagggccatctgcttttcctaaggcctctgctccatcagcaattaggtggcagccaaggcaggacaggctcactcagagcagcgtgttagtacctggggcctgtgcatgcaagggaggtgaagctggctcaaagagcaaccagccacctctgcaaggtctggccggggcgacagaaggccgagtcccctggatggtaatcctggctgctttctgcacttgaacataaagtcctccgcaagacggcctgttttctgcctctaggcaaccaagaagcccgcagtgctataccactcgaggcttggactggagccccaaaggcagcgcacagcctgctcctgagcctgctgctcgtttcctctctgtggctccatatgtagcagagaggttgcactgaggcttgttcatgccgggcaaggccaagctgtctcaaagagcaaccagtcacctctgcgagggtgtgccaggagccgctgcaccagccaccaacctcacttgctgctgcacatggcacatcagtacttctaccctaaaggtagggccacagggccatctgcttttcctaaggcctctgctccatcagccatcaggaagcaccaatcaggctgttggaacctggccatccgtgcttccttcagtggctgaagttggtggctggtccacctgctcctggcacacctttgcagaggtggctggttgctctttgagccagcttggccctgcctggcatgcataggcctcagctactgacacactgctccaagtgagcttgtcctgcattggcacaaattctgagtctggccagggtcacagaaggccaagtcccctggatggttatccgggctgctttctgcacttgaacataaagtcttcctcaagacagcctgtggtctgcctcttggcaaccaagaagcccacagtgccatacgacccgaggcatggactggagccccaaaggcagcacacacccggctcctgagcctactgctcgtttcctctctgtggctccatttgtagcacagttgttgcactgaggcttgtgcatgccagggaaggccaagctggctcaaagagcaaccagccacctctgcaagggtgtgccaggagcaggtgcaccagtcaccaactagtggccggacatggtacatcagttcttctaccctgaaggtgggccacagggccatctgcttttcctaaggcctctgctccatgagccatcaggaagcaccaatcaggctgttggaacctggccatccgtgcttccttcagtggctgaagttggtggctggtccacctgctcctggcacacctttgcagaggtggctggttgctctttgagccagcttggccctgcctggcatgcataggcctcagctactgacacactgctccaagtgagcttgtcctgcattggcacaaattctgagtctggccagggtcacagaaggccaagtcccctggatggttatccgggctgctttctgcacttgaacataaagtcctcctcaagatggcctgttgtctgcctcttggcaaccaagaagcctgcagtgccatacgagttctgaggcatggactagaggcccaaaggcagagcacaccctgctcctgaccctgcggctcgtttcctctctgtggctccatttgtagcacagttgttgcactgaggcttgtgcatgccagggaagggccaagctggctcaaagagcaaccagccacctctgcaagggtgtgccaggagcaggtgcaccactcacccaccagcggccggacatggtacatcagttcttctaccctaaaggtggaccacagtgccatctgcttttcctaaggcctctgctccatcagcaattaggtggcagccaaggcaggacaagctcactcagagcagcgtgttagtatctggggcctgtgcatgccaggaaggccaagctggctcaaagagcaaccagccacctctgcaaggtctggccagggctacagaaggcccccctggatggtaatcctggctgctttctgtacttgaacataaagtcttcctcaagacggcctgtggtctgcctccaggcaagtaagaagcccgcggtgctatacaactcgaggcatggactggagccccaaaggcagcgcacacactgctcctgagcctgctgctcgtttcctctctatggctccatttgtagcactgttcttgcactgaggcttgtgcatgccgggcaaggccaagctgactcaaagagcaaccagtcacttctgcaagggtgcgccaggagccggtgcaccagccaccaacctcacttgctaccggacatggcacatcagtacttctaccccaaaggtagggccacagggccatctgcttttcctaaggcctctgctccatcagccatcaggaggcagccactcaggctgttggaacctggccatcccagcttccttgagtagctgaggttgctggatggtccacctgctcctggcacacccttgcagagttggctggttgctctttgagccagcttggccttgcctggcatgcataggccccagctactgacacgctgctccgagtgagcttgtcctgccttggcacaaattctgagtctggccagggccacagaaggccgagtcccttggatggtaatcctggctgctttctgcacttgaacatgaagtcctcctcaagagggcctgaggtctgcctcttggaaaccaagaagcctgcagtgccatacgagttctgaggcatggactggaggcccaaaggcagagcacaccctgctcctgaccctgcggctcgtttcctctctgtggctccgtttgtagcacagttgttgcactgaggcttgtgcatgccaggcaaggccaagctggctcaaacagcaaccagccacctctgcgagtgtgtgccaggagcagccagaccagccaccaacctcactcgctgcgggacatggtacattggttcttctaccctaaaggcagggccaagaggcagaccacaggccgtcttgaggaggactttatgttcaagtgcagaaagcagccaggattgccaccaaggggactcagccttctgtggtctgcactgccatacaagctctgagacgtggactagtgacatctgctttatagaaaaattaacctaagatctattaaagagttaaacatgccatctgattttactcaggcctctgctccatcagccctcaggtggcagccactcaggctgtgggaacctggccatccctgcttccttcagtgggtgaggttggtggctggtccaactggtccaggcgcacccttgtagaggtggctggttgctctttgagccagcttggccttcccggacatgcacaggccccaggtactaacacgctgctctgagtgagcttctcctgccttgacacaaattctaagtctcgccacggccacaaaaggccgagtcccctgcgtggcaatcatggctgctttctgcacttgaacataaagtcttcctcaagacagcctgtggtctgcctcttggcaaccaagaagcccacagtgccatacgacccgaggcatggactggagccccaaaggcagcacacacccggctcctgagcctactgctcgtttcctctctgtggctccatttgtagcacagttgttgcactgaggcttgtgcatgccggggaaggccaagctggctcaaagagcaaccagccacctctgcaagggtgtgccaggagcagttgtaccactcacccactagcggccggacatggtacatcagttcttctaccctaaaggtgggccgcagtgccatctgcttttcctaatgcctctgctccatcagcaattaggtggcagccaaggcaggacaagctcactcagagcagcgtgttagtacctggggcctgtgcatgccagggaggccaagctggctcaaagagcaaccagccacctctgcaaggtctggccagggctacagaaggccgagtcccctggatggtaatcctggctgctttctgcacttgaacataaagtcctccgcaagacggcctgtggtccacctctaggcaaccaagaagcccgcagtgctataccactcgaggcttggactggagccccaaaggcagcgcacagcctgctcctgagcctgctgctcgtttcctctctgtggctccatatgtagcagagaggttgcactgaggcttgttcatgccgggcaaggccaagctgtctcaaagagcaaccagtcacctctgcgagggtgtgccaggagccgctgcaccagccaccaacctcacttgctgctgcacatggcacatcagtacttctaccctaaaggtagggccacagggccatctgcttttcctaaggcctctgctccatcagccatcaggaggcagccactcacgctgttggaaactggccatcccagcttccttgagtagctgaggttgctggctggtccaccttgtcctggcacacccttgcagaggtggctggttgctctttgagccagcttggccttgcctggcatgcataggtcccagctactgacacgctgctctgagagagctagtcctgccttggaacaaattctgagtctggccagggccacagaaggccgagtcccctggatggtaatcctggctgctttctgcacttgaacatgaagtcctcctcgagacggcctgttgtgtgcctcctggtaaccaagaagcccacagtgtcatatgacccctgaggcatggactggagccccaaaggcagcgcacaccctgctcctgagcctgctgctcatttcctctctgtggctccatttgtagcacagttgttgcactgaggcttgtgcatgccgggcaaggccaagctgtctcaaagagcaaccagtcacctctgcgagggtgtgccaggagccgctgcaccagccaccaacctcacttgctgctgcacatggcacatcagtacttctaccctaaaggtagggccacagggccatctgcttttcctaaggcctctgctccatcagttatcaggaggcagccactcaggctgtaggaaactggccatcccagcttccttgagtagctgaggttgctggctggtccacctggtcctggcacacccttgcagaggtggctggttgctctttgagccagcttggccttgcctggcatgcacaggccccaggtactaacacgttgctccgagtgagcttctcctgccttgacacaaattcaaagtctggacagggccacagaaggccaagtcccctgggtggtaatcctggctgctttctgcacttgaacataaagtcctcctcaagacggcctgtggtctgcctcttggcaaccaagaagcctgcaatgccatatgagccctgaggcatggactggagccccaaagacagcgcacaccctgctgctgagcctgctgctcatttcctctttggctccgtttgtagcacagtagttgcactgaggcttgtgcatcccgagcaaggccaagctggctcaaaggctgcgcacatcctgctcctaactctgccgctcatttcctctctgtggctccatttgtagcacagttgttgcactgagacttgtgcatgccaggcaaggccaagctggctcaaacagcaaccagccacctctgcaagtgtgtgccaggagcagccagaccagccaccaacctcactcgctgcgggacatggtacattggttcttctaccctaaaggcagggccaagaggcagaccacaggccgtcttgaggaggactttatgttcaagtgcagaaagcagccaggattgccaccaaggggactcagccttctgtggtctgcactgccatacaagctctgagacgtggactagtgacatctgctttatagaaaaattaacctaagatctattaaagagttaaacatgccatctgattttactcaggcctctgctccatcagccctcaggtggcagccactcaggctgtgggaacctggccatccctgcttccttcagtgggtgaggttggtggctggtccaactggtccaggcgcacccttgtagaggtggctggttgctctttgagccagcttggccttcccggacatgcacaggccccaggtactaacacgctgctctgagtgagcttctcctgccttgacacaaattctaagtctcgccacggccacaaaaggccgagtcccctgcgtggcaatcatggctgctttctgcacttgaacatgaagtcctcctcaagagggcctgtggtctgcctcttggcaaccaagaagcctgcagtgcaatacgacccgaggcatggactggagccccaaaggcagcgcacaccctgctgctgagcctgctgctcatttcctctttggctccgtttgtagcacagtagttgcactgaggcttgtgcatcccgagcaaggccaagctggctcaaagagaaccagccacctctgcaagggtgtgccaggagcaaccggaccagccaccaacctcacttgctgccaaacatggtacatcggttcttctaccctaaaggtagggccaagaggcagaccacaggccgtcttgaggaggactttatgttcaagtgcagaaagcagccaagattgccacccaggggactcggccttctgtggtctgcagtgccatacgagctctgaggcatggactggtgacatctgctttatagaaaaattaacaagatccattaaacagttaaacgtgccatctgattttcctcaggcctctgctccatcagccctcaggtggcagctactcaggctcctgtaacctggtcatccctgcttccttcagtgggtgaggttggtggctagtccaactggtccaggcgcacccttgcagaggtggctggttgctctttgagccagcttggccttccctggcatgcacaggccccaggtaccgacacgctgctccgagtgagcttgccctgccctgacacaaattctaagtctggccacggccacagaaggccaagtcccctgggtggtaatcctggctgttttctgcccttgaacataaagtcctcctcaagatggcctgtggtctgcctcttggcaaacaagaagctcgcagtgccataccatccctgaggcacggactggagcgccaaaggcagtgcacaccatggtcttgagcctgctgctcatttcttctatgtggctccatttatagcacagttattcactgatgcttgtgcatgccgggcaaggccaagctggctcaaagagcaaccagccacatctgtaagggtccacttggagcagatggaccagccaccaacctcacccactcaaggaagtagggaatgcgtgtttgtaccatgcatttcactacaagtacattcccctgaggttggtggcctacattttcttctaggttttttgcttttaggtcttacgtttaactcttttatgcttcttaatttttgtataaagtgtaaggaagtggcccagtttcagtttgctgcatatggctagccagttttcctaacaccatttattaaataggcaatcctttccccagtgcttacctttgtcagttttgtcaaagatctggtggttttacatgtgtggtgtcatttctgtggcctctgttccattccattggtctatatacctggtttggtaccagtaccatgctgtttccgttactgtggcctcgtagaatagtttgaagtcaggtactgtgatgcctccagctttgttctttttgcttaggattgtcttggctatgtagactcttttttggttccatatgaaatttaaagtagtttttctaattttgtgaagaaagtcaatggtagcttgatggggatagcactgaatctataaatcactttgggtggtatggcactcaggcacagaaatgtccttgtgttaggcaataccattcaggacataggcatgggcagagacttcatcactacaacaccaaaagcaatggcaacaaaagccaaaattgacaaatgggacctaattaagctaaagagtgtttgcagagcaaaagaaactatcatcagaatgaacaggcaacccacagaatgggagaaaatttttgcaatctatccatctgacaaacagctaatatgcagaatctacaaagaacttaaacaaatttacaagaaaaaaaacaaccccatcaaaaaatgggcaaaacatatgaacagacacttcccaaataagacatttatgcagctaaagaacatgtgaagcaaaccacatcatcactggtcattagagaaatggaaatcaaaaccacaatgagatacaatctcacaccacttagaatggccaacattaaaagatgaggaaacaacagatgttggagaggacgtggagaaataggaacgcttttacactcttggtggtagtataaattagttcatccattgtggaagacagtgtgacaattcctcaaggatctacaactagaaatacatttaacccagcaatcccattactgggtatatactgaaaaaataataaatcattctaatataaagacacatgcacacgtatgtttactgcggcacagttcacaacagcaaacacttggaaccaatccaaatgcccatcaatgatagactggataatgtggcatatatacactatggaatgctatgcacccataaaaaaggatgagttcatgtcctttgcagggacatcgatgaagctggaaatcatcactctcagcaaactaacacaagaacagaaaaccaaacacctcatgttctcactcgtaggtgggaactgaacaatgagaacacatggacacagaagggtaacataacacaccgagaactgttgtggggtgggggaggagggagggatagcattaggagatatacctaatgttaaatgacgagttaatgggtgcagcacaccaacatggcacatgtatacatatgtaacaaacctgcacattgtgcacatgtaccctaaaacttaaagtataataataaaatttaaaaattaaaaaaaagttttaaaaaatttccaactggatttttttttgttttttgttttttgtgttttttttttgttttgtttttgttttgcagccacaggagttttagccaattcagatgccttgctccccacaatttggaacattcctttggatttgaccaagtcaggaagagatgggagaaaagtgaaacaacaataaaaccccaaacataaacaaaaagagttaagcaaaacaaacaaatgcacaattcatatgattaactgagtgttctaatggtaaggaggaattaaaagcagctggtgggtaatcttaaattttagtcattaaacaaaaattttaagacaaaactctaattcagctacttacctggaaataaggctcagactgggtgatcattctctgccatcttagaagctggaaaaacttacactcaccttccctgtcagaagcaagctgaaactcaggaaaggaggtgcctgctctcctttgtcaatggaagcaggaaaacttgccttccttgttggaaatgagtaaaacttcaaaaaaggagttgtacagcaaaatcaaccttacatctcaaccaaattttcggagatcagggactctgtgaaagggagaagctccacaacctcagcaaattatcctattggtttgggcaatacaaatagcccaggttggtatcaagcaataatgagatttatcaaaggtcaggaccacctttgtaatgtccttctctttttttatctttattggtagagtctgttttgtcagaaactgggagtgcaacaccttttttctgttttccatttgcttgaaatatttttctccattcctttattttgagcctatgtatggcactgcacatgagatgggttgcttgaagacggcatactccagtgggtcttggttctttacccagcttgccccgtgtctttcaatgggagcatttagcccatttacatttaaggttagtaatggtatgtgtggaatttatcctgtcgtcatgctgtcagctggttattttgcagacttacatatgtgcttgctttttagcatcattggactgtgtacttcagtgtgtttttgtagtagcaggtgatgatcttttctttccatatttagtgcttccttcaggagctctcgtaaggtagatctggtgataccaaattccctcagcatttgcttgtctgaaaaggatcttatttctccttcacttatgatgcttaattttgctggacatgaaattctgggctgaaatttcttttctttaatggcagttgatgtgggttggggtgtgtgctgcactcccgtgtgctctcagggcaagtaaagcaaaacccacccgtgtaaacacacacagcaaagtgatttaggaagtttccaaataaagggctgccgtatggagaggcaatgtgcaggctggtgcgtggctctagaggccaccttgctgcagctctccactgatatggtacagtccactagcatggaagctatggtgtgggcatctacgagtgccccgtaagcaggtgtggccaggctggggccatgggagaggcgagcagactaaggagtgctgagatcagaccagccccatctcaagtgcaagactgcccagcctccagagatcaggtctcagaggagaactctctcaaaagtgaacccccagcacagcacagctgctctacacaaacgtggctagacttcttttattaagcaagtctcctttttttaaaaagggaactctcggacctgatctctgctgggcaatcttgcatataagatgtggctggtatgacctcagcattcctaaagtgctgggataaagtgtctcacaagggcaagtggaccctagagagacagccatccctgacctctgggctccacatcacctgacttgctgctccaccactttgcttgtttcctgggtgctccatcccagagacatgtgagttagcaatcacttagtgtaatcagcccaggatggagggtctgtgctgtgggcccaagccagggttccctgtctggtgatgagtagtggagggtgtgtggtacccgtgggagatggactggcttgttctttgggtcaactgcagcttattggaggtgttgatagggcacttagggtctttgcacccttgcatcttctgagggtagcaagggcagttccactgcagaggcagtggcagaaaggatttcatttgctcctggaagctctgtcccaggaactgcagagttgctactggcttgatagctccagtggtgggctggctagagacccaggccaggaggatctgcccatcaagtagagagcccggccacttttctgtagggctgctgtggtatgctgggggtcccctccagtccctaattgccttgtattttccacggaagatgatagtctgccccttcctctggaagctctgtaccactgaggtacgaacctgttgccaatctgaacacacctataagatgtggctggaggcaagttgagaagtcttacctagtcaggacgaacgagaacagggacttgcttcaaaaaaaaaagtctggccacgtttttatagagcagctgtgctgtgctgggggttcacttcagcccctggtccgcctcagacactctgaagccctaaggctgaaatggctgggtcgcccaaacagcaaagatgacaatctggtcctccccctgggagctctgactcagggaggcctgagacctctgtcggccagagaacagcagtcaaggtagccagagaccctggttgaaagacttcacccgctgactagaaatgtgatcagggactgacgtaaacaagagtctggccacgtttttgtagcgtggctgtgctgtgctgaggtacctcttccaccccttgtcagcttgggctctccaaagcccgcaggccagaatggctagtcaccgaaagagcaaaggtgggggcctgcccctctccgggagctctgtcccaggaacatttcacatttccattggccaaggaatgctggtgggggtagctggaggccccagttgggaggtcctgtccagtgaggtggaacaggatcaggggcctgcttacagaagcagtctggccatgatttggtaaagcagctatgctgtgctgtgggatctcttctgtccctcgtcggtttgtactctccaaagcccgcaggctggaatgactacgttgcctgaacgggaaagatggcggcctgccccgtcttttctctcagagttttatcttgtttcgtggagcttaatttttagcctgttgattttactgtcttcattagacttgttgagaaagaatctgttctcttttaggtgagataaatgagaattcattgtcttctgtaaataaacctgttcatgtcttgttctctggaaagaagtctctttcagctatctgactttggtcacaatcatgtagagcagcagccagtctacaatgacgtaattgaatttccatttccagtgtttcctcgttgtgtcttacattgtccagttcagaactgagcattttattctcagttgtcaacatgctaagctgtccactgtactgaaatactgtgcttcctcaatttgttttaaggtgtgcacttttatccaactctcctcaagtcagagtacaggtaagccctggctgcctccagccactctcagggagaccaaaagccttcatacaccccaagttggggtacaaaagaggggggccacgaaggctgatcattcaaaataaaacaaaattaaaaagtattaaggcgaagattcaaaaaattttgcattatgtaatttgcacaaaagcaatgctatcacctcccctgtgtgaactagggagaggactgggccattctccttagagagaagtggggtggcttttagcagggcaaggggcttcctgaaacaatgcgtctcacaatatttggaatgactattgaaaagaagaacaaggtacaatcaaagtccttggccacattgtagaactttggaggaagcttcctccaaccgactgctgtcaccttcaccattccggtttttaaatcctgagtcaagccaataaaaaacaaaacaaaaaatgaaacaagaaaacaaataaagccatgccaatctcatgttgttttctgagaagtttggttttgtcaagaaagggtgtaacgcaactaagtcagagtccacctacaagcatttgcggtggacaatggaggggcctgactcatcatactcctgcttgctgatccacatctgctggaaggtggacagcgaggccaggatggagccaccgacccacacggagtacttgcgcttgggaggagcaatgatcctgatcttcatcatgctaggcgccagggcagcgatctccttctgcattctgtgggccatgccagggtacatggtggtgccgccagacagcactgtgttggtgtacaggtctttgcggatgtccacatcagacttcatgatggagttgaaggtagtttcatggatgccacaggattccatgcccaggaagcaaggctggaagagcgcctcggggcagcggaaccgctcgttgccgatggtgatgacctggccatcgggcagctcgtagctcttctctagggaggagctggaggccaccgtggccatctcctgctcgaagtccagggcaacatagcacagcttctctttgatgtcacgcacgatttcccgctcggccatggtggtgaacctatagccatgctcggtgaggatcttcatgaggtagtcaggcagttcccgcccagccaggtctaggcgcagggtggcatgggggagggcattcccctcatagatgggcacagtgtgggtgaccccgtcaccagagtccatcacgatgccagtagtacggccagaggtgtacagggacagcacagcctggatggccacgtacatggctggggtgttgaaggtctcaaacatgatctgggtcatcttctcgcggttggccttagggttcagggtggcctcggtcagcaggacggggtgctcctcgggagccacacgcagctcgttgtagaaggtgtggtgccagatcttctccatgtcatcccagttggtgatgatgccgtgttccatggggtacttcagggtcaggatgcctcttttgctctgggcctccttgcccacataggactctttctgatgcatgccccccatcatgccctgctgcctggggcgccccacgatggaagggaagacagcccggggggcatcgtcgcccgcaaagccggccttgcacatgccagagccgttgtcaatgacgagcacagcggtatcatcatccatggtgagctcattcaattgtagagcctttaaaagattatcattcctttttttcacactttcaatatcctccaaatatttcttttctcttagctggctctgatgtttcattgtgtctagctccagtcttagcatggcaatttcttcccgcaacgtactattttcatgcaagatgtctttttctttcttacaactaagagaaagctaagtaaacaaagagaacttttagttagcactcaatagattgacatatcatgatttcttctgaaattcaaaaataacatgtatttgtataatgaaagaatccccatagtggatatttaactggaaaaaaattggacaaaacttcaaacctaataagagtgtaaattcctccagtgatttatttttcatcgtctttaaataaatatttaaacttttaggaatctgctcctaaattcctaaaagtttaaatatttatttaaagacgatgaaaaataaatcactagaggatttttaagaatcccagaattaaaaaaagccttttttctgagttacaaaaaacccagaggcataaaatataagattaataatttgactacatttttaagattaggtttacactctgatatctaacctatcaaccacaccatcctaagagccttagctatgcatatatttggacagaagcaatttctcaaagttctttaagtttcttttacttaagaacgttttaccgatattctacatttctaatatttctatactcagttataagaattacatttatttataactgtcaaataagcactgtacccttctacactgtacacatctgtatctaggcattgctcttctacatataatactgaactcatttaagatcgcgattcttaaaaggagaggtcaaaaaatatacacagatgcaggattttccccaggtctgctgatgctacttctagtgatcctccacaaaaccacacttacttctgtggtgtaaatatataaatacaaaagaaaccttttgtttcaaaatatgaatggtaaataagatacaacttatagagattttcttagaaatcatgagattatttgccattgcggtaacttttatttcctctttataatgtttgaaacagtagtaatggtgaaataggggaaatatactgaactatttctccagaaagaaaatacttatcaataaattattactaaatgtgtatcatggcatgtcattcttttcaaacctctttacattgaaatgagaaactacttggagcaaactgttcctctctgcaaaagtaaggataatggtatccacaatgtggcctctgacccagctatacatttcctactttcttatcagtaaaaataatcaattgacttctctattaacattttttaaaaaactaatgtccaaaaacgagaaaatctgttttcagtagcaaaacttatttctgatgtggaaagatcatcaattcttatgaaaaatatcaaatacttctcctttggattgaggccattgtgcaggtcactactcaactgttgcaggcaaatgaaggtgaattaagaacatggctttatcctatacgtacgtatatagatatatgacaaaggatatatagaatatatacacacatatatatgacttaaaaatcctttatatttccaaaatacagttctttaaaatatacacacatataaaaacatttgaaaataactaaagaaaatacctcagaattcattttttcaaccacttctatctgcttttcttcatgaatcagaatctcatcgtgtaatattccagtgttctgttcttcacaaaattgcttctgagtatcattttgttcgtcactagaagaaattttaattttcatgaaatactggagctgtccctaaaatgatgtacagggcaagatggcgccatcagatgtcattcacacaatgcatatctgcacattattccaagacaaggcaaaggggtctcacatctgttaaccaggtgtccccaaccatgctggcaccagggactgcttttgtggaagataatttttccaggaacctgaggtgggggatggttccaggatgattcaagtatattacattcattgtgcactttatttctattattattaatatataatgaaataattatatctcaccaaaatgtagaatcagtgggagccctgagcttgttttcctgcaactagatggtcccatttgggggtgacggaagatggtgacagatcagaaaggcattcgattctcataaggagtgaacaacctatatccccctgcatgagcaacttacaacagggttcaggtcacactcaggacaatctaatgccaccgctgatctgacaggaggaggagcttgggcggtaatgcgagcgacagagagtggctgtaaacagatggagcttcacttgctcacctgcctcgaacctcctgctgtgtggcccaggtcctaacaggccagggactgctaatggtctgtgtcctgtaacccatactctttatgtttattgtttggaaacactttctacttatattcttgattcctatgtattttataaacaacttagaaattccttttagaacaagacagggtctaatattatgtttttaacataggactttgaaataattttatctgtgtatgagagagagatgtgaaataaactcatcgttaagcactttccattttacttttatttcatgcatattaagaataaaactgggaagtcctaggcagagcaattgggcaagagaaataaagggcatccaaattggaaaagaggaagtcaaactatctcttcaccaatgatattatcccatacctagaaaaccctaaagactcctacaaaacactcctagatttgatacatgaattcagtaaagtctcagaggttacaaaataaatgaataccaatcagtagcaccactatacatcaactacaaccaagctgagagttcatatcaacaatccaatcccttttacagtggctgcaaaaaggtgtgaagtacctaggaatatacttaatgaaaaaagtgagtgatctatataaagataactggaaaacaccaccaaagaaaataacagatgacacaaacaaatgaaaatacatcctatgttcatggactgaaagaactgatatagtgaaaatgaccatagtgcccaaagcagtctacacattctatacaatacctaccaaagtaccaatgtcattcttcacagaattattttaaaatgctgacattcatgtagaaccacaaaagagcctgaacagcaacagacataccaagcaaaaggaacaaatatgttggcatcacattacctgacttcaaatgatactctaagaccacagtaacagaagcagcgtggtactcgtataaaaacagatacatagatcaatggaacagaacagacaactcagaaataaagccactacaaccaagtgatctctgagcaaggatacaaaaacatacactggagaaagtacaggttattcaataaatggtgctgggaaaaaaagatagccacatgtggaagaatgaaactggatctctatctctcaccatatacaaaaattaattcaagatggatgaaaggcctaaacctaagacctgaaaacattggcctaggcaaaggatttatgaggaagaccctaaaagcaaatccaacaaaaatgaaaataaataaataagacctaattaaactaaaaagcttcagcacagcaaaagaaataatcatcagagtaaaacaacaacttatacaatgggaaaattttgaaaattatgatgctaacaaaggactaatatctataacctacaagaaactcaaacaaatcaacaggaaaaacgcaaataattccattggaaagtggccaaattacatgaatagacatttctcaaaagaagatgtacaaacggtaaacaagcatataaaaacacgctaaatatctctaatcatcagggaaatgtacaataaaaccacagtgagatatcacctcactgcagccagaatggccactattagaaatcaaaaaacaacagatgttggtgtggatgcggtgaaaagacaacagtgatacactgctggtgggaatgcaacttcatacaaatctatggaaaacagtatggagatttctcaaagaactaaaagtagatcctaccattttatccagcattctcatttccagatatctacataaaataaaagaaatcatactctcaaaaggacacccgcatacatatgtttactgcagcacaattcacaatatgcaaagatatggaatcaaccagtgtccatcaactgatgcgtggaataaagaaaatggacgtatatacatatatatatatctcacatcacatacatgtatcatatatatgtatgtgtgtatatacactcacacatatacatatgtacatagctgagactgggtaattcacacacatacatacctgagactaggtaattcataaaggaaagaggattaattgattcacagttacgcatggctggggaggcctcaggaaacttaacaaccatggtagaaggggaaggggaagcaggcaccttcttcataaggcggcaggagagagagaagagagaagtgaagcgcaaagagccccttatgaaaccatcagctcttgtgaggactcactcactatcacaagaacagcatggaggaaaccgaccccatgagccaatcacctcccagctggtctttcctcaacacctgggaattacaatttgacatgagatttgcatagaaacacaaagccaaactattgcgggggggggggggggttatccttatttttaaaatatctaaatgtcattatttataattcaaaatagcaatttttattacttatgattttgtttgaaaataaaatgatctcgtaaattttcttcacttttaacctattcagtcaaaatatagaaaaagctagatttgccagcagaaaattgttaactttttaatgagataaaaatgtataacaatatcactattattgtacagagaaaaaagtgaacaagaaaaggaatttaaaaacacagaatatgactatcacatacatacatgaactgacaaagagactaaaatctcctactggagattatgttaggacttgagcaaaagcttctaaaaataccaaaaacaaaaacaaaacacttatttttaagaaataaattatacagagaacacttctggttaagatgatgtatcaaaaaaaaaaaatcttcgtgagagctattattaaccaagtcatcataaccaaaactttaaatccacaattctggaatattaaaaagtttctttttgaacatagttaatggaaggcaacttttgaacagaaaatttctggttaaagttgactcaaacttaggaaagaattgacctgtagccatggtaacaagaagccagccagagccagttcaaaatctagtcaatcgatcaatgaccgaccactggctgtgctcaccaaccaatatcagtgtgagcagcttgcttctgaaagacagccaagcagcaacagctgctccatcagaatagacagtgcctgaccagtatagtcttactatcggaagcaaaaaattccaactgtctttttatttcaaataccgaaggtccataatcccttggaaagaatttgtgagtccattacatttaccaccctaaaaaaactaaaatactagtggccggatgtggtggcttacacctgtaatccacccaggtgggtggactgcctgaggtcaggagttcaagaccagcctgacaaacaggatgaaaccccgtctctactaaaaatacaaaaattagccgggtgtcatggcacgcacctgtaatcccagctcctcagggggctgaggtaggagaatcgcttgaacccaggaggcagaggttgcagtgagccgaggtcacaccactgcactgcagcctgggtgacagagcgagactctgtctctaaataaataaaataccagtaaagtttgtaatttctctaactcattttaccataattgcaattatcatgattaccagtaaaagaatagtgaataaccacaatattgggcttttctccctaagtgaaaaaatattaatataaagaatgtagcttattataaaaagccgaaagaatttttaaaatacatataattaccaggcaaaattgttaaaatgaaccttgtcaaacattttttaagtgagaatcaatcaaacaatatacccgggataaactccattcattcatttaatacctatttattaggtagctacgtctgataggctaggcctctttctaggaagtgaggatatggtaatgaacaataaaaaccctattcatgagagtgagataaacacacaataacaacagacagatacggcaaaatacacagtacgttagaggagaaaaactaaagcaggaaaatgaaatctttatgtgtttgatgggaagggtggtgggaaagttgggatggccagaaaaatccctgctgagaaagaggatttttctttaatacaaagaaacttttatttgtacatcaaagactctaaaaaatgatgatgttaacagagttgatgtcaagacacaaacaggtttgaagttaaagatgataaatcactttgtttcattgaaccttccctcaattacgttaagagagcatccctggtatgttcccaattgaatctcaagcctgacgcgtcctgatgatacaatcctaattcctttctgttagtcctcattatctctcttttttttcattttcttcattttctctggattaggaatcgtgctggtacatggttcttcctcaggaagtggttattccttaatgggtttctttttaccctttttcttcttcttagaaaggggattttaagtaaagagctgaagtaatggaaacagtaagctagaagaatatctggggaaaaagcattccagacacagggaactgctaagtgcagaggtgtgcctggagtctttaagcactagggataggtcaggaatagcaacaagttcagtgtggctgaaacacagcaatagagataagaaacagaagtttcagcaggagaggtaacatgccagatggtttactgcctttcagttattaggaggaactctgccacatactcagagtgaaataggaggcaatcagaagggcaggggcagaggaatgacaacatttgacttatgttttaaatacatccactgagataagaattgatgaaaggggaagtttttaaaaaccaggactatcaattcccgtctatgacactcatctaaactgcagatgacggtggctcagatgtacaagatagactggcctctggatatattcttcagatagacctgacaagatttactgagagattagatgtgaagtgtcaggacagagagaaagatcagtcaagaagatcttgactgagagagaaagatcagacactgaggtttttggcagagcaactggaagagttgctgttaaccaaagtaggaaagactacatgaggtgtagatttcaggaaggacatcagtagcccaattttggatctgacaagtgtgtgatacccaacagctaatcaaatagagatgtcaagtaggtgggatgatatagagatctggaattaaggaaagagatctaagttggagacatacatttggaaatcactagcatatacacagtagaaaaagtcacgaggggccaggcacggtggctcacgcctgtaatcccaacatgtcatgaggccaaggcgggcagatcacctgatgtcaggagtttgagaccagcctggccaacatggggaaacctgtctctactaaaaatacaaaaattagccaggcgtggtgttgcacacctgtaatcccagctactcaggaggctgaggcaggagaagtgctggaactcatgaggcagaggttgcaatgagccaagatcatgccactgaactccagcctgggggacaaagtgagactctgtcttaaaaaaaaaaaaattatgagaaagaagattgaggactgagccatgagaaacaacaatgtccaaaaggagaaagatgaggagcagcaagcaaaacagaccatgataaacggactagaaaggcaggaggaaaagcctgagggagtgaggtcctgaaagccaagtgaagacgccattagggaggagatgccctccattggctcaaatattgctgacagattaaatgaggtgtaagaaaaatgcctagatttagtacagaaaaaaattagtgataatcttgaggaaaaatagttctggaggagtgctgaaattgaagacttaccggcattgagatcaagagtgaatggaaagaaaatttgagttcatgagtgtagacagttctttaaggacaatatacttaacgctcatgactgagaatgatgtaattttcatccacagtcatggaaaagtgatagacaagaaatagtagcttccaaattttacataccaggtggagttttcaaattttatgtaaccattatatattctaaaggttataaaaattatacacatatggcatttagaaatgtcagaccaaggttttaaaggccctttgaacatttctagattacataagctgattatcattttgttcacgcttatacataaagaccaagaaatactaaaactctcaaggagaatatttcttgcttgataaaaatcagccaattctaggacagttgacactcatcaaatatacgaagtaattgatcacagtaaaatactgagttctattaacaggaataaagtgggagaaatgcagaaaataatcttattttataaatgtagttttcaaaatcatatgaagtcactggaaaaatatggtgaggtaaatactgaaatatatccttttctcaaagggaggataatgtcacacatgcagggcacttttacaaataaaagtcactgcattagcagcaccttccttttagcacaagggtcagcaaataagcacctgtgggccaaatccagcccactgcccgtttttgtaagtcaagtatcttggaacacagccatgcttattcactttacagtccatagtgtcagttagctgggtgtgatgttgcacacccgtggtctcagctagtagagactgaggtcagaggatcactagagcccagaaagtcgaggctgcagtcagccatgatcacacaactgcactccagcctgggaaacagagtgagaccctgtctcaagaaaatcaatatatgtagtccacaaagcctaaaatatttactaactagctctttgcagaaaaagctggccaactcctggtttagtagatcaaagattctttgatgtattttaataaaagttttaccaaatatactgaaatgtttatattaaatatagatccccatgtacaatcgcttggcaatattcagattgagggtccaatatttcagcactcaggcactgacaacaaaaatttagtaactagcaatcttgttgctaacaaggtacagtgtcaatgtagcatgtagcttccatttgcaacacagcagatattacaagaaatttaacaagaactcttaagatgtgtcatcaaactaaacgctttaaatacattttaattgtgaaataatcagtataccctacatctaacctcattttttaaaaatggttgcataatacattattttggggatatggaaattgagctatttcctattgataaggaattagactagctccaaattttttacataatactataataaatgtccttatacataagtatacatataacatatctatacaaatatcctttacatgtattatatatgcttactgttatatatgtgtgtgtgaatatgctactcaattaatgttcaaaatgtatttaccaacagtatatgaaatgtctttttcaatgaaaccatttcccctgcagcaacacggatggagctggaggccattatcctaagaaaactcatgcaggaacagaaaatcaaatgccacatattcttactcattagtgggaactaaacatgagaactcatggacacaaagaggagaataacatacactggggcctacttgagggaggagcatggcaggagggagacgaccaaaaaactacctttcgagtattttgtttactatgtggctggtgaaataatctgtaccccaagcctccatgatacagtttacctatataataaacctgcacacgtaccccgaagctaaaataaaagttcactgaaaagagaagaaaatgtcttttccctcacatttgccaatactggttatttttcaaataaattaatgactggaaaaaaaacggtaactgattgtttgctgattttcatttttctgattaacaggcaaggctcaatatcctaataaaagtataaaatttgttcatcatgaatattagctcaaattaggattagtttggcagcacaaagttacctcctgttcaatgttgccataggcttacctgtgatactcttcattctcagtgtcaggaaattgctggctttcaggtgttctgctcttccttggaggaattaatccatcatcaccattgccagcagtggcaccattagtcaggttttctgggaatccgacatgagtacttctgtgcttcttcatttcttcgatagccataaaattttctagctggaaaatacagagaataagaaattatctactttaggcacattatctattgataatcagactaaaaccaagaaagataaaataattggtctaaagctcctaaagtggcattacctagcattttatggcaccattcgggattattccataataatgaaagaatagctctagggtttgcacctcttcaaaattcaatgtacagaattctgagttaactatttaatttttcactgatgatttatgctacttacatgataggatcatgtatgcctacatttactacactttgttaaacaacataatgtaaaaatctaattcaacacaaacgtttgaatataaaggtatacctctctatcaccatccttatttatttctggttcttgagatcttttctgcagatgtaaaaacagaaggttaatttgcttgttgtatttctgtgacatttcctcttttggagtgcatgtttttaaaataattttattctgaagtaatcaagtatggacaataaaaattagaaagtaattaaaattaaactgttaaaataaataataattaaaattaagaattaactttttaatctatgtttagctactgccacatcactggcttctaacatgtgaaaaataattcaccttagacaaagggagaagaaaaacatgaaccagcaaacttaactttctcactatttgtttggactaaatttaatttgttatgtgttaaatctaccaaaaatgaatcagcagatgatttgtagtgttccaaaatcttcctcacttgaaaagagtttacctcatgaaaccctaactagtgagcacctacagtgcactgaagtgcttttttaaaagattcctaactggattgtaggcaccctttaaactattaggagccgaaatcaacaccaaacagaaagaaatgcaaattctcacattttaattgaaattatatactgtcatatgatagtgttatgtatccagattatctgcgtaagtccagttctaatatattctaatgtgtactaatgacagcagataaaattttttaatctctactgattttctgcaactgaaataaattagaatgttattgtgtttgtgcactaacaccaaaggtcccattctgcaagatatggttcttgtaataggcagttgggttgcttttatgacctggttccctccctgaacagaaacactgaggtcaacgagagaccacaaggcaggatatgtccttaaccttggtatcagtgactgacaatataaaactgtggattttcaatcacaggccatgattactctttaaccatgaatccagctcagggaatcagtgttacattgttcataattcctattgcttaataatatgattcaatcattgatgttactttctttatcatgttagggtgttgtaaaaataaaagaacaaacaaagttctgaaatttgtttttgcctctattccaaaaggagagattagctataagctaatcaagaaggcagataagaatattttaaaataagagtattttaaattttatagtgggttatgttgaagttaaatatcaaatattaaattagaatctattgattcttctgttaataaggttgctgattttattacaataaattttaagaatctattaaaatttttttttttttttttttcacatggagtctcgctctgtcacccaggctggagtgtagtggtggatgtcggctcactgcaagctccctctcctgggttcatgccattctcctgcctcagcctcccgagtagctgggactacaggcacccaccaccacgcccagctaagtttttgtatttttactagagacggggtttcaccatgttagccaggatggtctcgatctccagacctcgtgatccacctgcctcagcctctcaaagtgctgggattacaggcgtgagccaccttgcctggccaaaagattcttaaaaaaacaatctactgattctcaaagcctagtctgaaaggtaatttcatttggactatctaatattattaaggcaaaaaaaacacaacattaaacaaaagtttaaatttaaaagtttccatgcctctggctggccattttcactgcctttaagcctttgtgactcttcctctgatgtcagctttaagtcttgttctgttgaaaaatccatacattcagttaaaatcaaccacttaaaacagttaaaaactattgccttttaaaaacagatttgagacatttcattttatttcataaattgagtgtttcatcttttgtgaaattgtcatttaagaaataattctcaaaaacttcaaaaacccacttggggagatagcagatgtcaccagattgaagacaaacaaacatgtcaaaaattccctcacaaattcatccacccaacatccatgaacaaaaccaccagaaacacagctttaaaatacagtagaaacatataaggtgacacagtgtactgttctccacttcctaatagtaccttataaatgatttccaaaatcactgctgacacctttattagtgtacaacatcttcctaatatctaaaatgtttctctccactattctgacaaatttattttctttttttcttttttctttttttttttttatgagctagagtcttcctctgtcaccaggctggaatgcagtggtgtgatcagctcactgcaacctccgcgaccctggttcaagtgattctcctgcttcagtctcctgagtaactgtgattacaggcaagcaccaccacacccagctgatttttgtatttttagtagagatggggtttcaccattggacaggatggtctcgatctcctgacctcgtgattccctctgaaagtgctgggattacaggtgtgagccaccacacctggccttattttcatcttttgaaacaatgctatatgaagtcttccttgattctgcatgtctttccccaaataaacaggtacctccttccttgaggctgccttagtactttactgatttttctactgcatcttgaccacctaaactgtacattattcctccacgtctgtcccctctgctccaagactgcaggggagagtcttgcacatcatctttgtaaaaacagtctttgttttactcagaaatattttattgagtcctgctaaatacatgctaggcattagggtttaaaaagaattaaaataaagcatgtcagagatggcttttctagaacacatgcccaagcagagacttaaatattgagactagccagattaaaaggtgtagagggcaggaaagggtgacggcatgccacgcagcagcaagagcgggagcgactcctgaaagagtgaaagtatttgcctacaatagaaggatgagtgagtagggcactgccagcagttcagtaatgccagagacagggcacacagggaaaagggctaaagatggagagtggggcagaagtcagattatgaaagcattatgtgtaattttaagatgcttgaacattaatgttcaaaagtggtcccgggtcctatctgcatttagatatagatcatttcaatgccaaaaccaatattcctagtgaacaattattcattaagacaaggtgacagatagctcatgtggacacagctgagatgatacaatgtagcaaattctaaacaattctcatgaacacttggaaagtcagttctataataaagtcatacaaattataataaatcagtaaatatttggtttcggaagatgctttgtaaagttataatgcatatgaatacaattaacagtcgtgaattcagagctgtgaaaataaatcaaagaaaccacattgtgtttgagtcagcaatctttagatttctatccagtcttcccatccagtccataaattctaagtataatcctggtactcactctcaagtttacgttaaatactatcccattacaaaaaaacactctttctcttacttcttttcattatgtcctgctaaaaagattctgattggctgcaggcggcaagagggaaaaacaaaaagcacattttgcagaaaatgattatttagaagtcagaactatgacatgaagccaagcagggcactctaggaccgaatttgctgtgctgccttcatacgctccttgctctttcttttctggcagctgtgactcacacaggtcatggagagtatcattccctaagaggaacaactccgatattcatctttatctattaagttcatctgtcccaattctgtgttctgtggatgctgactttctgtcacggacgatgatgcacatggacatttattactgactttcagattcttggatctttgacaagtcttattacttagagtcaaactagtaggatgcgagttataaatgctgattatccaattacctactcaaaataccctacacgaatattccattaaacatgcatcgaaaaacattagtcattcctgctgacctgctgctctttgctctcctgtattcaccagaaaatttcctactccttcctcatgtccaggttaaatactagtgtgcaatctggaaacctgtacatcatctgagatttctctctgtcccccaagcctttctcattcaattatcactaaatcatattgactatacctctcttctgcctctgttttatattcccactgccactgggaacacaaacatttacaaaatgacttctatttaaaagaaaactgccaactattaatgttatttcttacaggaaaaaaaattaagcaaaacaagtgaaaaaggcataacgaaggccaacatagtaaaatgagtaactgagatttctaacgttatttattttaccatggacgggtgaaaaccttgtaatacattgatgctactccaaggatgtgtgacatggaaactatagctgactactgcaaaagcttcctttgtctcctggtttctttgcatgattatctcccatcaatcccaggaaactataggccacaggccaaatccaatctgcattatggttttgtaaataaagttttataggagctcagtcatgcctgtttgcttacatataatcatggtggctttcacactacaacagcagacaacagcacggttaagtagatatgacagagaccacatagtccaaaatatttcccacctggtcctttaaagaaaaagcttgctaacccattttacaccataaccagaatgccttaatactcaaatttaatcttgtggctcccctgctcaaatttctccaatgagccccctccagcacacattgttggctccctatcaatagccattcctcattctttctggcagaaaaaacataagtctattgggatatttaatatcccaatccccctcctcagcctcagaaagaaatgtttattctaagctaatcagatatttaccttcccagtgcctggtttgggaatgagcatgtggtatgacccagccaatgaaatgttacaggaagccccttgcatgcttctaagttttctccctgtttaaaagacacatgtgaagaaaagcagccctttcgatgttgtgttgtgagaacaagatgtttggagctgctgcagattagccaaccacaaaaggagacgtgaataaaacactgtcaacagcacagctgaaagagggacaagtgggatccctaggatatcaatgaacaaaaaaacaactctggttcctagtgttttaggcactgctcatctagtatttgcagtccaaagcattctacctggtaaatttcccatggcccacaggaaaagacctactcatttctatagtattaaaaagtctatcgtaaacttgccttagctaagtattcacctcactcccaacctctggtatctcacacttttggtactagcaaaagtgaactgctcagaaaccctgccatgttcactcaagcatcttgtcttctgcacttgctgctcttcctcccaaacgggcaatctcattagatgttccttctggcaaacacactatctcactccatgttccttctgccaaatgtcattcctctgcttctttccctgaaaaattcttctcactctgcatgcttacattaaatcctgcctcctttctttctaaagctttcactcctcatcacatatgtctggcacacaatcaatatcacatataataaatcataattataagattccagtgggcatctagcacacagtaagcactgaataaagcagcaaaataataaaaatgacaatgataataataacaagctcctgtctgtttttgtgttctgtagccttagaaaaactgcttagtatctaaaagacatttgacagttatttgttaagtggacaagtgaaaacataaataaaaatgttttctttgtaaattctgttgaaaaaccacagaaatgaaatagaaacacttctgttgtgagcaccttaaagattaaaactacatctattccatctttgtctcctgcaacttataaaacctaacttacagaagctctttgataaataggtagctaaattaaaggtgtcctcatacagtttggattgtaccatgtattaggtgtccacatccaggtagcatactagcatttttgttactgtgaaacatttttatatttttattataatctgctgacccttgcattgggaaaattgtacattatgacaatcttttggcaaatggtagcagagcaccttcttctaacaaaattactgttatcatgacaattaaccagccggtggaagaacacatcttgttccaacaaagtaaatgcatctctttcaacttcaaaataggaggaatgaagtcagtaacagtgagaccttgttggcacaagcatatgtaacatgacctgtgcttcactgttcttttgtgaacaaaaattccttacttttactttttaaatctatggtaggacctcccagagcagggctccacaactccccggccacagactggtaccagtccacggtctgtgaggaaccacgccacacaggagtaggtgcgcagcaggcaagccagggaagcttcatctgtatttacagccactccttatggttcatattacagcctctactctgtctccagtcagatcagtgatagcattagatactcataggagcatgaaccctgttgtgaactgcccatctgagggatctaggttgtgtgcttcgtatgagaatctaatgcctgatgatctgtcactgtctcactttgcccccagaagggaccatctagttgcagaaaaatcagctcagagcttccactgattctacattatggtaagttgtataattattttattatatattacaatgtaataataatataaagtagcacaataagtgtaatgtgactgaacaatcctgaaaccatccccaccttcccccagcccatggaaagattgtcttccacaaaaccggtccctggtgccaaaaagattgtggacaactgacctaaagtaattcactatcacaagtcttacctgggttgctgttttcagaagagtattttggcatctgcttttctttgtagtcagaaagtaattcacaaattctatgtataaaaatataacaaataaaattactgttttaaaatactgatctggaaacttaccaaatgtaaaattcttagagtatttcaaacaatatcagaatatcagaacttaacagtattatcccatccacttatgcgtacgttctacaaacttctcatgaagcttctaattaaagaagaaaaaaaagtaagatgaaatactcataaatcgagggcactttgacccagtaaattaacttgcattagcctgacataatagaaagtgtcccaactctaaataagtcctagctccataatgaacagctatttgctcttgaacaagctgcttctcttaggctcaatgtcttctacaaagtgaggactatgctgccttattttactaggttgttataatgatttaacacgataacatttttttaaatgctcaaagaaatagtaaaacaatggaataatttgttcctaaactttatgactgaaattatcttggaatcccaaataaaacccagtgcgaattttgttcataggttctaatatgcaaatgttgtagttttcaggaaatgttattaagtcctaattttgcttcttagttgtcctactctttatggcttctaattcagggcatctcaactatgtcatagtttgtaactaaattttttcataaatatctcattaaagtagataatgtgattgtccactattacggagttgatcaatcacgccaagggcagaaaaaccaatggatgtcaagacctgacttggaccaatgatccttctctacagactcaaactctcagccagatgtttgttacgatgatgctttatatacatgttcatctccagctgacatgggagacgaaaaccctacttttatttttttttaggttccacgaagaagttgtaagttgccattctctaatttttaacatacatactaacaatatatttggtacacaacaccccacacgttatttggctctggtgtcatctcacagaccaccttacatgactatttttattgcgcaaatcacaatttcaatgtttttgtggcacccattctgctttgattcacaccatttccttaaagctactcagcaaacagtcaaatgaccttccagtgactgcgcaaaatatagaatgcttcaaaaatttgtgtggccgccttatgcaagggccagctccttgggaggctgaggcaggagaaatgcatgaacccacgttgcaatgaactgagatcgcgccactgcactccagcctgggcgatacagcgagactccatctcaaaaaaataaaataaaataaaataaaatagtaaagtttgcaattcctctgactcagtttaccataatgacaattatgattactattaaagaataaatagtgaataaccacaatattgggcttttctccctaaataaaaaaattaatataaagaatgtagcttattacaaagagccaaaacgattttaaaaatgcagacaattaccaggcaaaactgttaggaaagaaccatgtcaaacttttttttttttttttttttgagatggagtcttgctctgtcacccaggctggagtgcagtggcacgatcttggctcactgcaagctccgcctcccgggttcatgccattctcctgcctcagcctccatagcagctgggactacaggcgcatgctgccacacccggttaatttttttgtatttttagtagagacggggtttcactggtctccacctcctgacctcatgatccacctgcctcggcctcccaaagtgctttgattacaggtgtcagccaccatgcccgacccatgtcaaacattttcaaagtgagaatcaatcaaacaatatacacaggataaactccattcacttatttaataagtatttattaggtagctacatccaatatgctaagcctttttctaagcagtgaagatatggtagtgaaaaataaaaaccctattcatgacagtgagaaaaacacacaataacaacagacagataaggcaaaatatacggtatgttagaggagaaaaactaaagcaggaaaatgaaatgtttatgtgtttgatggggagggtggtgggaaagttgagatggccagaagagtccctgctgagaaagggttttttttttctaatacaaaaaaccttttatttgtatatcaaagactctaagaaatgatgacataaggttaacagcgttgatgtcaagatacaaataggtttgaagttagagatgataaatcactttgtttcattgaaccttgccttgattaccttagagagcattccttgtatgctgccaattgcatcttaagcatgatgcgtctgggtagtacacggttcttcctcagaaagtggatgttccttaatgtgtttctttttaccctttgtcttcttcttcttagaaaggcggttttaaataaagaactgaaggaatggaaagagttaagctaggaggatatctgggggaaaagcatcccagacacagggaactgccaagcacagaggtgtgtctggagtctttaagcactaggggtagatacgggatggcaagaattcagtgtggctgaagcagagcaagggagataatcaggaggaactttgacccatactcagagtgaaaaggaggcaatcagaagtgctggggaagaggaatgacacaatttgacttatgttttaaatacatccactgagttaagaattgatgaaaagggaagtttttaaaagccaggacgatcaattcccagtctatgacactcatgactgcagatgacagtggctcagatgtacaagatatgactggcttctggtcatattcttcaggtagacctgacaagatttactgaaagattagatatgaggtgtcagagggacagatgagtcaagaatgacaatgacatttttggcagagcaattggaagagttgcccttaaccaaagtaggaaagactacatgaggtgtagatttcaggaaggacatcagtagcccaattttggatctgacaagtgtgtgatacccaataactaaccaaatagagacgtcaagtaggcaggctgatataaaaaatctggaattaaggagagagatctgagctggagacatacatttggaaatcactagcatatacacaatagaaaaagtcatgaggggccgggtgcagtggctcacacctgtaatcccaacactttgtgaggccaaggcagacagatcacctgaggtcaggagtttgagaccaggctggccaacatggggaaatgctgtctctactaaaaatacaaaaattagccaggcatggtggcacacacctgtaatgccagctactcaggaggctgaggcaggagaatcacttaaacccaagaggcagaagttgtagtgagctgagatcacaccactgaactccagcctgggggacagagtcaaactccgtctcaaaaaaagaaaaagaaaaagtcaggagaaagaagattgaggactgagccctgggaaacaacaatgtccaaaaggagaaagatgaggaggagcaagcaaaacagaccatgatgaatggactagaaatgcaggaggaaaagcttgagggagtgaggacctgaaagccaagtgaagacgccgttagggaggagacgccctccactggctcaaatattgctgacagattaaataaaatgaggtgtaagaaaaatgcataatttacagaaaaaaattgtgataatcttgaggaaaaacaatgttggaggactgctgaaattgaagacgccggtgtgagattaagagtgaatgaaaagaaaatttgagttcgtgagtgtggacagttcttttaaggacatcatgcttaggagtcatgactgagaatgttgtaattttcttccacagtcatggaaaagtaatagacaaatagtttcaagttttatataacaggtgtagttttcaaattttatataacaattatatattttaaaggttataaaaattatacacatgtggcattaaaaatgccagactgaggtgttaaattcttaaaactatagaactaaaagtcgccttgaacatttctagattacacataagctgattatcattttattcatgcttatacataaagaccaagaaatactaaaagtttcaaggagagtatttcttgcttgataaaatcagccaattctaggaaaactgatactcatcaaatatacaaaataattgatcacagcaaaatactgggttctattaacaggaataaagtgggagaaatgcagaaaataatcttattttataaatgaaatttttaaaattatatgaagtcactgtggaaaaatatggtgaggtgaatactgaaatatatccttttctcaaaggaaggataatttcacacacgcagggcacttttacaaataggagtcacttcacttgcagcaccttccttttagcacaagggtcagcaaattagcaccttgggccaaatccagcccactgcctgtttttgtaagtcaagtattttggaacacagccatgcttattcactttacagtccacagtgtcaattagctgggtgtgatgttgcacacctgtggtcccaactagtagagaggctgaggtgggaagatcactagagctcagaaagtcaagacttcagtgagccatgatcacacaactgcactccagcctgggaaacagagtgagaccctgtctcaaaaataaattaatttatatagtccacaaagcctaaaatatttactaactggctctttgcagaaaaagctggccaactcctggtttagcagatgaaagatcctttgatatattttaataaaagttttacccaatatactgaaacgtttatattaaatacagatccccatgtacaatcccttggcaatattcagattgagggtccaatatttcagcactcaggcactgacaataaaaatttaatgactagcaatcttgttgctaacaaggtacagcatcaatatagcatgtagcttccatttgcaacacaggaaatattacaagaattttaacaagaactcttaagatgtcatcactgatgctttaaatacactttaattgtgaaataatcagtatactctagatctaacctcacttgtaaaaaatggttgcatactacattaatttctgggtatgaaaattgagctatttcctattggtaatgatttacttttgataatgataatttcctattgataaggatccatctttttgatataataatgctgtaataaatgtccttatacataagtatatatgtaacaaatctacacaaatatcctttacatatattatatatccttattgttatacatgtgtttgtgaatatgctactaaattaatgttcaaaatgtatttaccagcagtgtatgaaatgtcttttacaatgaaaccatttcttttgcagcaacacagatggagctggaggccattatcctaagcaaactaatgcaggaacagaagatcaaatgccacatattcttactcattactgggaactaaataatgagaactcatggacacaaagaggagaataacaggcaccaagggtctacttgaaggtggagcgtcgcgggagggagacgaccaaaaaactaacttttggtgttttgcttattatgtggctgatgaaataatctgcagtccaaatctccatgatacactttacctatataataaccctgcacatgtacccctgaaactaaaagaaaagttcactaaaaagaaaagaaaatgccttttccctcacatttgccaatactggttatttttcaaataaattaatgcctggaaaaatggtaactcattgttcgctgattttcatttttctgattaacgggcaaggctgaatatcctagtaaaactataaaatttgttcatcatgaatattagcccaaattagggttagtttgacagcacatagttatcttctattcaatgttgccataggcttacctgtgatactcttcactttcgttgtcaggaaattgctgattttcaggtgttctgctcttcctttgaggaattaatccattatcaccattgccagcagtgacaccattagtcaggttttctagtaatcccacattattactttcatgcttcttcatttcttcttcaaccttgagtgggatattaaggatagttatcactttattgaataaaaagaacctttttaattgattctatcaattgactcagtttgtcattattttagtcattaaaaatatttcacacttaaatttgatcatatatatagaaatattaccatataactttaagatgtaattatcatctcattaatatatcacagaaatttttgtaaagtttgcttcatttctgtttcaatgaatgaaacagaattttccaaaattcaaaaagggccctccttcattttgtgcttttattctcaatcactcttcagaatcttatgtatgtatttaccccatttgattcatgggaacacacaaataaaaagacaaagatgcaaaatgtgtcctcttccgtctttaccacctagattttacattaaacagtcagatttagaggatgacacactgtgcggcttcaggaatagaaaggaagtttgcccttttctgcgctaagatattcttctaccccactgcctttgagcattcttttttcatttggttgctgggatatcaaaaacatgatggtgctcactgaaaatgggagccaaagtttgccacaacacaagaagcagagtgaaactgctgacgtgcaagcatggaattccagaaaatgagatgctccccaaatttcacattgaatagccatacaattttctagctggaagatacacagaataaaaagctatcttctttagccacattatctattgataatcagactaaaaccaagaaagataaaatgattggtccaaagctcctaaagtggcattacctagcattttatagcaccattcaggattgttccataataatcaaagaatatctctaggctttgtatctcttgaaaactcaatgtacagaattctttctgagttaaatattaactttttcactgatgatttatgctacttacatgataggatcatgtatgcctacacttactacattttgttaaacaacataatgtaaaaatctaattcaacagaaacatttgaatatgaaggtatacctctctatcaccatccttatttatttctggttcttgagacattttctgcagaggcaaaaacagaaggttaatttgcttgttgtgtttctgtgatgtgtcctcttttggagcgcatgttttaaaaaaattttattcttaactaatcaagtatggacaatgaaaaattagaaaataattaaaattaaaatttaactgttaaataaataataattaaaattaagaattaactttttaatctatgtttagctactgccacattactggcttctgactaacatgtgaaaaataattcaccttagcccaatgaagaaaaaaaacgtgaaccagcaaacttaatttggtcaccatttgtttggactaaacttaatttgttatgtgttaaatctaccaaaaatgaatcagcagatgatttgtagtgttgcaaaaccttcctcacttgaaaagagtttacctcatgaaaccctaactagtgagcccctacagtgcactgaagtgcttttctaaaagattcctaactggattgtaggcaccatttaaattattaggagccgaaatcaacaccaaacagaaagagatgcaaattctcaaattttaattgagattatatactgtcatatgatagtgttatgtatccagattatctgcttaagtccagttctaatatattctaatgtgtactaattacagtggataaagattttttaacaatatgtactaattttctgcaactgaaataaattagaatgttattgtgtttgtgcactaacaccaaaggttccattctgcaagatatgattcttgtaataggcagctgtgttgcttttatgacctggttccctccctgaacagaaacgctgaggtcaacgagagaccataaggcagaatatatttttaagcttggtatcaatgactgacaatataaaactgcagattttcaatcactggccatgattactccttaaccatgaatccagctcagggaccatcagagttacattgttcataattctattgcttaataacataatccaataattgatgtaccttcttcatcatgttcgggtgttgtaaaaataaaagaacaaagttctgcaatttgtttttgcctctattccaaaaggaaagattagctataagctaatcaaaaaggcagatgagagtattttaaataaaaatattataagagtattttaaattttatagtggttatgttttttaagttaaatatcaaatgttaaattagaatccattcttctgttaatgagattactgaatttattaaaataaattttaacaatctattaaaaaattctttaaaaaatctattgattctcaaaacctagtctgaaaggtaatttcatttggactatctaatattattaaagcaaagaaaacaacattaaatcaaaaatttaaatttaaaattttccatgcctctggctggctattttcactgcctttgaacctttgtgactcttcctctgatgtcagctttaagtcttgttctgttgagaaatccatatattcagttaaaatgaaccacttagaacagttaaaaactattgcctttataaaaatagatttaagacaacattttatttcataaattgagtgtttagtttttcatgaaatagttatttaggaaataattctcccaaacttcaacaaaccacttggggagacacctgatgtcattcactcacaaattcatccacccaacataaatgaacaaaaccaccagaaacacaactttaaaatacagtagaagcatctaaggtaacacagtatgttgttctccacttcctaatagtgaagcagtaaatgtaaagaaaaggaaatttagttttaaagagaaacaagttttcccgcacttagctagtctgactctaaggatagtaacaagcagggcccaggaaaggtcgtggtgaccctgcctgagaagccagagcccacaggtatgggctccagacatcccagagcaaggttaagaaaacaaaatcctttactgtctccccttcccctcagcattcactcagagctgtttttacaaatgcatactattcgcaagttcctgttgaccttcaatgcagctgcaaggtcataagctttgctgaggttgcaaaactgtcactatatgattaactgcctttgttctgcttctgtaagcttgcctacataagccaagccctgtctttgttcagggctcagctttcggatgcaaatctgctgagctgttgcgaacctaaatgaaatcctcctgtttcacccacttggtctctcctgcctcctgctttctgcaacaatagtaccttacaaatgatttcaaaaattactactgacacctttattagtgtacaatgtcttcccaatatctaaaatgttttcctccactattctgacacatttattttcatttttctttctttctttttttttttttttttgagccagggtcttgctctgtcaccaggctggagtgcagtggcgcaatctcagctcactgcaacctctgacactccctggttcaagcgattctcctgtctcagtctccggagaagctgggattacaggcatgtaccatcatgcccagctaattttcgtgtttttagtagagacggggtttcaccattggccatgatggtcctgatcttttgaccttgtgatctgcctgctccagcctcccaaaatgctgggattagaggtgtgagccaccacacttgtccttatatttatcttttaaaacaatgctatgagaacgtcttccttgattctgcatgtctttccccagataaacaggtacctccttccttgaggctgccttagtacttcactgatttttctactgcatctttaccacctgaactgtacattattcctccacatgtctgtcccgtctgctccaagactgcagaggacagtcttgagcatcatcttactcacattttactcagaaatttcttattgagtcctgctaaatacatgttaggcattagggtttaaaaagaattaaaataaagcatgtcagggatggcttttctagaaaacatgcccaagcagagacttaaatattgagactagccagattaaaaggggtagagggcaggaaagggtgacggcatgccacgcagcagcaagagcgggagcgaggcctgaaagagtgaaagtatttgcctacaataggaggatgagtgagtagggcattgccagcagctcagtaatgccagagaaagggcacacagggaaaaggcctaaagatggagagtggggcagaagtcagattatgaaagccttatgtgtaattttaagatgcctggacattaatgttcaagagtggtccctgatcctatctgcatttagatatagatcactttaaatgccaaaaccaatattcctactgaacaattattcattaagacaaggtgacagatagctcatgtggacagagctgagatgatactatgtagcaatttctcaataattctcatgaacacttggaaagtcaattctataagaagtcagagaaattataataaatcacttaatacttggtttgggaaggtgctttctaaagttatagtgcctatgaatttaactaataattgtgaattcagagctgtgacaataaagcaaagaaaccacattgtgtttgagtcagcaatctttagatttctatccagtcttcctacccagtccgtaaattctaactataatcctggtactcactctcaagtttatgttaaatactagcctatacaaaaaacactctttctcttttttcattttgttatttatatattgctttgtttaaaggaagaacacaaaaatgccctgctaaagggattctgtttggttgcaggctgcaagcggggaaaaaatcaaagtgtatttcacagaaaatgattttttagaagtcagaactatgacatgaagtcaagcagggcactctaggactgaatttgctgtgctgccttcatacgctccttgctcgctcttttctggcagctgtgactcacacaggtcatggagagtatcattccctaaaaggaacaactccgatattcatctttatccattaagttcatctgtcccattctatgtctgtggatgctaacttttgatcattgatggtgatacacatggacatttatcatcaactttcagattcttggatctttgacaagtcttattagtgagagtcaaactagtaggatgcgagttataaatgctggttatccaattacctattcaaaatatcctacatgaattttccattaaacgtgcatagaaaaacattagtcattcctgctgacctgctgctctttgctcttctgtattcaccagaaaatttcctccttcgtcctcacatccaggttaaatactactgtacaacctggaaacctggaaattatctgacatttctctctgtcccccaagcctttctcattcaattatcactaaatcatattgacgatacctctcttctgcctctgctttatattcccactgccactgggaacacaaacatttacaaaatggcttttatttaaaaaaaagcctgccaactattaatgttatttcttacataaaaaaaattaagcaaaacaaatgaaaaaagcataacaccaaaaaaacaaaggccaacatattaaaacaagtagttgagattcctaactttatgtatttcactaaggacgggtgaaaaccttgtaatacattgatgctactccaaggatgtatgacaaggaaactatagctgactactgcgaaaacttcctttgtctcctggtttctttacatggtaaagaaccttccatcaatcccagcaaactataggccacaggccaaatccaatctgccttatggctttgtaaataaagttttataggagctcagtcatgcctgtttgcttacatataatcatggtggctttcacactacaacagcagacaacagcagggttaagtagatatgacagagaccacatagtctaaaatattgcccacctggccatttacagaaaaagcttgctaacccgttttacaccataaccagaatgccttaatactcaaatttaatcttgtgactcccctgctcaaatttctccaatgagcccctgcagcacacattgttggctccctatcaatagccattccttattctttcttgaagaagaaatccaagtctattgggatatttattatcccaatccccctcctcagcctcagaaacagaaatgtttattctaagctaatcaggtatttaccttcccagtgcctggtttgggaatgagcatgtggtgtgacccagccagtgaaatgttacaggaagccctttgcatgcttctaagttttctccctgtttaaaagacacatgtgaagaaaagcagcccttgcgatgttgtgttgtgagaacaagatgtttggagctgctgcggattagccaaccatgaaaggagacgtgaataaaacactgtcaacagcacagctgaaagagggaaaagtgggatcctaggatatcaatgaacaaccaaaacaactctggttcctactgttttagccactgttcatctagtatttgcagtccaaagcattctacccagtaaatttcccatggcacacaggataagacctactcatttctatagtattaaaaagtctatcataaacttgccttagctaagtattcacctcattcccaacctctcgtatcacacacttttggtactagcaaaagtgaactgctcagaaaccctgccatgttcactcaagcatcttgtcttttgcacttgctgctcttcctcccaaacaggcaatctcattagatgttccttctggcaaacacacgacctcgctgcatgttccttctgccaaacattcttcttctgcttctttacctagaaaaattcttctctctctgcatgcttaccttaaatcatacctactttttcccaaaactttcattcctcatcacatatgtctggcacataatcaatatataataaatcataattataagcttccagtgggcatctagcacacagtaagcactgaataaagtagtaaaataatgaaaatgacaatgataacaaaaagctcctgtctgtatttttaattgtttgtggtctatagcattagaaaaatggttactatctaaaagacatttgatagttatatgttaagtggacaagtgaaaacataaatagaaatgttttctttgtaaattctgttgaaaaagcacagaaatgaaatggagacagctctattatgagcaccttaaagatcaaaactacatctattccatctttgtctcctgcaacttataaaacctaacttacaaaagctctttgataaatagatgactaaattaaaggtgtcctcacacagtttggacaatataatgtattaggtgtccacaaccaggtagcatactagcatttttgttagcgtgaaacgtttttctgcttttattataatctgctgagcctagagttgggcaatttgtatatttattatgacaatcttttggcaaatggtagcagagcatcttgttctaacaaaattactgttatgatgacaattaaccagcaggtagaagaacacatcttgttccaacaaagtaaatatatctctttccaacttcaaatgaggaggaatgaagtcagtaatagtgagaacttattgggacaagcatatgtaacatgacttgtgcttcagtgttcttttgtgatcaaaaattccttacttttacttttttatctatggtaggaccacgcagagcaggggtcctcaactcccaggccacagactcataccagtccatggactattatgaaccacaccacacaggaggaggtgagcagcaggcaagccagggaagcttcatctgtatttacagccactccttatggctcatattacagcctctactctgcctccagtcagatcagtgatagcattagatactcattggagcatgaaccctgttgtgaactgcccatctgagggatctaggttgtgtgcttcgtatgagaatctaatgcctgatgatctgtcactgtctcactttgcccccagatgagaccatccagttgcagaaaaataagttcagagcttccacggattctacattatggtaagttgtataattatttcattatatattacaatgtgataataatataaagtagcacaataaatgtaacatgattgaataatcctgaaaccatccccaccctcccccagcccatggaaaaattgtcttccacaaaaccggtccctggtgtcaaaaagattggggacaactgactaaagtaattcactatcacaagtcttacctggattgctgttttcagaagagatttttagcatctgtttttctttgtagtcagaaagtaactggcaaattctatgtataaaaatgtaataaaccaaattactattttaatactgatataaaaaaacttaccaaatgtagaattattaagagtatttcaaacaatatcagaataacagaacttaatagtattatcccacccacttgtgagtacattctacaaacttctctttaagcttctaattaaagaagaaaaaaatgtaaggtgaaatagtcataaatcgagggcactgtgacccagtaaattagctagcattagcatgacataatagaaagtgtcccaactctgcataagtcctagctccataatgaacagctatttgttcttggacaacttgcttctcttaggctcaatgtcttcttcaacaaagtgaggactttgctgccttatttcactaggttgttataaagatttaacgagataacattttttaaatgctcagagaaatagtaaagcaatggaataatctgttcctaaactttatgactaaaattatcttggaatcccaaataaaacccaatgcgtattttgttcataggttctaatatgcaaatgttgtagttttcagaaaatgttattaagtcctaattttgcttcttagttgtcctactctttatggcttataattcagggcatctcaactatgtcatagtttataactaaatttattcataaatatctcattaaagtagataatgtgattgtccactattacggagttgatcaatcacaccaagggcagaaaaaccaatggatgttaagacctgacttggaccaacgatccttctctaccgactcaaactctcagccagtagatgtctgttaggataatgctttatattgatgttcaattccagctgacatgggagaccaaaagtctacttttattttttttttagtttccacggagaagtagcaagctgacattctgtaattttcgacatacatactaacaatatattttgcacggaacatgttattcagctcaaagtcatctcatagaccatcttacatgactatttttgcagcacaaatcacaatttcaatatttgggtggcacccattttgctttgattcacactatttcctcagagctagtcagcaaaaatagtcaaatgaccttccagtgactgcacaaaatatggaatgcttcaaagatctgtcctgcctccttatgcagaagccacgctaactttccccgtattgttccaattttaggatatgtgccgccgaagcaagcacaaagccctacttttacatatgattagtgatgcgtcatggacaaggcttggctctgtgaagtccaactaacctacttgagattctgagaattctcttcaatggcttcctgtgagctagagtttgaaaatatcttaaaatcttgagctagagatggaagtagctccgataattttcattatcatgtaaatcagatcactcaaggggccaaccacagctgggagccactgctcagggcaaggttcatacgggactttctactgcccaaggttctatacaggatataaaggtgcctcacagtacagatctggtagcaaagaggaaacagacactgacctccttctgccacattatttgaacccctctcaccctttagaacaagcccacctaacatctgccagagaaaagaccaacaacagcctcaaaggatctcttaccatgaaggtctcagctaattcctggctaagatgtgggttccacattaggttctgaatatgcggggaagggtcaatttggtcactttgtgtgcggataaagtcaggatgcccagcggccagagcagggggctggtgctctgggaacaatggctgagcatataagcataggtatgggaattaaaaaacatcaaagtcactgtatgaatcgccatgaagacttgagggatctgaatctactgattcatcttaaggcagcaggaccagtttgagtggccacaaagcagcaacagaatcaacggaaacaacagaatgattgcaatgtcttttttcctcctccttctgacttgataaaagggactgtcttccttggatttagtgaactccttcggttcttgaaaaattcaaggagtatgtaggacatagtccccagaagacagtacaagactttccgctaaactggacatttcaagacccaaataactaatcagaaaaattaaagatgtgacactattttttatccctgcataggtgttacacttggatcaaatgaacaatgctgggatctctaaggataaagatcttaaaagtcctgagataaagaatcccgcacccattggtacttctaacttgtcttgctttttgtctgatttctggctgatgcaggggactaaaactcactgccacgcgaaaactacctgaaccaaactatgacatctcacctgatatgtgagatgcaactgttataattattttaaacctcaattcagcattaactagccttttaatgtaaacacttacacatgatgatgactagaaacagcatactctctggccgtctgtccagatagatcttgagaagatacatcaatattttgctcaagtagaaggctgactatacttgctgatccacaacatacagcaagtatgagagcagttctaaaatgacagagataggaactgtaataaagttatttttaaagctaatttgatatactttaccaatgtaacatcttgcctgtctgtgcagaatcaaacatttacatgcactaaaagacataagcaacctgagtgctcaagtgttcatctttgtaaaatgccaccaaggttaaaaggaagggaccaaaaaaaaccctcttatctcagtggggtattgcatagcagaagctactaatttaaagtcctttgatgggcaagaaacaatgttagggccacttatctgaggtggacaaagatttaagtgaagattttgtcacagcttccctagactgacatgctgtaatagaaaatcagctagggggtaagagaaataagagctctctgcatgctcaaagcagtaataataatggtaagaatagtagtcataggagtttcagttaatggtgccaataaccatgtgctaggcactgaattaaatgccacatatatctttcttacttatgcacagccaactttgaaggatatattctcctacttttcatatatgacaacatatttggtggtaaataacgtccccaaggtcacacacctagcaagtaagaaagttactaattaaacccagtcttgtgtgaatccaaagcctagctcttttctctttatcacccacgtacggcttgtcttcattaaaggaaaagtgtatccacttaaaactatcttcactccctctctccataccaattaaaaataaaaacatcaaaatacactggaaaaacaaaaggaaaaaagctgttgaacccacagtatgtgggaacagcaattaattgttatgtagggataagctaacactaatattcttcaaagaaagcaacttaaagcaaagtcattaaaaagacaaaaggattttcaacccctatttatgtttaatacagcatatttaatggaaaagcatgtaagacacaggttaaaaactattagaaagggttaagaagttcaatactgagtcataaagtaaactaaaagttaaagttcaaacttcataaaattaatatgaaatcctttaagctaacataagatcatgtaaccaaaaatgtcacataacaaataacatcagtcaatataataagagaagatgaatcctactaaaactgttctttatgttgcccagcccaagtaattgtttttctacctaactgatttgtgttgatactgatcactacatcccagtaagtatacattaatcttattaatttaatatttatgacttgagtgactgctgtccatctacaacacacagattaaaagaaagaactataccttccatatctatccagtgcatttaaattcgcttttttcttaattaaaaatttcacgacttgctgtttttgctcatgtacaccaagtaacagtggtgtgaggccatgctgtaaaacaatataaagcaaaaacctatgtaattcaaaaaagtacatattcctcaaccgaagtggaaactttatataagatcttatggacttacacgcatagaagtaaataaaatgtagtcacttccttctcactcttctgtgctttcccacacgctgctccttcccttggaaacaccccttctctgcctcaccacagtaactctaatcatctcaaaaactcactttaaacatttactgcttccaaggctctttgcttctaaaccagcatttggcttggtgttattggatgataatatttttcccatctaaacaaaaagcttcttgagggcaggggctgtatcttttgtctctatatcctcaaccctaagacaaattgtgtataaagcaagaatctgcatgtaaaatatttctttagtttcatgttttaccaaaagttcaacctccaacatgcaacaaaaattgctattaaaactcatactgcccatttgaaaaaattttccaacatttatttatttaaaatctatttgtatttaattttcccagattgttaactaaaccatcagttcataggactactgaaactaaattaacagaattcctatctgtattcttaataactccatggtttttagtgtttaaaactgccatgctgattatgccaaagctctacatacttaagagacacactggatagtccataatacagcgtcaattgacaaaaaatggtttagaatttgctactattctaattgagaaaactctgctcttaacgacttactgacctaagtacttgaatgactgaacaaagagacacaaaatcctgagagggccatcctctacttattgaaagactactcacagcaaatttctaaagaccttctgaacggcagtgaataactgatggtaggaaggaaaaggtattattctgtaagctgatacatactaccaataatattcattttaatgtctcaaccacagagataaaagtcagactaggtcaggaatggtggctcacacctgtaatcctagcatttggggaggctgaggtgggtgaatcgcttgagcccaggagttcaagaccagcctgagaaacatggcaaaaacctcatctctactgaaaaaaaaaaaaaaaaaactgaggttggaggaccatctgagcttggagaggtcgaggctgcagtgagctgtgatcacaccactgcattccagcctgggaaacagagtgagaccccatctcaaaaaaaaaaaaaagtcagattaatgttattggaaagatttaaagaaatcagcacatatccaaccccaactcttctagagataccttaagtttctgagacataagaatttacatattacatttatgtattgagtggttcttaagcaggagtgtatccagattttgagaaaattgttgttgttgtcgttgttgttgttgttgttgttagagacagggtctcattatgttgaccaggctagactcgaactcctgagctcaagcaatcctcccacctcagcctccctagcagctgggactacagccatgcaccaccatgcctggcttcaaggaaacattttcaaatatacatatccaggctttattagacttactgtatcaaaatattcagaaaaagcctagacttgttatttaaacattttcctcaggttactaggatgcacaattctagctgaaagctagtgcaacagacaattacttcagtctcatttctcacccacatgaccaattccctttctcatttgaagatttggccaaaaagagtaaggagtaggagagagacccatttgctgaaaacaccacatgattttccccggtaagagaagaacagggtctagtcaactcaaaatccaacttgatcttgttacttgtttatcttccaccttcccatccagacactctagatttgaaagcagagctgagactctcattggccatttctaccagaataggatactaagtcagttaattacttgatattccctctgctcaagggtttcctcttacattaccacctattcactgccaatctggttcctcagaggcctcctaaaattgatctctaggtagtttacaacccactaactccctctcccaaactgaaaactgtcattctctaaaattgaagagaaccttgtctcaccatgcaaaggaaacaaatcagtcaacaacaacaacaacacacacacacacaacctcttcatggtcttttccctccattatctaatttccaaattggccttgatatttctgattgctctcttttttgctttccacttctggctcatgagcaatcagaaatatcttaagccttgccagtgagaggcgcatcacctcgtatctattactgttttttaggaacttgccaaaggagcaggatctctattcactgaaacatgtttaacttttcttggagttttcatgtaaaacctatttcagggcaaattttgccattttacattcaatagggaaaaaacatcctaggagggaaaaattgaaaaatagtaagtattatcttttacaaattcagtgttttcaaaaaaagtatttaccacaagtgcattaaaaaaaaaaactgtaccctctaatgcttctttgaaagtaacaatatttaaaatgaagtcttagataattaggtcatttcaaaatatttccattcaggttatgcttgagcttccaaatatggaagactggcccttacacaggtcaatgttaaaatgaatgcatttcagtattttgaagataaaattggtagatctataccttgttttttgattcgatatcagcaccatataagagcagtgctttggccattaatttatcttcattatagatagcgtagtgcagagtggtatttccatactcatctggaatatttggatcagtgccatgttccagcaacattaacgcacattcatcttcctggcattgtacggcctgtcagtattagaccaaaaacaaattacaaatcttaggaattcaaaataacattccacagctttcaccaactagttatatttaaaggagaaaactcatttttatgccatgtattgaaatcaaacccacctcatgctgatatagttggctactgcatacctttatcagagctgtcctctttttgttgtcaaggacattaagttgacatcgtctgtccagcaggagttttactacttctgaattcccattggcagaggccagatgtagagcagtcctatgagagtgagaagactttttaggaaattgtagtgcactagctacagccatagcaatgattcatgtaactgcaaacactgaatagcctgctattactctgccttcaaaacaaacatttaactttcccatgaaaaaagcacactatttattatctctcattgctcgctgtattaatgaaagggcagcctatatgaatataaagagcatagcccttggatgacattcaacgtgggctggaatcctacttgaagctctgtcacttcctggctgttgcttagccttttggggtctcagtttcctcatcaataaaataggaatgaaaatagtagctttctcacaggaaaccactctaatgcttaaatgagactctgcacaaaagatatagaatagttcctaacacaaataacagctcaataattgttagatattttaatttttactaataccactaaagacaacatttgaattgagatgatacaattatacctacactttcaggtgtgttttaaatattacagctaacattgtattttagtgattctgagatgatcattgtctccatgttgtctccactgaaataccacttacaattcatgatttactataattggcggcatttaaataattctcttattgaggcataaaataatggggcatcacacaatccctggtgtcttacatgaagtagaatatgttataacaggtccggggcggttccagtcagatgaccagcatttagataaattttggttcttaaaagaactatggaataagaaagctgaggtgaaaacaaaaacaaatttctaaaataaaccaattcttactttggttttcaataaactttaagccaaagaaaacctggaattcaaatgaatagcatgggctcatttttgtcaatacttagatttatacaatgtatgtacatcagatatttccaatcattcatattaggatttaagactgttataaattttctccttttaaaacggatttatgaaacgatttgtggagcttttttcaactgttacattcaggggtacacgtgccagatgtgcaggtttgttacacaggtaaacacgtgcaccaagggggttggttgtacagattatttcattactcaggtgttaagcccagtacccattcattctatttcctgcttccttccctcctcccacccttcaccctgtaataggccccagtgtgtgttgcttccctctaggtatctgtgtgttctcaccatttagctcccacctataagtaagaacatgcaatatttggttttctcttcctttgttagtttgctaaggataatggctttcaacaccatccatgtccctgcaaaggacatgctctcgttccttcttttatggctgcatagtattccatgctgtttatgtaccacattttagttcttaaaacaactaaaacagtctttctccaagacttataaattttcaaaagggcagttaagggttgtcttttactattttctaccttcagaaatgcttctgtttgaaaggagggaggaaaagcttcaattgagattaagtcctaatgcaccaattttaaatctctcatcttgctcaagcccagcagataaacatgaagttttcaaaggtggaaggatcctgagagatagtagaatatgcctgccacataataggtgtctggcttatgtctgatgactaaatggattgaaagaatggatgaacacagcttgggagttcaatattttcaaagaaaactcctgtcgagtaatgcaatacatttgcaatagtaataatcacttacatttgctattttaattttcataaacatataactcaactaaaatgattaattcatactttttacatgttaatctatatctaatgaaaagataattatgtaataaaatgtatatacaataaaatctacaggaacaggtaaacacaatccctctacttctgaagagggtaaaagttcacggaagatagccaaccacagatagaaaaataaataatagaatgtgacaaattatttgcatctatgcaagaagcatattccttctcttcccaaggattattgcattactaatgaactttaactaaaacttcagatgttcattgcagaaatcacagataagagaaagggaaaaacttcacttacaaatccccagaaacaagtttgattatattttctacatgttttcagctaacacgagcagattctgttcgtgtatatgtgtaaccgattttttttctcacttgttatagcaaagtacatctttgcatgtcgacatatctctgtatctactgacaacctcaatagttacatattagtccatcctatggatgcactgaaatttgtccatgaaatctttatatgggttcttctaaatacactgctattttaatcaatactaagaaaaacagacctctatttggtaaagatatttcagtataatggaattgatgagtaaaaagcataacattttaaaaatgtggttcttaccactaaagtgtttgtttgaaaagctgtagcaatttaaactttaaatgactacgtaagtaccactgttcttcatcctcacaaactttgtggataaaaaacagtatttcattccttttttttttcttttttttttttgagatggagtctcactctatcacccaggctggaatgtagtggcgcgatctcggctcactgcaacctccacctccctggttcaagcaattctcttgcttcagccttctaagtagctgggattacaggtgcgtgccaccatgcccagctaattttttgtatttttagtagagatgggatttcaccacactggccaggctggtctcaaactcctgacttcatgatccacctgcctcagcctcctaaagtgctggggtaacaggcgtaagccactgtacccggcctttcattcctcttctaacttaaatagaaaacagtatttcattcctcttctaacttacattccttcttctaccaggaacgctatcttttcctatgtgcataggtcactggtagatatgcaaaaaaagtactttgcccaattttaaaatgagcttattttattatgtctgcaaatatggccaggcacagtggctcacgcctgtaaccccagcacttggggaggccaaggtgggtggatcacgagggcaggagttcaagacctgcctggccaagatggtgaaaccccatctctactaaaaatacaaagcaattagccaggcgtggtggcaggcgcctgtaatcccagctactcagtaggctgaagcagagaattgcttgaacctaggaggcagaggttgcagtgagccgagatcgcactactgcactccagccggggcagcagagtcagactccatccaaaaaaaagtatatatataaatatatatctgcatatataaataggcatttgtatgtttctcttctggtatgtttctctttttgtatatttaaattttttaatctatactcttatttttgtgacataaaaatctagctagttttctccaaacatgaattatgaacaatccatctttttcaaataataaaaaacaccaccattatcaagcgctaaattcttaacatatatttgggtatttctaaatttcctattctgttgtattcattgatgtcttttcagctgttagtaaacaatttgtggaaataaataacatgcacattttgatatctggaaaagcagcctttttccattctgttacaaaaaattaatttatcacaataataaaagacagcatgtgtaatttaaaaacgctaaaactttgctatttttatttggcttaggtaaaagtgataaatagaaaaagctcccatcttttttttttttttttgaaacggagtctcgctctgttgcccaggctggagtgcagtggcactatctcggctcactgcaagctccacctcccgggttcacgccattctcctgcctcagcctcctgagtagccgggactacaggcgtctaccaccgcacccggctaattttttttatattttttagtagagacagggtttcaccgtgttagccaggatggtctcaatctcctgacctcatgatccgcccgcctcccaaagtgctgggattacaggcgtgagccaccgcgcccagccaaaaagctcacatcttaagaaaattcaatcttcctgttcaagcacaggaaccatcttcccatttcagtttccttctaaggttcctcagtaaagaacatatttacatactgtacattgatataaaatccatactggattttatttgaagaatatttagccctgaagttgatgtgttatggggcttcgttcttagttctcaatatacacttttctataatgtatagaacattgttttaaaatctgtagattaaaaataatctgctgcattgacttaattaattttgcaagttaaatcactttaaaacagtctattagtgttctatgagggaaattatgattggaaatcagctaaagttttgtttttgtgttgctgttcataaagggccctgtaccctgacctctctgaggtttccacatccagggtggtgtgaggcctgcggaggcgagaaagccaggtccccctcctcccccgccaggagggtatgtccccatcatccccccacgtcccacctcctcccagcccaggcctggttacctcttttgcttgtcctgcttgttcacgtcagtgtccctgagcatgacgatgagatcctttctggggactttaccccaccaggcagctctgtggagcttgtccagatcttctccacggacgtggtacctgggctccatgaaggcactgtcatcgtagtctccccaagcgcccaccttgctcttgctgctccccctgcagcaggggaagcagtggcagcaccacttgcccatcttgttcctgagtgtcttcatagcagagtcgtcgtggtctccagaagcgcccacgttgctcttgccactccccctgcagcaggggaagcagtggcggcaccacttgcccatcttgctcctgagtgtcttcatagcagagtcgtcgtggtctccagaagtgcccacgttgctcttgccgctctccctgcagcaggggaagcaacggcagcaccacttgcccatcttgctcctgagaccaaatggcttcttcacagaagaggcagccggcatggaatcaacctcaaccaccatctgcttttaacagccaggagaagccagtagtagccaacagatcgcgtctaccaaccagtttcaccaactagcaggtaactccgggtttccaatctgtttgaagagaaaagtcaatcccagccaaaacctgccaaccccagcaggggattccagcccagcccaccccacccagggaaaacccacacccacccgaggaaagcccacgccccccctgggcgaccccacgcccaccccagaaagggccaacccccgcccccaagaaaacacccagcccacccaagggaatgccaaacccagcagagaaaaggtcaagcccagcaaaggaacacgagagagaaaacgtcaatccaagcaggaaacgtcaatccaagctaccaacgccaagccaagccaagaacgcaaagccaagccaagccgctacaggccagccaagccgttaaagcgcgtgcagcatgcgcgtgcaagccattacaggccagccaagccgttacgcgcgtgcggcgtgcgcgtgcaagccgttacaggccggccaaaccgttatgcgcgtgcggcgtgcgcgtgcaagccgttacaagccagccaagctgctgccgggcgtgtgcgcgcggcgtgcgcgtgcgcgtgcggcgtgcttatctcaggtggcgtcagggcacgtggcacagacactggccgatgcatgcaacgcgcctgcttaagtcttggcgccacgaatgtcactgacagccttgagttccggcaaacttcgtgggagtcagctgagctttcaagccactgagaagcctctggtgaaaaaaaaaaagcctcttaaaggaggactggggctaagcgtctggaacttgaggatgctgacagcctcctttgaaaaaagcccccaggacactcctggcggtgctgttgtgcatggcagcagctgcagctgggagctcgggctgacggagctggctgcaaatggcctcaaaatcgcggagcacaagacgcccaccgagcccagggcctgcctgaggtgccttcaacacctgctcctctttgctccgcacccagaacacgaggccatcagcaagggggcatttggggccacaggattgcagccagctcctgccccggtgcagtgtatacagtgtatactgcacaggtgttgggtgcaccaaaatctcctgaatcacctctaaagaacttactcatataatcaaacaccaccttttccccaaaaccctaggaaataaaatgaagaactttttgtttatgcataccacatattttttaacttttttcacaggttcattgagatacaatttatatattatttaattcactcatttaaagtataaaattcagttttttaagtgtattaactagttaaacaatcaccatgattttagaacatttttatgctccttaaaagaaactttgcacccattagcaatctttccctattttccccattcttcctttaaacctctcccagccctaggcaatcatccatctattacctaagaatttgcctattctggaaggatttgcctattctggacatttcatgtaagtggaatcataataatatagttacgtgtgacttactactttcatttatcatgttttcaatgttcatcctttttggagcatgtattaatatgtttttctttttcattgccaagtaatattttattttatggacagaccacattttattaatccactccaaaattcatggacatttctgttgtttcctactttttgttgctataaatacttttatgtgtaaggcatttgttttaatttatttttggtgtatacataggagtgaatttactgagtcatgtggtaattctgtatttaacctttgaagaacggcttcatttttctgcatgtggcttgccaattataccagcagcatatgttgaatagggtgtcctttcccattttcttgtttgctttgtcaaagattaggtagtctgatgcctccaggtttgttctttttgctaaagattgctttcgtttttcagcatcttttgtggttccattcagattttaggactaatttttctatttctgtgaagaatgacattggaatttgacagcggttgcatttaatctgtagaatgctttgagtagcattgaaattttgacaatattaattttttcaattgatataggactttttctatttgtcactttcaatttctttcatcaatgtgctataattttcagtatacaaatcgttcacatccttcattaaaattactccttgctctttgatttacttatatatttgttttgttgctattataaatggaattaccttatttttcagataacagtttgtcattggtgtatagaagccaatgttaattttgtaactctcaactttattgaatatagtgtttatcagctgtaatgggttttttgtggagtctaaaacacagacaatctcaccccttcccttcctatttagatgcctttcctttctttgccttgtataattactctggcaagtcagttacatataacgttctcagcatttgtaatttgacatcaaatccatctgttgtaatacactgattgttacttttcaactcgaaaacatggacatttatcactactctccctttctcttggtctagttgttatttaaaaaaaaacctatcaatgcaaaccaggatatttttctacaaaacaatttcaaacacactaaaaggttttaatctaacaatttttaaactttctttgtcaatgactttgaactgtggtctctcggaacaaatccaacacctttagtagaaaaattatgttaattcctacattatcattgggtctagccaagagttgaccaaaggtgatattaacagatatgcttatttattaccttgttctcaaagttctagcataagtcttgaaaaatctagtaaaaatttgtaaagactataattgcacaaactccctctctcatgagtcacacagttaatccagaatactatttctaagttattggaaagccaacaagtaaatatgatgtagtgtataaaaataatcctaatttcattgtatattctgtaagtgacatatgcaattgatactatttactaaatatctcataattatatttatttacatagaaaaaaggaataaaaaacatatctattatctaacatttaaatgattaaaaatacttgagatagcattgctacataaatgctatgtaaatgctgaagaaagtaaaaatgtcattccctacatttgctaaatatattgtgacacattataagcatttttaaaatatatcactaatggttgggtcaagtcagcaaaaatgattctaagtatttaattgtggaaaaatttagtacaggggatagtattcatgtgatggaaggattttaaatggaacccagagattagcagcagcagtaagttttaattgcataccaggtgcagagtctaggatacaagacagaactgcagataaaatctgactccttccagcatagctaggagacatggctaactccacctgtccggagaccttacctagaaatctaacggctccaaaccaggtaaacaaaactattttccaaagtcaaagcatcaatttatgacattaaagcacttctaaaacttaacctctgacttaagttagaccaaatggataaattttgaagatatttttattttaccactgactttaacaccatctttatttcccaaagattactgaagtcacatgaaataaaaggcattagagcttctatttttcttacaaaatatttaagagctttcattttcttttaagccgagccattatatatacatcacatacacaacacttctagacaagaaaagatctagcagttgttcagtttttctttcccactttatgaatcataacacaacttccacagactatctacaacatgattaaatttatctgacctgtcctgtatttccctcttttgtaattagtcattctactttaggacaacaatttgccatataagatcctctctcatataacatttctttccttcataacatttcttacaataaatacatcttcatatccacaattttctttagatctctctcccctactaatttctgatgcccatccaaaccaaaaaggtcagacaacgcaaggcaaaacagagcagagccttagatttttgagagggacctgtctgcttaaagttcttggggttccatgaggaaaacagaggtttctcctaaaatggggtttgtggaaccttctgtttttccttaaggagtcccaggttgtcagaaattaccttagatcctctcatgtgggcatcaagagtggcaacaagagagactggggtaataattcagacaactgagcagaaaaagaaaaacttactactgtccccactgtaatgatggataaactgaggcaccatgcagttcaaaaattcatgttcacataattaggatccacagctcactctcttaaataattttgccacctctatgcccagtcactgatgcacctgtatggtagctcatggcccccttggaacttagaacctgggtttcattcctgctctacggctatataattcaacaattttcctttgaatttgttggactctaaccctgtatatctcaaattttattagtattactgaatcttaaagggagctgtgacgtctttagtctttagaaatattaaacctataaacaaggactatatgaggttaaacagtattcaaatttctatatgctttaaaacatggacacaatgtattgagaaacacacctacaaaactgcaccccatcaactctggacaaaaatttagatattatctcttcaatataacctatctagtggtatttatacatattcttccatgtatcaacggtatattacatgctcataaccttaaaaataacaagtgttcaaattataggccttacacatttctacgggcttgaaaaatgatacaatatagattgtctttaaagcagtcaagaaaatgcataaacttctagaggaatcagtaaaataaagataaaaagttcacacctaaagtagtaatactaggaataaaagagggctcgacactgcaggttcttagatacaaaagttaataaagccttgtttttggttgtgaatctttgccttaaaatacacacagctgaccgaggtgggtggatcacctgaggtcaggtgttctaggccagcctggccaacagggtgaaaccccatctctactaaaaatacaaaaagtagccgggcgtggtggcaggcacctataatcccagctactcagggggccaaggcaggagaactgctttcacccaggaggcaggggttgcagtgagccaagatcgggccatcgtactacagcctgggggacaagagcgagacttcatctcaaaaaaaaaaaaaattacacacaattctcccgacttcctttttctcttgcaaagaggtggtgatgaaccaggtttgctcaggcagatgacaatactcttgaaaatggtggcagagagccaggcgtggtggctcacacctccaatcccagcactttgggaagctgagacaggtggatcacttgaagtcgggagttcaagaccagcctgaccaacatagagaaaacccatctctattaaaaacacaaagttagctgggcatggtggcacatgcctgcaatcccagttactcaggaggctgaggcaggagacttgcttgaacccaggaagcggaggttgcagtgagccgagatcgccccattgcactccagcctgggcaacaagagcaaaactccatctcaaaaaaaaaaaaaaaaaaaaagaaagaaaacaaaggaaatggtggcagagaaaatgaaggcaatacagttcacttaataatctcataaattagaacttaccccgtgactcctgcatagctccaaatatgtgagagagatgaaatggctgtttgccaccaatatttttatgtgatgcttcattttttgattctctgaataactacttacaacgcattagcccatttatgccagaggctgcaattttttgaatttttgcacgagtgaaaaatcaaaccttctaatgaccttgagcagtaggatgtaattaactccctcatgcttaccattccaataatggaacactaggcataagtggtttaacacaatcgtgaaagcatagctattcaagtaactaattatacaactgatttttttcctcatccctaaaacatagtaaaggaccagttattttaaaaatacaacacagtgacaattttggcttgttgtttgttaaggccattgcttggcataaagaaaacaaaaagaggaggagaaacaagaatagaaacatgaaatagaagcagcagcaaaagaaaatgaagaggaacaagaagatgagaagaatacacagactagaataagcaaaaagaacaggtgcaggaattagaaggcctattatgacaccttttatcccctccccaattcacaaaatttgaaaaagtccaagaccatcacaacaaaaaagaaggaaaaaatggccgggagtggtggctcacgcctataatcctagcactttgggaggccaaggtgggtggatcatgaggtcaggtgatctagaccatcctggctaacactgtgaaaccccatctctactaaaaatacaaaaataaaattggctgggcgtggtggcaggcgcctgtagtcccagctactagggaggctgaggcaggaggatggtgtgaacccaggaagcagagcttgcagtgagccgagatcacaccacggcactccagcctgggcaaaagagcgagactctgtctcaaaaaaaaaaaaaaaaaaaaaaaaaaagccacacacacacacacacagtcaccccctaaattttgttaagaatgagacaatgctgccactcatgcctggctcagaaggaggccaccctccagagattgcaagagaagggggaggactcctttccctaagtgcacctccaccactgccaccgaggcccatggtacagcaccagcaggttcgtccccaccccaggtcggactgggccctgcagtgctcctactcccccttcccagtccccagactttctgccactaccaccactagcaccaatgccaatacaattgctgtcgccatcaatgcagcagcccaccctacaaggttcctaccaccttgcccccgcgggcaccctcctaccactcctgtcgagctgcagtctccgtggctgccatcagtcacacgaggcgagctgcagagtcacgccacatgcaggctccagcgtaccacaggtgattccttctcctcctcctccagcctggcttggagcagctagacgggcaaagccagaaaagcctagaatgggatgcagggagtggtaacgttagagcctcaccttgtcatgctggccactgggtggcagggaccagcttcagctaaggcactcagacccacccaccgaagtccagcctctctttctggcaaaaggtggccaggaactggggcgggtgtgagtgcctatgctgaaaccacccccatccaggtgcaactggccagaaattgctgggcccaccagggctgcactccttggggagcaggagtaggagaaactcagacccagccagccctccccactcaactgctggttcccattcctgacacctccacccacagtgccctgttcccacagtcccccgcgatgcccactaatccccacccggtagtcccaggtggtctccccaacacagagcatggggtgtgggcgggaggtgcaggccggagaaccgcagtgggtgtgggggccctgccctgctcaagattgcaccaggaggaactctggagtctggaaaagagaagagtcacccgaaggagcaaggagaccatggctgttgctgtccccaccacctctgcagccgaccaacaccactggcagtatagcccccatagcaaccctaacctgacccctgccgccggcagtgtagcccccggacagcacacccaccacaccctgtgccagttgcaggcagtgtaaccccaataccccccccaaccaccccctccacaggcagtgtagcacccgatagtgcccacaacctgacccagccacaggtgttgctgcacaagacaatgcctcaaaatcgccgcccccaccccaccacaggtagcgcagctcctgatagcgcaccctgagtaagggcagtgcagcacccgacaacactcctaaaccaccccccgctgccagcattgtagctccaaataaccaccaaaaccactccctgccccgggcagtgcagcagaaaatagtgcccctaacccctcccccgccaccggcagtacacgttagtgcacacaacctgcctcccccccatcacccccgccaccacgggcagtgtagccccggacagccagccaaaaccgcccccctccaccgccagcaatgcaacctcggagagtgcccccaaccagccccctgacacaggcagtgcagcctcgggtagtgagccccaataggacacccaacccctgcccccacaggcgggcagtacatccccggataactcacctacaccaggacatttctaccactctggccgagctgcagtgtcccacgtcaccaccaaacacagcaaggcgagccccaggggctcaggctccagcctccagcatgccgctcccttctactcgtcttcctgcctggcaggagaagctcccgctactggttgccctcctaccactgtcgacaccaccaactgcagtgagccagtgtccgaggctccagccagaaacaggtagcagccatgccggataccaaacgcccacacttaagagcctgaaatgacctgacgccacctccgcatgctttacctactgaggttacgcacatgtggttcccagactacatgttctgattggatgagagaaaaacctctaggcctactctgattggactttattttcatgctgtgattggttgtcttaagactggctctcatccaatcagaacatgataataaagtccaatccaagtaaccctggagggtttttctcatccaatcagaacatgcagtcaggaatcctcctgtatataatctcggtatatgactgctgctgaagggaagtcaggctcttccacgttcccgtattttcctgtggagctgctcagtgcccggcttagaggaccaggaatgggtaatcaccagccgtacgctggaggctggagccgctacaccgtggctcgcctcgctgcgactggtggtaaccgcgaccgagacggcagtgcggcggaagcggtaagaggaggaaaagagttttgggatagatggagggggtaaagagggtggttagtgccaaagggaaaagaggatagtgagcaggagagcgcgttgcaaaaaggcggtggggaaaagatagtgggaaaaaaagtttttgggtagatggagggagaaaaacggggtggggagcgggagggagggaaggttttgcagaaagatggtgggtaaaatgtttatgggtagatggaggaggaaaagagggtggcaagggaggaggaaagagagggtggtgggggggagaaacagcgttgagcagtagggagagaaggttttgtgaaaagacagtggggagaaaaggttttgggtagatagagggggaaaagagggtaacaggtgggggaagggaaaagggtagccagcgggaggaagacaaggttttgcaaaaagatagtgggcaggaaagaaagacggtggagaaagaaaagacagtgggtaaaaagtgtttgggtagatggtggggggaaagagggtaacgaggaggaggaaagagggtgacgagagggagcagggaaagagagttgggaaaaaaatgggaaaatagtttggggtagatggaaggcaaaaaagagagtggcaagcaggatagggcaaagaagaggacgagtgggaaggggggaagactgtgaaaagacagtagggaatattctggggggtggatggagggggaaaaggggaggtgagcaggagtggggagaaggctttgcgaaaagactatggtgaaatgtttttgggtagagaagggaaagagggtggcaaggaggagcgggggaaaagacgatgaggaaaacagttttcgggtagatgaagggcgaaaaagtggtgagcagcaggagtgaggagaagggtttgggaaaagacgggagaaaatgtttttgcttagatgaaggagcaaaagagggtgatgagagtgggatgggggaaaagaaggtggccagggagaaagggaaaagacggtgggaaaaacagtggggaaagtgggtaagtggatggggaaaagggtggtgagtgagagagcagagaaggctttgcgaaatgacggtggggaaaaatggtggggaaaaagttttggggtagatggaggaagaaaacaggtggcgagggggaggaggccaaaggcggtcgggaaaagaaggtgggaaaataatggtgggagacaaagatttggggtagatttttttttaatcagattatttgtatttttgcttttgagtagttatttatatattttgtgtattagccccttggctgatgcatagtttgcaaatactttcttccattctctgggttgtttcttcgttctactgatttcttcctgtgctttgcagaagcttttaagttttatgtaattacatctttgcttttgttgcttgtgcttttgacaagtttaatgtaattacatctttgcttttgttgcttgtgcttttgatgtctatttgaaaattccttgtcctaaccagtttcatgaaggatttatcctatgttttcttctctagtagttttatagtttcaggtcctacatttaaatctttattttgagtagatttttgtatatggtaagataacggcctagatgtattcctgtacatgtgggtgttgagttatcctagcagtttattgaagagattgtccttcccgaatgtgtgttcttggtgcctttgttaaaaatgagtacgccataaatgggtgaatttatttctgatttctctattctgtttcacttgtctatgtctgtcattccttcgtttctgtttctcccccgcccctttttttgatagtattatgctgttttggtattaccatgcttactacagatttgtagtatgttttgaagtcaggtgtgatgcctccagcttttctttttattccagattcttttgtctatctgaggtattttgcgtttccatgtgaattttaggattttttttttctatttctatgaagaatgtcttttgtaatttaacatggattgcattgactctctagatcacattgggtgatatagacattttaacaatattcttctagtgcatggacatgggatatctttccatttacttgtgtctgctttaatagctttcatctgtgttttagagtttccattgtgggatcttttgtctttttggttaagtttatccctagatataatttttttggtaatgaaatagctttcttgatttctttcttaggtatttcactattggtgcatgggcgtgctactgatttttatatgttgatattgtatcttgcaacttgactaaattatttctagtaggtgattttgtggaatctttagggttctctctttctctgtgtatatatatgatcatgtcacctgcaaacaaacagtttgacttccttttttccaatttggatgccttttattgcattctcttgtctaattgccccacttaggacttccagtactatgatgaataaaagtggcgtaaaagtagccacacttgttccaggccttagaggaagagtttaaacatttccccattgattatgatgttagctgtgggtttgtcatatatggcctttattgcgctgagatatgttccttctgtactcatgttgtccagtttttgtcatgaaggaatgttgatttttatttttttcagcatctactgaaatgattatatggtttttgttcttgattcgctgaatgtgatgtcgcacatttatttgtgttttattgaatcatcctcatattcctgggatgaatcccacttgatcatggcagatcatctttttattgtgttgtcaagtgcaattttcaagtattttgctgaaaatttttttgcatctgtgttcatcagggatatttaaaatgcctgtggttttctttttgtgttgtttcctggtctggtttttgtaccatgtaccagggtcatgctgtcctcatagaacaagtttcgaagacttcctttctcttcattttttggggaatattttgagtaaaattcgtattaactctttaaaaaacgtttggtagaattcagcaataaagccatgattcttgtgtttttgtttgatggaagactttttattactgctttaattacattactcattatggatcttgttccggttttttgtttatcattctatcttgggaatttgttatgtgtccagaaatttatcacttctcctagattttccaacttgtttttatataggtgtttttagtaatctcttacaatccttcatatttctgtgttatccattgtaatgtctcctttttcatctatcattttgttttgtttttcttttccttagtctagttaaagcttgtcagttttgatttttttctaaaaaatccagctctttgttccattgactttttgtattttttgtttctatttttaaaatttcttctctaatctttatgatattttttgtgctaattttagtattttatttttctcgtttttctcattacttcaggtgtactgtcaggttggctatttgagatctttctattttctctgatgtaggcatttatagctatgcccttttcctcttacaactgcttttgctgcatcccacaggatttgttatgttgtgtttcttttttcaataaatttttaattttctttttattttttcatttatttattggttgttcatgagcatgtattttaatttccatgtatttgtacagtttttcctcctgttattgatttctagtactattccactgtggtcagaaaagatactcgatatgatttcagttttgttttgttttgttttttttgagacggagtctcgctctgtcgcctaggctggagtgcagtggcgcgatcttggctcacgcaagctccacctcccgggttcacggcattctactgcctcagcctccccagcagctaggactacaggcgcacgccgccacgcccagctaatttttgtatttttagtagagatggggtttcactgtgttagccaggatggtctctgtctcctgaccttgtgatccgcccccctcggcctcccaaagtcctgggattacaggcatgagccaccgtgcccggccatgatttcagtttttaaaaatgtgttgtgacttgttttttggcctaatgcatagtcttttgtggataataatccatattctattcagtggaatgtgcattatgcagttgcggagtggaaagctgtgcaaatgttaggtctattcggtatagagtacagtttaactgatgatgttttgttgtctggatgatctgtccattgacgatagtggggtgttgattatagcgaagcattgaggcattctgttattgtattgcagtctatcctttaaggtctgttaatatttgcttctgtgtttagttgcttgagtgctggttgcatatacacttataattgttatgctgctgtttactttttctcattatataattatcttcatttttttctttttttgactgaaagtctatataatctaagtagagctactcctgctttttttgtttccacaggtgtgcgatattatttatcatgtcttcactttcagtctatgtatgtctataggtgaactgagtttcttgtaggcagtatataattgggtcttgtcttttaattcattcagccactctgtcttaattggagaatttaattcatttatattcaaggttattattaacaggtaaaaacatactactgccattttttacttgttttctggttgttttgctattctctcttttttcttttgttctttctctcttccttcctctttctcttctctctgatctctctctttctttcttttctttcctccttcccttccttcctgtctttatttgtagtgagataattttttctggtagtgtgtttcaattgcttgcttttcatttttagggtgtctattattgatttttgttttctggttaccatgaggctaaacaacataattatatcaagttattttaaactgaagaaaacttaactttgatttgtcccagctactccggagactcaggtgggaggattgcttgaccctgggaggctgaggttacagtgagttgagatcgcgccactgcgaatataaataaataaataaacaaacaatagcttataatgaattctgattgtaaattttgagatgatgattgataaggtataaagaagaaagtgaaaatcattcataatctcattactcaactactcctaatgttttggtacatatgcttcctaattcataactcactctctctctctctctctctctctctctctctgtctctctctgtctctctctctcacacacacactcacacacacgtacacataaaatagatacattttatacacagatacaattttattgtaacattttaagaaaaacagctttgtaattttttatttaaaaatattggcctggcgcggtggctcatgcctgtaatcatagcattatgggaggctgaggcgggcagatcatgaggtcaggagatcgagaccatcctggctaacatggtgaaaccccgtctctactaaaaatacaaaaaagaaatgagccgggcgtggtggcgggcgcctgtagtcccagctacttgggaggctgaggtaggagaatggcgtgaacccgggaggtggagcttgcagtgagctgagatggcaccactggactccagcctgggcgacagagtgagactccatctcaaaaaaaaaaaagaaaactcaagaatgacatggcagtggtgagtgggatcctgggcatccctgggggaattggggctcccccaagagctcctgggagcaccactgggaggggccttcaaggttagggtggctgggtaggggctgggcctgacctgagaccctgcccaccaggcctcttccaggccaggtttgctgtgctgggtgggaacatgggagaagtcactctctgtctgtggcccccatcggtgcctctgccacctggcccagagggggcagggactctggggaggacaaagctgtgggggtagggaatatacccaggatcagccaacattgtctgcacaagggtggaggctgagagagaggcctcgggaatctggctgtgagtgaggacgggcctggggtgggaaagccccctacatggggaacccttgggttccgggctgctgaccatgcccatcctgctccagcccactgccccactgcccccggtgccactgaccaaacagcagtacctatgccagctgctcctggatgccatcctggccaacatccgctcaccctcttcaaccattccctgtaccgcatattcatgccaaccatgattgccatccacagcccacccatcacatacatccagctgggctgggcttcgcagagggtggctgcctggccctgggccatgtgtgcccagtgtggtcaccatggtgcctccccaaggccccagtggtatgcacccagaagcacaggcttgaggacgatgagcagcagagcatccccagtgtgctccagggcctggtggccaggttggagcccaagtgcatgataaacctggacccttctcactgcagcaacaacggcaccgtccgcctgatctgcaagctgggcgagtgtccaggagggccaggctggcgcaagagagcaacccccaactgcagccccaggcctctgctgtccaagctggagggcacagtgcccagaccccatcctatgttcacgtgccagcaggttgtctgctctgtcttctgggcccaggacagactggccattgcctctgcccccacccccggagcccacgcaccctcacctccccaacacagatgcggctctgcttgcctggggccctagggaggtggcacgcaggacctctgggcacccattgatgcaggtcactctggcttcaggtttggaaatccgagagtgagagagacatccaggctttgccgcaagcctcaccagaacctccctgggtgtgaagagtcctgttcgggagcagggctgtgaggcggggcaggccagggcttgtctgggtcacaggtacagccttgtgtgttgcaaacgacaaggacctcccaagtgtgccaccatgtgcccacccactaccctacccagagtccactgtggatggaccggcagtggctatacagtgggcagacccagagggagctgtctgggggcccagggcaggcaggggtcattctggaacaccaggcttccagtgctgcagggacagcctctgtgcactccagcccctcccagctcaggcccctccctcccctcttctgactccccctgcacgggcaggcgcaggttttccagtggtcacctgagagagaggggtctctgctcttcttctgtgtccctttgccccttcatcttgtgtcaggtcagttgtccagggtggctgtgttcagtggctgaggggtgagaaagcctacggctcaaggacagaccctgcttttcccagaggccaccagggagctcagcggggctgacaggtcctaccagtagcttgggcacacaaggccccatctgggcgatgtggctccagagggtcatgttgacaggagtcagtgtccctgagcccagagctggcacacagcagatccagggctgggtccccaaggttgtcagaggcaaagccctgggctccaaaccccattcagattcagttcttcactgacaatgaggctctgggaggagagcccgatggccaggcaggcagcgtgcagggctcctcctggtgcttcagccagtcctggggctgccacttcccagagcactgccgggtgtgcaggccgtgggtgcagcaccagctgcctcaggctcatgcccattgttctgttgcaggcaccaaccccttcctcaggtcggtgcaccactgcgtgacctccaggcagccacagcctggaaaagcactcggttaccaccttgctcaacacctgtgcccggaacatccacaaggcctgcctcggctgcttagccaggactgcagggatggcccgcagcctcatcggggccaaggacgcatgcctcctgtcagacacttctaggtgttggcgtccatggagagcctggagttaggttagctttcctccttttctctcctgccttggggatctgccaaatgaaatcccgcacttgtacagactgagatgggcgtggtggagcgggctgctcgccgtggcctgtccagggtccaggtccatctcagcggcatgagggtgcgctcagggtgttgttagagcatcttgtgtgtgctcaacacacccctgctcctttctataggagaacacagaggacataggaaacccttcaaacacacatcggattctctgctcacagttttgggttcaggctgtgctgctttgggcaggtggggcaccccccagagaagcccctaagtccagggcacaggctgcctatcggagggagggctggcccatggctgctgccagctccccaccaccagctgggcctcagccctcacggcattcctgctgagcactgtggggcccccagggagcaggggcacgggggatcctgctgccggcacccctgtgtcactcgtgtgagggccgtgtccccattgtgaaggatgaagagccaggccctctggacccgcgtcctcagaacactacgcactgccacccagagagtgcgggcctggcggtgggtggggccatgcagtgagtgcctccctatgttgcccactgccctgggcaccggccagcagccctttggtgacaagagtcgccccttttaatgcataccaccccatcatctgtgattgttataatcttgttattcctgtgtttgtcaggactcgtcactgtgtcccccactccatgaaactgggcctgctgtcctgttaggatgctgtaagcccccgggcctgggctgtcctttctgacgcactgtcccattccttggcctggttcatccccagcttcctggcaaagttctgctccctgaagcaggaagaggctgagattaatgccaacgaagtgggccgtgggcctgggaagactgtgtggctggctgagggtgggcactaagctggccaccccacccccgacatggacatggctgtgctgtggcggaaggggtggtgcgggcatggccacggcactcgagacagccctccgaggaggagggcgagcctggctggaccccctgtctgcggtgctgtgtcagggcagcagaggacagcctcttgcccccaggagtgtgcagtgtgggcaagagacagagtgatcatgtgtttggaacgcagctccagcccagccaggggaccagaaaagccctcccgcttccagggaggatgtgcatggctctgccaatgcctgtctcccagggccgctggcaggtcccaggatgcgcaagactgggctgcccaggcaggtccctgcagacagcggggcctgggctagaggccaagggctgggactgggaagggacgcgacgcctgatagccagtgaggagccaggcacacaacttggaaataaacaagctttattttcagtttcaacaggtaaggcgatacctgcttcatcgtgtgcttttatgtaaatgccaaatagcaaaataacagctagaaaataaacagtttgtcagtttggagatcaagtactttatctatcttgagtgttatctatcttggaatttagccaggcctaaaagtagcggaagtgtcaggaaatgctatagagagccaatctccagctgcaggttggtgggcctggcactgaccagatgcgggtagctcaaagcaccgagcgatgcaggcgccgtttctgcattgcctgcagcctcttctgcctctcggcaaagttgttcttcggggtctgcttcagtgcgggcaggatggcacgctccgccacaggtgggctcagaagcaggctgggggcgggtagagggactgtcaccgtgagcatcctcgcgagtggagtgtgtggggagtgcggcctgcatggccctcacgggggcacagagaggcctcagcgagctccgcttctgcgctgccacgctcccttccccactccctccctggggcccaggctgcagggctgccccactgtccccatgcctgtgggacttaccatttcttggagaggctcttggtggagaccttggggaaatgcgtggcttcttggtccctgggtgaaggaagagtcagcagtgagctgtggataggcccccagggatggggcaggggtgcaccaggcactcacctgggaaagctagcttcctccgggactgcctggggcctctggctcccttccaggagggacttgaggtgctgcagctgaaaggcaggggcaggggcgtggtggggcctgtggcggtgccagactgcccagggccacccccaccacccagggcctcacctcttgggtctgcaggaggttggtattccacagctcgcggatgagcacttcgcactgcctaagtgtggtgggctttcgcaggggaaggggcaggatcattggggggtgtgccgccgcccccatctgcctgccctggtgctggctgttccccatacaggcagctcctgcgttagaggcctctgctttctcctttctgaaacagtcattgcagcagccagaggtgacctgcccaggtgcgtctaaccacccacccagcatacctccccaggcagcgcccaggccaatgtggggaagagggcctggttcccctctcccactgagcagggtgctctgggcaccaggtgggggtctctgggactggggcctgtccctttctcccctctgaaggtgccctaagggtcagatgggcttcagtgggtgaccagctagctgccaggctgctcttgatcgtgaccccacacccagtggggcatcttgctccaggcctggtctcgggatgtgcagatgcaggagcctgtcctgctggttgcgctgctgaaagtgtgcgctctgtagcatctcagggcagtcccgcaaactcagggatcaccagaacctgttcctactctgacctgctggcctagtgccctccaaaggcaggctgtggccaggggcagcaagccttctcttggtcagaatattactttacttttctctgaggaagtggtttaggggccgctactggcccccctcgtgggctcaggtcagcacaggtactctgcaggacccccaggggaagggaggaagacagcgcccaccgatgggtagagcgtggccgtcatctgctatcatgagccctggagacaggcccctggagctaggggcagagcagttggctgactgcagggcgtgagcctagtaaatgtagtcatggggcccttagggtgcaggcaagacttacctggcctgcccttgcaccccaggaacacccaagccttacctggcctgcccttgtaccccaggaaccttgtccagcttgctgttgtgaagtaggggctcctcttccaggtccgccttctgggggacgtcagcttttgaatcttgcttgttgaaggagccgggctggggcctggccttgccttgagagttggctgcaagtcagaccctacaaggccggtcactgcaggcaccaacagtcaccgcccaagttttccaggaacagctgtgtgtacccaagaagcccctgtccctgcctcagtttcctcctctgtaaagggaagcctgccttggagggttctggggggaatcaatgtggttctgagggtgaagcccatgggtggtgcctgtgaacactctagaacaatcaacatagtggaagctggccccatcttgggtaaaatgaaactgcatgagaggcttgggacccagcctgcatgggtttcctcggcaaggacaaggcccgtccagcacctgggcccatcacaggaatggtgagggttagggctgggctgaggaaaatgcccggcctcacagagtggggaaaagaggctctctgctcccagttcactctgcagaaggtgccatgagcccagggctccgtgggcagtgccatccctcctgtgtcctgcctgcttgtggcggggacacggccaagcagggctgctgctgggcagccagggtacgtcctccctaggcggccacccggggaggcccctcctgcctgcttgctgccccaccctggggtgcctgctgtgaggccttactgccctgtgactggtccctggtcctgcccacccccccttaatcccctcccggtggcttcagcttgcagggctcttttcagctgcaccttcatccccaaatcctggagcttggcccagcagagggtacctggtcagcacccctagaggccacccaggctggggtccccgtggggcactcacccctgtgagcacatggacgccagcctgctcacctgaattagagatggacttgacagactggaagcttgacgtggagaggctgtctgcaggagagcgcacagtgtcggcgctaccgcccgcaagacgcccatgcttgcctcctggcctgtgtgtccgtgaggagccctccttcagcctggcagggctgggtcctcccggctctacccacactccgttgatgcagacccagcgagcgcccaagggagcagaggccctggaaaggtggtttcctgaggggccatctggaaagcaggagggcttgggacacatggaacagcaggtcccgagggagagcatggcctcttcccgtgtcctgtcagcgtccccagcactgcagggctggggctgccgacttgggccacactttgcccagaacagctcactggagttgccacagcggctagggaagggccctccctcaaccccattctccatgtctctctgggaagggagagccctaggcactgccccagctacgatgttcccaggctggctccatccaccagtcagatgtcctcctgatgtcagccccagccccaaagataacgggaagtgagctcgagaccacaacccagaatcctgggctgggtgggggccgctgtcaggatggggaagtgccttggacaagtggcaaggaaacaggactctgcttcctccctttgtccccatggttgctgcccagatggcaggaagggatccctggatggagtgtgtccagagcccctgggcccccagcatgtcaggactcagagccatagggctggagatcctgggcctggccacagcagcaatctgaggcaaagatctagcagggcaggggctgtcccaggggttccttcccatttcagctctacttggaggagggaggtctggggagcaccctgtgcccacctccccactgcaatgacctcaggccctgggcttcctgagagcagcacgtgctgtgcttggctgcgtaacatcatccagccacggctagaggtagcggcatctgtccaggtcccccagaacctgtccccactgggttggcatacaggggccagtgcagccaggtgggcaaggacagtctggaggggctcccctgggtggcaagagcatcccatcaggaactgaagggcccagttctcacctttcttctgtgatgtctgattcattatgagcttgtaacggagatctgaaagcaagcacacgctctcctcagcacttgtgaaaccacagccattctgagagaagaagcctggcctgtcctctcctggctgctgagcccgaaagtcctgcccccccactggctgattgggccctgccccatggatcccgctctccaccatgcctttgtcgtgggtgtcaggccaggagtggcccctgcctgttccctaggcagagcccacctggcatatcagcctcatccatctgagatgactggagggcgtccacactgccaggcagaacctgggctttaggggtacagaggtgaactctggaatccctggctatggcggtgtcatgatcccgtgggcatcagggactggggggaggctcaagaagatatgaggaacggggcgtcctgaggctcaagaagacatggggaagcggggtcctgacaaaacagacgcctggtgatgggatactcggcactcaggtaaggcagcagcagggaacggggcgggagaggaggccgcgggcactggtgcccttgctggagccctcctgaagcaagagcgaggagcggagccacatcccacatcctggcgggccctcctcctgctcggggcaggaggggtgggggaggagggagggagaaaggggggcgtgggggtgaggagcagctaagggtgcagttgggaaggccccgccggaggacagcatgggcacaggcgaagcggggacggggtggggggcgggggaatgcctgctcctgatccgatgtgtttagctggaagaaattcactgagctgcgcactcgcacttgggcacgtttccctgcataaagtttttgtttgtttgtttttgttttttttgagacggagtctcgctctgtcaccgaggctggagtgcagtggcaagatctcggctcactgcaagctccgcctcccgggttcacgccattctcctgcctcagcctcccgagtagctgggactacagacgcccaccaccacacccagctaactttttgtatttttagtagagacggggtttcaccgtgttagccaggatggtctcgatctcctgacctcgcgatccgcccgtctcggtctcccaaagtgctggaattacaggcgtgagccgccgcgcccgggcccctctataaagtttttaacagaggtgtgtctgaccctgcttggagaggagaggactggcggagtcagcatctgaaatgctgctgccctaggagacaggcagacaggttcggcactgcccgggggccacgcgggtctccctctgggaggaggggacagctcagcgtggcagggcgggcttaccgtcctgtgttccccctgagcccaggcgtgtgctggagttgatggctgtgtttctgtgctgcgggagcggcagtgttgagtgtgcctggggaggcagggccggcctagggccccgcgccggctcacccttgttttcccgcttcagatgctcgatctcctcatggagcttggccagcatctccgagtgctgctgctgcaggaactgtaggctcttctccaggtccaggttccgtttctgcgggtcgctctgcctgagctgcgggctctgcggcctcaaggactggacgcccacagaggggcgctggcgccggcgccgagagcccggggtcggcgagctggggggccgcgtcccagccgccacccccgcaccgctcatatcgccatcgccaggtactctcccgctgccactgcaccccggctcagtggccaggccgccctagcctggcgccccgtcaccatggaaaccgggcgacggagggcgccaggcgtttggcgggggcggggcctgtcgctggctcttcctgggtgagtagtgatttacaaggcatccagggctgggcgccggggctcacgcctgtaatccccgaactttgggaggccgaggcggacggatcacttgaggtcaggagttcctgaccagcctgaccaacatggcgaaaccccgactctactaaaaatacaaaatttagccgggcgtagtggcgggagccagtaatcccagctactccggaggctaaggcaggagaatagcttgaaccgggaggcagaggttgcagtgagccgagatcgcaccgctgcactccaacctgggcgacagagactctatctaaaataataataataataataataataataataataataataaaaggcatcctttccagcctggatggaaagtgagcccctgtctctataaaaattaaaagaaaaaaaacccgggcatggtggcttgcgcctgtagtcccaactgctcgggaggctgaggtgggaggattgctggaaccccggaggtcgaggctgcagtgagctatgatggcaccactgaactccagcctaagtgacagagtgagatgctgcctaaaaataagaggccgggcgcagtggttcacacctgtaatcccagctactccggaggctgaggcaggagaatcacttgaacccaggaggtggaggttgcagtgagccaagatcgcgccattgcactccagcctgggcgacagggtgggattctgtctcaaaaaaaaaaaaaataataaataaataaataaatttaaaaataataaaaataaaaagtcttttttttttttacaaggcctgccctcaaaaaaaaaaaaaatcacagccaggccaatcataattttgccagacaccaacaaacctggaggaagggaacatagctaaccccagcctgctctggctctccttccccacatcttactgccacatcagcggggctcctgtataataacaggggatacaagtgaaagaactgctcatctcagagcttattcgagaaatctctaggaaaccgtaaagacaacagggagacaaaaactaagacactagaggaggtttaagcctctgacacctccagttaacaaacagcacacatggcacaacccctaaccagaccaacataaaacttcacacagaaagtccatttactggttgagcatgaccagccctcaacaaaaacttgcaaggcataataaaaaacaacacagttcgaagacacagcaagcatcagagccacacttaaatatggcagagatgttggaattatcagaccaagaaatggaatacgactatgattaatatgctaagggctctaatggaaaaagtggacaacatgagattacagactgataatgggaacagagaggtagacgttctaagaaataatctaaagaaaatgtgaaggccaggcagggtggctcatgtctgtaatcccagcactttgggaggctgagttgggcagatcatttgaggtcaggagctcaagaccagcctggccaacatggtgataccccatctctactaaaaaatacaaaaattagctagtgtggtggcatgcacctgtaattccagctacttgggaagctaaggtgggaggattgcttgaatccaggaggtggaggttgcagtgagccgagatcatgccactgccctcaagcctgggcaacagagtaagactccatctcaaaaaaaaaaaaaagaagaagaaaagaaaagaaaatgtgagaagttggccaggcacagtggcttacaccgctaatcccaacactttgggaggccgaggtgggtgaatcacttgaggtcaggagttcaagaccagcctgggcaacatggtgaaaacccatctctactaaaaatacaaaaattattgggaggccgaggcgggcggatcatgaggtcaggagatcgagaccatcctggctaacacggtaaaaccccatctctactaaaatacaaaaaattagccaggcatggtggtgggcgcctgtggtcccagctactcgggaagctgaggtagaagaatggcgtgaacccgggaggcggagcttgcagtgagccaagatcatgccactgcactccagcctgggcgacagaacaagactccatctcaaaaaaaaaaaaagaaaaaagaaaggcaggcatggtggtgcatgtctgtaatcccagctactcaggaggccgaggccaaagaattgcttgaacccaggaggtgaagtttccagcaagctgagatcctgccactgcactccatcccgagcaacagagtgagactccatctcaaaaaactaaaagaaaatgtaagaagtcaaaaacacaacagaaatgaaaactcaggtgcatggctgatgcctgtaatcccagcactttgagaggccaaagcaggagcatctcttgagcccaagagttagagaccagcctgggcaatatagccagaccctgactccacaaaaaactaaaaagtttgcctgcatggtggtgcacacctgcagtcccagctactgagaaggctgagatgcagcgagccgtgattgcaccactgcactccagcttgggcaacacagagagaccctgtttcaaaaaaagaaggaaaaagatataggaaatttggatctaaaaaaagggaagtgcattagagaaggaataaagtaaaataaaatataatctttattattatttttaatagatgacaggttgttcaaaaaaattatggcaacatgtatttagtaattatggtttatggatagctggaatgaatggtagcaatattattgctgggagggaggatatcctgagtggagagaaattcatccaggcaggagtgcagtggcgcgattatagctcacttgcagcctggaactcctgggctcaagccatcctcctgcctcagcttccctagtaactgggattacaggcacacaccacgcctggctaatttttttttttttttttgtcttgctatgttgcccagattggtctcaaacccctgggctgaggcaatcttcctccctcagcctccagaagtgttgaaattacaggtatgagccactgtgcctggtatatggttgcttttgaatgtcctagtcctaaacatctggttcccaagaaggagaaaagaaaaatgaaggcaggaggaggtgctgatccataaaaacctcctggaaggtgtgtacccagggaggcagtgagggttgaggagggacgttgcaaacatagcagtggagattgcagcagtggctgcctgcctctttgtctgcattttcacaatcaacagcagccatcatcaatcagagcacagatccccagtatttggaggatggggctcttattgcccgctctggttcctgcaagctatagggaagctactccagaaatgcatgcatggctgcttgcaccaccaatttaaatgccactttcttctgaaaacacccttacagacctgccaggaaataatgtgtaaccagatatgagtgcatccggtggcccagacaagctgacatatagaattaaccatcacaagtccaccccttgtcaacctggcacccatacacatctccttaaaccatacgcactctccaaataaacacaataacccagtgttattgtgttagcagtggaaggtgtccgagttaatagtgttagcagtggaaggtgtccaagtcactggcagtgaatccggatgggtcttcagcaaccacaattcttggctcctcagaagaaggaattcgactgaggggcataaggcagaaaaagagaccgaagcaagtttcagagcaggagtggaagtgtattttaaaaggctttagaacaggaaagaaaggaaagtacgcttggaagagacctaagtgggcacatgaaagtcaagtgtggtgtttaaccttgatcctaggactttctagactggcccctttcccatgatccttcccttagggtgggctgcccacatgtacagtaccctccttacccttgggagttcctaaacacatgcagtgtgtttaggaaactgtatgcatgcccatctgaggtttttgggtggggtgccccccgaaggtcatactccaccactttgtctcttaatgcacatgcctgggaagttgattctccctggaatctgcattcaattaacactttagtgaaataggtgtggcccatcaggaaatggcctgtccctggcgccagctgccaatttatcactttttttatttatttattttttgagaaggagtctcttgtcacccaggctggagtacagtggtacgatctcggcttactgcaacctctacatcccaggttcaagcgatcttcttgcctcagcctcccaagtaactgagattagaggcatgcgccaccacactagctaatttttgtattttcagtagagatgggatttcagcatgttggccaggctggtctcaaactcctgacgtcaagtgatcttcctgcctcagcctcctaaagtgctgggattacaggcatgagccactgcgcctggccaaaagtaggaattcttgactgggaaataatttgatatattttcgcaccttgtgacttgagaaaattatgctaggaattctggttttgggagtcaagggaagctagcttaatttttacagtgaaggctacataagagtccgctctccagtgtggtggctcacacctgtaaccctagcacttcaggatgcggaggcggtcggatcacttgagcctaggagttcaagaccagcctggcaacacagtgagaccccgtctctacaaagaaatttaaaaattagcagggtgcggtggcgcatgcctgtagtcctggctacttgggatgctgaggcggaaggattgcttaagcccaggagttaagaggctgcagtgagctgtcatggtgcagtgcactccagcctgggcaatatagcaagaccttgtctcaaaacagagagttctctctcatttatattggaaatgtcagggttattggtgagagctggcctttaggggatctaacttgctcttggatgtccaaggggaaaggtatagatttctcccgactgcacagggcctctgcttgtgagttgcttgcacaagatgatcagaatctgacttaccttggatcacgggggcgctggtatatcctagcggtagatcatggaagggagtgggccacgaatgggatccagggaacgggattgtctcggggcaaggaggacgatgcggaggtgcgggggcaggggtggtgtcaggacaggctgaagctgcgctgccagagtctctgggccacgtggtcagaaaagcatcggatttggcctgttagcaggggagtgtggcccaatggcaaaaagtcaagggcatcctaggagctgaggaggcggtggcagtggcagttagggcaaaccactctggaagcatccaggggtggagacaagaatctgcaggagctcctgcctccagcctggcctccctcctccttgtgccccagacagaactgcttcccctgagttgctccaactcgtccttccccggaagtccctcacaagtgcctcctggccgggcccccccaactgcattttgcttctgctctcatcccagcagtcccattttctctacagtgagagttcttggcaaaatttaaatcccattttattggcgaggtccctaccccccacctggaagtggctggaacccagctgcccactgctgccctcgctccccagggagaagccactgagcaccagctggctttgtggccatcgctgtccaggtcccagccaccaagaccctgacccctcactcagctttgctgttcttggttctcaatgcatttttgtctgccctccgctcctggccagacagttcagcccccagcaactcccgcaatcctcagagcttctggaagccatagacttggcagcacatgttcccggtggtcagcttttctttgagaacagggtctcactctgtcacccaggctggagtatagtggcgtgatgaaggctcactacagccttgacctcctggaccctgatgatcctccaaactcagcatcccaagtagctgggaccacacatgtgaaccgccatgcctaactttttgaatcttttgtaaaggcagggcaaagtctactgtgcctctgagagaggaaagcataggaagccagaggtccaggcctgtggacactagcgggaggggccgacagggtgcccaacagttgtttctgcagcccccgtgtgctcagggactctgtacaggtgaacctcctagagactgagcccaggtgccagaagactcagaagcaaggacatgtttattcagatccatggtcgttacaagcttcatttttggtcacaggccctaaaatgccattatgctcagtttacatcaaaatacaaagcccaacatttacaatttcaaaaacattaaagcaaacccccaaaaccccacaccgaaaacaaaggcttggtttggaaatcaccactgagatgctgttctccctcgcatgtcgcctgtggggtgaatgaaggtgaagaccccgtgctggtttctgtcagagaatctgtagttgtatattttgaatacttaagtaccactgaacggttgccatgtctttgagcacttgatgttactgaagtgacaatgcttctgaccatctttggctgcagagcagaaactggcagaatccgaccccatcgacccagcagtgtccccaacgcctgaggaccagcacccatctgtgacaaggcacaggggtccgcgatgttggccactgctttgggtgatgtgctcaatggcttggggtctgcggtgaagcccctgggctctgggagggtcttaggctcctgaaacatggaattctacggcccagtcttggaacagctgggagaacatgaagaacgcccctcacagtgaagaatcaggacagccactctctggttttctcacaactctagaaactttgattctttcctggagtggagacttaagccactgtcctggtcccacacagagagaggaagcgccacaacccactctgccaacctcaaggccagccagtggggaggccaggcccaggtggctgttggcaggctggctcccaagcttggtgcagcagagtagccaaatgggcagtggaaaaaaggccccgagagctggcttggccgtgagtccttggcggagggagggaaaggccgccgctgagctctgcgctgtcacagagcgtagctgttgagccctggcagctactcctttgctggggcccacctgccttcctttcttggttgcgtttcctccagatgcctctgcggctgcaggaaccccgctccagaagcccgaggatgaccgtgttccctcctggaggggcttcccaggtcctctcagcccaagggtggggctgtgtggcaaatccctccagcctgctctgaaggcagctgacaccttcagggctggtgcagcttcccccgctcggtcagcagtgtcatggcagaggcgtagaggacatagcccagggtgagcagcagcgtgcatgggaggggcccgacgcagaacagagaggccacgaagaaggccagcagcagcgagaccagcgtccggtaactgcccaggaagcgcaggctgagcctggggccgcgggtgtggccggccacctgcctccgccccacagggctcagcaggtgcctgctggccagcccaggttctgtgaggtggtagcgacagaagctgccgaggaagtcatcccgggaacacagagccgccatctgtcctgcaaactgaagcacagacagaggcacggggatgtggggtggtggcaccacaggcctcaggacagcagtaccccaccctcacaggccaccccaggactgcaccccaggcaggagcatctagaaccctctctgaagacgccaggccagccctcctgcccactcactctgtggttgatggcagacgacagcctaaagagtgtgcggaccaagctggcgatctcatagctccggatgggctgcagctccgggtccccctggtactcaatttcaaaccttcgcagcccattgatgatctagaaagccaggccatggggatgggtcagaaaacacagccccacacacaactcagaggagcctgatggcctctgctcacaagggaggagggagctggggacgggtcagggcccagcctgtgcgcctctgagacacgggcctctcacctggtaccgccccaggggcgtaaggatgagtccgtcctcacccacgatgcagtcggggagttgcttttttccattctcatcctgggtggtgcccaaggcgagtgtgaactgcctgagctgcgcttcgctgagctgccagagagaaatgccactgccctcagcatcaagatgaagagaggggaccagtcttcaccccaccagcctacaacagtggcaacaaggggacccagctatgacgctcggggtgtgggcctgcctcccacaacactgggtccatatgtgtggggcctgggactggtaggtggctgaccacaggctgggtggagtggatccttcagggaaggggaccctgatggcggtggggcaggccccatagctcgtacccggaatatctggcgcaggtactccagggccttctccaggtattcatctgtcttccggacactgtcttgccccatctcgtccaggtcgttggctgtgtaggagccattggtgtccatggagctaaagcccagccatgagaggaaggagtggccagccgggctctccgcacactggtcggagatggacttggctgtgtgtttggcctgtgtgatgagctgagcgaggcgcaggacctgcaagggaggcgcgggcaggtcaccagcaggacaggcctgtgctgccacccaggcagccccaagagcaatgcacagccagactgctgagcgtcaggaggagtggcttctgccagaagacttttaaagactaaaggatgatcttctacatttgaaatttcccaagaaacactgccttcgttatcaggaaaaaattagactttactaaaacgggggaaggagatatggcgtcaaatctatacccagcctccctccttcctgctggatcacagcacttcccgggttctgctcagccccatggctccaggggccctgaggacaggcaccgccgaaccactcaccagggtgcgggcctcgggcccaaacatcggggtgtacttgcagtcctggccctccaggctgtagacgtggctcttcaccttgaaggaggcatcagtgaccgctggtggccagggtgacaggaagctcccagtgaatgtgggggccgtgaagagtcggtgctggcggtgggggatgaccagctctggctccaggaatagctgctcacctagaaggcaggagacgaacctggcacccacttcccggaggcagagtacccgactgctgcccttaggattctggggtgtctctgaggtgtctggggagccatgacccaggggtgtcctcctgaggccctgcctggcagcatctcccacacagtaggtggctgacatggggagggcggatgggggagctgctggctcacagagcccctagcagtgtctgcaggaggtaaacaacaggaggatcgacagaaaccaacgcccaacccagccaggatgaatgcaaggcagagaccaggctcacctcctgaagcggccaacacgagttgccagggagaaacagcggggtcacggggccgcagcttggaccgtgccggcccgctctgtgggcacacctgcgatcccccacccagtgcctggtggctgcagggcaggcaggatccagccggtttcagacctcaccacacagacgtgtcccaggagtctccacagcaccctttgccggggcccactctgggcgtgtgggtccctcttaaagaccagccacccccagctaagggcctggccctggtctggctgggttgacgtataccgggctggcccaggctgaggacttacctttctgaatcatctcagccaggttgggctgggcaaagactttggccactcggaacaccatgagcgcgtgcttggggctgaccaggtctgtgcggagcgcgcggttcagaaagcccacaaacaacttggtgtacatcagcaggttctcctggacaaagggtgccctggggaccgaggtggcaggttggggccagccttccaactggaagcatgcccctaatgcccggtccgtgcccctaatgcccttgctcacccttgggctttcagactctccttagccaaggtgacaagctgtcacagatgacagctcagggggccacgggcaggcagggaggacaggacagaggcaggtaagacccaggccctctgaggatgccacatccttagcaaggctgaggcccctttccaagtggatggaggccaccatggcagaggccagcccagagcctgagggggctcagggaggatcccccagagggtccaaaggggaatgccttgggcaaggaggggagggatcagtggccatgccaggtgccacggaagcctgggggtccgctgtgaggatcaagcaggggatgaggggaagacagcctccctcatcccctgcttgatcaccgctgctctgttctgtgctgatgaaggtcaagggatagtttgggggtggctaaacactcatctgggacagaagggagaggggacagggcaggatgggtcacccacagcttccataagaaaccaattctagggcctggcaaagttgagcctaggaaaaggctggtctgtgttccgctcggcaggggctgggagaggacttcaggaggccacgggggccagggccaggctgaccccagcacaggccgctggcttggcctccacccactggaacaatatccacctgggggagccagtggcatgtctgtgagaggagctgaggctcaccatttctccgacacacaccggggctgggagtcgctgcccggagcctgcttgtcaggcgcgtaccgccacggctgcaggtagctcagccacatctccaggacctgtgggggaggtgtgtgctaagggctccgtggctgggggccaaatactcggtggcctggagcccagataccaggcggcagctgggtgggactgactcttctcacttcctccagagggcgcaggagagacatgcacagccctgtgaggtttggctcttgctggccctccagaagccagggtgggcttttcccagcccagggggcagagtactccctggtcaggtaagggtaggaacctgccctgcaccagacaggtgggacagggcagggctttcctgagggctggctttggaaactcaaacagaaagaacaatgtggccctccaagaccccctccttgccaaggcctctgtgataacacttgctctcctcctttatctgccccaaaggacctcccacctcaaggcacacagaggacacaggcacacgtgtgacggggccaacactcacagctctgaacgatgcgtccaggggccagtggccaaagcaatgctgcaagaagaggtagagtttctgctggacgaacctcgggacagcagccctgcaggggatggggagggtcacctgctgcttgcccagtaaggaggccctgctcacagatgaccccagggctcccatcagtgagggttggctccgccgggggagagcactgggcacctccgggaggttcagccccattcttcagaggaagaaatcaaggttcagagaggttagggaacatcccaaggacacacagcacgcaggcggccgagtcagcacaactcctgcacacacctcaccctccgtcccatacaaacagcccactctgctggccctggtgggcctggcagtcagggccaccccaactcttctgacagggttgaagaatatgagatgcaagagatggcagcacaatggggcctctctggccagtctggagagagaggctctgggagccaactgggcggggtgagaggacacctgcctaggcctggagaggcctcacgtgctctgtgaacagaaagggactcccctcaccctgccctccatgccctggggagaggtcgctgtgggcgacaccttaggaggggaaagtgggggagacggcagtggtgggaagccgcaagggccacccaccgtttgaactcctccagggggctggtggcgtgggagtgggcggagggtgaggcctgctctggcttcaggctgttggcaaaggcgtgcaggtgcttcagcagcaggcgcaccaccaacacatgctcctcagtaggcgtgaacgactcctgggtggagaaggaggggtgagggcctgggaaggagcgtggcacccatagcactccgcctccaggtctgaccacatcccgccctgagccagttgctctgctgcccccacgggaggcatgagccaggccaggagtggggccaccccatggggcaccactgtgcctggcacccagatgtgccttgcactgcttggtctgaactgtgaccagcttgtggtatggaagtgcttggcccagcgcccacacagccctggggaggcctcactaagacagacacatctgcagagggcctcccagccctgcttctgcacggctgcaaatccgcagcgggtggcacaggctgtgcccttgggcgctggtgcctgtcttgatccccagggcaggagaaagccagcatcacccacaagctctggatccagggtctcccacctgcctcccaagtgtgtgcagaaagcacatggaacccaggtgtggtgcctcagacctgtaattccagcactttgggaggccaaggtggaaagatcgctaagaagaagttcgagattagcctagacaacatagggacaccctgtctctacaaaaaatttttaaaagttagctgggtgtggtggtgcacacctatagtcctaatgactcaggaggctagggtgggaggatcacttcagcccaggagtttgaggctgcagtgagctaggatcgtgccactgcactccagcgtgggtgagagtaagacctggttcaaaaataagaaccccatggcttcactttcctccccaattcctcccacctgctcctcatcctggacacagccagatgagaactcggcccagtagaagccccgggcgtcacttcctctgttgcccagggacctgtggtcaggaaaaccccaagacaaaagcacagtcaagcatattaggccaaactttttttttttttcttgagacaacgtctccctctgtcgcccaggctggagcacagtggcgcaatctcggctcactgcaacctccgcctccaggttcaagcaattctcctgactcagcctcctgagtagctgggacgacaagtgtgtgccaccatgcccagctaatttttatttttcatagagatggggtttcaccatgttggcctgacctcaggtctcccaaagagagggaatacaggcgtgagccactgtgtccagcctaggccaaacttttgatttgtaacatacaagcaggatcctggagatctagccggagaggaaagcctttttggtggccatgggcttcctctggttgtttagcattgggagggcaggtgggcgcatcgagagtagacgagggcagggaagtaggggtgctgagggcaggaccctgagtctgagtggacatgctcgcctctccacacttgtcccctagccctttgggccgtaacacatctgtgctgctgaggctggtgcagggcccagcctccaggtatatcctggtatgctgtagaccccgcacgggccactgcccatatcgctacccactcaagtctccccgtcaggaaactgtccccacaggtccaagtgacacaccccagagataagtggctgagtctgaagatggagctatggggtgggaggcattttcttttttttgagacagggtctcactctgtcacccgcgctgtagtgtcgtggtctcggctcactgcagcctctgcctccagggcttaagggatcctcccatctcagcctcccgggtagctgggaacacaggcgcacacaccaccacaccaggctaatttttgtatttgtagagacaggggtttcgccatgttgcccaggctggtctcaaactcctgagctcaggcaatccgcctgcctcaacctcccaaagtgctgggattacaagcatgagccatcgtggctggctatttttctctatctgtattgttaagtctttgggcaatgaatttgcattgttttggaagaaagggccaggtgcggtggctcacgcctataatcccaacactttgggaggccaaggcaggcagatcacttgaggtcaggagtttgagaccagcctggccaatatggtgaaactacatctctactaaaaatacaaaaattagccgggtgggtggcacatgcctgtaatcccagctactcaagaggctgaggcagaagaatcacttcaatctgggaggtggagattgcagtgagccgagaccatgtcaatgcattccagcctgggcaacggagtgagactccatctcaaaaaaaaaaaaaaaaagacagaaggagaaaagtatgagacataatacctgtacctatactgcccaactagaagggcaccagtggggtgggaagttagaccagggtctttctcctcctccagtctcagcccaggccctccctccaatcctggcctgggatcctgagccgtaacatccttcctgcagctaaggggaggggaagacctccacatgtgaactggaaaactgctttcccctgctggtgcacttgacccacctcacctggtccttccgaagggtctggagggcccactgtccgcccctgccgccggcagtcacatggaaccctctcaggctattttcccataggtttgctgagccaaacttctccctcagctctgcacccctcctgggccatgttcccacatggagtccctggccacagtcacctgcttgcttcttaaggatgtgtccccaaagccgcacatttcccactgggctgagactcacagcacctcagctcaccccacctgggtctcgctggtcaccctcccaccatggggtttgccagatgctttctggaccactgtcctccctccctggcgcaagccctcaggtccctcctctcctctgcagtggctcctgcggaatgaggtgcccctgtgtgctgtggccaccatcccagcccaccagcgctaaggagccaacacattttctcatcttatgctcaaattcctgttcaatcatgtgtgctctttcccaggtgaatgggacagatcactggctgtgagcacagcccgtctcccccggctctcacagattcctctgtcatccctgaagtcccctacaggtctgaactctgcttcactgacctcaaatccatccacacacttgtcatttctgcctaggcagctgcaacctctatgaggtcaccacccactctaatctgcctctggaggtgtgtatgagcggccagggctccccaggtgaaggccgggtcctggctgggctgtcaaggactgacagcttctgtgggctatagggtcaagccccaggtccttcccaccccctgcctcacacgcaagctctgggtcacagcacctccaggctgggtgacagttctgaacaaggcagaacccacaccacccgtaagtcccaggcctctgcgtcttcagctccttcctaagcgccagaccctgcagagtgcagtgaacccagccactgctgaggcctgaggactccagctcttcaaaccagggccaagcacgaggcctccaacactggagagcttgtgacacctccactggcctggagcctggacagccagggccacatgcccacatgcctcgttctgccacaaagccaccacccccacccccaaccaaactagtctacaaagccaggggccaagccaggctggaggctgacccctgcctccccccgacacaggggcttcgttctgcttggaactagcctctgagtcaccagcggccggccccggcggccccttgctttgccaggcatggacatgcactctgggcaggaggaagggaacgaatgagccagtacttggtaggcgtggagggcctggaggctgggttgggcggggctgtagagggcgctggagacactgagtcggtagtgcagaacctccagctgagataagaaacagagagatgccggaagaggccgaagagcagaggacaagagaatggggtggggaaggggagagataggaccagacacgggagggggaagcggagagagaaagaaagcaatgagaacgagcccaggagtgaggagaaaaaaacaaaaacaaagcacggtcagtgacaatccaaacaattgcagtcccagcagccgcgggccagcgcagcacccccctccacaaccaggccagggctgtggccacactctcctcgctttgaaggcccgggcagaggggcctccaggtcacctgggtggcccctcagtattgctggggcctaaaggcctctctagctccttggaagggcccaactcactgcccttcaagacgggacccactctccccagtgactgaggtcacactatgtgtggcaaatgcaaaccagagccctccaagagcccagggccctcactgggacatgctgccagccaccaagacctcaagatcctgaggctcagaaaagaaaccagcggagcatgttccaggaggagcactctgcccagaaaacacatgtggaattgactggatttccctgggttgtcttaagaaatttaccaaattggtataagacatgattgattcctatgtgtctaaaactcaaatcaatgtcccctccatgactggctctctgagaactgagggcgaggacaggtccccaagggtagcacagagacgaggagcacaggctcaggccaccaggccctgccctccaccctcatagtctggacgtcagctaaggtggtgtgcacatcagctctgactcctggaggcagcctctcctaccgcaccagaaactcccaccctccagatacagtgggttcccaagggcgggagcccctgaggatctggccacagccacacacacccagaggcagcaggaacctgaggctgagctggctcctagccaggaccctccgacctgctgccctgcagcaccacggcctgccgaagcaccccttcagcccagtgcagccacagccggcctggtgcacatcctgccccgccagcagcatgcctcctgcccaagcagcacacccactgggctccacacaggagaaatcagaacacacgccagtcgccatgacacgcagagcagggagtgaaggagcagggcagggaggtgttgccctccacagccttcctctgtgccagacctggggctcagggaggaatcagacacatagttccccagtgtggctctgcccttgcttgcaggaacacagtggcctacagcgccatggccatccttactgcccacagggccactggggagcaagcatgcatcctggactcaagcagggtgaggaggatgaccccaggagcctcacttcctgcatctgaaaataagggctagtggggacgggcagggatttctgcatggcagtacgtgtagcacaggcctggacaagcggcaagaagccttgggagacacagacctccacagctgcctttctctgactcccacccaccaagttttcttgcgttttgtgttttgcctgaactggaagaggcgaagagtggagcatctctgggtacttggtccggccactgcaaggtattctgagcagggtccacccaccccaaggtctggccaagaggaagcaaatgtggggaagaagggaactgcacctcctgccctccacagggacagccccctgcccttcctctggcccgtgaggacacagaatcctcacaggtgacagcctcaaagagcctttctggctgactcttgaaagtaggtgtgcttccactccctcagaaggcagaaggagcaacaggaacacaatgcggtgcagtggcctctgcccctgccaggccacgccacgccacgccacatgcacgagtgctgagtgtcccagagccccacgggaggagcaggctcagggaataaccaggcccccaggcaccggccaggaacatgcagcaagtctgctctggaagcaggaagggcactgcaggctctttgtgactcaagaggcccaagatggggtcctcagcttttccccattctccgcccatgtgattctgagggtgaggatttgggggaccctatgctctgagagagcctccacatggcaaagcatggggccatggaactggctgcagactgtggcagaagcagacccacagctctttgccagaaccagaggaaaagtgacaggatgctcttctgaagtttaactccatcacccacattctggaggaagccctcaataattctgtcagtgacaaagccaaagtttcccaagcatactgatgcacagacgccatgggcaccagactacgtggctgatgccacttcaggcaagggcacggatgggcatgagtcaagctgctccatggagatgactgactggagatctaaggttcacctagctgctttctcactctgaccggtccaggggtggtgctagctccaggaacggcaacagcaggaatgacccagggcctccgccacctccatgcatctgaaagcagcgtgctgcccagagagagagagcagggacaggcgaggcggagggagaggaggcaagccaggctgcatgcaggggggcaccaggtgccactcgccacgagaagggctgcttgctcatgctctggagaaggtgggggagtagggtgagcaggcaaaggaggctccaggccaccccttcatgggaaagcacaaaggcactgctgatggtcgaggagacagacaagaaagtgactccctgaggcatcgcagctcccccactcccagagcaagagcaccacaacctcatctgttcctgctgccagggagggggctcaggaagctgcacagggagggccccggagaggccagacttccaggcctcaagtttctacacatcagggtgcaatgccccctgcccgccaccggaaactagagaacgatgcccacttcttatttggcttctgagtgacaggtgggtggtgggtttctgcttcccaccatccagcctgtgaaaactcactcagaggcaggataagaagcagcaggctgagcagggtcagaagcaggaggtgggaagaaaaactgaaaacataccttggcatgaggggactgcattttttgatacatctccaaggaatagtgatgaagccacatttcaacaaaaacctgcaaaaaagcattagctagtcaaaccattcttgacaatggtgtcagaccatccagtggggaaaggacagtgtctccaacaagcagagctgggaacacagaatacccatgtgcagaacagtgaagctgggcccttccttcacaccatcaccaaaaaataactcaaaatgggtaagcgacctgaggataagcactaaaaccatacactcttagaagaaaacatgggagaaaacttcataacactagatttggcaatgattaattagatatgatgcccaaagcacaggcaacaaaaggaaaaaaaatagacaactagacttcatcaaaatcaacactcttgagcatgaaaaaatactatagatagagtaaaaaggcaaccaacaggcatggtggctcaaccctgtcatcccagcactttgggaggccgaggtgggtgggattacctgaggccaggagttccagaccagcctggccaacataatgaaaatctgtctctacaaaaaatacaaaaattagctgggtgtggtgaggcatcacacctataatcccagcgacttgggagtctgaggtgggaggattgcttgtgcccaggagtttgagactgcagtgagccaagactgcaccactgcactctagcctggcaacaaagacagactctgatttaaaaaaaaaaaaaaaaaaaaaaaaaaaaagggctgggcacagtggctcacacctgtaatcccaacactttgggaggccaaggcaggtggatcacctgaggtcaggagttcgagaccagcctgacccaacatggagaaacagtgtctctactaaaaatacaaaattagccgggcgtggtggcgcatgcctgtaattccagctcagctactcaggaggctgaggcaggagaatcgcttgaacccaacaggcagaggttgtggtaagccaaaatcgtgccactccactccaacctgggcaacaagaacaaaactcggtctcaaaaaaaaaacaaaaaaaaaacccagcaactcaagtgtctactgagagatgaatgaataaacacaatgtggtacatccacacaatggaacactattcagccctaaaaagcaaggaaattctgacacatgctgtaacatggattaatctttagtccattatgctaagtgaagcatgctactcacacacaaataagtactatgtgctacgcatactctgggtatgagatctaggagtcaactccatagaaacagagagcagaatagtggttgccaggtgctgggtggggaattgtttaatggtttgatttccttgtttttcattagaagagatggggtctcactatgctggccaggctggtcttgaactcccggccttgagcaatcctttcctgctgggcctcccaacgcactaagattagaggtgtgaggcccctgcgcccgggctggttcagtttcagttttgcaagatgaaaagcattctggagattgcatgcacaacaacatgactgtattcaacactactgactgtacacttggaaatagttaagacaataagtttcatgttatatatatcttataattaaatttttttcttagttaaaaaaacaaaaagggccgggcacggtggctcacgcctgtaatcccaacactttgggaggccaaagcaaatggatcacttgatgtcaggagttcgagacatggtgaaaccccatctctactaaaaatgcaaaaattagctgagcatggcagtgggcacctgtaatcctagctactcggggggctgaggcgggagaatcacctgaacctgagaggtgaaggttgcacagagccaagattgagccactgcactccagcctggacaacagagggagactccatctcaaaaaaaaaaaaaaaaaaaaaaaaaatgctttggcccagggaacagcagaaccttccagttcttccctataagcgctgtgtcatgatcttctgccctcttcatggccagcacagcctacggtccacacagccaagagccatctgggcatcatggtcccctctgtgaacaggggcaacggttcttaccattccaccctgcgaggatgctgtgaaatggtatggaggcttcaaaaagtgcagcaccccaaatactaggagttacatataagatgggagatagaatcctatcttatctacatgccaggctgtaaagcaaggctgtggctaccaagtcagccccaggatccagcgtcagaagcagcacctgctgaatctctctgtgtgcctagaagacacagccaggacctgggagttggccagcactcaggaagtgagccagcccataccatcctgacaggctggagcccctctgggcagacaaggaaatctgtcacctactacttggatcccctgaatcaatggaaggcctgtggaggctgcacagacccctcaccattcagtgtcatggaaaccaaaagactctgcaacaattatatcaccacaggcaaaacgaaacaacttccatggacaggggatcctgggatgaaaaacgccatcaatgacattcaagttaaaagggtgggcagatttactttcatgttttctaaatgtcacagcaggaaaatatcaacaatttagaatcagccccgggctgaggggccgcctctgggactctgccccacatagtggaaggtggcaacagtttcttttctttttctttttttttttttgagatggagtctagttctgtcacccaggctggagtgcaatggcacgatctcagcttactgcagcctccacctcctgggttcaagcgattctcccgcctcagcctcccgagtagctgggattacaggcgcctgccaccacgcccaactaatttttgtgtttttagtagagacgtggtttcaccatgctggccaggttggtcccaaactcctgacctcaggtcatctgcccacctaggcctcgcaaagtgctggggattataggcacgagccaccatgcccagctggctgaacagtttcttttgaccagctcaactctcacctggagcagagtttctgacctccagatctcgtgggaggcggggtctgcattcacagacgtctgatgagagatgtgtcgctttaggaggctagtgtggtggaggccataggaagcaaagggtatggctggtgtcctgagggagacacagaaacaggcccgagttacaggctcccgctgtaactcgctcccgctgtaacaggggcaatctggatatcaaaatcaacgagagcagggacagattacaacttgttcaatagcacaatgcacacctccccccagccccctgatccacactgatatacctgaataaataaatagcaaagagagaagtcttccttaccacagagtgaccattgacccacaaatcaatgaaggagggatgaagttagagaaccaccatttagtaaccgccctattaatagctgatttggtcaagaatcaacagtgaggttgggcatgggggttcacacctgtgagcatgggggctcacaccagcaccttgggagaccaaggcaggaggatttcttgaggccaggcatttgagatcagcctgggcaacaaaatgagaacctatctccacaaaaacattgaaacataaaacagctgggcctggtggcatgtgcctgtagtcctagctacttagaaggctgaggagggagaatggcctgggcccacgagttgaggctatagtgacaaatgatcgtaccaacttcactccaccctggggtgacagagcaagaccctgtttctaaaaaattaagaaattcccagcctgggcaacatggcaaaaccctgtctccacaaaaaaatacaaaaattagccaggtgtggtgatgcctccctgtagtcccagatacttggggggttgagacaggaggatcacttgagcccaggaggttgaggttgctgtgagcagagatcgtaccactgcactccagcctggggtaagagaacaagaccctgtctgcaaataaaatcaatttgaaaaaataggagaatcaaaagtggatgttaatactactgataattacatagtctccatacatcttcccggtaaattctcgttatcaatttttttttgagacaggatcgtaccctatcgcctaggctggagtgcaatgatgcaatcacagctcactgcaacctcaacctcctagacttaggcctcccaagtagctgggaccaacaccaccacgcctggctgatgtttttctttttagtagaaacaaggtcatgctatgttgcccaggcactattaatttttttttttttttttttggttgagatacggtctcactctgtagcccaggctggagtacaggggcatgatcttggctcactgctacctccgcctcctgggtgcaagcaatcctcccacctcagcctctcaagtagctgggattacaggcgcacaccaccacacctggttatttttaaatttttggtagagatgggattttgctatgttgcctgagctggtctcacactcctgagctccagtgatccgcccacctcagcctctcaaagtcctggaattacaggcatgagccaccatgcccagcctcattactatttaacctgggcacaaagtaattattttacaatggaaaaacctgaccggcacctttttaacccagtgataaaagggcacctggcaaggaccaggtgtcccactacggtgctcctcccaacaaagcccatgctgggcctagtcaccagcaaataccacacagcctaaggggcggccgcatgctctggaggggtcaaggtcaggaaagacagaaaggcaagggaccattcctgactgaaggggactagaaatatcactatatacagtgggtgagcctgtgaaacatcactgcacacagtgtgaggcctggtggcaatactaacttcctggtgtggttacaggcactgtgactatataggataatgcattcgcttctaggaaatacactgaaatattaagaggtcaagggatgccatatcctgtagcttactcatattggcttagagaaaaaaaaacacatacaatagaggtggaaaccaacacatgcagcaaagtattaacagtttggaaatctgggtgaagatctatgaaagtttcttttttttttttttccctgagacaggatcttgttctgttaccccaggctaaagtgcagtggcacgctcacagctcattgctcctgggcacaagtgatcctcccacctcagcctcctgagtagctgggaccatagttgcacatcaccatacttggctaattttttttttgtagaaatgaggtctcccgacgttgcccacactggtctcgaattcctggcctcaagtgatcctcccgccttggcctcccaaagtgttgggattacaggcgtgagccactgtgctcagcctgcaagttatttttattatgcgtggaaacttatctgtaaatctgaagttatttcaaaataaaaagttaggtgtggtgacttgcaactgtaattccagctacttgggaagctgaggcgggaagattgctgaggccaggagttcaagaccagcctgggcaacacagcgaggcatccccatatctccgcaaaaaaaaaaaaaaaagttaaattagctggctgtagtgatgcatgcctatagtcactgatgtgacaggctggcttgagtgatgattgtgccaccaagtgatgattatgacactgcactccagcctgtgtgacagagtaagaccgtctttaaaaatacataatggctaggccaggagcggcggctcacacctgtaatcccagcactttagggggtcgaggcaggcagatcacttgtggtaaggagttcaagatcagtctgctcaacatggtgaaaccctgtctctactaaagatacaaaaattagctgggtgtggtgacaggcacctgtagtcccagctacttgggactgagccaggagaatcacttgaagcagagacagcgccactgcactccagcctgggcaacagagtaagaccctgtcaaaaaaaaaaaaaaaagcacacaatggaccagtgtagtggttcatgcctgtaatctctgaactttgggaggctaaggcaggaggatcgctcgagcccaggagttctagagcagcctgggcaacatagcaagacccatcttacaaaaaaataaaataaaagctaggtgtgggggtgcatgcttatagtactagctacttgggaggttgaagtgggaggatcacttgagctcaggaggtcaatgttgcagtgagttgtgatcacaacactgcactccaggctgagcaacccagccaggccctgtctcaaaaaaaaaaaaatgctgggtgcagtagctcacacctgtaatcccagcactttgtctgaggccaaggtggacggattgcctgaggtcaggagtttgaggccagcctggccaacatggtgaaaccccgttactactaaaaatacaaaaattagtcgggcatgctgacctgtgcctgtaatcccagctacttgcgaggctgaggtgggagaatcacttgaacccaggagatggaggttgcagtgagccaagatcatgccactgcaccactccagcatgggcgacagagtgagactccatctccaaacacaaaataaaataaaataaaataaaataaataaataaacccaaaccatatatatataatttcttttcttttttttttttgtgtgtgtgtacagtggtgcaatctcagctcaccacaacctccgcctcccgggttcaagcaattctcccgcctcaacctcctgagtagctgggattacaggtgtgcaccaccatgcccagctaatttttgtatttttagtagacaaggtttcaccatgttggctaggctggtctcgaattcctgacctcaggcgatccctccaccttggcctcccaaagtgctgggattacaggcatcagtcaccactcccagcctacgtatataatttctaatagaaaaaattaaaacaacccaaaaagttaaaacaagcaaaaaaaccaggcatcaaaaactgcttggcagctgaattctgcatctaagagggtgtgaatctgcctcacctccgagtcctccacaggatcagcaacatttcagggtcactgatcactgccgctacctgggcagcgtctcctccttgccactccctttctcccctccaccctctggggaatctgtccacacgtgaattgtaggtaaaggcctggcctgccttacacatgccagcagatctggggtgggccagcatctgcaggaaggggcctgcatgcagcttcctggggaaggcgatgggccagtgagattaaagagggtcagaggtgcacaggcagctgctgctggggcaagagggtctcctgggaagtcggcctgcgttagtgcccactgaggacccaggacagccaggcatgagagcccctggttcacactcccaacctgtgcaggcacgcatcaggctcagcctgtttggactgacaaaacaggctctttggcccagggcctccccttcaagatctgctcctggggcccatagagattcctattttttttgctcataggacaacctttccaccctgctcactgactcagacaccgcctgtggggacggctgctccatgcacaacacagcccattcccatgcaggccgtggaggcctccagggacctgatagcttcagtgatggccaaagacactgaacactaaggacagattgcccgccataccccaccctccagtctgtgctaagacagctggggatggggaatgaggcataagaaaaattggggaaccgtggacaaagggtggcaacattgtccccgtgggcgatgcaagtgaccaggccactcccttatggaagggccaggtcttaacaaagggcagccttacctgggaggtggtgaggggctggtcccccctgggctggaggagagtggtgggggcacactgccttcggtgggcaggaaccatgacaggtacctgtccaccaggatgaaataggcacagtctgaagtacggacgtggagggacacaggaagtggctggaaaaccaagctagttgttagcatgggctctggacactgccaggccaccaagcaccaacaagtgcagggaagccctgggccgtggccccacctctcccagcaaaaggcatcccttccttaccttctgagtgatgaggctcaaggcaaagaagaatatgtaatactcgaacggatctgagagcagcgtcaggggcaaacatgcagggttgatgagccaccccccgctcagtgtcaagtgctgggccacccacagcctccctacctcagggccaccaaaggatactcagggccaagttcagaccaaggcccccagtaggggtgaactggaccttgttgtggtacagaggactgtcagggaggatgcactcctggatggacgccttcacaggaccctgcagagagaggcagtgaggcttgtgggcaggtgctggtgcgtagtgcccgatacgcagtaccccacatgcacagcagcactttgggaaggctgctggggaagagacccacacacagaacccacctgtggggacagtgccctgcctctgagcagtgcctgaacaagagtctttgcttagaacttctcctaccatcatctcataaagagctgcagacagcaagggtagcagtcatgcaatacccatttcctttgcctctcacacccctggaacgaatcgctcctcaatttgccctcagaggactggaggagattgcccatcaccacagggctgtgcaaggcccactgccccgagcaccactctcgccactgtggtttacttacaggcaagtaggagacaggaaagtcgaacttatagtcttcagcttgaagcttataaaccaacttcatcattgggccactgaacacgaaattgaacaaacaaacaaaaacagggcaaatgaactgcgaattatcttgctttgattgtttcttaatcttgagaaattcagagagtgctttaaaggtggaatcaccatgaggaatcacccagcctctctccggtgaccaacctacctacccagggtcgagaaattccatcacgatgctgtactccacaggattcacgcgcccctgtaagcagcggaggttccagccaacgaggacaccatctaggctgccaaaaatgctttctaccagccatgggaagatggtgtgcagctcctgaaacaatgtgtggtgaagccgcgtgcaggaccagcacccactcctgccccggctctagtcctgcaccacctgctgcccagctccctctgaggaagccactccctggctaagacctatgggatcagccctgcacccaaaggaagcctggtgccatggtgccaacgacaagagcagctttacgttcttccagtggggtacatggcataccaagcagtgttgctttagacttgggccagttaagtaagtcagcctccgatcaaaatacattttttgtgtgtgatagaagattaaattaagaaaaataaataaatttaaaaaaaaacaaacaatgaaaataaaaaaatataaaataaaaaaataaacaaaatacatatttattgagacaaggtctcactctgttgccctggctggagtgcagtggcgcaattatggctcactgcagcctcgacttcctgggctcgagcaatccccccacctcagcttcctgagtaaatgggactataggcacacaccactacactcagctaatttttaaatttcttgtagagataggttctcagtatgttgcctaggctggttttgagctcctgggcttaagtgatcctcccacctcggcctcccaaagtgttgagattacaggcatgagccaccacaaaaaaaagattctttaaacagtgatggaaacttctgacttgaaggatgctctatcagaaaggaaagcaacatcctttccagagtgaagcccctgaaacctaactgacctattgccatttggtattaactccttgtctaggccagcttcctgggcttgacaattccaggtgtgatttaaatacatatttttagtatttacatcagggtttctcaatcttggtgctgttgacattttgggctagatacttctttgtcgcagggagctgtcctgtgctttgcagaatgtttccagcaaccctggcctctacttcttagaagctagtagcacacactccccatctacctccagatgtgacaaccaaaaatgtctctgacattgccaagtgtccctgaggaacagagcatctgtggctgagaacccctgatctacaagttcacatgtttaaatgtgtccgtaaacataatggtcatggtaatggccaggcctctgtgccaggcagtgctcggggttggggcggggagggaaattaggaattataataaagttcttcaacgaatgtataagacatgctccaaagagagacgttagcagagctatacctttgctggaaagtcctcaatgactttaaccaagtcttggcactgctgtgcaaagggcttatttatagagtcagctttcaggctagcctagaagacagaacaaagcgaaaaagtcacgaggacattcactctgcagcttttagtggcactctggcttgagtcaaacagaaatccaagcaataggttatgagtcagacccataacctctggcctggttccccagcccctcatgtgtgtcagtggcccaaagagtactactaggagaggccgtagttctatgctctctggaccaggaactatcagccttgtttcccagtaccccctcagagtgctgcacatgatcagaacaggattgacttccaccaatccataagtaggggttggtcccagagtcagccccacagccagaagaggatcttgactgtgtaagggcacccctcacaaaccacagagtataactgagtttgtacgcatcaactggaaatttccagcctgatggaccaccgtgattacaccattgtgatcatcagtaagaacgcccaacaacatcacggctatggcagaagctctcttaaatgagctgtcctttattcggtagacactgaaccactaaaccaatgatcttaaaacacagggcagacaaaaattatagatggcttcagccaagtagacactaatcatgaaggcaatggagaggccagaaaagactcaggacaaggactaatgaaatctacctagtcgtgggatgtgaggaaagcaccctgactacaaggagaaaaagggcatctgtgcgaatggattaagatcaggagaaacggctagaatttcaacctagagagctttgccaaaggatatctaaggccttgtctacctccaaacaagggtggatttcacagtgattgagacagagatggagacctgagctatctggccatgggccagacctgttgactctagtggggtgcactgaggaagaatgtccttccacataaatgtttacaaaaacacctcctaagaactaaaattaggaactttcatcaccaatacttgcctcatatctaacttctcacttctcagtatcatttttttttcctttttgagtctttactatgttgcccaggctggtctcaaactcttgggctcaagtaatcctcctgcctcagtctcctcagtagctggaactccaggcatgagccactgcacccagttctcagcatcatgtttaatacttaaagtgcaacctagcaggcccccgcacaacagtgtctccatttttcactgatgacagttatgactgattattagaatacttcatatctatttaagaatttacaagtcatgaacattctgatatacatccttctcacttgctcttcctcctcctcacacccttgggaagtagagaaaatagaatttgaatgaacttgtgtgagaaaacccagagcccagaagttgagtaaccccaaggtcctgtagtaataaggaggcacagtcaagttaaggagtctgccattgtttccatcacatgcccctaaaaaacaaccactacagagttcttcaagtcaatgggaagaacactcaagtcccacatctacagaactatggccacactgacactcatgcaagcagttgatatttaccagtagaaagctgggctgctgcaggtgagggaacgccatagcagcctccagtggagagttgaaaatggccttcttagcaaaccactgtggaaaaacaaagacaaaatctcaacatctgtaacacagcagaatctttttatattatttttttagagacagggtcttgttctgttgcccaggctggcatgcagcagcacgatcatagctcactgcaacctcaaactcctgggttcaagcaatcctcccacgtcagtctcctgagtacaggcacgtgccactatgcctggctaattttcttcttttttgagacagggtctcgctatgttgcccaggctagtttgtcaggctgtgatgcccaggatcctggcctccactgatcctcctgccttggcctcctaagtgttggggttacaggtgtgagccactgcacctggccctaacaaaatattacatagtttcacaatgcccaggagaatatcacacattacattaccaattcgcaacacacattacattgccaattctcatgtcttacttattgattagagacaggctcttgcttgctcactcaggctgcagtacagtggtgcgatcatagctcattgcaacctcaaactcctgagctcaagtgatcctcctgcgtcagcctcccaactagcgggaactacaggcaaacatcaacaagcccagctaatttttgtactttttgtaaagatgggggtttcatcatgttgcttagactgctcttgaactcccagactcaagcgaactatccgcctcagcctcccaaagtgctgggattacaggtgtgagccaacacgcctggccagcaattcccatcttttatagaaatgctgttctcagccgggcatggtggctcccacctgtaatcctagtactttgggaggctgaggcaggaggatcacctgaggtcaggagttcaagaccagcctggctaacatggtgaaaacccgtctctaccaaaatacaaaaattagccgggcatgatggtgggtgcctataatcccagctactcaggaggctgagacccgagaatcacttgaacccaggagaggtggttgcagtgagctgagtcacaccactgcactccagcctagaaggctgagcaagactccatctcaaaaaaaaaaaaaagaaaaaaagaaatactgttctcctgcagcccatagtggccagcttcagagccaagtttgtagtactgaatcctcggtaatgcttgtacagcatttgttatataccaggactcgctctaaatgctctctatatatctcctcatttaatcctcagtggtaggcagaattctaaagatagcagcccaagattcccgacccctgtttgttcaatcaaatactcatctaggtactgctatgacggcattttgcacatccaattagagtcctaagttagtggaccttaagttacagagtagtccccagctgacagccagcaaggaaacaaagaccttagttctacaactccaaggaactggattctgccagcaacctaaataaacctggaagcagcttcttccctagagtctccagataagagcaaagctaccaacaccttgattttaatcttgtaatgcctggacttctgcatacataactatgagataataaatggatgccggtttaagctgctaagtttgtcatacaagaatagaaaaaccaacctcacaacaacccgatgggtacagatgtactatgactgcaggtcagtacagatgatgaaggagaggcagaaatgggataattcacttacccccacccagctagtaagtggcagaaccaagattccaatacaaacaccacctcacaaaactgagacaggggcaaatcccctccatattacctgtgcactatgcaatgaacggaggggaagagcaagctctgccaagggagcctttgaataagccatgagaaaactaggatcaaaggccgggcaccatggctcacacctgtaatcccagcactttgggaggccgcggtgggcagatcacttgaggccaggagtttgagaccagtctggccaacgtggcaaaaccccatctctactaaaaatataaaaattagctgggtgtggtggcgggcacctgtagtcccagcaactcgggaggctgaggcatgagaaatgcttgagcccaggaggcggaggttgcagtgagccaagatcacaccattgcactctagccggggtgatagagggaaactctcaaaaaatggaaaaaaaaaaagaaaaaaaaagaaagaaaactaagatcagctttccagaatcctacctctcagctcacccaggtcagaaatgaaaaatgctcagacctagacttcacagacaggaagtctgccaagtcccactggtgggctagttacagttttcatggcccagctctgcccactgcacaagtaaaggcactggggtgacacctggcagtctgtggaggaagagaggctgggtgtaaagaggccatgtaggcagctgtagagtgagaggagacaggaatctctgcctctcggcaataggaacatctcccaagttttttcaattctttttttttttttttttttgagacagagtctcgctctgttgcccaggctagagtcctgtggcgctatcttggctcactgcaagctccgcttgggttcacgccattctcctgcctcagcctcccgagtagctgggaccacaggcactggccaccacacccggctaatttttttgtatttttagtagagacggggtttcactgtattagccaggatggtctcgatctcctgacctcgtgatccgcctgcctcggcctcccaaagtgatgggcttacaggcatgacccaccgcgcccagcctcttttttctttttttgactgagtctcactccatcatctcactgcaacctccacctccaaagttcaaacggttctcgtgcctcagcctcccgagtagctgggattacaggggcctgccaccacaggctgcctaatttttctatttttagtagaggcgggtttccctatgctggccaggctggtctcaaattcctggcctcaagtgatccgctgcctcagcctcccaaagtgccgactttttcaattcttttttgagatggagtctcgctccgttgccaagctggagtccaatggcatgatctcggctcactgcaacttccgactccctggttcaagcaattctcctgcctcagcctcccgagtagctggaattacaggcacatgccaccacatccagttaatttttgtatttttagtagagatggggtttcactatgttggccagactggtctcaaactcctgacctcgtgatcagccctcctcggcctcccaaagtgcagagattacagacgtgagtcaccatgcccggccgctttttcttttttctcctttttttttttttgagatggtctcgctctgtcgcccagagtggagtgcagtggcgcgatctgggctcactgcaagctccgcctcccgggttcacgccattctcctgcctcagcctccctagtagctgggattacaggcgcccgccaccacgcccggctaattgttttttgtatttttagtagacagggtttcacgtgttagccaggatggtctcgatctcctgacctcgtgatccgcccgcctcagcctcccaaagtgctaggattacaagcgtgagccactgcgcccggccagctttctctttttcttttttcagacggagtctcgctctgggctctgtcgcacaggctggagtgcagtggcgcgatctcagctcactgcaacctccgcctcgcgggtgcaagcaattctcttactcagcctcccaagtggctgggattacaggcgcccgctaccacgcccggctaatttttgtattttttactagagacgaggtttcaccatcttggccaggctggtcttgaactcctgacctcgtgatccacccgcctgggcctcccaaagtgctgggattacaggcgtgagtcaccgctcccggcctcaattcttaacctagctatcaactgcagtgttaaagaaaaacgcctcagtcctaaggcacttggtcaagaaaacgctgcactactacaaaatgatcaaagcagcattaaactgtggactgttcggtaagtgcggagctctagagacgatgaaggggagagcatctctgctcagaagaagctttcatgggcagcgactgaaagaatgaggcccagaggaatttctaggaaatttccaagaaaggaaattcaaacccgagaattcccaagaggtgtctcccacacccctgttatctgactctgccatggccaccctcccccgtcacaggtctctgcgtgccatgcacctagagtccacttcatggcgactctccaacacctattttctccaggagctgcttcggaccccgtttgttttttgttttgttttgtttttctgacagcgacagcccttgggcaacgctaatcattccaagcaaattctgtcatgccaagacctcccttaacagcacgcgcccacttgttcccaactctcctgccaattgggcttcgggagcctccaaaaccaaggctcggagatgtggagcacacaggggaagggtcgagctgggacccacacccggctcttacacccacaccgcctgttgagcccaaggctcaacttcaacacaaagctctccttccctcaattccttcaacgaaggttaaccttcagcgaacacctaccggaccgggacagagtgtacgagccgcgcgggaaggtggcacaaaggcatggcccagaggggtggcagaagactcaaccggggccctccactccccagcctgccctgcctgggcagagccggctggccggcccgagtcctggggctcgcggaggaacggagatggcctccgcaggggctcggggaagcccccagggcgccggaccgtctcaggcgcgcatcccgcgccactcacctgtgggatccatagcgtcgctcgcctcagagatggaagccgccattccgccacggcgccgaaagtcgtcatcaagctgcgcgcagagccacgccccgcggccgggcgggaaaagcgcttccacctctttgggccgttacctcaaaaggcgcgtgcgcaaagcgaaggccggccgggcggggaagagaaatggcgaggcaggagtgcgggggagggagtggtccttagctgaatgcgcctgcgttgtggcggcctccggcgccccaaggtactttctccccagcaaggaatccgcgtgcgcgtaagcagtattgttgattagtgccccccccttccccccgcccgccccgaaaagcgacccctagtggtgcaccggtgcggaccagaaaattgcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccagggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagtgagcggggcgggtgggggccgcatgctagccagacaccccccgacctctgctttccgggtacgcccggcccgctggtcgggaggagcccccgcccccgtccttgtcgggtcttcagggaggtggccgcgccgggcggagagggctcaccggccccgcgtctgtccccgccaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggtcagagctgggcccgctgtccctgccccagtggcgggggtggcgggcggggagggggcaggcgcggcacagcggcggcgtggccctgagtggccaggcctgtctgtcggtctaggcccagcacctgcagggcccatccgtgggctctgctcctgggcttcgctgccagccttaggaggcacgtccaggtcaggtggacgcagagtgcgtaccccagggtggtccaggctgggtagggctcctccgcttagctcccctccacctcttcactcaggccttcatcctacaacgtcgggaatcaagacagtttggggctgggcgccctggctcacgcctataatctttgggaccccagggcgggaggatcgtttgaggccatgagttttagaccactctgggtgacagggtgagatcctgtctctaaatgtttttcaaaagacagtctcgatctctgtcctgtggtatacagcatccagggaagtgcccagggaccagggcaggcagaggtcttcctgcctttaccccacctgggcccagttcctgcgcaggggcttggccagtcctggtcagctttccctctgatgactgcaggaagagagtcagacgcggaactcccagggtgcagaggcctgcggggtctgaagggcctcctccctctccagtgtggtgactgggctgaggagattctgggactgagagtgtcatggtggagcctctgtccctgctcatcctctccgcatgttgcttctgctcccgatggctctctctgaaatgcagcacaacctcctaggccaatggaagaaggcccagagctggctccctgcctggaagcacgaggagacccgcacaggcatcctgagaaggcgtggagagcaggctgccttcatggggggagtgccagggcctgggcacccacacccgctgacccaagagggcccgggcacctgcgtgctggcctcttcactgaccttcgctctgtctgctctctttgtgtctctctctgacctccagaggcctcctttctctctgccaggaacagtagcccccctgcaaggccctccttttcctccagcccgcagcctgcggcctctccggttctgctccacagcccggctgccacacactcgcctctctctccaggccccccgggttccctccgcctctcttgctgcctgttctctccttttgcaggttgcgtttattggcttatctctgggggttggtgctctcccttgtttccatggaaactgcctggccccaggaggcccaagcagctttgagctccaagggcaggaccatgcaggccatcgctgccctgccgcttagccacagggcacgatttctgactcggtttattagagacatagtgtggcagtctctagaccccacagtcgggctggcatctggggacaggaccaacacccccacaccccagaggcgaactgtggtgagtgtaaagagcccctctccaagggaagacagccggccagagtgcggtgtgctgtgctggagagcacagccccaggcgtgacaaacacctcggcctcttagaagttgtcccttatctggacaggaagtctggaggctgaaacagagactcccaccttcccagagtctcctgggcagtgccacacagatgccatatgctggccccgtggccacactccagcactcagcccccttgcccacctcactcctgagttagcacactttccaggtgtcagcaggtgtgatcaggggctcagagccagggtcctgtgagagcccaggggtctttggttgcacctcctgcgtgcacttcctgacagcgcccacctcactgccacccagagctcggacccaagggagggtggagaggggctgagggacaggcctggagtaggggtgtatgcactgcaggctgagatgagcaattgaggggcaagtgtccagcaggagggagaaactgggaacagagtccttgtcactccaggggatgttgctgctcactcagcactcactcagggctctgggagccaggcctagctctcagggcagagggtgtggcagggaagtgagatgatcacactcagagcccagtgagaggcagtgaggaaaaccaccagcgagaccagtgtggtggctcacacctgtaatcccagcactttgggaagtcaaggcaggtggatcccttgagctcaggagttcaagaccagcctgggcaacatagcaagaccccatctctacaaaaaatacaaaaactagccaggcagggctgggcgcggtggctcacgcctgtaatcccagcactttgggaggccgaggcgggcggatctcgaggtcaggagattgagaccatcccggctaacacggtgaaaccccgtctctactaaaaatacaaaaaaaattagctgggcgtggtggcaggtgcctgtagtcccagctactcgggaggctgaggcagaagaatggcgtgaacttgggaggtggagcttacagtgagccgagatcacaccactgcactccagcctgggggacagagcgagactccgtctcaaaaaaaaaaaaaaactagccaggtgggcatggtggtggcgcccatctgtagtcccagctacttgggaggctgaggtgggaggatcgcctgagcctgagggggatgttgccgtgagccaagagcttgtgactggactccagcctgggcaacagagcaagaccctgtctcaaaaaaaaaaaaaaaagaaaaaccgctagcaatggagatgggaggaggcttcagagcccagagagcagcaagggttacacaggggggtaacaagggttacagcaggaggggggtcggcagagccccacacgtgtgagctggggcagtgggagggcgtgggtgaggcagagcgctgtccaggtgctggtaggccgggggcgggaggaggcaggtgggggggcacggtcaagatgtatgtgagggttgtggcactggaaatgcaggcatagaggggccaggaggattagggggtgctgtgtgagcgaatgggggctccgagagaatttacccaaggacaggagtggcctggagtgctgggaccctcagggtcatttgttccttgagggctctgtcctggaagcatagcccaggtcctgtaggctgggtggcagaaagccaggacatgagggcaccgaggccctgtggagatagagtggaacctgaggaggaggtggaggggaatggggcagatgtggggccacaccaggagtgtgctgctgagtgagaagcagaggccacagatggaatgctgagagctctctgaggcccacatgttacagcatctgaccacacagagctccggctgccctggtaatggcagaatctggggtggaggacataaggggggttgttggagtgatccggctggggggcatggaggccataggtttcccacaggactcgggtgtggagttctccaggctgtgggccaggccctctcaagcttgcctctgagctgcagcaggcaccctgggtcctctggatgcctgtcccccagccatccagacagcctgtggggacaaccaccaccagattcactcatacccacagggaaggggaaatagaaaaccccagaagcacagaggggcaatgcttgtcttggtgagagtctggagtcattgagggaaaaataaattcagtcaagcgttctatttaagtttagagaaactatacgttttaaaagttgtccagagcatgcatgtaagatgacgtttggagtgtggaagccatctcacctgagctgtgctgcctgatacaggaaccttgagccacacatggctggcatggtcattgcactgcgtgtggtatgcacagcagatgccaaatgaccggtacaaaagggaatgcaaaaaacccaccacaccttgggagtccacagctactggatctcttgagctcagcagttcaggactagccagggcaacacagggagacccaatctctacaaaacacaaaaattagcagggcatggtggcacacatctgtagttccagctacttgggaggctgaggttggaggattgcttgagcctgggaggttgaggttgcagtgagctgtgactgcaccactgcactccagcctgggtgagagagtgagaccctgtctcaaaaataaacaaaaaaccccaaagtgaatgaggctgggcattggttcacacctgtaatcccagcactttgggaggctgaggcaggatcatcacttgaagctcggagtttgagaccagcctgggcaaaatagcaagaccccacccatttctacaaagaaacaagaaaaagaacagaggtgaatgcaacatcttatgaataacttatgtactgattacgtattgaaataatacgttggatattttagattaaagtatttgagctaattctgcattttcttttactttttatttatttatttatttttgagacagtcttgttctgtcacccaggctggagtgcagtggcacactcatagctcactgcagcttcaacctcgtgggctcagacaatcctcccacctcctcttgagtagctgggactacaggtgcacactaccacacgtggctaattttttaattttttgtagagatggaggtctcactgtgttgtcccagctggtctctagcttctggcctcaaaggatcctcccgccttggcctcccaaagtagtggaattacaggcatgagccactgacccctgctgagccaggctgttttcaacattcaatggtcattgactatctttggcgtttaggagggccctccagggaccaggcgtaggggcatcagtcaccccgccctcacaccccaacctgcagccacacttggttcaatcccactgtctagcccgtctgactcagtagcccctcccgagggagcagggctaagcaaagctggtttccccactgcaaggcactgcaggccattctattctgggccttctcatccttcataaagtgaggaggcctgaacagggctccccactaaccctgagagcgcacaattcctgaagatttccaggattttcttagtatcagttatggcttaaagttatgttggtttcacatttccagggtttgtcaaccctgtcagatttaaagataagcattattagccaggtgtggccccatgcttgtagtcccagctacatcggaggctgaggcaggaagatccctccaggccgtgagtttggggcagcaatgaactgtgattgcatcactgtgctctagaccaagtgacagagcaagactcagtctctaaacccccctcccccaccactcaaaaaaaaaaaaaagcattatttgctcttttctgcttccctctcatccttgtttccagaagggactgggtcattgctgaggggaggagaggaagctcagatggcagcaagctgaagggaagccgactctgagtcaggcccaagtctgcggcctgccatgctgcgtgctgtggggagctgagagcgcatgggcacctaagcacccagattaggctgcggctacagaagatctgactctgtctggcctggcctgcggagggactgtggcctcagaggaggatgctggcccagtgtgggagctgctgcagggtggcggggcccgtctgctcatggaagacagaatccttgccccttgaccagtcagtggggactagaattatggcagtttgtaccacaagagatgcgtggtggctattgtctgctttgtgcctttttcacgagtcactgctgggctgaggtggccaatcatcacccaccacgtgttcctgactgcgctcctccttggctcagggcaaccctgactccatctttgttgagtcaagtgtgacaagctgacagagttccaagcatgacaccgctgtaaccctcaccaccaccaggcaagaatgagcaaagatctcattctctgaggaagaactccccggaaactcaaaaggagggccgtcctatccctgcagggtatggggagaattttctggtattagcatagaaagggagctggaggtacctctggaagagcgggggtccacggcatctcagacacaggagtctctgcttgttcagggtgacagatggtgaaacagaaatgacctaatggatctctagacacccggttgcatcttttctccaggaatccagtttcccattgcagggtatttgactacacttgataagaggccagggaaggaccaggattgaggctgggtgttctgttggctgaacccttgtctggagtcaccctaaaagtgatggcaggggagttcctgcaagggactgccccaaacctttccaggatgagagccagttgggattccaaaggaagaaacacttaatgccagggtggtcagtccaaagcatttgttagggagcttacatacagagggggctgcagtgtaccctcacgagggacagccaggaaagaggttgtgcctaggcacaccgcactgagggggtggggtgtggagtttctatgagggtgcaaggaatttggctggggtgggaccagtttccacgtgcttagcaacatgtcagatctttcagtgttccaggcaacaacctaaacgtgtatcagtgtctggtaacatgcaagccccagccagggtttgagcctgcagggggaacatgtagctgattaggtcagagtagtcaaggcacttcctcagtcaggacaaaggaaacactggggggatgaaatgggggacccaacactgagtcaggcaggggacacatgccctgtttagagcccacaggccagaccctgccaggccagagcaggggagagccctggccaaggcactccacatgggggtctgtgaccccacgggcaagcctgctacccgggcacgtttgtaccttggagggtcctctcagtcttgccgatgctgtcaacaccctgagcccagggaaatccatcccattaaaataaaggtctggcccaagtgtggttgcagatttttcttggctatcttaaagagtaaagtaagcaaattacaaatcaaagaaactctgaaccagtggtcttcatccaagagagcctctggtggtcagaaggaaagtctcaagcattcagactgtggcaggaaccctgtcatggaatctggcagctaaacccgaaagcaagaggcttgaccactgcagaacactcgggtaggtaggaaacaatgaaagagcttccaaaatcaaaatcagaaacccaattccaggacttggtgactgcagtacttcctgcctgtcaccatctagggcagctcagatgtgcagtccagcatgaacacaccttgaggatgaggcagcgcatccctgctgctgccgccgctgatggcaccatcagggcagactaggtttgctgaccaggctaggtgtggaccagcacacctacctttccctaaatgggcccgtggcatgtgtcctttcaaaatgttcccttggcagtgtgctccttgcatggctttgctcctaggacacatccaaaagggtcccctgcacactgcgaagggcttctggggcgtgacctgtctttagtggttctgagtctcaggacttggggctgatgcagggcctctagctgaagggactttgatggaaatgtgcagacacaaatgttgcccaaggaccacgagtacagcaggtgctgcagttacggggcacgcccattcctaatcattgtgctttgtgtctcctcagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcagatgttgtctaccgttttttttttttgtttttttttttatattaaggcacacttagaatgaagtttctgtgccggtcctggttgtgccacagtgaactaaccaggtcccttcaccatgggtcaacttcctgaacctgatttgggttctgagaaaaggcatctggattgccaggtcttttataaatagacgtcaacaagcttcacttgaagtgaaatgtgggaggtttttttggtttttttgaaatggagtcttgctctgtcacccaagctggagtgcagtggtgcgatctcggctcactacaagctccgcctcctgggttcacgccattctcctgcctcagcctcccaagtagctgggcctacaggtgcccatcaccacgcccggctaattttgttgtatttttagtagagacggggtttcactgtgttagctaggttggtctcgatctcccacctcatgggaggttttctaccaaggcagttgacagtgctgagggacagggtggctgtgtgtgcgcacagagggcgaacgctgccttccaggttaccgtggagcactggggtcagcatgggtgtgttgtgaccttctgtgggtcacgaatgctgtgtggaactcggttaatattctttccccctctaaaatgtcctgaccttacatatttgacccacagctttagagacttcatggacaagccccatccacagacctccaacacttcatgctcccttttagccagcatgacccatcaataaagaagcccgaaaaatcacaaattcagttgaaaaccctgactcagctttcctagaatttaggaaatctatacattgaacgcctggctttgaagaaacactattttcccctggtcaggttacttctgtggcagctgcttatgtacagtcctgctgcacccaaccccacgccagcagggcaggctggcaccccaccgctgtccatgcaggctctggggtcccaccagctcctgtaggcagagctaagctgcatgacactcagaggtcttggttttatacagaatctttaattgcaaacaacttgaaagcagccatcctaggggtggcaggggagaacccaccacaccctcccctcagtatgcttcgccttcttcagcctcagcttccacggaatccacgcccacctcttcacaatccttctctagagctgccaggtcctcgcgggcctcagagaactctccctcttccatgccttcgcccacgtaccagtgcacaaaggcccacttggcatacatgagatcgaacttatggaccaggcgggcccaggcctccgcaatggccgtggtgttgctcagcatgcacacggcccgctgcaccttggccaggtctcccccggggaccactgtggggggctggtagttaatgcccacctgccagagaagggaaagaaagcagtccgtgaagcttatatcaaacctagaaatggtagctacttctcctcaaacagaagacaccctgtaggtgacacggagaatgctcagttcacctcacaaacgtcactaagcccttctctgcaccaggcagggtgatagttccagacgaggaatagagaaaggaaccttggaggtagccaccctggtgggatcccaagctacctaaagggctgtgtcctagtacctgtgacatgtgataggtgcccaggtgaagacagtcttccctctgaaaatgtatgctgcttgtcttctttgtagattacaattaaattctgtagctaaacttcttccacccagatagattcagagtacacaactcttgcccatgctatcacaaggaacatcatacccacttctgacccacaaaacaagccactgtggatatgcaaaggtagcagatcatgggtcaagagtcatatgaatgctgctaccacagcagcaggaagtggtcgaagtggtccatgtgcctgcctaagtagggggtgacattccaaggtggtaaccaaaggggaagcattccaagtttcagaactcggtaataacatgacctgaggtcctggcagcagtgcacagggtcaactagagcagggatcagcaaactcgttctataaatgacaacatcaggccaggtgtggtggctcaagcctgtgaccccagcactttgggagacaggcgggcagatcacgtgaggccaggggtttgagaccagcctggccaacatggcaaaatcccatctctactaaaaatacaaaaattagccaggcgtggtggcaggtgcctgtaatcccagctacttgggaggctgaggcagagaagtgcttgaacccgggaggtggaggttgcagtgagtcaagatcgtgccactgcattccaacctggacgacagagcaagattgtctcaaaaaaaaaaaaaaattacccgggcatggtggtacatgtctgtgttcccagctacttgggaggctgaggtgagagaatcgctagagtctgggaggcagaggttgcagtgagccaggatcacactactacagcctgagagacaaagcgagaccctgtctcaaaaaataaataaataaataaagctcaccacagatatatagtgtgatgactcagaaagagttcaaaagacatcactgacctgggcgcagtggctcacgactgtaatcccagcactttgggaggctgaggcaggcagatcacctgaggtcaggagttcaagaccaacctgtccaacatggcgaaaccccgtctctactaaaaatacaaaaattagccgggcatggtggcaggtacctgtaatcccagctacttgggagggtgaggccagagaattgcttgaacccgggaggcagaggttgcagttagctgagatcgcaccactgcactccagcctggtcgacagagcaagactgtctcaaaaaaaaaaaaaaaaaaaaaatcactgaatcaattatcaactctggttcactaacttatgcccacatgcctagcccatggaacagggatagtctccccaaaggatgtgggccttcaaggccagtgttattttgtgcatctgctgcttgctgaaaggcctccatgtcacccagtcataccttaaatccagtcgggcaccaatccacaaactggatagtgcgcttggtcttgatggtggcgatggccgcattgacgtctttggggaccacgtcccccctgtacaacatgcagcaggccatgtacttgccatggcgagggtcacacttgaccatctgattggctggctcgaagcaggcattggtgatctcggccacagacagctgctcgtggtaggccttctcagctgagatgactggggcgtaggtggccagggggaagtggatgcgggggtacggcacgaggttggtctggaattccgtcaagtccacattcagggccccatcaaatcgcagggaggccgtgatggaggacacgatctgcccaatcaggcgattgaggttggtgtacgtgggacgttcaatgtccaggttgcgccgacatatgtcatagatggcttcattgtcgaccatgaaggcacagtcagaatgttccagggtcgtgtgggtggttaggatggagttgtagggctccaccacggctgtggagacctggggggctgggtaaatggcaaactctagcttggacttcttgctgtaatccactgagagccgctccatgagcagagatgcgaacccagagccagtgccgcccccaaagctgtggaagatgaggaagccctgcagtcctgtgcacagatccgcctgagagaaaccagacaacgtgagccaatgcccgtggaagccacaccaccaacctccaacaagccagggccgcttctctttgcctctaaagagttgatatggattcaaatcatccataataaacatgcaatacactttgaagcaaagaaaagcaaagatctacggacaaatcaccattgcagactcagtaggactcaagatgctggtctaagtttttgcttgtttgtttgagacggaatcttgctctgttgcccaggttagagtgcagtggtgcaatctcagctcactgcaacctccaccttccgagttcaagcaattcttctgcctcagcctctcaagtagctggcagtacaggtgtgtgccaccacacccagctaattttcgtatttttagtagacatagagtttcaccatgtaggccaggctggtctcaaactcctgacctcaggtaatccacctgctttagcctctcaaagtgctgggattacacgtgtgagccaccgcgcccggccaagatgctggtctaagtgttgataaaatgacttccctttcacattccaagaactacccctcccatgcaagacaatggccacatgaaaccttctcttcttaccagtttgcggatccggtccaggactaggtcaacaatctccttgccgatggtgtaatggcccctggcgtaattactggctgcatcttccttcccggtgatcagctgctctgggtggaagagctgcctgtaggtccctgtgcgcacttcatctgcaaaagagacagtgtgtactgtgaatttttaaggcctgtactcaccaagatggacacattccaggagtgttcacttctacagagcacatgctgttcaaagtacatgacctacatgtcataggtcaacagtggcagtgtctggtagaaaatgtctctgtgtgataaccaaactgcatatgcaatttatgactctacgacgttaaactcagcttgtggtataaatgtcagcacgaccagttcccagtgaaaggaaataagctcttgcactcctactcaggtacataattctttcctacgtgtagctacatcaaaggctgtaagttaaaaactcttacaacctgggcagtcaccaggtcagtgtgacttctgcagggcagtcccatcagggcaccctggatgacctgggtcccacaggctttcaggtgatgctgtcatctcctggggggccactgaaaggtgctgcctctttgtagctctccttggaaactacctcaggctgcgaatctgaaggaagcaaatgactgttctgtacttaccttctatgcctaagatgcaggtcaagactctcgtgcaccagcataagagaatgcacagcattcgggagggaaccaatgccactgcaccctgcaggcagggccacctgagcagggctgaggcagccatgagggaatctcttcacagcccatcttactgctggcaaagcagcttttccctgtaggtcaggttttcctaaattaggagccgagtctcacagacactttcatcacaaacctttcagtttctctcctaacaatgccatgggcatatgcctgtctatcccatcctttcagcaggaggattcaaaggagcccacacggggctttaccaatgctctcccaccctctcaggaaagctgccatccagtgcccaggcacctaccgaccacagtgggctccaggtccacaaacactgctctgggcacgtgcttgccagctccagtctcactgaagaacgtgttgaaggagtcgtccccgccaccaatggttttatcacttggcatttgaccatcgggctgaattccatgttcaaggcagtacagttcccagcaggcattgccgatctggacacccgcctgccccacgtggatagagatacactcgcgctgtgaaccggaacataaatgtgaacccattcatttcaaggcaacttgaaactatatggcatgcaaaatattctaatttaatatttatatagtgcttcagtatctggcgctttcacaatcgatatttcctaggagggttagtgactgatccctttatcgctgtgaaaactaattgctgtaaaccatactagctagtaagttctagaagtagccctagaacctgtttgccactacacaaaacttaggttattttaaaacttggaagccatttaatgtcaataatcaaccccacattatagcccgtcacagtaattctctgaagaataagtagcagtttttgattatgtcctgatcaaaggataaggtagtcgggttgggtaaggaaatacagagtaggtcccaggtcaccatggtccaagcccaggtgctcagtgtgtgtcctctctctgccccccagttctaccccgtccatcattcaccacctgctctgtgctctcgaaggctgacccttgagaacagcatcagaggccttcctcgccctctggcttcttgctggtttggtcaatggcaggcagcagtgggatactggggggctggaggaaagcagtgccagggtactccctccttggccccttcctgctcaactgctgtgggtgacctgaatccctctcaaggctacacttttggcaggctgccctcttcataaaactaccctcctaatttcttgtaaccacgccctctctctaccccttgaagcctacgggtgtaatggctcccagacatcatcagtgctgggacactgcactgtcctttggtggtttctttaaactctgccaagctgggtgtggtggctcattcctgtaatcccagcactttggaaggctgaggtgagaggatcacttgggaccagtttgagaccagcctgggtaacatagtgagtccctgtccctatgaaaaatttacaaattagccaggtgtggtggcacacacctgtagtaccagctactcggaaggctgaggcgggaggactgctggaagccaggggttcaaggctgcagggagccgtgatcttgcaactgtgttccagcctgggcaacagagcatttattgagtgctgtctcaaaaaaaaaaaaaaaagaaaagaaaagaaaaaagaaaaagaaaggaaaaaaaggataactgacaaatcacagctattcagacttgggacttgggaatctgttatgttaatgggctgctttttttgtttggttttttgaggcagggtctctgtggcccaggctggagtgcactggcgccatcacgactcactgcagcctcaaagttccaggctcggctgatcctcccacctcagcctcccgagtagctggaaccacagactcgcatcaccatgcccgggtaattttagtatttttttgtagagactgggtttcgccatgttggtcgggctgatcttgaactccagacatcaggggatccgcccgcctccacctccccaagggctgggattccaggcgtgagccgccgcgcctggcctaacggttgcctttaggtgaacaaggcaatgttgcagcagcgtctgagccttaattcctcatctgaccaatgtccacagccccaacccccgtcaccgaaggctcctgcagctcctcagctgtttccagtagcacaaagacgtgtgaagcgggagcagcgccctcctgtcttcaggaggcgacgccactatttgctctctgggggacgggataccgtcaatggtccccgtccactaaaggccggcagcttcatctaaaacaaaagccgccgtccctgccctgggacctgcagatccaggaaacgatcccgtgtcctcctgtcccgcactagaccctgcgtccttctctggcctcctctcagcgcccaggcccgcaacaacgtccctctgtccacccgaggccaacttcgtctgcctgggcatctgcggggcgggagtgacccgggtcttaccatggcgaactccgctgcttcagcccaacgctacttccagacctcaaccggctgccacagctgctgagcgcccaactgcaatgacctgcccacgcgcgccgcacaggattggcctgccggtgccaggccgccattggctcggagttcctgggaggcaggccgagggccggatcccagttctgattggccgttgctcaacacgtgtagtggggatgctctctgattggatgcaggattggcgggaaggcagcggggtcatcaaaggctgcgcggttgctgaggcatttccggggtgtcttccgaccaggattggaacagctactgcgctgcctctgtgggtcgcggaacattgccttgctcccagtgtgccactgcccctccctgattgccccaggcctgctcctctccctgcctaattcagatctttgcaaacaaggccacctctgagaggccttgccgccatctacccaagtcacagcagcaccgcaattatccccctcttccctgttcccacccagcacccgggaagtggcaggattcaatcacttttctgacccaaagggagaaaacgggccgggcgcgatggctaacgcctgcaatcccagcacttcgggaggccgaggcgggtggatcacttgaggtcaagagttcccgagaccagcctggccaatatggtgaaaacccatctctactaaaaacacaaaaattaccctggctggtggtaggcacctgtaatcccagctacacgggaggctgaggtaggagaatcgcttgaaactgggaggcagttgttgcagtgagccgagattgggccacagcacactccagcctgggcaacagagccagactctgtctcaaaaaaaaaaggaagaaaggaggcaaaattaacgtaagtggagaggttgggccaggcacaccagctcatgcctgtaattccagtgctttgggaggccacggcaggaggattgcttcaggtcaggagttcgagaccagcctgggcaacgtggtgagtcccaccttgcccgtttctacaaaaaataaaattagcaaggcatggtggcatgcgcctgtaatcccagctactcaggaggctgaggcaggagaatcccttgaacccgggaggcagaggttacagtgagctgagatcacgccactgcactcaagcctgggtgacagagcaaaactccatcttgaaaaaaaaaatagtttatttgggccaagtttgagaagtgcaaccctggagatgcaagttgtcttaaaatattagcagcagttataagtgggtttttaaaggaaaagaagaggcagttcctaagttgtttaccaagaatttgaaattagagaagtcttgctgtgttgtccaggctagtcttgaactcctgacctgaagggatcctcctacctcggctggcctagcctgaggaatttatattaaaataacgtaagctatttattgggccaggcgtggtggctcacacctgtaatcccaacactttgggaggccaaggtaggaggatcacttgaggtcaggagttcgagaccagcctggccaacatgatgaaaccctgtttctactaaaaatacaaaaattagccaggtatggtggtgagcacctatagtcccagctacttgggaggctgaggtaggataatcacttgaacccaggaggcagagtttgcagtgagccaagatcatgccattgcactccagcctgggcaacagagtaaaactccatctcaaaaaaaaaaagaaggcagggcgtggtggctcacgcctgtaatcgcagcactttgggaggccaagtcaggcggatcgcgaggtcaggagatcgagaccatcctggctaacacggtgaaaccccgtctctactaaaaatacaaaaaattagccgggcatggctgcaggtgcctgtagtcccagctactctggatgctgaggcaggaggatggcatgaacccgggaggtggagcttgcagtgagccgagataacaccactgcactccagcctgggcaacacagcgagactctgtctcaaaaaaaaaaaaaaagctatttattgtctctacattgtctacattgtctttggtatcacaaattccaggaacaggaagataatgggttgagctagtcaggaacaaaatgcctttaaacagtcaccccagggcatgagtacaaggcgtgtgactgaagtccatattcctgtctctctgggcctgataaattctgcacacctcacataactcaaagtgctgtgaacactttttcttatttctttggtgagagggagtgggtttatggccaacaggaaaggggaaggcacacccctgtcccgggaagagcagagtcaggacccaatacccattttggaggactttggaacagtcacctgattcttcctttttatttatttattttttgacactggttctcactatgttgaccaggctggactcaaattcctggcctcaagtgatccccaagcctcagccttccttgtaggctgggactacaggtgtgtgattcttcccagtttgagtcttccatccctaaagatcatcttagtgtgtattcagttctggggaaagccctggaggagacgtgctggcttacccccagctcatcaccaggatgcagcatcccaccatgtcatctccctggagggtggccaagcaggcccttaactttccctcctgagaggagagcagagaagagagagggagctcccccagtgggatgggactcacgaggtccaggagttgagacttttctgtggcctttggggacctctgaacagtgcaatcaggtcttcccttagaaagatgctttggcaaaaggaggaggggcagggacggagttctgccgacagctgggaaaatcagaggaggccactggccccttctccccaggagggtgaatccttctgtattagccccaggcaccctaaaaaataccactgactgagtggcttaaacagcagggttttattttctcacagttctggaggctaaaagccccagaggcctctcttcctggtttgcacacagccaccttctcaccatgtcctcccacggggaggtagcatccaagcgctctggtctcttataaggacatgaatcctgttggatcagggcccacccttatgacctcacttaaccttcatcatctccttataggccctgtccccaactacagtcacattggggattagagcttcagcgtctaatattggcggggggggacaccattcagtccatagccccccttcctcagggctccaaccacatcatgcacagaactcagctgtagcccacatcacacggtgctcttcagtccagccacgcatccttcagcggctgggatacgttctcgacaatgcatcatcaggtaatttcgttgacgtgagaacatcacagagtgttcttagaccaaccaaggtggtgcagcctactgcacacctaggccacatggtatagcatatagccccttggctacagacctgtacagcaaggatttatgtatctaaacacagaaaagctacgggaaaaatatggtattataactttatgggaccactcttatatatatgctgtctgttgttgaccgaaacatcattatatgctacgtgactgcaatatttatttttctgattataaaagtaacacatattcccagtagacagtgtagaaaattagcaacaaactattctactgtaaatgacaaaagaaaaattgagccttggacatgcccatttttactgtaagttatgattccataattgacttgcagtaaacagtgtttctggcccctaagtattgctgccttgtgtattttatttagtatacagcactaaaaaaaacagtcctgtgaattattaaatcatttcaataagtcagctaacaacgtttacatatagttgctacacagaaaggaacacaaattatttcctcttttgctcatattcaaacaggcttgagtgacaacttgaggacaaggcggcgcctcgacaagatttcacacagcagctacgggggccagagaagcagcaccgcatggtgtggcaggagaaggaggacatgcacaaggtaggcagtttggttctgggtgagaaaggcttaagaggctttgcagagttttgtaaggttcatttcatacagatgtttacagacctccttgggactcccactcatggactgtccctgctgcaagcaggacaacagggccaagcctggttccagggcccctgctgtgcccagttgctacacagcccatgtcagctagctgggcttggctccttgccatgggtgcctttcagcgtgctgcctgcagcaggcacccacttcacagtcatcatctgccatctccagttcaaccccgcagagtaagcagcaactcccccagccccgcccattctgaatgaggaacgatgtccagagggcactgtgttatctgcagtgacacgctgcgcctgacaccagtgacctcgtccttctctctacaccatgccccctgctcttagaaggggcatcttagtaaggacagggaactgcaaaagaggacatatgttaaaatgtggctgattcccccataactcctttataaatttggtttttagtaagatatctgaactttatattcaaatgccattaagtatagtaataacacaattaggttcttttttcttttcttttttctttttttttttttttttttgagacagagtctctctctgtcaccaggctgcagtcatgcgatctcagctcactgcataggctctgttttctaaaatacattcatttatacactgaagtccttggacctgtagtttgtgatctgtcctctaaaatggggcagattttaaaaccaaattgcttcttaagatcatctgtggtatcatccccctgcatgacttgtctgggagtgcagtgtgggctgggcggcctctcattgcttgacacagtcacagtgactctgagctggacccagagaggcctggggaggcctttcctccccatgtgggagccgccctgccagcttgctccaggtctcgtcacttccagtcttagtccagcaagtgtgacagtgactaaacagccagactgttggccagatcagctgcagggaggtcagggtcatcagtgcagcaagtggtaaggttgggttgtcagtgcagctgaacttgtggtaagtcctacttgtggccctccacccagggagtctttgatttaaatctctttcttcttaattttcttttctttcttttttagtttttttaagagatgaggtctcactattttgcccaggcgctggtcttgaactcctgggctcaagtgatcctcccacctcagcctcccaaagtgctgggatgacaggcttgagtgcctggcctgatttaaatcttcagcactttgcctatgtatttttttctgcttctgcttcttcttgtgtttaagtaactagattgagtgcccaaatgctttattcacctttgcaattgtgtagaagacctcgggcagaggttggcattacagagccagctgtcctgctgtaagttactccatgcagttgcgaggtctttcttggtgtggggttgttgctcagcacctgagcccaggtggtcttcccattgaatgtttggctggggtgaggtgagcacagggctttttccaagcaggggatttctcccatctgtggctttaatctgtaaccagcattggctgtcacttgtaactctttaatatagtgtaagactaaatgtccagccttccagacctttgttaagcaaacataaaacatctgtaatttttttttcagcaattggttgaagcttcagagacattgaaatcccaagccaaagaactgaaagatgcccatcagcagcaaaagctggccctgcaggagttcttggagctcaatgagctcatggcagagctctactcccagaagcagaaggtgtgggacaaggaggaggagatggaagtagccatgcagaaagctgacatgatgtggcaggagatctgaagatccaagaagctcagaaagaggatgctgtttagccagatgtggtggctcacgcctgtaatcccagcactttgggaggtcgaggcgggtggatggcctgaggtcaggagtttgagaccagcctggccaacatggtgaaaccccgtctctattaaaaatgcaaaaactaaccaggcatggtattgggtgcctgtaatcctagctacttgggaggctgaagcaggagaattgcttgaacctgggaggcggaggttgcagtgagccaagatcatgccactgcactccagcctgggcatcaagagcaaaactctgtctcaaaaaaaaaaaaagggggggtggggaggaagctatttagatatttcagcgatggtattgactggacttttgtatgaccttaataaaacatctttgaaaacttgggctgcattatgtaaattactttaaaatcatcttaagttttatgtgaacccaagtaagttgatctgccaagcatttattttgtgctcatccctcaatatctatttgtgaaattattaaaagaggttcctagtcctaagtttttaaaattcccttttaagtaagtagagggtatttatgctgagctgtgatatggcccggcttaattgaataagagcacctgcagtccataaagggccaatggcagtagaaaggcaaatcatagtctaggacgcttcaagccacttgctttagaccagtgcttctgaagcatcttggcctaagcactcctttacactcttgcaaattactggggatcccaaagagcttctacttaggtagattacagctctcaatatgcaccacggcagaaattaaaactgagaattctttcaatacaacaaaaacccattacatgttaacgtaaagtttgtaatgaaaagtaactatttctttaaaaatctagtgagaagaatggcatttttacattttttttattttattttaagatggagtcttgctctgtcacccaggctggagtgcagtggcacaatctccgctcactgcagcctctacctcccgggttcaagcgattctcgtgcctcggcctcttgagtagctgggattacagacatgcaccaccattctcggctaatttttgtatttttagtagagatggggtttcaccatgttggccaggctggtctcgaactcccggcctcaggtgatctgccctcctcagcctcccaaagtcctgggattacaggcgtgagccaccgcacccagccgcatttttacattttttaatgtttctttaatatctggcttaatagaacgtgctcgggttctcatgtctgtttctgcactcaatctgtttggatacactgttccggatgaagtacatgaagaactcctggttcccacagatagctaattaattattaaaagagattactgtggtactaggttttaaaaattcccttttcagtaagtagagggtatttattctctgacaatgtctcaggatcccaaggttctcagcccacaatttgagaactgctgccctaggtattctgaatgttctgctgttgatgagtgacatgttttaagcaatgcttactttaaaatttgattaaaggccaggggcagttgctcacacctctaatcctagctctttgggaggccgaggtgggcccatcgattgagctgaggagttcaagaccagtctgggcaacatagtgaaaccccatctctaccaaaaatacaaaaagttagctgggtgtggtgacatgcacatctagcatgaagtactcaggaggcttagtgggaggatcacttgagcctgggaggtggaggttgcagtgagccgagattgtgccactgtactccagcctgggcgacagagtgagaatctgtctcaaaaaaattctattaaaatttatttaatgaatcccacaaatgagaaggtctgaaagcacatgctcaagttcagggccctttgctgtttagccacaggatatctgtttgttttcttcttagtttattttgcaacctaaatatatttgtagttgtagccagttacaactcaagttaatgaaacccctaactaaggattaccattccacatcggatgcagtgatacgttgcctgggatttgttctcaagcggtttgtgcgtaggcagagatgaagcaagctcagctcaagctgctcactgtcagccgactacggtggcttgcctgtaatcccagcactttggtgaggctgaggtgggcggatcacctgaggtggagtttgagattagcctggccaacacggtgaaaccccatctctactaaaaaaaatacaaaaactagccgggcgaggtggtgtgtgcctgtaatcccagctaaactggaggctgaggcataagaatcgcttgaacccaggaggtagaggttgcagtgagctgagatcacaccactgcattccagcctgggcgacagagcaagaatcttgtcaaaaaaaaaaagtcctctccttagtgtcaaagccgaggtgccaggcacaggaggttcattactctctcttcttctgttcttctgtgtgtgtctgaaattgtccatttaaaaaatgaatcagtgttctacagaaatcagaagtacttgttttcacaaatcagtaccctttcttgaaatcttatctcaaaatatcaacttaaatttgaatttgaacttgttttattactaaccaaccacttcagctgagccctgcggtgtatttctgaaactttaatttgtgataagattgataaagggtgaaaaaatacaaaggtcctttaaggtcttgctctcttacaagtcctttggggaagatctaactggtaaggccgtgcttcctttgtgttaatgacaagtgcgtcttcgtttcgtagctggaagctcagctcaaggacactgttgctgaggcctcaaaggagtgcagacgtcgtgagcacgtcacggacttcaagcaacagaaagtgagcctgaagccctcgaggtggtgctgggttagagtctttactcttaccccagacagaaagctcatccttgctgatcccggcacgtggacattgccttgtgtaatgtgctggtcccggctgagcgttacccaaggcagctccagacaaaacagggatatggagaggtggggagggaccctgccttcgtgattgttttcattttcatagccaagtgtattagtccattctcgcactgctataaacaactacctgaggccggcgcggtggccgacgcctgtaatctcagcagtttgggagaccgaggtgggtggagcacctgaggtcaggagtttgacaccagcctggccaacatggcgaaaccccatctctattaaaatacaaaaattaaccaggcgtggtggtgggcgcctgtaatcccagctactcgggaggctgaagcagaagaattgcttgaacctgggagatggaggttgcagcgagccgagattgcgctactgcactacagcctgggtgacagaaaaaaaaaagaactacatgagactgggtaatttattaaaaaaaaaaaaaaaaccaacaggtttaattggctcacagttctgcaggctgtaccggcttctgtttctggggaggcctcaggaaacttaacaatcatagcagaaggggaagcaggcacatcttacatggccagagcaggaggaagagagagagcggggagatgctacacacctttaaacaaccagatctcatgagaactcctgacctcgggtgatccacctggctcggcctcccatagtgctgggattacaggcgtgagccaccatgcccaaccctatattttaattttcaaatgaagtaatatatttggtcttttaaataggatgtttttattcagttaaaagatgctaattaggccagcccggtggctcacccctgtaatcccagcactctgggaggccaaggcaggtggatcacctgaggtcaggagtttgagaccagcctggccaacatggtgaaaccttgtctctactaaaaatacaaaaattagccaggcttggtggtgggtgtctgtagtcccagctacttgggaggctgaggcaggagaatcacttgaacctgggaggcagaggttgcagtgagccaagattgtgccactgtactccagcctgggcgacagagcgagactccatcttgaacaaaacaaaacaaaaacaaaaacaaaaaagaattaatcacctgaaatcattaggtctatcagttttagatttagatttgaattgaaatgtcacttaaattagatacaatttaaaaatccatatcatgaacttagtttggaaaaatctcatgacaattaaactttctaaatcttcaaaagaacttccagtgttaataatgctagcataccacaggatgccgcgtgagcaagttatgtagtgaaattgtctcatctcagctttgttacttgtggataaactcacatgccagagggtgtggtcagggctgtgaattacaggtgaggccaagtgacctcccactgctggtggtcactgtgacttgtcagactccacctgcccatgcagtcaccactttagccaaggatgccaagggcagtggtgcttgggtaggcggccagctgggagtggagtgggggtctgtgtagagacaggaggggtgatgggatccaggaataagaaccacgggaacctctgggccagacacagtgcatttttttttctttttctttttttttgagacagagactcactctgttgcccaggctggagtgcagaggcgctgtcttggctcactctacctcccaggttcaagtgattttccttcctcagcttcgcgagtagctaggaccacaggcacgtgccaccatgcttggctaattttttgtatttttaagagagacggggtttcaccgtgttagccagtatggtctcgatctcctgacctcgtgatccccctgcctcagcctccgaaagtgctgggattacaggcgtgagccaccgcgcccggccaagagtgcactttttaagtaaagaacttgtaagtagagtctgaatcctgtggaatatgtcttcatcccactattcatttctttgttattacagaccagctgagctagtgagcaagaaacacaagcactgaagctggaagcgtccccatcaatttctgtggctgccagcacagaaccgcaggaagtaacacagcattgtcctactgatgctctcacctggggtctgccctcatgtccaagtgacacagctgcccttggtgaccagaagccactcacctggtccctgcatgccagcttgcagtgaggacatctgtccaggcacgagagcccaccttccattttgagaattactgtcagtacctcagttagataagctaggcttctgcaatcatactgaagtgtaacatccatacaacaaattgcacaaatcacagcatgtaacctggtgaatttttacaaagtgaatatgccccaaaaaccaacacccagttctagaaatagaacattagcagcccctcagaagcccctcagaaggctgctttctcctttcctgacactagcattccttgactttattctgctttctagcactgtaggttaattttacttgtttttaaactttatgtaagtggggttgtaaattatatgttctgtgcctgtcttcttttgctgcaacattaggagtcatccacattattgtatcaggcaacactttgttcattcccataacctatggtatttaactagataaatatgctacactttacttatccattgtacttctggtgaatatttgtggcatttcaaaatttgggatattacaaataataaaggaataagcatttttacatgtctttcggtggacatatgcaggcttttcacacactttttaaaaactgtttaataaacaccctgttttgcaagaagttcacatgccaattcatgtagagttgcttgagtctgtaacaactgaatagaggttaattgtatgatgtcttgtaatatgtttccttgttggtcatttagtcatgtggcagaaaccactagttgtttgctaaaattcattctctgtttcctctatggtaatggaccctccacattttaagctaggcagatggctgcccagaataaagactaccaataaaggtgcaatcatgttcctaagttcttagtaacaggatgtagtagaaatatggcatggcagattccaagatctttcctaaagggacacactttgctttcctatctcccttcctcattgctgtgtataaacatatactgccatcttccaccttggggttgcggctcatacagtggccacaagacagaaggaacctgggccctgataaaatcaagtgttatatttaccttagactgcctatgcaggttttgacaagagctacaatggtttttctaccactcataactgaaataaattataatatataagatagtttccaatttttgatattgtacactatatagcagtgaacattgtgcaatatatcttttttttggaaatgtataatagtttactgttgtaattcatttataacatgtgttggacaacttagctaatatgttaattgatttatacaattcctttcaattttatctaaaaatagcagaccaaaattaaattaagaaacttacataagattccatttgagcatacataaggccatgatactttaatgtgaaccaccatttcttggaagaaagaagacatccaaatgtccaattcagagagaaagttcctggccagtcatccagtagactctctccactcttcagtgcgaaggtgatgcttatatttttacaaatctctacaaagctcacatacaacaagacagtacatcctagatttgtgactgatatgagcatttaaggctgtcattttcaagtataaaagtttagtgttccattacccaatctgtgcagtagacatagctataagctcaagtcacatgaattaacagaagcccaccaaagacatttaaaaaattataatttaggcaacagcaagtttaaatgtaggaaaggctagaaaaaaatgtgtagatgagattgtttctctaaaatgcattaggttgttcacaatgaagctttgtctaacaccattatctgatgcatggcatatgcaataaggcagatccacagcagaccaaacaaggaagctgaattaggtaatagaactagtaattaagatggttcacctctaacacagttctgcagcctgttcccccgagagaaagattagaaaaggctccagtgtaccaaataagcttcacagaagaacatgaaaatttttctccaacttttttttttgaagcagagcctgtcacttagggaccaactgcttgtagatgaaataaatcaacattaattacttctagcctaatgtaatatggctggagaaaatgggtctccggaagccggtattttgtttaacttacattctaggtgtgtatataagttctcgctctataacttctgctgtggtcccaacatctatatctgaaaggtggaagcagctgctctgttacaattttcatgtaacatgcttggattctaggtctttcctctttaacacaacttaaagtttcttgtggtttggtcagcatacacacttctcatttcatttgatgtacacagccaaagtgggaattaaaaaaaaattaccatctagttcagagagctaaattgagtccagcattatggcaaagtctgacccaaaattttaatttgtaattttagcatgtgtctcatgcactttggggagcgtcaaactaaatctacaattgcccgaagccttgttacagtttaatgcacattaactaaaatgtgtacatttttagtgttcatgataaatgcagttatgaccttattacactttaggcattctttaagaaagcacattaagctttaatatagaaatatttaggttacacttgtgctcaagtaataataaaacatttgttcttttttgatctcatacattctctcctcaggtatggcccatctcctgtacgcttggagcgacctttggctatgtggctggccttgttatttcaccactctggatatactggaatagaaagcaacttacatacaagaacaattaactggaacaaagggagatatttctttgtgcagattctgtaagggctgtgcagaaatgtgtatggtcaaagccaagcagttccatttacagctctgttttttacgtagttacatgatgtgattgtagctttttaaactatgaaacccctgagagattgtaccttctagttgaaataaagtatttatagtagattgtggcttcagatactgcttactgcttcttaaacctttaaggaacattcttaataaactttatggaattctggggacaggttttgttttctttcaagttttgaactgcttcattacctataaaaggtctgggtatagctgtagcatttcatttgctttctcagagaaatggccagtttccttggccactgaagatgtttctcacgtaattaaacaacagtttatacatcttgatcctattctttttttttttacagtgtgtttctttggagttaaaatggctatgatagcctcatcaaaaacagtcttcaatcccttctgggttaaagctgaacattccacatagcagcatgctcctatctcttttgctagtttctgtccttgttccacacatataggtttttctttcatatcattcagtcttgctaaagttttggggtcatctcggagatcaatctgagttcttattaataaaaagggtacatttggtgcgtattccttaagttccggtacccactcctctttcacattttgaaatgaggctggatttaccaccgagaagcatataaggaagacgtcggtcactgggtaagataaaggcctcagacagtcatagtcttcctgtccggccgtgtcatagagtcctaggaggtactacttgccccccacagtgacgctgactgcttagtggtcgaagacggtgggcacgtactcctccgggaaggcttcgttggcatagctcatgagtgggcacgtcttgcccaccgccccgtcgccgaccaccacgcacttgagcatcagcgcgccaggcccgtgagccacgctgctgcccgccggcctccgggcatggtccccccggagcccccgccccggtccccgggctcagccccagcccgcctggggagtccgccgccgtcgccgccgctctgcgccgcaggccgccccccgaccggccccatccagcggctcccctcgccggaggggagggggcggcgggcccggggcgctgccgccgcggcggtcgccgccaggatccccgccccggccccggtcgctgcgcctgcccgctgcccccgccactgggcgcccgcgccctctccccggcctggtctccccaggagaggatccgccggatcataagcatctttttttttttttttttttgtggagtttcgctcttgttgtccaggctggagtgcaatggcacaatctcggctcaccgcaacctccgcctcctggattcaagtgattctcctgcctcagcctcccaagtagctgggattgcaggcatgcgccgccacgtccagctaattttgtatttttagtagagatggcgtttctccatgttgatcaggctggtctcaaactcctgacctcaggtgatccgcccacctcagcctcccaaagtgctgggattacaggcataagccactgtgcccagcctatcttttatctttatatatgtctgttttatagaaaaaaaaattctacaggtggaattgctaggtcaaaaactaagaacacttttggccagacacggtggctcacgcctgtaatcccagcactttgggaggccgaggcaggcagatcaccttgaggtcaggagttcgagaccaccctggcaaacatggtgaaaccgtctctactaaaaatacaaaaattagccaggcgtcagggtgtgcgcctataatcccagctactggggaggctgaggcaggaggatcgcttgaacccaggaggcggaggttgtagtgagccgagatcgtgccattgcactccagcctggacaacaagagtgaaactccatctcaaacaaacaaaaaaactaagaacactttatagatacaacccaatgtttgttcctccaaaattacattaacactgacataagtgacatttctgtcttaaagacactgggtgtcaaattgttaaacctcttatatgtaaaagagaaaccaacaaaacaaaacaaaagaaccaatgatcaaaccctaattatctgtttcacatctttgttgtgggaagaaagttgagcagcttttcatttgaagagcctactcttctttctttttttgtgacttgtctgttgaaatgctttgccatggaatagtaattccattgcagaagctttttataatgattttaatcaatatttataatatagcttttccctcaattttgtttcgattagctttacattttttgatacatagtagagcaaatcttttcacattcttatcgaatataaggtattcgtatacatttttcttccaaaagaaatctgaagtcaagcactgacgttcgaagaaaaaaaaacaataatttgattaaaattgtattaaacatatttaatttggaggaggctgagataatcaagatataaataatgctggatattctcatctagtcagatgatgtctctccattaactaactcttgtagtccaagtaacattctgtagatttatctgcatagggaatgctcactttttctaagtgcatatcaagatattttagagttttcaatgtgaatagaaactttttgcttgtacaaattcaatttgattcagtttgattcatgagaattcttttgagtttcattttatcttttatctgtcctcttaactcattgtttttattaatttttaatttcattttctgaaaattatatcagtggctgtgtaattgatgtttcattctaatatgtatatttcatttttcctgtcatattgcactgggaataaaacctgaacagtactgaatactctcagtgaaagtagtcatgctttttctcttaccaacagaaattcctttagtaattcatcaagatgtttaatgtagaattctttaaaaaatcaaaaccacaatgagataccatgtcatgtcagttagaatggtgatcattaaagagtcagaaaacaacagatgttggagaggatgtggagaagtaggaacacttttacactgttggtgaagctgtaaattagttcaaccattgtagaacacagtgtggtgattcctcaaggatctagatcaagaaataccatttgacccagcaatcccattactgggattataaggatttacatttccaaaggattataaatcattttactataaagacacatgcacatgtttgttcattgcagcactattcacagtagcaaagacttggaaccaacccaaatgctcatcaatgatagactggataaagaaaatgtggcacatatacaccatggaatactacacagccattaaaaaggatgagttcatgtcctttacaaggacatggatgaagctggaaaccatcattctcagcaaactaacacaggaacagaaaaccaaatattgcatgttctcactcataagtgggaggttaacaatgagaacacatggacacagggaggggaacatcacacactggggcctgttgggggtggggggctaggggagggatagcattaggagaaatacctaatgtagatgatgggttgatggatgcagcaaaccaccatggcacatgtatacctatgtaacaaacctgcacattctgcacatttaccccagaacttaaagtataatttttaaaaaatcaaattaaggtattataaagcttttagatgtttgtctcacttcaatactatttttctttagtttaccatgtaaccatccaaaactaaatcatcccccacctcagttaggcatcttagcataagtccagttactcagaagtctcagctttgcttcctcttcccctacaacccacttttagaatgtaagcaagtcctctcctggttttcttttctccattcctacatcttagttaaagcttttacatcttcaccatgcagaccacaaagaccactaaaaatgagacagataatagacacaggctcccatttctgggttctgggaccaaagtttaaatcagaagcacagcataatgctattaattggtagtgtgtttgggccttattgaaagagcctacctcaagtgttgagacagaaattgaaaataatcatacaggaaaatactgtagaactcagtagtccagaaagctctattacaggctgggcactggcttatgcctggctcatgcctgtaatctcagcactttgggtggctgaggcaggtgaatcatctgaggtcaggagtttgagaccagcctgccaacatggtgaaaccccatctctactaaaaaccccaaaatcaagccaggcatggtggcgtgcacctgtaatcccagttactccagaggctgaggcaggagaatcatttgaacccaggagacggaggttgcaatgagccgagatagcaccattgtactcaagcctagtcgacagagggagactctgtcaacaaagaaagaaaggaagaaagaaaggaaggaaggaaggaaaggaaagctctattacagaaagcaatgtgaattggaattgctttatggtcataaaggaaatattttggccactctgagggatgttccaggcaatagtttcagtcttactctagctatataaccctctcaggtcagcaaaaagggtcaaaaaaaccagccagtgttcagaatgaacatgcatttgagatttgtgagaaggagaactcacatctaaagtctagaagaacaggtcctaggtgttctggccgtaattcattggttactgataccatatgattgcaatgacattctatgttgtaagggcaatgcttgctgccaagacacaaaaccttgtacaaagctttctggttttggcccctcgtttaacaaagatataattctggttattttctttctttttttttttttttttttttttctttttattcctcccagagccttgccatttcttccccacccccctccgcccccgtcccccgctcttttttttttttttttttttttttttaagatggagtgtcgctctgtcaccaggctggagtgcagtggtgcgatctcggctcagggcaacctctgactccctagttcaagcgattctcctgcctcagcctcccgagtagctgggattacaggcacacgccaccatgcccagctaatttttgtatttttagtagagacggggtttcaccatgttggccaggatggtctcaatctcccgacctcgggatctgtccgcctcggcctcgcaaagtgctgggattacaggcgtgagccactgtgctcggcagccatttcttcctttaatctccagctgtttcaccccaagatggtcaagacaattttttatttttatattttattattattatttttgagacggagtctcgctgtcgcccaggctggagtgcagaggcgcgatctcggctcactgcaagctccgcctcctgagttcacgccattctcctgcctcaacctccggagtagctgggactacaggcgcccgccaccgtgcccagctaatttttttgtatttttagtagaaacggggtttcaccgtgttagccaggatggtgtcgatctcctgacctcgtgatccgcccgcctcggcctcccaaagtgctgggattacaggcgtgagccacggtgcccggccaagattgcaagaagacaggaagtaacactttgtcctctaatttatctcataggtgaaactttctttcttttttctaagaagtaccactagaatataatcctaaaatttaatggttgagagacttaactatagaatttgctttctgttgatgttataggggcttccttctaactcagatgaatttactctgaaaatggcaaatggttcccccacttacccgaggatggaagaacaagttataagttgcattcacttgctgaagataccttaagtatttagaattgcgataatgtgctgaactcaaatagttgaaacaagtaacttctggggcagcaggtacttatgtcagcaattggcttattccttgacgccaatgttttggctttgtttggtgaattggtggttgacttgatccttacttgctattcagactgcctctgatctttctgagagccagaacaatctggatggttcatttgacattggtcagaaaggtccttaatctttaaatacaccagttcaagcacagagtcataagatgagatgaggagatgaaaggtggctcactttgggaggctgaagtgggtggacagcttgagcccaggagttcgagaccagcctgggcaacatggggaaacctcatctctatgaaaaactacaaaaaattagccagactttgtggtgcatgcctgtattcccagctacccaggaggctgaggtgggaggaactgagcctggaaggccgaggcatcagtgagctgtggttgcatcactgctctacagcctgggcaacagagtgagaccctgtctcaaaaaaaaaaaaaaaagaccaacaaaacaaaaaaaattcaaataggcccctccaaggagcaaccatttgtctacaaggagtaaggagacttctacatcttggcagtacttgaagacggtgggaaattatcacgtcacattctgttacagtttgggggctactccaaaagaaatttcttaatgcaacactttcacaagaaaagataatgtgctactagtgctaccattgtatgagtgagagaaggggagtgattaatgtgttacagcctcttctcactagtatctaagaacatgaaattcatgcagcacacccttccctctcccagccacttggaatcagtccttcaccatgtccttattcacttcacaaattatccatatgcattgtggttacaacagaaagtgtagataagaaaagatactttactgatgtcataactcatataatttcaagtgtcttacagggtcaagtgttcttgttccagttataattgctgcataacaaaccaccccaatctcagtgccatacaattgtattaaaataacaacatttgtattcccagattttatgggtcaggagtttagtctggacacagggcagactgcttatatgtctgctatgccacatctggggcatttgcttggaagactcaaagtttaggtgtgacagcagttgggaacaggaatcacctgtgtgtatcttcattcacatgcctggtagttgatgctgattattggctgggacctcagatggactacaggccaaactgcctctgcacagcctctgcacacgggttattctgtcctcctcacagcatgtatagcagatgggttctaagaacaaatgtcctaagtaggcaaggcagaagtgcaaggtgttcttactatcgatcttggagggcaccatggcattacttccattatactctattggtcaaaatagttacaaaattctgcccagcatgacaccacaggtttttctttgggggctcagtataaaaaggcagaacagcctctgcctgtttatctcttattcttttgcaggagttttgtgttacatacaaataaatatttagagatattgtcgtatttcccagctaccgaagtcaactgtgaagaagaggcatttacatccctctatagcagtaccaagaagagaggtatccttgactaaataagcaaggcaagattactctttccagactctgatttcggagttagcagatagaacatcaggcagaagttcctctgttggtgtcacctacaaagcaacaagcttgagaactctgtgttccaacttgggagctagtcagtctcccagagtgggggtatttggagagcaggcttgtgaagaaggccaaggaaacagaaaggacagctcttaggatacactttactgaagatatatcactcagacaagatgcccagaaagttcaggattaacaaaggtctagagtcttgtaactcacttcctatggaagtttattgtgaacaacaacagtaacaaagcagcctcaattctctaatcctgcagagggctaaagaacacctattactccctggagcttaatagagatgaaatcttaggatataactgcagtatacatgcttaggatgaccaggaagatggttataattgttataccctagtttaggtgaaaactacatgtaagatattgtgaggtccttgagtggttagatgactaaggtattagtcatcctggaagaaaatctggatcgattaaatgtcagatgaattagatgcactaaaaataaaaagagaagccagaaagttgtcctagtaataatcagtccatccttgcttagcacagctccagtattacacagatttcagttaccacagtttagtccaatgacaccagtcccccaacaacacagttctgatatcagttgctatggtctattaactatgaataattggataaaggagaaacttcactgctagaccttcaacccataaattgctgcatgtataccagaggcgcattatgatcagtgaccaatcatgtcacttatttcaatatctattggtgattggtcaccacacatctttttttttttttttttttttttttttgagacggagtcttgtgtctccctctgtcgccaggctggagtgcagtggcgcaatctcggctcactgcaacctctgcctcctgggttcaagtgattctcctgcctcagcctcccaagtagctgggactgcaggcaggtgccaccatgcccagctaatttttgtatttttagtagagacagagtttcaccatgttggccaggatggtctcgatctcttaacctcgtgatccgcccacatcagcctcccaaagtgctggcattacaggtgtgagccaccgcacccggccccacatcttttattcaattcacacactggcaacaaaccatgcagctgtgttttttccttttcttccagtgataaacctgcataacattttcaataatggctaatcaaaagagaaaactggccaacagtgaagtgtcagaaagataaaagcacagcaaataaaaatagagaactctgaatgctagttacttttatgcatcaacttggctaagggatgtccagacagctggtaaaacattagttctggtgtgtctgtgagggtgtttgcagaagacattaccatgtaaatgagtagactgagtaaagatcagatcaccctcaccaatgtgggcatcatctgatagaacaagaaggtggaggaagggcaaatgtactccccctgtttgagctgggatatccatcttctccagcacttggacactggcactgtggttttccagccttggacttggactttggactgaattattccactggttttcttggttctccagaatgcagatggtggaacttctcagcctctctaattgtgtaagccaatttccataataaaataaatctttatatatacttatataaatctttatagatcttataaatcttcatatatataagatgaaataaatatttatgcctctgtgtgtgcgtatactgttttctggagaacactgactagtatactctgaaagtgaaattcaaattgagtgtaaatggagttatggaagaaatagctattggaggtaatttgccactgtttgaggcattccagaggaacttagggaaggcagacttaacaacataaatgaaaatagatgtgttcattcattttaggataaagatgtcccaagaaagtgacatggcaaaacaaaacaaaacaaacaaaactcacattaacggaattatcagaggtatttcatgacattgaaagcacaaagaataaatagttggaagctgattcaaacttagacaggagaatgacagtttgtcaaggtatagctcactctgcactgtaagtatactacaagaagaggagggccagcttcattcaaactatactccataagatttttacaaagaaataaaatattgattcgtgtttctgatgttttaaattacactatactaaatattagttttactatttttgaaaatgttcctgtacatttataacctacaatagtttttaatgttttgacaacatatttttaaaagtcacagaacagtcagaacattcccctttgatgcacgagatcgcgttccattttctgtttgcagtcatttctgtggtccctcattagcatgcaaagcagggcctccctctatatctgttctaggaagtgactgtgggaagggaaatgaaatggtgtatgtggagtgaagcaaaactgcaaggaccacgattgagtggctgtgaagaataaggctggagatggtaatcactgtgcctagcagagagaaaggtaaaaaagctctgaatctttcagattgtgctgatttacccatgatcttttaaagacaggttaatcctcactgaggatttgcctctgatgacaaatgtcttctttaggagatgttagttcagtgatgttatttcagcattcaggccaacaaaggcagtcagaagaggaatgcatgccaggtgtcctagaggtcagtaaaaaagaagaacttggtctaggggaagaattatgaatgagagactgcagcagagctagaagatggtgcccagcagaagagaattggaacagatagatccctgctcttttagagcttcaacgatgaagcctattgttctgtggtttgaggaatgctcatcattcaccatagctggttaacataatttattaagttgaatcaagtacaaaaggaaaaagttctttctaataggccagattccatgagtggaaattccttggagtcaaacagggagaaaatacgtctcagtgttaaagactttccagagacttcttccattccactttccacccctccttaaatcactcgccaaagaaatgctttgctggacactaaagtggccacaaatgtgttcataagaaaacatcagaatataaaattaatcattgtctcttttagttaacttttttggagtgtgtgtgcagggttaaaggacagatgctattaagatgataaacatcagccaggtgcggtggctcacgcctgtaatcccagcactttgggaggccgaggcggaggcatcacctgatgttgggagttcgagaccaatctgaccaacatggagaaaccccgtctctactaaaaatacaatattagccgggcgtggtggcacatgcctgtaatcccagctactccagaggctgaggcaggagaattgcttgaaccaaggaggcagaggttgtggtgagccaagatcgcgccattgcactccagcctggacaacaagagcaaaaccccatctcaaaaaaaaaaaaaaaaaaaaaaaaaaaagatgataaacatcactgaaaagtttggaagtactaccagtttctatgaccaagagctttccaaacagctgtaattatttgaaggtcaatgaactaaaaatgtccatgtatcagctttaggcaaaaaggtcattaatgctttaggggactgtaataagtctggaagaggctaacttgactctcaccttctgcagttctctatcagatcaccctgagatcctcttcaactgccaggctcctggaaggtcagagtcaagccagtgactgactccctgaccagccacacagagcctaaagttacaacctacctggattggcaaggtcttctacaacttatgtagccccccatccttggatgaggttgccacccacccaattcccacccaaaagatcagtcttctatgctagctatgaaaaaagagaggcaatgacagtattttattccattagtgtttgaaaaaagtctgcaacttctatgcaggtatctcaaagcatctaggattccagggatggacagaaagtccttcaatcacaacagaattcctgttttgctctttaaaaaaggagagaggacaggctgacggatgctgtgggtgcatagactcacatgttgtccatgaagtggggactgtcctctaattctaaaggaatagctttggtgaccgttttgccattggtgccatctctcaggaaactgataataaactacaatgttttaaacttgtactatatccaagagatatgtagatatataaaatattttgttatttaaattccacaagcgtacaatgtaggtattattttcattgcacaaatatgataaatgagacaataattttctcaaagacacccagttaagctgcctgactgcaaagagtttcaggcaataagatttagattcctttagttcatcatcttctaaagatgatgctttaatcattgtttagctggttactgatcatactcttcttaaagcccttccccatgggatttgaaaaatctgcttctaagcatatctgaaagtttttttaattttcaattttttttagagatggggtctcactatgttgcccgggctggagtgccacggccattcacaggagtgatcatagtgcactatagcgtcaaactcctcaactcaagagatcctcccgcctcagcctcctgagtacaggctacaggcatgtgccaccatgcccagccatagcttgaggttttcacctacaataactgaagttcctaccttgccacttcagaccatctactaagaagtcatagatattacttcagggaaaaaaatgcctggctgcaaataattccctttaacggacttgaagatagttctgttagtgtcttccaagcatagttttcaactcagatccagtgctcatgcaatactccttatctactgtgtctttgtttccaatagcaataacacatgaacttaataaatatgctgtctttttaagaatttacggtcgggtgtggtggctcaagcctatactcccagcactttgggaggccaaggtctgtggatcacaaggtcagaagatggagacgatcctggccaacacggtgaaaccccgactctactaaaaattagccgggtatggtggtgggcacctgtagtcccagctactcaggaagctgaggcaggagaatcgcttgaacccgggaggcggagcttgcagtgagccgagatcgtgccactgcactccagcctgggtgacagggcgagactctgtctcaaaaaaaaaaaaaaaaaaagaatttacattggtgtatgaatacaaagactgaaaaaatgtattagaaagatttattatttaagagattcattatgaaagagtttaaatatgaaagaaattcatcaaagggtttgtatatttcaagaagaaagtatgacatcatctaaatacatattgctgggttaaatattctttccaccataagagaaaaatctattctcttttgtcctagtgtaaaactcaggacttctgcagctgcccttgtctctgaaatcttcaacttgcagagttctaaacacacaccctacctcacaccccacgcagttactctgcgtccacacagctgagctctgtgtgttttaacagtcataggatttaattaccacatcttgttctgaaagctgagatttataatttcaataaagatttcaacagaaagatggtaaataactcagaggaacttatttatttatttatttatttttgagacacagtctggctttgtcgcccaggctgaagtgctgtggcatgatcccggctcactgcaacctccacctcccgggttcaagcgattctcctgcctcagcctcccgagtagctgggattataggtgtgcacaaccacacccagctaaattttgtatttttagtagagacggggtttcattatgttggccaggctggtctcaaactcctgacctcatgatccacccacctcagcctcccaaagtgttgggattacaggtgtaagccaccacgcccggcccttcataacaatgtattatctctgaaattccctttcacaacagtgaccttgatttgaaattttaaaaaaatcaggcaaatctattaagatataataaatagagagtggctaagaaactctgaaaacagatatcaaggacctcaacttctaatgtttatttttaatcattttaacaaataagcaaactttacaagattagtgaggttctggtgtaagagatgttttcatagtccctgaatgagcctcaccaggcttcccactaaaatgtggcagggatgagagtgcacctcaccactgcagagcccagaatggaggctcccctagtttcagaacttgggaacagtttccaccacttggcctatcaaacactcagactcaatgaagaaacccaattggtggctcagacctagaaatggagtaaatctgttggcctgaataaaaggtcaaaaacattttgtacatgtctgcagaaaactggacttttcatctattgcaggcattgtttttacaggcaaacagaatgaggtcttctatctctttctgtttccccagacacctccccaaatcctaagtcctctctcatacattatatgttctatttttcacccctctgtaacagtctaaaaaaggataactgtggaagtaagataatgcctattagggaacatctggaaaatcagaaaactacaaaaaagaaataatcaccagagacacctgatgttcctatttcagccacttcactgctcgggctgttcagcagcccttgcgctgcctgccagttctggtctccttgcttgcccatcctcctagacgaccgttccgtattcttctcttattcaaacctcaacatttcctctctgcttctcactctcacctgaaggcttcaattttgatacaggagaaatcagaatggatcattctacaaaatgcagcaggcacagacatctgtctccatgcactcggctttccctggcttctagggccaaccccccactttgtactggatcctgttccccactcctcctaaaggactttgctcctggaattatttccattcctgcctcattagttttttcttcttttttaatgagtcattgccaagaaaaatgatgtaccgtaacatcttgaattgcaacttctaaaaacttcccattttcctgattcctcagtatctctacaaacaagctgtgggcacctttcccagatgaccaggtacaccaatgtgacaaggctggtccctgtcacaagtcccccttcttactctcccctgaccatggcctagtgacatttaagcacacccatgatatcccctcctgcctttgctggtgaaccccaccctgatgcccaataagggtaactgtccacaggaacctgtttgcccttggctccccacctgcttggctgagcccgctttgttggtgctctgcccaggtgatccccacaaggtatgtcgtgcctccctctttggaacctgtgagtacagtaaatcctttattcatatgccttcccaaagtcatctccacagcctattggaatgttccttaaggactccacaaggggtacttaatccctcatttataacacatacctccatcttaaaaaagccctctcttgaacctgtatctttctcagctactacccaattttaagcttcccatttccaagaaaagtgactgcaagagttgttcacattcgctcggcgccgcccgcccggcctcccgagaggctttggggactagaccttggacgcggatccttccagcgctgcgccccgggtctgcatcctcctcctccgggaagccccgcccccaggcctagccctcctcctcctctgggaacctcccccctcaggcctagccctcctcctcctccgggaagcccccctaagcctcgccttcctcctccgggaagccccccaggccttgccctcgtcctctgagaagccccacctaggcctcgccttcctcctcctccaggaagcccccccaggcctcgccctcctcctcctccgagaagccccccaggcctcgccctcctcctctcccgggaagccccctaagcctcgccctcctcctcctccgagaaacccctaggcctcgccctcctcctcccccagaagccatccccgctcccccgaccccctaacttgctctcctctgggaagccacggggccccggtgcaccaagaggccgaatgggaccctgagggcactctggccgcgtccggctcacgcgcccccttcagcgccaggtctgggggatccgcgcctgcgccccggggcgaccctgtcgcggggtctggctgtccaggcccgggggcccgggtgtcaggctggtagcaggaaggaaggcgctggcctccccaccgcattcgccccatgcggcgtccccgggaaaggccgcagaagaggcgccgtcggcacccaaagggccatggacggggagcgccctgcgtggtgttcgtggcgctggcctggtctctgcggatcagaggcgaagccagcctggctctcgggtcgcccgtcttctgtcgagctggcaacatcagtgcggttcccaccgccatttgcgctttctcctggaccctctgctttttattgttgatttgtgggagctctttgcataggggccccgccgtcgcagcctggcgttctcgcaggcgcatgccctcggaacgccgggtgggctgcgggcgcgacgggactcctggtctctcttccccaggacggacaccggcgtcgccgcgtcctacgaagccgggcgccgagcgggaggcgcatctgggccccaccggggctgcccgcaccgagcacgcgaacgcgccctcccgcccggaggccgcgggcgctgcggtcggagaaccgtagagccactcggctgggcgtggcgcggcggggcgggtaacggggcgggacctgggcgacggaagtgcgtagccgcgcggcattctggggccggaagtggggcgccagctgcgggctggtgtcatggcaggtgggcggcgccgcaggaggcgcctggcggagctgacggtggacgagttcctagcttcgggctttgactctaagtccgaatactctccagaagcggagacgcgggaggcacgcgaggctgcccggagtccggatgagccgggcgggagcccctcggccagccggcgtaaaggccgtgcctctgagcacaaagatcagctctctcggctgaaggacagagacgccgagttctacaagttcctgcaggagaatgaccagagccagctaaacttcagcgactcggacagctctgaggaggaagaggagccgttccactccctgccatatgtgctggaggaagccagtgaggatgaggatggagcagaggagggggaagatggggacagagtccccagagggctgaaggggaagaagaattgtgttcctgtgaccctcgccatggttgagagatggaagcaggcagcaaagcaacgcctcactccaaagctgttccatgaagtggtacaggcgttccgagcagctgtggccaccacccaaggggaccaggaaagtgctgaggccaacaaattccaggtcacggacagtgctgtgttcaatgctctggtcgtgttcaatgctctggtcaccttctgcatcagagaccttactggctgtctccagaagctgctgattggaaaggtggcaaaggacagcagcaggatgctgcagccgtccagcagcctgctctgggggaagctccgtgtggacatcaaggcgtacctgggctcggtcatacagctggtgtcctgtgtggcagagacagtggtgttggcggccgtgctatggcacatcagcgtgctggtgccctgcttcctgaccttccccaagcagtgctcaagagaatggtggtcgtatggagcacagggaaggagtccctgcgggtgctggctttcctggtcctcagcagagtctgccggcacaagaaggacactttccttggccccatcctcaagcaaatgtacatcatgtatgtgaggaactgcaagttcacctcgcctggtgccctccccttcatcagttccatgcagcggaccctgacggagctgctggccttggagccgggtgtggcctaccagcacgccttcctctacatccgccagctcgccatacacctgcacaacgccatgaccacccgcaagaaggaaacgtctgtgtacaactggcagtacatgcactgcctcttcctgtggtgccgggtcctgagcactgtgggccccagcgaagccctccagcccttggtctactcccttgcccaggtcatcattggctgtatcaagctcatccccactgcccgcttctacccactgcgaatgcactgcatccgtgccctgacgctgctctcggggagctcgggggccttcatcccagtgctgcctttcatcctggagatgttccagcaggtcgacttcagcaggaagccggggcgcatgagctccaagcccatcaacttctccgtgatcctgaagctgtccaatgtcaacctgcaggagaaggcgtaccaggacggcctggtggagcagctgtacgacctcaccctggagtacctgcacagccaggcacactgcatcggcttcccggagctggcgctgcctgtggtcctgcagctgaagttgttcctccgggagcgcaaggtggccaactactgccggcaggtgcagcagctgctggggaaggttcaggagaactcggaacacatctgcagccgccgccagagggtttcctttggtgtctctgcaggcagtggaagcctggcagaagctgaccctggaagaggggacccccctgaccttgtactacagccactggcgcaagctgcatgaccgggagatccagctggagatcagtggcaaagagcggctggaagacctgaacttccctgagatcaaacgaaggaaggtggctgacaggaaggatgaggacaggaagcaatttaaagacctctttgacctgaacagctgtgaagaggacgacaccgagggattcttggaaagagggatactggggcccctgagcactcggcatggggtggaagaggataaagaggacaaggaggagggcgaggaggacagcagcaacttggaggatggagacccagacgcagaggcggggctggcccctggggagctgcagcggctggcccaggggccggaggatgagctggaggatctgcagctctcagaggaggactgaggcagcccatctggggggcctgtaggggctgccgggctggtggccagtgtttccacctctcaggcctagaggctggcgtctgtgcagttgggggaggcagtagacaggggacaggctttaatatttatttttcagcatgaacgaccaaacttaccgagagctaggctgggctggcgtggctgctgaagccccacagttgtgggctgttgaagtcagctccgcgggggagctgaccttgacgtcagctgacggagaccagtcccagttccagggggaggcctgcaggtccctggccccttccaccacctctgccctccgtctgcagaccttgtccgtccgcaccaggctctgcattcactcccccaagtctttggaaatttgttcctttcctttcaagtcacattttcctttaaacttttttgttttgcgtctaaaactgaaagaaagaaagctgtgggaggcagggccattgtaaaaaaaaaaaaaaaaaaaagagttgttcacattcaacattttttcttttcttctctcttcaacccactccagcatgggcaacaagcacacccaagttgctaaatccaatggttgatgttcagtcctgaggtaatttgaccttgcagcatctttttgagtctgtgggtcatgctgtccatgtcacacaatttactcccttggcttttatgacctcctcacacttgcttggttttcggtctacttcattggctctttctttggctggatctttatgttcccaactagaacccgttgcataatttgcagggtgcagtgcagaatgaaaatgcagggctcttattcaaaaattattaaaagtttcaagatagtgagagcagagcactcaacaaagcatggggcccttctgagcaagaggtcttgcgtgattgcaaagatcttgtgcccatgaagccctgttcccatcctcagaatgcagcaaagcacctgctcagtgctcatctataaatgatcttgtccaacccaattggctttagatgccacattcagcaacaagcttcacatcttaccttcaacaccaatctctccattttacttcagattcaaatattcaactatctattctccatgtgcactgaatatatgaaatgcactcaaacttaatatgtccaaaatggaactttcatttcccacccaaattcttcccatagttttccccatgtcaataaataccaactccatttttccagttattcaggccaaaatcattatagccatcctgaacttcgcacttttctctcacattctacattcaatccaccaaatcctgcaagctctaccttcaaaatatttcctaaatccgaccagtcacgaccttcaccacttgcaaccccggtacaactttctgtcctgagtcacctagtcttctagtgtcataggcctcttggctttcacttctgcccttcacagtctatttgccacacagccatcagttatctttttaaaatgtaagtcatagtttgtcactttcaaatcgcaaagttgaaacctttgaatgccttccaacctcactcataattttttgttaagtcttcaaaatatggcctaaaaaactctatgtagccagcttctggctacctctccaccctcagctcctatcactaccccctcagtcacttcatcagccacattggctttcttgctgctcctcactttcctttgcactgtggttttctctgtctggaacactcttcactcagatatttaaatgactcgctttctcaattcaatcagacttcaatttacagggcacctcctcagaaagccttctgtactgaacataaatctcagcttcccttgactgtttcctttgtttaaaaggtggcacccctctcctgaacgaggaccatgccacaccactgccatctttgttgagtccccagaactgtcagtaatctgcaaaagtcccattagttccaagtctccactcacttctgatgaaatgtcccataacagagaatgcgatctgccttcctggtccaccgtctaaaagcccaacaatgttttcctaaagaacagggcattcgctcttcatgagcaatagaaaacaggagccacaaagagccaagcagcaaagggcagagaatagatctagatagatgatgaagaataaccagtatacactctctgtcctcttaatctgttttgttgcagactgatgttttactctatgtctatgcatatgcacatatgcatgtacgtatacatgcgtgcaacttgatggcaaagatcccatcttgtatgttccttgtcatatcaccagctcctacggcagtaactgtcacatagtaaatattcagcaaatattcttttgagagaacgaatgaagatgcaatactattaaatacattcacaatttctcaccttgttcttttcactcaacacaatcactttgggttgttttttggtgtgtgtgacaagtattcttctaaaagaaattatgatttctttaaggaatctagtctaaatacacatgaaaggaaagggactactgaactaaattatttcagcaagacatttagagagtattagtgattttataataaataatgctatcatgtgatttaagtgttcaaagaaaaaagtggatgcttttcctatttgtagttcaaaaaaaagatttcatcaatcacaacgtgagtcaaacccaaggatgattatcgatgactagaactattagaaaaagcattcgacaggtaggcagtaaagaagggtgggaagttcagagtaatcacataaacaaagaaaggaactatctagaaggcagacccatcaggggagggaaatttcaagggaagaagactggaccctgttacctgggaaataagtaaggccacagcacggggagaaaaaaagacttgatacttttcagagaacaaaaaatctgtctttgttaatgcaaatgcatgtaatgcacagtagtttgagaggtgctaatgggtttttttattgcttttctttgtcaattacaaattgctcattcctgaagatgaaactaaaatgagccattgagtaaattacttccaaaacaagctggtggaaaacgtgtaaacctgtaagtgagtaatattaaatccttacatgttttataggcatttagactccaggcacacgcaatgttttataccgataatgactatacattttttaacttattacataaaattatatatgttatagtccaggcacagtggctcacgcttctagtcccagcactttaggaggtcaaggcaggaggatcacttaaggctgtgagtttgagatcagccttggcaacatagcaagaccctatctctacaacaaataaataaataaattagccaggagtggtggtacacacctgtagtcccagctacttgggaggctgagataagaggaacacttgagcccaggacttcaaggttgcagttagctataatcgtgccattgtactctagcctaggtgacagggcaagatcctgtctcttaaaaaaaaaaaaaaaagtactggtagggcacaatggctcaagcctgtaatccaatcactttgggagacctcatgatctcttgatctcttcaacatggtgaaaccccgtctcaactaaaaatataaaaattagctaggcatggtgacacacacctgtagtcccagctacttgggaggctgaggcaggagaatcgcttgaacctgggaggtggaggttgcagtgagccgagatcacaccgttgcactccagcctggcgacagagtgagactccgtctcaaaaaaaacaacaaaaaaaaggcattattgaaagtttagaacatagcaataaacaaaagaagaaaatataaatcaaaacaaaaacagccactgtaaatgttttagtttataatatttcagattttttctactaagtaaatatatgattatgaaaagttgtactcattactgcttaatatcctgttttgttgttcatgaaataatttttcatgaatatttaacagtgtaattatattattgtctcttttaagccaatactataacataaataacacattattaaaaattaatccatcactgcagtttaaaagttaaagaaaaaaaaacaaaattcaacttggtcatagcatattagtattttaatttgagactggatgagtttgctaatattttactcataatgtaattgtaggtttcttattgtgggatatttgtcaggtttttatttcaaggctaagctaatttataaaataaactaggatattatacattatacataaattaggatattatacattatacataaattaggattgttttctatgctttaaaacaatgtttttcaaattatctgtgtgaaatccttttttgcagtttcccatccattatgtactgctattatggttaaaacaaaacaaaaagaaattagtagaaaattaaaatagtaagccacaaacaatcaaaataaaagtttaatttctttatgattacattcaatagacactaaatttctctaccaaattgctgtaaaagtctctaaatgctgactgtcattgccatatttatcatgaacttgtaacaaatagttcatgaccaccagaagcccatggaccacattttgaatagtgctgcttgaaagaagacgcttaatatgtttaatgatacacatttatcagcaaaaaaatgctgttgaaatattaccacaatatgtgaattttcatttatttacaaatcatatctctaattaaaattattttaataatattctggatgcttagattttaagtgctcagcatcctaaagacctcatctttttttttttttttttttgagatggagtctcatgtctcgctctgtcacccaggctggagtgcagtggcctgatctccgctcactgcaagctccgcctcccgggttcatgccattctcccgcctcagcctcccaagtagctgggactacaggtgccttccaccatgcccggctaattttttgtattttcagtagagacggggtttcaccatgttagccaggatggtctcgatctcctgaccttctgatccgcccgcttcagcatcccaaagtgctgggattacaggcctgagccaccgcgcccggccgacctcatccttttatcagttaattcgcaggtacaatatccaattaagataagatttgctattgctgatactgtgtatggatctctattttccagtaacatttctgatcacttaaaattactgagccaatgcttttcatatctgattagatcatccttgtgtttgactcataatgtgattgatgaaatcttttccttgaactacaaatagcaaaagcatcatctagtagtgctctgtcttcaatctgtggcttctcttcaggaatataatcatgccacttgttcattttgtgaggattcctttcgtgacaactatatggtataacccacataattggaaattgccatgcagtgtttaaagagcaaacacactggtgaggggaccaggtgccacctacactttctttcaagaatatctgttggaggcaacctacagaatgggagaaaatttttgcaatctactcatctgacaaagggctaatatccagaatctacaatgaactcaaacaaatttacaagaaaaaaacagccccatcaaaaagtgggtgaaggatatgaacagacacttctcaaaagaagacatttatgcagccaaaagacacatgaaaaaatgctcaccatcactggccatcagagaaatgcaaatcaaaaccacaatgagataccatctcacaccagttagaatggcgatcgttaaaaactcaggaaacaacaggtgctggagaggatgtggagaaataggaacacttttacactgttggtgggactgtaaactagttcaaccattagtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttgatgtcctttgtagggacagggatgaagctggaaaccatcattctcagtaaactattgcaaggtcaaaaaaccaaacacctcatgttctcactcataggtgggaattgaacaatgagaacacatggacacaggaaggggaactcacacaccggggcctgttgtggggtggggggagggggttgggatagcattaggagatatatctaatgttaaatgatgagttaatgggtgcagcacaccaacatggcacatgtatacatatataactaacctgcacattgtgcacatgtaccctaaaacttaaagtataataaaaaaaaaagaatatctgttggaccatgcgtgtgaattggccatttgacataagaactcagagagggggccagctcaagtagttaaatgctattaaagtgaaactgaaatttattattttattaggaaaaataactaaagttctatttctttaatccatcctaatgaattttttgtgcaaacttcatatttaaaaagactatggctttagaacaggtttctctaaggacagtatggttctctaagcatctgtttgtttaaaattcagattcccagatcccatcccataactactatatcaaagtcccaaagagaagatggggagagaggagaaaggaattcatatgtttaataaactccccaagtgattattgtgcatatatatatttatttatttgagacagagtcttgctctgttgcccaggctggagtgcagtggcacaatctcagctcactgcaacctccactttccagattcaagcaattcttgtgcctcagcgtcccaagtagctgagattacagacgtgcaccaccacacccagctgaattttgtatttttagtagagatgggttttcaccacgttggccaggttggtctcgaactcctgacctcaagtaatctgcctaccttggcctcccccaaaatgctgggattacaggagtgagccaccatgcccagccaatattttgaaaaccaatgcttcagagcaatttaaaaaataatcataggcattacatataatcctcaaaggttacatgcacaaaactgggcatctctattatgaaatagttgaggactctgacatccttttcagctttttttctatcattcgaattagccttttcttttttctgtttcttcttgagtccattttagtaatttttatcctcctaggatatcataattttagttagcttttaaaagaattattgtaataaattatatttagaaaataatttagtatgcttttcttttccatacctgtctgatcatgcatgtccctatatagggatacaaactgctagtgatatctttagtttaagggaaatgagagaacagaagtttaaaatttatctagctcaaacacaaagagaatgcaaactgttaaaagatatttttaaggggaatgtgagaacagaggtttaaaatgtatttagtcaaacacaaagaaaaagagagtcggctgggtacggtggctcacgcctgtaatcctagcactttgggaggccgaggtgggtggatcactaggtgagaagttcgagaccagcctgaccaacgtagtgaaactccatctctactaaaaatacaaaaattagccggcatggtggctcacacctataatcccagctacttgagaggctgaggcagaagaattgcttgaacctgggaggcagaggttgcagtgagcagagatcgtgccattgcactccagcctgggcaacgagagcaaaactctgtctcaaaaaaaaaaaaaagtaaagaaaaagagagtcaatattttgaagtccacataaaagatgatagtttggaaagctgttagtttacaagaaccaagatttttgaaagaacaatttttgaaaatcaaaaggcaaagatttgaaagataaaggtataacattagcctacaaataaacaattaaggttgcggttttccagggagtcaataggatgacagagaacctgacaagaacgaggtcagggtgacctgcatggcttccagggatcacacagagaagagcagagatcatacttggaaagaactcagtttctgccctaaagaagaccaatacagccaaaccaagggcagtcgggcaggtgatggaaccaagccacgctgaagtctgtccaccaccgttcaggggagtgctgttccccgtcccaccaggagaactgctagcattgccttcattgccccccgtgaaggtcttcctttgatcgctgtttgcacctcactccatgacacccaggagaaatgtgacccgtatacatcctgatgtttcagtcagcccatctcaactctactataaatatttttcaataacccagcactttttaaggcccctaaaagaaagggtagaaccgtggatgcccgacaggactgggtagtgcagagagaaccagcagctcaacttgggtggtttcagaaaaacaaaaaacaaaaaacaaaacagttcaaaacttcactttgagccaggacagtggaaagagccacagctgttctattagtatcagtatttttagcagagtctactttcctcaggctgcaacttttcttactggaaaagtgcaaccacctcttaactgatctccctgaaactgttctctccaccctccagtcttttctgtacattgcttgcaacaattaccttccaaaaaatcaaatgtggtcatgtttcctctctagaaatctttattatcctgttgttgcatacaagaggaaggccaaactcagcagcattaactggactgcccttcaaaacccagtcgcagtcaaaattttagcctcaacctatgcctctgccagtgtttaaacttaaatgttagccatttcaaacagggcagagcttttccatacggttgaatatttactcactggttcttcctcctagattatcatgaacttggttctctgcccagcaaactccttcccaactcaaatactattatgaccctataaaaagttacttgctttctctctcatttaccgaggtgctttattcagattaatctaaaagcatccgtcagattctttttttttttttttttttgagacggagtctcactctctcgcccaggctggagtacagtggcatgatcccagctcactgcaagctccgccttccgggttcatgccattctcctgcctcagcctcccgagtagctgggactacaggtgcccgccaccatgcccggctaattgtttgcatttttagtagagacggggtttcatcgtgttagccaggatggtctcgatctcctgaccttgcgatccgcccgcctcagcctccctaagtgctgggattacaagcgtgagtcactgcgcccagccccgtcagattctttgatcatgatttcctcttgtctctttccctactggactgacagctccttgagagcagtgacttccttccacttgctcctaggagccaccctatacatgtttgttgaatgactcagtccacaatgagtgacacagctgactaacataaaactaaaatgacctttgttcacacaacaggctacagtactttgttaattgttctgatccagctttttttttgtacttggaagtttatttgttcatcgtgcatcatttctctatgtttggtcaatcattccagcctgacaaggtagttttttttttttaatcattttttaaaccttctgagtctgttatccaaggaataatgttgcctcttccagctgcatcctcagcaccatttataattgtgccatcaattccctcatccaagttataaatatcagttctggacagagagttttacatggcagttaccctatcttctctagaattatacttatttcttgttttgtcaacttgaatgtgaactcctcaagacaggcatcatggacctctcatgtttatgttctcttaactttcttgattttaataaacactacaaaatatcctagtgtcccttgatggtggtgacagaaagcgggttctggaatcagatgaccgaggatcagaccacagccccccacctgcaggtcaacttaggcaagtttctcaaacccttctagccatcaatgacattttctcatatacaaaatgtggaaaaaagtagtacctacatgacagaattgtcttgagagaataaaacagataatgtatgtagaacgtttcatgctatacttaatccagagtgtttaatataataatagttattagaggtattagttgaataaaataaataatggaaatatcaatgtcatcaaatctactaatttattactcaagtgtatactttgctagggctgccattacaaagtaccacagtctgggtggctttagcaacagaaatctattttctcacaattctggaggccagatctccaagatcaaggtgtcagcagggttgacaccttgaggccttttttttgttttgttttgaggcctttattcttggttagtaggtggccatcttctccttgcaccttcacatggtctttcctctgtacctgtctgtgtcctaatctcctctacttaccagagcaccagttatactggattagagcccactccaacaaactcatttaaccttatttatttttttaaagacccaatcttgaaatgcagtcattcttagacactgagagttaggatatcaaacataatttttttttggagaggggacacaattcaggctgtgataatcagtaatagctatcacacccattataagtaatatctaagttagtcatgatcagctgtataaccatcaacaacaactcactgacccttcttttgtctttttttttgaaacaaggtctcgctctgttacccaggctgtagtgcagtggcatgatcttggctcactgcagcctcaatctcccaggctcaagtgatcccccaacctcaacccgctgagtagctgggactacaggcatgtgccaccacacccagctgatttttattttcattttttttgagatggagtttcactcttgttgcccaggctggaatgcaatggtgcaatctcggctcacagcaacctctgcctcctgggttcaagccattctcctgcctcagcctcccaagtagctgagattacaggcatgtgccaccacgcccggctaattttgtatttttagtagagacggggtttctccttgttggtcaggctggtctcgaactccagaccttaggtgatccacctgcctcagcctcccaaagtgctgggattacaggcatgagccaccgtgcccagcctgattttttatttatttattttttgtagacacagggtttctctatgttgtctaagctagtctcagctgaaacagggcttagctcacacagttcaaaactagctgaaggcctgactttccctggtgaccataccagatacaatcataaagcagggaaaaaagagaatgtgcctggcgactcctcttctggaaactctctgggaaatccgtccttttggccactatcaatgcctgggggcagcttagattgaaaactgtggtgccccattagcaggcaactttcctccaagaaaatgttatttttctttcccttattgaattactggcttcattatattggggtttatttgggaggggaaatttctgtcttccttgaattaaaacctgtggttagacatggttcttttgtacatataccgtttcatagggttttgaaaaaaggaagggatgaaggaaaagaaaatgatgaggataaaaccaccagttggcttagttctctgtaaatattttcttttttttttgattgacaaagattacgcaagactttatttttacttataaagtgaacatatttagaaacattattaatcccttaaaataaccaagatgttgcttatcaataggtattaactatattatatacaatatatgaatattttattatataaaacatatttatataaatataatgtatataatatataaaataagctttggtagtgaataataatggttagcttaatcagtatagtaatgataattttttgctctcctgtgcaaatgacactgggatgttcttataacttttatgtgctcatctataatttcatctgtctttacagaatcaggaaaattactatcttgttctccattctactttttgcacttagtctctgtcatgtagtaagaatttgataatcactgttaattattttagctataaaaccaaagatttgcaagaagtacgtatttatgctcattccatatttgtagaatttacattgattgattgttttttgaaaagataatattttcatatggttaaaatttataagggaatatcatgaagtatctctgtttccaattcccaacttccattcctggtctcaatcagtattattaattctatttttttaaattttattattattatactttaagttttagggtacatgtgcacaacgtgcaggtttgttacatatgcatacatgtgccatgctggtgtgctgcactcattaactcgtcatttagcattaggtgtatctcctaatgctatccctcccctctccccccaccccacaacagtccccagagtgtgatgttccccttcctgtgtccatgtgttctcattgttcaattcccacctatgagtgagaacatgcggtgtttggttttttgtccttgcaatagtttactgagaatgatgatttccagtttcatccatgtccctacaaaggacatgaactcatcattttttatggctgcatagtattccatggtgtatatgcaccacattttcttaatccagtctatcattgttggacatttaggttgcttccaaggctttgctattgtgaatagtgccacaataaacatacgtgtgcatgtgtctttatagcagcatgatttataatcctttgggtatatacccagtaatgggatggctgggtcaaatggtatttctagttctagatccctgagtattcaccacactgacttccacaatggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggcgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagttctttagtttaattagatcccatttgtcaattttggcttttgttgccattgcttttggtgttttagacatgaagtccttgcccatgcctatgtcctgaatggtaatgcctatgttttcttctagggtttttatggttttaggtctaacgtttaagtgtttaatccatcttgaattaatttttgtataaggtgtaaggaagggatccagtttcagctttctacatatggctagccagttttcccagcaccatttattaaacaggatatcctttccccattgcttgtttttctcaggtttgtcaaagatcagatattcgcagatatgcggcgttatttctgagggctctgttctgttccattgatctatatctctgttttggtaccagtaccatgctgttttggttactgtaggcttgtagtatagtttgaaggtcaggtagcatgatgcctccagctttgttcttttggcttaggattgacttggcaatgcaggctcttgaaaagtgattttctaaatgcagagttctgataacctcaaacggtcccttccttggacggttattttgaagaataagtaaggaagtatacacagcatattgcctgactggtattaagcattacatattctttcaaaaagggtgggcagctggagggatgaggcatggcccccttttcccaggatcttctttgggcacatggatgcctaaccctaagctgcaaaaatatgcagcccaacccccgaaggagaagaaatgtctgcttcctatttgtctttgcgcgtgtgctttgcttggccttctcagggtctctctggcaccagagcagccaagctgctggcccaccatgggcccagtgtcctcacgcctcccaagcagacaccagagattgtcaggttcctcaagcagatggtggaaggttctccctcctcctgtggaccggcaccctcctgtgctggatcgcatgtgggattcagcactaccaacagtccctggacaatataagtctcttgagtgtcccctcctggttttgctcaggcagtaacagggagaacagaggctgtcactgcatgggtgtgggaaaaacagtcatttcctctgctgtaaaacagaaatggtatctgcctttccaatgtctcacaggcagtttgtgcatgaatttcacaaaagagagagacagacatgaagcaccctgcatttttaagaggaagaaaatatgcatccatgtgaagtatctttgggctctgtttcctccaagctagcctttccctttaacatggagagcatgtgtgcctgatgagacctgggaaatcaaatcacaaaattgagtccgccacatgacgctgacagacagaaaccagaggcagccagccacgtgtcgcaggattaaattgacgtgaaatgtgcagaataggcacatccacagggcaggaagcagatcagtggtgccgggactgcggatggagcaaagggtactgcagaggggcagggggcatctgctggcagcattgagatgctgaggctgaagtgcaggatggttgcacaactctgcaaacttacaaaaaaatcaacaaatggtgcacttaacataggtgaatgctgtggcctgtaaattacaccaggtcacagctgccagcatcacatcctcctatggagagccccagcctccaggcttgggtccttgctgctgcctatttctctggctgatgcccctgctcctcacccaggtgtacttggctatgtacttgtcctagttgtcattttgatagggatctttacttgttggcaagagataaaaagcactgacatcttgtccacctctttaagatgatcctcaggtgggtgccagccacccctcctctggtctctggtgactcccaggtgaggaagcctcaggagagtaggagcttggggccccaggagccgagagtccctgctcaagctccggcctgcccttccctgtctgagaaagcttgggcaagttacatctctctgaaccctgttcctcacaggattttgatgatcaagcgtgttcccatccaggaaaatgtgaatcactgtccaacatctatgcctgctctcagcatttgtggacagttatctgggggcttctggaaggagcctgtagaaggtcagggagtttcttaaccaaaagcagaggagatccacctgggattgttgatctgtgactgttctgagacagtctgagtcccaaaatgcactcagcgaggggacctagcactcccctctcaccaggaaccctgacaggtgtccaaggcaggaaagccatgctggccctggctcagggagctgctggctggagtgaaggttctaggtgcaaaggatgcctcctgccgagctcaaagcaggagatcaccttgttagaatttccctgaccctcacgagattattaacaccttcagtgttcttcccagatgcccagccagtatagctcacccttgtttccctttctatgaggtccagggctcttgctttgttagatctgcctgacagcagccttttctggttccaagaacatctctttgagcttaagaaagaatagttcttagagtcttcagctcctaggtcaaaccatcttcagttgtattcttgccaatgtgacagcttcaggttccaaggcctccatgctggggtttgctgcagcacagattggagaggagggctggggtccttctaggatatgaggcacctgtcacagctttcttctgcagcaagctcttgtcatctcagattctgaggagatcatcgctgcagagcagctggggtgtgggcattgtggaggctgaagagaagaccagatctctgcagatatcaaggtgctgccttctatggggtgtcgggcaagtggcaggggcaccagccctggggactgtgcttagagcagctggtgttccacctttccctacctcagtgtaagaggcaaggaacaaggtgcctaattttgatctgttttccacatttcttctaggtgggtaactcgcccgtcatgggggagtctgagccctaggcccgctcctctgagttgcacacgagaccctcttgggaacaagaacatctgtttctcttctccaacctgtctgggaggtgaggctgctagctctcgggctgcatgcccacccacaccccttctcccttctggggcctcatgtctgttctttgtgacaccttgttacaaagcttgtcgtagaggaagcatgaaactgaagggcctagatgacacatgtttggtcttcataacatcacacgctcatggatcatgcaagcgctgagggagggctacaagctggctgtgtgcccctcatagctaacatccctggaataaaatgtctacttccctggtaggcatcgccacggcatagcgatcggcacggtgaccgcacaccactggtcatattgcctccttgatctcaggagttggaaatgagaagacgccattgccgctgagagggggcactgtgttggtctgtggcgggaatggccatctccaccggcacccttttcttcatcatggcagtgtccctgcagtatcacatcctggactctgttatattcctcactggcatcactgtggccaatgtgcccaaggtgtcctggccactgttactgtgagtccctgctgttaggcagctgcactcagccctgtggacacagcattgctgctctctccaccaagtccagggcaccaaccctccctgccagggacaatcacggcaccttctgaatagactgtttcttagagggacaaaaggaattgtctaaaattagacaaacttactttaaaacaacaacaaaaatattaacagaaataaggatattttataacgacaaagggtaaattaatcaggaaaatgtaaaacttattgacatgtatgcactcagggaaagagtacagaaacacaagaagcaaaacttgacagaaatgaaataattcagcaatgatagttggagactttagtaccccacttacactaatgggtataacaactagacacaagataacaaggaaatagaaaatatgaacaacatcagaaaccaaatacacctaacagatacatatagaacacaccattcaacagcacaatctgtattcttcccaaatgcacacagaacattttctaagacactatgcaaagccataaaacaaacaccaattaaattgaaggattaaaataatacaaagaatattttctcatcatgataaaagcacattaaggatcaatgaaaggaagaaatctgggaaactcctaaaaatgtgaacattagcagaaactttccaaaataataaaaggccaaaaaagaaaccacaagtagtataagacagtattttaagataaatgaaaaagtagacaaaacctaaaaaaaaaacttacaggattaattgaaaaccatgctctgaaggaagcttacagcagaattccatcaatgaaaaagcagaaaaatctcaaatcaataactaaatgcctgttaaaaacatttaaatggaaatggctgaccccactcatctgagaaaaggatatcagttggggcaaaaatagtcttgttgaaaaaccctaggaaggaagacttggaaaggacaccctctggaattcagggctgtgacaatagttttggaaatctagaaggcaatgtggatgctcagggccaggcacgtgatcaggaatgacccaggaagaccctaagctctcacctctgaccttcaaattctgcaaaagaagaaggtaaaaagaagttgtcattagattaaaataattggttataagatgttctatacaagcttcatggtaaccaaaaaccaaaatcctatgataggtatgcacaaaatagaaagcaagcagttaaaacatactaccagagcaactcacttttatacaaaggaacacaggaagcacgaaagaaaggaagagaggaccaaacaatcaactagaaaacaagtagcaaaattgcaatactatgcccttacctatcaataataacactgaaggtaaatggactaaatgatccaatcaaaaaacacagagtagctcaatcaattagaagacaagagccaactataggcttcctacaagaaatccacttcacctataaagacacatatagattgaaaatgaaggggttgaaaaagacgttccatgaaatgaaaaccaaaaaagagcaggagtagctagctacacttagatgagacaaaatagatttcaagacaaaaactgtaaaaagagacaataaagtttattatataatcatcaattcttcaagctaatataactattataaatatatatgtacccagcattggagcactcagatatataaagcaaatattattagagttagagagacaaataccaataaagtaatagctgggactttaacaccccactttcagcattgaacagatcatctaaacagaaagttaacaaagaatcatcagacaatctgtactgtagactcaatggacctaatacatatttacagaatatttcatccatcagcttcagaatacacatccttctccccagcacataaaacagtctcaaagattggccgtatggtagaccacaaaacacgtttcaaaaaaatttttttaaacatgaaattacattaaatatgtttttctgaccacactggaataaaacgagaaataactaaagaaactttgaaaaccatacaaacacatggaaattaaactacatgcttctgaatgaccattgagtcaatgaagaaattaagaagaaaatgttttaaaaatttcttgagacaaatgaaaatggaaacacaatgtaaccaaatctatgggatacaacaaaagcagtactaagggggaagtttatagcaataaacacctacataaaaagtagaaaaacttccaataaacaacctaatgttgcatcttaaagaaatagcaaagcaagagcaaagcaaacccaaaattagtagaagaaaagaaataacaaagatcagagcagaggccagggtggtggttcacgcccgtaatcccagcactttgggaggccaaggcaggcggaccacctgaggtcaagagtttgagaccagcctagccaacatagcaaaaccgagtctctactataaatacaaaaattagccaggcatggtggctggtgcctgtaatcccagctacttgggaggctgaggcaggagaatcgcttgaacgggggaggcagaggttacagtgggctgagatcgtgccattgcactccagtctgggtgacaaagcaagaatccgtctcaaaacaaaacaaaacaaaatcagaacagaaatggagactaaaaaaaatacaaaagaccaataaaatttccagttatattgaatcatcaaaaccagcaacagacgcagcagcacagggcacagctgcagctacaggagcagcagcaacaggctttgcaggcccagtgccaatacagcagccaccaatgcaatgtctgctgcagcctgccccctcccaggtcctgccccagcagctgcagcagatacgtcaaccacaccaccactagcagctgccatagtcccggcaacctccagctgctcagaaccaaccattgcagctcccgccacagtcagtcacagacccagcctttggtgtggcaagtgcaagcattccctggacagatgtatgcccaacaacagctgcaatttgtctgagctccaagggtagttcagcagctgcaagtgcagccccgctgcagccggtgcagtcctggacgcagtagctgacagtggtgcggaccgctgaggctccccaggtggtggctcccggagtccatggtagccagagcagcctccccatgatgtcctcgccgtcgcagggccaacaggtgcagaccctgcagtcgatgtcccctccccgactgccgtcctcacaacccgactagccccggtctcacagcccaactccaacatcagctccggccctgccccagcgcccagtggctagcttcctgcccagcccctcgccgaaaccctcccagagcccagggatggcgcaccagaacttcagagtcccatgacccggatctttaaacgcccctatgaaacgcggctcagtcatgagcccagcgggctccagccgggccgagcagcagcagtgcctggacaagctaaagccgctgcccaagtacagggagcccctgcgccgcctgagcaacgggatccacgggaaccaagacagcaaaagggctgcggtaagacgagccttctggacgctctgacagtcggctcccagctgtgtcccctggagaccctgtggaagcctgagatcgccctggagaaacgcaagcatgacctggaggtgcccaagccccgactgcacctggtgccgctgaccacgcagcagcacttggcgcctgccgctcctggacacacagtcctggcccgcatctgctcgcagtcctgaaccattccctgcaccgcgccttggtgctgcccagcacaaacacctttccaaaggaggcaaatcaaatacgcatctatctcagtgagcaggggagagactttaaataaaatgggaggcaggtttgccctaagcagctccaagcttaagtttaatttaatgattttggggggcccaaaatattttcctttcacaggcgcaatgggagctcagggtctcctgagagcatcttgtgtgcaggctcgaggcacctccactcgcttccacaggggaacacggaggacacaagaaacccttcacacacacgattctctgatcgcagttttggattcaggctccctgctttcggcatctggacgccgcaggcggaagctagggtcagggtggaacgctgcctctggagggagcccgggcctagaggctgccgggtccccgctcccagctggagctcagccctgcgggcgcccgaggagcgggggcatcggagatcctgtcctccgcacccctggcccgctctcggctcagggccgcaccccagctgtgcaggatgccccgcgatgtctgggggccccgcgctcagagcaccccgggcgctctgcgccactgcagagtgtgcagccctggcaggggagccgtgcctccctctgctacccacactcgggacccagagcagatctctggccccaggatccccctttttaatgtgcgctgccccatcatccgtgattttttcttttatttttctttttttggacagagtttcgctttgttgtccaggctggagtgcaatggcgcgatcttggctccctacaatccccgcctcctgggttcaagcaatcatcgtgactaagcctcctgagtagctgggattacaggcgccggccaccacgcccagctgattttttgtattttagtagaggcggggtttcaccatcttgcccaggctggtttccaactcctgagctcaggcaatctgcctgtctggacctcccaaagcgctgattacaggtgtgagccacaatgcccggcctcgtgattcttacaattgtatcactcctgtgtttgtccggggtttatcactgcagcaccccttctccgtccatctggggcccgctgtcccctcaggatgctgtcagccttggagctggcagagaccagtctggccctggatgcccagaccttacctctcctctgtcgcagggtcctcttcctacaccttgttcgccccccagcttcctggcacagttcttgctccctgtagcagcaagagactgagcttaatgccaggaaatctgggctgtgggacgggagggtgggctgccagtgagggtggcactgagctgaccacctaggacaatggtggcacctggggctatggcgatgggggccacatgggctgggcaaggcactctggagatggctgcccaggagaatgatgaactggtaggaccacgcctaagcggccctgtgtgaggcaggagaggccagcagcttgcccccagcagtgtgctgtgtttgtgaggaagctgccggcccaggcagtgcaccaggaaagccctccggtctccaaagagggcctgcacagctttgccaatggtttttttccagggtagctgccaggtcctggaatgagcaagactcagctgcccagaggggtccctgcggacagcaggggctgggatgggacacctgatagccagtgagaaatacaagcacgacttgagagaaacacaagccttattttcagtcttacaaataaggcgatcctcattttgtcatgtgcatttgtgtacccgctgaatagcaaaataacagcaagaaaagatgacaatttatattttcatagactcagaaaaagtaacaggcaacagtgtgtttcaaattttcgattagttgattttacagtgcaaacatggaagaatctgcagcatgctaggacaaaataattttattaattttataattttactgagattgctatttaaaataattagatgtggggatactacaggaaaataggaaaaagttcatgctgcagatgagtttttcagatgagttttcacaaatatttttgaatcttgaatctttgaataagatgaaattattctgaatatgtgtgtttgggtgataacagttgccaacaaaaatatggctcataacaccagtttcatttgattgcctttggtacattttaaaaaatgctacactactttattccacattaggtgaaatttattttttcttacagtcagattttatcgtgtaaaaaacattctggatatgtaggtaaatttgatttattatctgattataggagtttctgattgtaactgacattgtttggatacaggagagttaattaatcatcattaatgaatcacagttaatatgtccattacagttgagtgctacatctttacactggaagaagcagtggatgtgtagcagaaactttcgagtaaaatagttctgggttcttataatcccttctctgatatctaccaactctgtgtccttaggcaagttaattaccatcactttcctgatccataaagggaataatactaatatctacaaaatatggttagagtgaagtttcatgaagtgatgaatgtaaataacctggcagagtgcctggggatacagcatgattcatcacgatacctgctaatattaatactgtctagttagaaaattatttagataaaatcatctgggtaatcatcacggtgtattagcaacacaaaatcaatttataacctctttttactccttctgctggagaagctgtaaagcctaaagatttgccttctcagtttccttctggctagagctagtcatgagaccttgtggccaatggaatgataccaacatacaagacttctggaaaaaccggacagactcaggtgacctagattttagctgtttgccccttctcttttcccttgtctttctaatatctgggatgtgggtgtgatgtttgaaactgttccagctgccttcaaactgtaagaatggaaaaataaagaaacctgaatcattgatgaaatttttgagctacaatgtgagaaccaacacatctgcatctaagtgactttactcagtggagaaactcttgccccgataacactgaaacttacattattgttagtttcaggaacatcccctaatctgtttatctgaacaacagaccactcaactaatcctcatttctctcttctcaggacagcagattatccaaaccaactaatcaactggctatctacccaacaagagtcccttccaaatccttacctccctgtgttcactaacccttagctattgtaccttgaagtttacccagtttcaagcacgcctcacgttaagaaagccatgttaaaccagacaccaaatatctcacaaccgtcctgcctgtggcctccttactataagtagctagtaagatgctctgcaagtggtggtgtcccatacaacagtaagcagtaaacttgcctttggtttatgaagagattttggtggacttttcagggacttaatcaacaaatactagggcttgattacataggataagattctttctcttcctttttttttctttagagacaggatctcactctgtcgcccaggctggagtggcatggtgcgatcatagctctctgcagactcgatctcccaggcttaagtgatccctccacctcagcctcctgagtacctcagactacaggtgcataccaccatacccaactaatttttaaattttttgtagagatgggggtctcgccatgttcccaggttggtctcaactgctggctcaagcgatattcccgcctcagcctctcaaagttctaggctaacaggtgtgagccactgtgcccagccaagattcttgatacaggtaaaatgaacctcttttgttcaagccactgaattttggtttcgtttattcctgagcatatctctaacaaattgtgcagctattattgttcataaagtaatttatgtaaagactatactagaacagtatttactatactatatttgcataggatttagcagagaaatcatcaagtaatggtagttttccttactttatggccagtcattaaatgttcgttcacataatcttcatgaaaggattttgagggacaatttttttaaagtacattctgtctggtcagtcacaactcaattcaaaaccccattctgccatctgctcactatgtgaccctgggcacattgatgaactcctaatcaggcctcagtttccacacatgtaaaattgtcatagcaaccttactagattttttaaggaaaataaaaataacattattgataaataaatgtaaactatttaggagaaacttagttcaattatgaagcattcgatgtgttatgctttcctcaaagcttcatgttgttcatggtttgcccctgccttgtgaaagctccctactgaagtctcagccctctgttctaaactgctctcttctccaccctaaaaacaacaagaattttaaacctctgttaaatctctaaaaattctaagattaattcctattaaaatggtaacagctattaaaatttaatacaggctaaggatccccttaccttgggaccagaagtattgtggatttgggttttttttttttaagactttgaaatatttgcatatacataatcagatatgttggggatgtaatccaagtctaaacagaaagttcatttatgttttgtatacaccttatacaaatagcctaaaactaattagataaaatattttaaataattttacgcataaaaacaaatctgactgcattttgactgtgacccatcacctaaggtcaggtgtggaattttccacttatggcatcatgtcagcactcaaaaagtttcagatgttggagcatttcagatttcagtattttggattaagatgctcaatctgtatgttaccctgcctaggatttttctgtatctaatggtagaatctaatgactttgaaaagacaaggcaatcatttcccctttgtcagtgaagaatatatttttttctctctgaagttgaaatcacactaggtaaacatttacccgtccatgtgtaactctaacatggccacattattgagcacttacctgcctagagtcagctattgaataagtatattaagtctgcagaaggccgaaatacgcacatttagatggactagggctacagggcaatgggctttggacattttgctttataaaggtaacagatttgactctgcaatttcatcactttcattatttccctattgtctgaaaatatccatttctgccgattccttttacttacatcagcaacactgcaataatacaactcagagaacctttcaacatattccttttcttgtataaggagtggaatctttcaaaacaaaataataactttaaattgtagaagtttatgtacttaacttcagatgttttcaattataatgactagtgatattcatagtagaagcacatagtttaaagggctaagaattgatttgaaatatgtcagaattagaaagaaaggttaatttgttttgaaccaacgtgtcgtggtttaggtaagtgtttctcaaccttggcactcttgatgttggggctgaatgattctgtcgctaggcagctatccagtgcattgtagaattgtggcagcatctccagcctccactcactacacagcagtccaccagtagcagcacccttttgtgaccaccaaaaatgtctctaactattgtcaaatggtacgtgagagtgaaattactcgttggtaaccactcattttgttttggcatccttacagttgacatgtatcattttcttgctcagtattagaagcttcttgtacttcaggaacatgttacatacttcttgtcaagtttccatttgttaagtgtttccacagcaacacttaacaggcagctgcccttggcagtattccttcactgagaagaataaatgggagctgccccagctccatcttactcttattctccttttcttctactcatgctaacttctttcgactacttgctcacccttcatgggatggttcctatttattcatggattccattgcctaatagcttctgcttcagtccttcctattctgtgccattattcttaactttgctatttatctcactaaattccccactagatagtgcatttgtctttactgaagacacagaaaattcttaccaggccactccacagacttcaggtctgcctttagaggaaggtccttcagaacagaatcctgtttgactggctaaagtcatttttaagaaaactgttgtcatttcttttaatatgaacccaggtcaaggaaggcatgctgagttgtggaggtataggatgttattccaggcaggcactttccctccgttatgtgatacagatgagatttgagcattacctttttgtcacttgaaattatatcttacaaaaatacaaacagatagagcatatacagatacacattagaaagggtgaggggaacagatacagaggaaggaggaagagagacagagagggagggagggggagagaaagtggctttgtgtggagccaagatggtaacatgccgaactgagaggcatgagagagagagacagaaagacacagagacagagagaaacaaacagacacagacaaagaaggggttccaggaaaacaacagggcactaagacctcagaactttcatgctacagagaaaaggggtcaatgctggctcattatccaaatcctgatttcaaagcaaaatacaattaaagtggattcagagaactcgtgaccagaaacatgaagggaccgtctaacaccttagtaagccaagaccaccacaatcctggaacataaacacaaagaactcaatatatgcttgttgcaagaagaaagttaaaaaaaaattgtgccaaggcctgtgctgagaaagaaggtggacacaccaccatcctcagggagctacttctgaacactcctggcagagtgaaacagtcactgtcagtgatcagattaaaaattacttcattataataactggacttgtaccctcctcaaccctcctcctttgtgaatgcaatccagttcctggacttgcctcactgcctacaaagaaaacaaaaacaacaacctcctccaagtcccccactgggtacaacgtgcgctctgcagcttggctttctgaaatcacacaggaaggcacctgcatgcatgtttttctagagacagcccacggctttccttaggtttcccaaaggatctatgacctgaccccaaaggttcagaatcactactttttaaaacacccatttgtgagtatgtgcgggaatgttgttgcttctcttttcttctttgtatgttggcaattgtcagtgatgaaaaaaaagaaatggtttctaaggaaaaaaaaatgatccatattctctaacaaggagtgttaaaggagacccccccagatattaggacagcaatgagggaccatgtgtgaagttgacagttggatgctgtccacgagcgtggggccaacactgacaatcacagcagggaggcttccccaggagaactcccttcatctctaactcctcccatatatgcaaactcccaatgacagctgcccagaatcctgcttcaaggctatagtggatgccacggttgaccccttcctttccagccctgaccactgtgctgtcaccttacaatgtggggcatgggggtggtatggagcaaatctgacctcagctccaggtgtggaccctgatgggttcaatttgtctcccctgcccatagtcactggttcaaatgatccaggcttaacctgatgaaaagttggcaaagtcctggacaaagggattggtttagctttgaacatggggctcagtttgggccaatgcgacttaaggggaggggtatgggaaagggggttttacaatgggaaacaggaagtgtttggcatgtaagactgaacctgctgcagccatatgcccatgctccaggaagccaggctcaggatgaagtcaacaccaaggcaagcagaatcacaaaattcaaagaaactgaggtctcagtgatactgtggaaccactggtcgaactgaccctaaacctgctctgcttctcatcctttaagttatctgaacccagaaatgtcctccactgtttacccaggtggaagcggtttcctatcattcacaaaggagtcacaaacaatatgaagtcctaactaaaacagaaaggatgttcgtgttaaaacacaaagttgaggctgggcatggtggctcatgcctgtgatcccaacactttgggaggctgaggtgggtggatcacttgaggtcgggagttcgagaccaacctggccaacatagtgaaaccccgtctccactaaaaatacaaaaaaattagctgggcgtggtggcgggtgcctataatcccagctactgggaggctgaggcaggagacttgcttgaaccagggatgcagaggttgcggtgagccgagatcgtgccactgcactgcagcctgggcgacagccacgagactccatctcaaaaacaaacaaacgaacaaacccacaaagttgatccttttccctacagccatgccaaaaggaactaaagaaaaatatggaactaacgtgtatttagcacataaagctcaacagtaacgcactgccctgtgttgacagaaatgaatccagctgtcagatgagtggcttggctggaaacccttatgactgcttctcctcaagacatttttaagatagtgtattaaaaaaataccccaacaactaaccttacacgaaatgaatattttccactaaaaagacttaaaagcggcacattaaaatgaataagattctataatagaaaactattctgaccatcatttgggggcaattcataatcttcctattcccgaacggttttgttttttaccctataccacacccagaatggatggaatgatgaaactacaattttccctcaacaaaccatttcagttgggtgcatgataaaaaccctgccaatagccactttggctacatttaaaaacttttgtacacaggtcgtgaacctagttctcaattggttgggtctttttggtttggggttttctcccatgttgggaatctctctatcccgagacattttcaaacacctgacagtgacctggcttcccagtgctccattctcctaaacacggctgactcggcttggcatcctgtccccttctccctcctcaccaggcagctatatggatggtagcctgcgtccgccagaaatcatcagtagcatttgttgagtacctactaggtacttactggagaaacatcactaatccttccagaaatagattctctcagctttatagatatggaaactgaggtccaagtctcacctggcaagtagaagagccagcttcggccctggtttctctgactcctccacccagctctctgccaagcaaagtgcaggaaaacagctgcacagggaaacaaccaggcagccgcactgagcagccttttgatacagtccagatgctctcaggcacaggcaacgtgcagaggggtcccaaatggcaatcctgcacttccagaatggcctcgatgtcaagtagcctcacacattaggaactcctttaaaataaatggaaatgggtggaaaacatccacgaatatgcacattggaaataacaggcaggacagacacagcacctgtgccgggctgtagggtgggcgggaaagccaggcctgtgtcccagcctaaggggcagttcacccccacagggctcttgagaagccaggagatggctcttcttcctcctgagcaggagagggttcacagtatgcctggcagtgggagaaaggggtgtgcagggcctctcgctgtgaaaacaggcttggggcacttcttagaactgcgaagaagactttcagctgctcccctgccctgtgtctgacacatggctgctggcatagggcccagcctccccagtgaactccactgggacttgcttatgtggttgttttccagcgccccaaggcagccacctctcctgcttcctaaccacctcctcttcctgggtctgtaacacgggtttgcattaaggttccaggccctctgccctcctttccctgcacattccttccaggctccattgtctcccataattacctcttccctgttggcagctccctgatttccagctccaaccctgaaacccagctccactctagcagccacctgccggcagctgtgaggtgtcttccactccagaaccctctctcaccctttcctggggtacccactcctggctcaaacctgactgatttttgatcccttgcacttctctaattccaaattctacagattcttccccaaaaccttctaaacaaatccatccccagatatgaaaagatgacctaacggcaggaatcaggagtgagccacaggcagcagtggcctccagaatcatagaagggtgcacattccataccccaccagcccagagaaactcatccacagacaaaaacaccatgctggtcaatcaggatacaagccatagttttcaacttctgctcaaaaaagtagaatccaaactccctagcctgtcatttaaaaaattttccatgagctgctctcaccttaaatttcagtccttgctgctccactgggagcgtctgatctggtgagactggacaaggaattttccctcatgcttggggcagcatcttatcttcccaccacttgcatctgtccattctttgagggcagttgaaatgccgcttgctccctgagcctgcagggccagtgctctcctttgacagcacccatgagagccacctggccaggctgttgggacatgttcctcactcatctcccttctccatcagtggccttcagggaaaactatagcagtgtgggaaccccacctgtggtggtgacacaggccccatgacccagggcccttcagtggatggggacaggtccctgatctcagggctgcaggttacctagctgggtcctgccctgccccctttagaaaccatgctcccagacaagaccccatccagggtggaagagcagcccagccccgccctgcagctgcactcactcccagctgttccagggcctgtgcaaagcaattgcctcctgagcccgggctgcagctgcaagcacacatgtaggaggaagggaggcgggggccaagcagcagatgaggctgcagcctgcaattacagtgggccagtgggccagctcaagtatggctgggcagaggaggcgaggctgggggctgatgtggttctcgtgtctcttggcctaagaacttacatctgggcgctgagggaaagggcagtgccacaggggcacagagcgggtgtcccaggggctgggaatttatgccgctgctagggtggaggcttgggtcccactgtctgtaggatgtgggaagggctgagtgtggatggggcccacacttgtgacgcttcctgaatgtctgcattgcacactaagctcttgcatccagccctggactcaggcgttcagaagaagcttccacagtggcactgggcctgaggagtcaggagcccatccctggtgctcagcagcccccgggtccttccgcgtggtgacccttggtgactgaggcctgaggttcaaggcagtcagggttctcatgggcaggctgcagctgctgctgtactgccgggccaaggggcagctccatcgcatcccccaatatggagacaccatcttcacataaaatcacactcagaggctctgagcagatgtgaatttgggaaacacttcagctgaggacaaacaccaacttcaggaggggcagcttcctggggcagcccagcttgactcacatcaaggcctggcagacccagggggcacattccacctctgtgcagtgggggctcaggcaacttccttggggagtctctgacctgggttctcctgtgcctgggaccagtcaaggaaggagctgctccctgtccttggaaagggtgcgctaggccatagcatggggcctggtgctggcaggggagggtttcagagccagaggaatgtgtgtgggctgaaggtggcagcgctgggatggcgatgggtccagcagggagcatagggttgggggacgtgggtgccaaggcccagaagccaggaggaggcaggagggacagcattgtgcctagaacctgggaagagacagaggggatccccaaggtgggtccccagtttaaagtcgcaggtgccctctgctgtggccacagatggccagggaataggaaaaccccacagtggagttggcccaggcagggctgaacacccattgggagcaccccaagtgcagggtgggcgactgggagctggcctgggggtacagctgctgcccggctgactaaaattcaccagtggttgccgtggttcagatgtccctctcatggccatgactgggggacacagtggagaatgggcacaggctcccaggtcagtgaggacagtgcaggtgtcggggacttgagggaggggagtagcactgggcaggcccctggccaagcctggatgacggggcaggaagaagggcagggagtaccatgtgcccggccgtgcactgtggacacgggggcttccctgctcccgtcctggtggccagagtgaggatgttctgtgcttcttcaaggacatcaaccgcctccccttcctgggaccttggacaaggtgcactgtccaggttccccccaccggcctcacagggtctggtgagtacggcagtgggacagggccactcttggcccaggctgcagtgagcactcagccaacctggccacagtctggtcactggggacctggtgtctgctgcccacaggcctaaggaccccaacacccgtcccagcccaggctccccaaggctgggcagatgagggtgagaggcccctgttcgctgggacccattcttgacaggctgggctgggctgtgcaggggcacacccgctctggggggatgtggggtggggacacttctgggcctggttctgttggccccaaggacagacatggcatccctggcaacagctacaccagaggctcaggagccaggagacagagcccaggccggctgggcccctactagggatgagttacaggggctgcagatgcagagggactctctgggggggtcagcaccaggggacagacagaggctgcagtccccccgccccaggctgggacagaggatgagccagcccccacccttccccacccagcattccccaggggctgctgtcaccctgcacacaagaagctgtcccaggctgtcaccatctgacactgcccaggctctcccctcggaatccctgattagcaactatggccaccctagtccctcccactaaccttgggcagagcacagggaccctgatctcatctccactgctgccacctccacccccagtatggtgcataactgggctgggagggggatcccaggacggtgcacgcttggggagccccggcacccaggcagtgggaggccagggaggagccgtccctctgggcatagcacggtcactgcagaccatgggtcggcctcagcgctgaggacccaccagcacacaggaggcgctcagtaaatgctggaggagtaagtgacggtccacgtggtgtgaaactcctgtgccctggagccctacccagactccagcaccgtgacgtttatttctcccaccccaagcccccctcagtgacaccctgggacccttaacaaatgcctttttcttccagggtccatctggacctcagggccctctaggatacccaggacctccaggtgtcaaggtaactgacctccaggctggggataaaggactgtgttgaagggagcgagatggggtctcaggggctcgctccttccaacccacctccatcccctggccactctgtcatcctctaatttcagggtgcagatggaaatcggggtctgaagggccataagatgcaaaggtgagcagaatttcccagcacctcactcctgccattgctgctcctcagcctgcccctggctgccctccagctcctgatcccacccttccacccatgttctcagaatcctccattagagcccccggccctctgtcatctgtggggtcatctcacctccacctttctcaggggatggctttctgaggttcaaaggtgacgtagatgtgaaaggtgtcaggctgagtagagaccccacactggccccaactccatgtcctaatgattctccactctggagcccccaagcaccggttcattccatggaggccccgggttcctcaattccagtgctgtgcatccttgggggcctggtccctgcaggacagcaaacccatgatctgcatcgcgctggccctggatcaccacactctctataccccacaggctccctctcctgcaacagctactgggatccgccagccccactcggcctcactggtgcccctttctcctctgggcccagacctcatccccaggcctccacgcttacctctcccactctctcactcatggtgaggctggagccctggttccagaggagaggatggtcccaaggagcaaaaggaaacaatgaactgactagagatcctgggcttcccagggctcacaggcaagatgatgatgggaagagaggtctgtgcctggaccctctagggatgtgggcactaggtcaggacgggcatgcagggtgcccacagctgacatcagccagtcaattgaagatggccgtgccttaattatgctcctctctctgtaaacggcacctgctggctgctgatgggttgaggaacctataggaaaagtcaaggaaaagccactgtgtgaagagttgattggagatgaggcacagagtggctgcaggtcccaggcaaagtgaacatgcccaggctcagagcagtagcttcgaaaagggagtgtccaacagcagtgagacttgtggtctccagggctgactccccccagccctcgccatgtgcaggcactgtgctaaggtgttctctccatcctgtgaggtgggcgtggatggtcctgttttgcagatgagactctccagaggcacaggaaggcttggtcatcacaccagcagtgatgggcaggccaggggctgagtcagggcagtctggctgcagaattgctgctcccaacccttgctccacagcatcctgggcaggaggagccctggaacatcaggaggaaggggacaggttggggagttggggtgttgtgccacgtgggcaaagggcagggggcctgcagggtgactgatcttggtggatggagcaggagtgggtgctgggacagatggtactgaggtcggcaggtgggctgcagctggatcacagtgaccctgaggacttgacagggctgcaggcacaggaaagcaggatcccagcactagagttggggaaaattcaccctctggaaggagatactgcaaaaggcagccatggggcaggagagaaggggctaggagctggggtgtgtgggtgcactgggggatggggcatggccctcacatgtgagggtcggggtctccagaaagtagcaccagggcctcctctcactcctaattgctccctgtccctccacagggcaagctgggtgttcctggtctgcctggctaccccggatgccaggaactcagggtgacaccgggtgtgtgcccctcctccttttcacttccctgacttcgattccagggagcacagactagcagagcagtggggggccctcaagagtgtttagcggcccccaatctacagatgagagagaggccgagagcagcaggggtttgtcccaggccacctcatttgtggcaggatccaggtctccatgccgctgcctgcatggcctctgctggccccctctgctccttcccgagcctgacctctcataacttctcaatttccccgcttctccttcctcaccagggactcctgggatttcctggctttcctggagtcagtggggagaacggagcctgaggaagctggggatagggagaaggtgtggagggaaaggctggaggggtgtggggggggctctgtggggaggcacgccccgggggatgtccactccattcccaccagggcctgtcaaggaagtcagggcctcgaggagaatggggcctcatggcaagtgcaagggagagaaacagggggctcaaggtccaaatgggtttgggtttttctgacaacaacactcccctctctagggtccacagggtcagccgggtcctcgaggtgccactgggaagtctggagctaaggtcagtggtctctgcagggctccccctgacccctgcccactgagccccagctctccctcaaccacctgaccttggggacaactgaggagcagctcctcccactctgtttcccccatagggaacatcgggggcgaaggcctccatgggccccccagagacagggtgtgtgtggcatgagtgtcctctctctccatgctcccagggagcctgggtgagccagctccttcctcaccccagtgaggaccccagcccctgcccccattctcctgactcagcccacctctgtccctagggtcttcctgattaatgtgtctggtcctctgcctccctttccccaggccataaactctagtcttgtctcaggggccaagagaagcccctttccccaggagggcttcactgtctccctgtagtgaccttggagcacttatcctggcctctgccccagaaatgggcccacctccctaagcaatgacgcctatttctgctcctccttcagggcccacaaagcgccccaggacgcattgggaacctgggtccccctggagagatggtcactgggaagggggtgaatggacaagtatttcaactgagggatgaaagttggttttctgacaactttgattggggagacataaaagaatgagatgtgaggaataccaggattttctgatggggcaaataggtttttgacatcaatctctttgcagggggagccaggagattcaggatctccagggatccagggtgagccaggtgtcaaggagactgacagctccagggccctactttccaacccctttcacccccctcactgccccccacttttcctgtgacctctttgagctggagctcctctgtggccaggagtatctgctctggaccatactctcaataagcccttcccctcttacctccaagggaaagagaccagggtctccccttataggctggactttctgtgtctgtcacattgtccctgagggcagtagggggtggctgaaggtgtctttgaagcagaggctgcatccctgatcttcaagaacccccagaccatctgtgcccttcacttgttctgcagcacccatgtggggagcatggggagaatacagtagagttggggcagctgggagaggcaggaccaccagggccttaaaggacactggggtcaggtgaccgccccaaagggaaccctgcaattttgggggcatggaggctgaggcctctcagcccttgcgaatgacagccctgggatcatgggtgactgtgagcaaggatcttggagtgtggggagcccaggagtggggggatgcctgggagggaggctctgggaatgggatctcctgggaggattcttggggtctgggacccaaagagaaagtgagaaaggccctgtggctaataccctaaagcattagatggcattcagtgagtgcatgaagtggagagggggcacttcgataaaatcacttttcacccttcctatgcaatcaaagatatcctaggtttaatttttctcctcctccttttaataatgctagtactatcttcacttgacctcctgagtgacctagataattatgccttagccaacccctcaaaatagtcatctactttattttatgatcaggatgagcaacctattcaaactatgactaatcggcacattacaagccatcgcctaatttcatatgaagttaccctagccatcagcctattatcagttctactgataagcagcttatcaggggaaattcagccagatatcgggtgaaattcacccccgatatttcacataggttcttttctattttccctaagtgttggctggtctgagaaataaagggacagagtacaaaagagagaaattttaaagctgggtgtcaaggggagacatcacatgttggcatgttccgtgatgccccccgagccacaaaaccagcaagtttttcttagtaattttcaaaaggggagggagtgttcgaataaggtgtgcgtcacagagatcacatgcttcacaaggtaatagaatatcacaaggcaaatggaggcagggcaagatcacaggaccacaggatcggggcgaaattaaaattactaatgaagtttcgggcacgcattgtcattgataacatcttatcaggaaacagggtttgagagcagacaaccggtctggccaaaatttattaggcgggaatttcctcatcctaataagcctgggagcgctacaggagactggggcttatttcatcccacagctgtgaccgtaaaagatggctgcccccaaagcggccattttagaggcctaccctcagggatgcattctctttctcagggatgttccttgctgagaaaaagaattcagtgatatttctcccatttgcttttgaaagaagagaaatatggctctgttccgcctggctcattggcagagtttaaggttatctctcttgttccctgaacattgctgttatcctgttcttttttcaaggtgcccagatttcatattgttcaaacacacatgttctacaaacaatttgtgcagttaacgcaatcatcacagggtcctgaggcgacatacatcctcctcagcttacgaagatgacgggattaagagattaaagtaaagacaggcataggaaatcacaaggatattaattggggaagtgataagtgtccatgaaatcttcacaatttatgttcagagactgtagtaaagacaggcgtaagaaattataaaagtactaatttggggaactaataaatgtccatgaaatcttcacaatccacgttcttctaccatggcttcagccggtccctccattcggggtccctgacttcccccaacagcagctcattcaatttatatatacttatcacaacacaagaatccctctggctactcctaccatcatgacccctagccataatatttatttctgcattagcagaaactaaccgagccccttttgacctaacagaaggagaatcagagttagtctcaggtttcaacatcaaatatgccacaggtccatttgccctcttctttatagcagaatacatgaatattataataataaattccctaactactacaattttcctaggaacaattacactctatgtattcaccagaactctatactacatatttcattaccaagaccctcctcttaacctccctatttttatgaattcgaacagcttatccccaattctgctatgattaacttatacatctcttatgaaaaaactttctaccacttacactagcattctgtgtatgatacatctcaatacccatcataatctccagcatcccaccccaaacgtaagaaacatgtctgacaaaagaattactttgacagaataaacaacagaggttgaaatcctcatatttctaggactataggaattgaacccatccctgagaatccaaaattctccatgctacctatcacaccacgtcctaaagtaaggtcagctaaataagctatcaggcccatatcccaaaaatgttggttacatccttcccatactaattaacctattagctcagcttatcatctactttactatttctacaggtacccttatcacaatgctagcctcacactgatttttcatctgaacaggcttagaaagaaatatactagccctcgccccaatcttaattaaaaaataaatccccgctccacagaagcagccactaaatatttccttatacaggcaaccacatctatagtcctcataatcggtattctctccaataatctgttatctggacagtgaacaacaataaatactgttaatcagttttcatccctaataataataatagccttagtaataaaattaggaataaccccctttcacttctgagttccagaagtaacccaaggaacttctctaacatctggcatacttctcctcacgtgacaaaaactaacccctatttcaattcaattcaatcaaatttttccatcaataaatacaaatattctcctatctatctattttagtgggcagttgaggaggactcaaccaaacacaaccatgtaaaattttagcctactcctcaaccactcatatagactgaataatagcagtactaatgtataacccaaacattaccatttttaccctaattatctatttcatcccaacaattgctgcattccaagtactcaacctgaattcaagcaccacaaccttatcactatctcacatttaaaacaaattaacatgattaatatctataatcctatcaattttattatccctaggatgtttacccccattaacaggattcctacctaaatgaattattatccaagagtttacaaaaaataagtcttattatcccaaccatcatagccatcataactttactcaacctatatttttatatatgcttaatttactccacttcagtgacaatattccccacatccaataatataaaaagaaaatgacagttcgaaaacacaaaacccgtattattcctccccccactcatcatcttctctaccttcctcctaccaatatctccattgacactatttataatctagaaacggaggttaagtaagaccaagagccttcgaagctcttagcaagtacattatacttaagttctgcaaaaacctaaggactgtaaaattctactctgtatcaattgaacgcaaatcaatcactttaattaagctaagcccttactagattgatgggacttaaacccacgaacatttaattaacagataaacaccctaatcaactggcttcaatctacttctcctgccattgggggagaaaggtgggagaagccccggcaggattgaagctgcttctttgaatttgcaattcaacatgaaaatcacctcggggctggtaaaaagaggtcttgatctctgtttttagattacagtctaatgcttactcagccattttacctttttctcacttcacttatgttcaccaactgttgactgttctcagccaactataaagataccgggatattctatctactattcagtgcatgagcagggatagtgggtccagatttaagcctccttattcaagctgaactgggccaaccaggtactcttttaggagatgatcaaatttataatgtcatcattacagctcatgcatttgtcataattttctttatagtaatgccaattataattggaggcttcggcaactgattagttcctctgataattgcccccccaatatagcatttccctgcataaatagtaggagtttccgactcctctcaccctctttcctactattatttgcatccgctatagtagaggcaggcgctggaaccggctgaacagtctacccccacccccccaccccttagcaggaaatctaacacatgcgggagcctctgtagatttaaccatcttttcactccatttggcaggtgtttcttctattttagggctattaactttattaccacaattattaatataaacccccagccatgtcccaatatcacacactcctcttcatctgatcagtcttaattacagcagttcttctactcctttctctcccagtcctagctgctggcattactatattgttaactgaccgcaatcttaatactactttttttcgacccagctagtggaggtgatcctatcttatatcagcatttattctgattcttcggtcaccccgaagtctctctcatcttaccaggcttcggataatttcccatatcataacatattattctggaaaaaaaaagaaccatttgggtatatgggcatagtatgagccataatatcaattggcttcttagggtttatcgtatgggcccaccacatatttacagtaggaatagatgtagatacatgagcatatttcacctctgctactataattattgctattcctactggtgtcaaagtctttagctggctagctacacttcacagcagtagtatcaaatgatcccccacaatgctctgagccctgggatttattttcctttttacaacaggaggcctaaccggcatcgtactagccaattcatcactggatattgtactacatgatattatgctgtagcccatttccattatgtcttatcaaaaggagccatatttgccattatgggaggctttgttcactgattccctctattttcaggttatactcaatcaaatctatgctaaaactcactttgctattatatttgtaagtgcgaatttaacttttttcccacaacacttcttcggcctatctggtatgccttgacgttactccagttatcctgacgtgtacactgcatgaaatattatttcatcctaggctcatttatttccctaacagcagtaatactaataattttcatggtctgagaagccttcacttcaaaatgaaaagttctaatagttgagcaaccatctacccacttagaatgactatatggctgtccaccaacccatcacacattcgaagaaccaacctacatgaagacctaagtgaaaaaggagggaatcgaaccccccacagactggtttcaagccaatcccataacctctgtgaccttctcaataagatattagtgaaattatttcataactttgtcaaagttaagttataggttaagccgtatatatcttaatggcccatacagttcaattaggtcttcaagatgcttcatttgctattacagaataactacttaccttccatgaccacatccttgtcattgttttcctaattagttccctggttctatacgttatttctctaatactcacaataaaattgactaacaatagcaccatagatgcccaagaaatagagactgtctgaatgatcttgcctgctagcatcttaatcttaactgccctcccatccctacgtatgtaatatacaacagatgaagtcaataagccttctctcaccgttaaaacaatcggacatcaatggtattgaagctactagtgtacagattatgaagagttaagcttctattcttatatgcttccaacagcagacctaaaaccaaaagaactccgactccttgaagtcgataaccgaacaatcctcccaatagaaattcccatccgcatgttaacctcatctgaagatgtcctgcactcatgaactattccctcattaggtttaaaaacagatgcagtccctggacgcttaaaccaatttaccttaaccactacacgaccaggcttcaactacagacaatgctcagaaatctgtggatctaatcacggttttatacctattgttctagaactagttccattaaaaacttttgaaacttgatctatagccacacgataatatcactgtaaaattaccccagtgttaaccttttaagttaaagatcgagagaaatcatacctctctagagtgaatgcctcagctagatacctccacatgacctattattgtatcaataatcgtaactttattttccattattcaattaaaaatttcaaatttcatctaccatacacccccttcaccaaaaacagttaaagtacaaaaacataacaacccttgagaactaaaatgaacaaaaatctgttcacctcatttatcgccccaacaatcctagggttacccacagcagcactaatcatcttgttcccctccacactccttccaacctccaactatctagtcaataactgattaatttctattcaacaatgactagttcaacttatcctaaaacaaataattatacgtaacattaaaggacaagcccgatcccttatactgatatctctaattctctttattgccttaaccaatctccttggactcctaccagactcatttacaccaactacccaaccatcaataaatctagctacagcaatccccttatgagcaggcacagtaatcacaggcttccgctttaaaactaaaaactccttagctcacttcctaccacaaggcacacgcataccacttattcctataccagtattcaccgaaaccattagtctatttattcaaccaacagcactagctgtacgtctaacagccaaccttatagccagtcacttactcatgcgcttaattggaggagccacactagtattatcaactactaaccttcccacagcttcaatcacctttattattctaattctattaaccatgctccaatctgctgtggcccttatccaagcttatgtctttacgcttttagtaagcctttatttctatgacaatacataatgacccaccaaacacacacctatcatttagtcaaacccagcccttgaccattaacaggggctctctcagctctcctaataacatccgccctagctatatgacttcactttaactctattactcttttaaccctgggcctactaaccaatacactgactatatatcaatggtgatgtgacattatccgagaaagtacatttccaggccatgatacaacaactgttcaaaaaggcctccgatgtggaatagtcgtatttgttatctcagaagtatttgtctttgctggattcttttgagcattctaccattctagtctagccccagctccagaattaggaggacactgatctccaacaagcatttctcccctcgaccccctggaagtacccctcctgaacacatctgtattacttgcatcaggggtttcaattacttgagcccatcacagcataatagaaaataatcgaaaacaagtaattcaagcactacttttcacaattatcttaggcatttgcttcaccctcctacaagtctcagaatacttagaggctccctttgctatttctgatggaatttatggcccaacattttttatagctacaggcttttatggacttcacatcattattggatcaactttccttactatctgccttctctgccaattaaaataccactttacatccagccatcattttggctttgaagccaccgcctgatattgacactatgtagatgtagtatgactattctcatatatttctatctactgatgagggtcttactcttttagtataaacagtaccattgacttccaatcaattagtttcgatagtatctgaaaaagagtaattaacctaacactagccctagtaatcaacaccctactagccctgtcacttacagctattacattctggctcccacaacttaatatttatacagaaaaatccagcccctacaaatgcggatttgactcgttatcctctgccctcattcctttctccacaaaattatttctagtagccatcacattcctcctatttgacttagaaatcaccctactgctacccttaccatgagcccttcaaacaacctgacactaataattagtacatcctttatgctagttatcattttaatcctagggttaacttatgaatgaactcaaaaaggattagactgaactgaattggtaagtagtttaagccaaaataaatgattttgactcattagttatgacagaacatgtttaccaaatgccctctatttacataaatattatattcacatacaccatgtcacttctgggggtattaatctatccatcccacctaatatcatccctactatgcctacaaggaataatattatcattattcatcataaatacccttttaactttaagtatacattttaccctagcaacgtagtacccatcaccctactagtatctgctgcctgcgaagccgcagtgggccttgcgttactagtttcaatttccaacacatatggcttaaactatgtgcataacctaaatttacttcgacggtaaaaattatcattccaacaattatactgctaccaataacatgactctctgataatcctatactctggatcaatataaccactcacagcctaattatcagctttatttccctattattctttaatcaattcaacgacaatctattcaacttctcatcaacttttctcctctgatcccctaacatcaccccttctaatcttaacagcctggccattaactcttataattatagcaagccagtatcacctctccagtgaatccctcccacagaaaaagctctatatttccatattgatctccctacaagtttttctaattatggcatttacagccacggaactaattatattttatattctctttgaagctacacttatccccaccttaattattattacccgctggggcaaccaaccagaatgcctcaatgcaagcacatatttcttaccttacaaactagtaggatctctccccctacttattatacttacttacacccaaaatatcctaggctcactgagcataataataataacattttttaatacccaagaactattgatttcctgatccaacaactttatatggtgtgtataatggcttttatggtaaaaatacccctatacggacttcacctatgacttcctaaagcccatgtagaaacccctattgctagctcaatggtacttgcagcaggactcctaaaactaggcggctatggcataacacgacttaacccttatcctcagccccctgacagaatatatagtctatcccttcctcatgttatccttatgaggtatagttatgacaagctctatctgtctatgacaaactgagctaaagtcacttattgcatattcctccgtaagccatatggcacttgttattatggctatccttattcaaatcccctgaagctttaccagtttaattatcctcgtaattgcccacggacttacttcgtccctacttttctgcctagcaaattcaaactacaagcgaatccacagccgaaccatattactctctcgagggcttcaaacattatttccactaatagccttttgatggcttatagcaaatcttactaaccctgccttacccccctccactaatctaataggagaactcctcgtaatagtggcttctttctcctgatcaaatattaccattatgcttataggatgtaatatattaatcactgccctttatctccatcacatacttgtcacaacacaacgatgaacacttacttattatattaacagtattaagccctcctttacatgagaaaatatattaatatttatacacctttcacctattctcctattatctctaaaccctaaaattattatacagtcagtttaatcaaaatgttagattgtggatctaataatagaagtctgctgcttcttatttaccaagaaagtgtgcaagaactgctaactcatgcccccatgcctgacaatatggctttctcaacttttagaggataagagctatctgttggtcctaggaaccaaaaatattggtgcaactccaaataaaagtaataatcacatattaccataataaccttaatctccttaaccttaccaattattattaccttcataaacccttacaagaagaactcgtacccatattacataaaaatagctatcgcatgcaccttcaccattagcctcattcccacaacaatgtttatatatacagaccaataacccatcatctcaaactgatattgaataacaatccaaacctttaaactctcattaagcttcaaactagactacttctccataatgtttattccagtagcactatttgtcacctgattatagaattctcaatatgatatataaagtcagatcctaattttgatcagtttttcaaatatttacttattttccacaccacaatattaattctagttaccgccaacaactttttcaactttttgttggatgagaaggcataggaattgtgtcttttctactaactggctgatgacatggctgagcagatgctaatacaacagccctgcaagtgatcctacataatcgcattggcgatattggcttcattttagctatagcatgattcctcacatcctccaatacatgagagcctcaacaaatatttatcctaaatcctacccccgatcttcttccattaattggccttctcttagcagcagcaggaaaaacagcccaacttggcctccactcctcacttccttccgccatggaaggcccagcccctgtctcagccctactccactctagtaatatagctgtggcaggggttttcctacttcttcgtttctactccttaatagaaaataatgtgttaatccaaacccttacactatgtctaggagctattaccacttttttacagcaatctgtgctttaacacaaaatgatattgaaaaaatcgtagcactctccacctcaagtcaactaggccttagaataaccacaattggcattaatcaaccacacctagcattcctacacatctgcacccacgcctttttcaaagttatattatttatgtgttcaggatccatcatccacagcctcaacgatgaacaagacatctgaaaaacaggactatttaagactttaccccttactttctcctcccttattattggcagcctagcacttatgggtatgcccttcctcacaggcttttactctaaagatctcatcatcgaaactgcaaacacgtcatataccaacgcctgagccctctcttattattttcattgccacttccctaacaagcgtctatagtatccagattatcttcttcgccctaataggacaaccccacttcccaaccctaatcaacattaatgaaaatattccttccctaataaatccaattaaacaccttatagttgacagcatcttcgctgggtttctcctcaccaatagcattgtccctgcttcatccctacaaacaacaatagcacctcatctaaaacttgcagccctaggtgtaaacatcctagggcttttactggctatagaactgagttctataactaataatcttacaataaaacacccattacaaatattcaacttttctaacatattaggattttactcaatcacaattcactgtataacccctcactcaagcctatctacaagccaaaacctggcatcacttctattagatctaatttgactagaaaagtccataccaaaaacaacttcacaaacccaaatcacagcctccgttactataagtactcaaaaaggcctatttaaatcttatttcctctttttttattccatcctttttgactttactcttaagtatttaatctgttgccctgagtaatttcaattataacatcaacaccagccaacaatgttcaaccagcaaccaccaccaatcaacactcataattatagaaagcacccgcacccacagaatcttcacgaaccaaccctggcccctcaccctcaaaaattattcaacttcccatactattaaaattaactacaatcaccagtccatcatactcactcatcaacttaacaccaactctactgctaaacccaataataacgtttctaaaaccacaatgcttgatcctcactcctctggatattccttaatagccaccaccgcagtatagccaaaaacaaccatcatcccctacaagtaaatcaaaaagactattaatcccataaaagccccaccataatttagtacaataacgcaacccatagcaccactaataattaaccctaagaccccataaattggaggtttagaagaaaaacctacaaatcccataaccaaaagaacacttaatcagaacaaagcgtatgtcattattcccacatggattataaccatgactaatgataagaaaaaccattgtcatatttcaactataagaacactaatgaccataatacgtaaaacaaatccactaataaaaatcattaattattcactcatcgacctccccactccatctcatatctctatatgatgaaacttgggctgacttcttggcacctgcttaatccttcagatcatcacagggttatatctggccatacattacacaccagatacctcaatttctttctcttcagtcgcctatattaaccgagatgtgaactacagctgaattacccgcttttttcacgctaacggtacttcaacattcttcatctgcctcttcctacatgtcggccgaggcttatattatggctcattcacatatttggaaacctgaaacactggcattattctcttgcttacaaccacagcaacagcgtttataggctatgtgcttccatgaggccaaatatcactctgaggcgccacagtaaccacaaacctaatatcagctactccatatgtcgggactgaccttgcccagtgaatctgaggtgattttcagttgacaaagccactcttacacgattcttcaccttccatttcatcttacctttcatcattatagccctaacaattctccaccacctattccttcacgaaacagggtctaataacccctcaggaaatctcatcacactccgataaaagagaccctcttcctagggaggcggtgtgggggattggtcagagtggtgggaaaaactatagggaaaggacacaaaccttctgaaaggtcggaagtttctacagagccccaggaggagaatagctgaaggcagctgttctataaccctgaggtagagggcaaggagtagctacaagggagtgtgggggaatttttcttaaacaagattgttcacttacatcaaccaggaactgacctttgatcatccgtgcgcctgacgttccctgaaaggggaacaataaatgttaattacctacaggttgtgtcggctccaggttttcaccattgtgcctgcactgaataaaagcaagcagctccagcttctcacagctgctctctggccactggggctgggcagtcacctagctgccttacactgcatacctgtgtctgagtactcatttcatccatcagccagggtctgtgggacagatccggcaaggtggcaggcactgtctgtacagagggagagggtggcatgtgcctgtggtagtctgtgttgagcgggcttaaggggctgtgaccttgatccttgttctctctttggatcagggtcttgattttcctggagaccctgacccccctggagaaggtgacttgggtgtcttagggagggggaaggggaaaagagggtggggcttctatgaggagcctccatgtggctaatgggcttgggtactgggaagctggagatatggcaggacaggcagggggatgggaggattggcagttttaggggtgatgccagccaggttggggcctcctctggccttgcttcacccctgcagggccaggacagtgctaagggtgactgtggcaaggatggcgaaccaggacaatctgtgaatgaccagtgaccccaccacccccactgagccccagccttcagccccttagccctcttctatacccacgcctgagaggtcccttggctggaggccaaacacacacccatcccagttcttctcttcctaggcattccctggtcccactggggagaacagaccccctgggccactagtcaagtgggtgagtgaggtgggctctgggaccctgggaggcagtccctgggccatgtggtagagattgggcaatggctggtggggcgggcagggagatgcctgctatctgtgctgtccctgatgtgtgcatggggcgggggggcatgagcacacgggtttatgagtctgtgacctcctgggtatgttgttcctgaggtttggtgaacatgttctcaacagcggtggtcatgtttactgaccaatcaatggacactggtggagggacgggccagcttttctgctgggccagaggttaacctgggccaccaggtggggtgtgggcgactggctcttccccaaatgcacagacgcctctgcattttcacaacaggacctctgcatctgtgtgtgtgtgccatgtgtgtgcaatgtgtctatagtatgtgcatgtgtgcagtgtgtgtgtgtgtgtgtgtgtgtgtgtagcacagaaaggggaagactggcgcctggctgcctaggcctcatgttctctcccttcccgtcccatttgcagggtctcactggcatgcctggtccccagagccaatgaggagtaaagcccaggtgaaagagaggctgcccctgggtgctggagcctcccctctgccttcctgcccctcaggtgcctcgtctccagatgtctacccacccccatccatgtatcccatgttgacccctcctggggatggggtttcctatagttattgctgctctggggctcccaggcttcgggccctcctccctgcctcaccccttccactttgaacccctgctccaattcacatcccctctgctgcctttcaggacacgttccttgtgtgcatttcagggcctccaggtgctgtgggtgccttgggtcccacaggcccagctggtgctgatggtctgaggggctctggggttcagtgtgagtcactgcaggcgagggctgggcttggggaggagggtgaaaagcccggagaggagtgcaatgtggggtgctcctcctcatccctggggtcccctcaaatctgcagggtcagcaaggccgacctggagccacaggccaagctgggccttccagtcctgtggtgagtgactgggatggggctggtgaggggtgagggtgggcgccctgaggcagccagctaagaccctgcaggaagtgggaggcgatgggagaaccgagttaccgcctctctctggagagagggacttcctgtctccccaaagggacccccagggcttcctggctttgggagcgatgctggagccgaggaagaggtgagtgacaaacacatggccaggtgtgtctcccatcaccctcagccctgaagcctgtgggactctgaggggcctgctctgctccaggcccccagccgccaggccccggggtccctgctcagtgagggccacccacagaccctgtgcccagggcattctctgtgtcttggcctttctcccccatccatgtgactcctcctgtgttccccgaccacctgctcccttctctaggggccgctcaggtctcactggactgattgggccccctggaggagcagggagagaatggggatcagggtcttcctggccctcagggctcccctgaacagaaagggagaggtgagtacagggcctggtcctggagggtggggggaggggtggggagtgggaggatggggttaaaactcagctgtgggtgagggagcagatgctctggagtttggggggaggagggcccagttgagccaggtccttccctagggtaccccaggagcatccaccccattggtcctggagactccctggcctccccgtgagcactgcttctgttcctgcactaaatcctgaaccccactgttgcctcccttgacttccagtgtaacacgccaagtcctcagggtccccatttgtcctcatgcctccagtgcttcctccccacacttccagagctccaatgtccccagatttcctcaggcctgcccctcctgtgtaggaactcgaggctgctgtggacttgggacctggcctctgcactcctgaatcctgtctttcccctgccgtgactggctctttcttgttctttgtgtcacagggacactggctcaaaaggagccaaaggaggcgcagtgagtgacccctgttggactggacactgtctcttcaaggcaaacagactccccccagggagcccctgattcccaaccaggagactgacttcacccttctgtgaccttaatcccatgtgtgacatcttgacctctccatgacctcatttgtcctcgcccgacaggagaggaccacagccccaaccagggctgtgcttgggaggccttctggattttctgccacttggcagcaacaggggaagcttgtgggaccccctgggatgatgccacagaggtgcgagctggtctctggctgcccgtccctgcccatagtgcaccccctcagggcccagtggtttggcggttgtggaaatggagagaagccttttggaattcatactggagaagggataaacaggactcagtcatgggtcgtttaggacactgggagatacaggatgaagaaactctcccagagtctcagactaattcataaattaaaatacaggctccagctctggcactgtggctcatgcctggaatccacgtgctttgggaagctgaggcaggaggacagcttgagaccagagttggaggccagcctgcggacacagccaggaaaagaaagtggctgccagaaggtgcccgaccgccaggcccgaggcaccctggagggatccgcggggagggacccgcagaccgaggaaggcatgcagctgccccacaggtggcccggcctcttcctggccccctcacgtacatgtgcagagaccgttccttgtcttcggaaggtgaacttggaacaattcccacgggacactgcgaatgacggcggctgggcttgggctcccctctccgtcctcagagcatggccaggcccatggctgctgctctttgcccgagagcatgggagattgccccagggggcgcgcccggcagggccctgctgtgctacctggaaccaagaggcctggccgcagtctctgaccccactcccgcaggggactgcgcaggacacagatgccgaggccggcgtggtggctacgcctgtggtcccagctgctcgggtgaggcgagaggagcgcaggagcctgggaggccgaggctgcagtgagccgagagggccactgagccccagcctcagcgacacagctagaccctgtcaaggaaaggggaaggaaggaaagggaaagcaaagaaaagaaaacaaaaaagcagaagcaaacgggcaagaggccagcgtgtggtcccgggctggcctcagtagtaaagatgctcggaggattgattgatttgccggattctgcgcggtttcccagcctgtgcctggttgcagtgccctccctgtggtcgctggctgcccggacccatacccagccccacgcctgccctgccctcttcccagccagagtcacgtgaaaagacccgtggaggtacaggagggcggccctgtatctgtctcatcccccaaataccttgtcactaggaccacgttgcctgagatgcccattccatctctgtccttaaaggcgtcactttttttttttttttttgagacggagtcttgctctgtctccaggctgcagtgcagtggcgccatctcggctcactgcaacctccgcctcctgggttcaagcgattccattgcctcaacctcccgagtaggtaggactacaggtgtgtgccacctcgcccagctaattttttgaatttttaagtacagagggggtttcatcatgttggccaggattgtctccatatcctgacctcgtgatccacccgtctcagcctcccaaagtgttaggattacaggcgtgagccactcgccaggccaaggcttcaccttttaacaggtcctactggaagcatgttcaggactttcatgtggtcctaaacttcgtgagggagagtgagaaactgccccccatcgcagtgatgagattaccgcgtggaggtgacttggaggtccgcccgcgccctgggatggagcctcggccaagctcccgggaaagtacttaaaaaggccactagcaagcgcgcgatgaacggcgcaaacacctacgggacggctcgagatcgcaggctggcgagggccatcgcagctgccacccgcacgcccgacaccgtccgggtccacctgggatcgccgtcccggcccgggtgggcggaggggccccgacaccaccccagagccccagctttggagctccccaacgccacagccaggcacagtgcgaccccggcagcagagggggcacttggaccatttgttcatagtctgggacctccggtcccacgagagcagctgcgagaaggcgaccgactcctcctgcagctccggggccgcgcctgcggggtcgcagctccggagaggacagggccttgctccaggcgaggaggccgggggcgcctggccaggacttgcccaacgggttcctggcaggcatggacctgaaacctgaaaccaagaaaggactgcgagagaaagtggatgagtcccttttaacgccaccatttccgagtgcagttctttctaaaccttaaaacaaagcccagaagccatcaaggacatggctgagaagctaaccacggcattcacaccaaatttatcttctgcagtgcgaccaagccaaaggacaacaaatgggtgtgggccgcagttgtgcaaatatttgtataagagcatcgatttcaggtgggctcagtggctgcgcctgtaatcccagtgccttgggaggccgaggcaggaggatcgcttgaggccaggagttggagaccagcctcagcaacacagtgagatcccatctcttaaaaaaaaaagaaagaatgtcgatttcagcattacttaccataataacaaaaaaagaaagaaagaagaaataataggcattaagagggacctacttaaataaatcctagtacatccatacaacacaatactatgaatttatggagtttttaaaataaggtaaatgttgatgaactgttaaatgaaatactctttcgcctcactcatacaaactaactgcaaatgggtcacacacttaaatgtaaaacatgaaactataaaactttaagggagaaattctaaaagaaaaatgggggacctagagctggataaatattttaggcttgataccaaaagcatgacccataaaaatttggataaatcagagttcatcaaaacttaaaacctaggttctgtgaaagactatcttaagaggattaaatgataaaatacaaaccagtagaaaagacagacattcctgggcgacatttcaggttctgttccagactaccacaataaaagcaaatagggaaataaagccagttacacaagctttttggttttccagtgcatacaaaagtggagtttacatatattatagtctattaagtgtgcaatagcattgcctctaaaacaatgtacattccttaattttaaaataccttattgctagccaggtgccatgactcatgcctgtaaatgtcactttgagggttgaagtgggaggatcacttgagcctaggagttcaagacagcttgggcaacattgtgagaccaaatctctaccaaagaaaagtttcttaaattagctgagcatggtggcacacgcctgtagtcccagctactcaagaggctgaggtgtgaggatcacattagcctaggagttagaggctggtgtgatctatgattgagccactgcactacggcctgggtgacagagcgagactccatctcaaaaaaaaaaaaaaaaaaaaaaaaaaaacactaaataaatattgcttaaaaatgctatagaagatctgagccttcagtgagtcctacataatctctttgcttccttgatgctgatgactgctgattgatcagggtggtggttcctgagtgaccagcaatttctgaaaacaagattcatcaattaagtttgccacattgaagaactattcctttcacaaaagacttctctgcagcatgcagtgttgtttgatattttacccacagtagaactactttcaaaatcatctcaaaccctgctgtggctttgtcaagtttctgtgctattcggagtcctttttgtcatttcaaccatgtgcatagcatcttcaccaggagtagattccttctgaagaagtcactttctttcctcatccataagaagcaactcatctatgcaagtttgatgctgagactgcagcaattcagtcccatcttcaggcctcacttcttcttcttcttttttttttttttttgagatggtgtcttgctctgtcgcccaggctggagtgcagtggcacaattacggctcactgcaacctccgcctctcaggttcaagcgattctcctgcctcagcctcctgggtagctgggactacaggtgtgtgccaccatacctggctaattttttttcagtagagacagggtttcaccgtgttagccaggatggtctcgatctcctgatctcgtgatccacccacctcggcctctcaaagtgctgggattacaggcctgagccaccgcacctggccacctcacttctaattctagttctcttcctatttccaccacatccacagttacttcctccactgaagtcctgaacctctcaaagtcacccatgagggttggaatccacttcttccaaactcctgtgcatgtggatattttgacctcatcccatggatcacacatgttctagatgtctaactacacctagaatggtgattcttttctaggttttgaatttactctgcccagacccatcagaggaatcactatctgtggcagctatagtcttacaaaatgtatttcttaataagaattcaaagtcagaattactccttgacccatgggctacagaatggatgttgtgtaagcagacatgtaaacaacattcatctccttgcacatctccatcagagctcttgggtgaccaggtgcattgccaataagcagtaatattctgaaaggaagctttattcccgagcaggtctcacagtgggcttaaagtgttcagcatatcatgctgtaagtagatgtgctgccatccaggctttgattttccatttgtagagcacaggaagagtgggtttagcataatttttaaggccctggggtttttgcagtggtaaatgagcactaacttccacttcaagtcactggctgcattagcccctaacaagagtcagcctgtcctttgaagctttgaagccaaggcatttactttggttctttatctatgaaagatctggatggcatcttacccagtagaagactgtttcatctgcattgaaaatctgttgtttagtgtagctgccttcatcaaagatctgaactaggtcttctggataatttaccacagcttctccattggcactcgctgcttcaccctgcactcttatgttatggagatggcttctttcccccttaaacttcatgagccaacctctgctaagcttcaaacttctattctgcagctttctagcctctctcagccttcatgaaattgaaaagccttatgaccttgctctggattaggctttggcataagggaatattggggctggtttgatctatccagaccactcaaactttctccatatgagcaataaggctgttttttcttcctcttttttttttttgttttttttttttgagatggggtcttcctctgttgcccaggctggagtgcagtggcacgatctttactcactgaggtcttgacctcccaggctcaagcaatcctcccacctcagcctcccgagtagctgggactacaggcatgtgccaccatgcccagctaatttttttattttttgtagagacagggtttcaccatgttgcccccaggctgatctggccaaactcctgggctcaagagatctgttcaccttggcttcccaaagtgctggaattacaggcgtgagccactgcacccagcctgttttgctttcttatcatttgtgggttcactggcttagcacttttaatttccttcaagaacttttcctttgtattcacaactggctagctgtttcgtgcaaaaggcctagcgtgctggtctgagctttccacatgctttcctcggtagctgagtttgggatttaaagtgagagatgtgcaactcctcctttcacttgaacacttacgagcccatagcaggcttacagattattgtattttcaatattgttgggtctcagggaatagggaggtctgaggagagagatacagacagctggataaacagctggctggtgcagcagtcagagcacacacaccatgtatggattaggttcaccgtcttatgtgggtgctgttcatggtgccccaaaccaatgacaatgatagcgtcaaagatcactgatcacagatcaccataacagatatagtaataattcaaatgtttgaaatatggcgagaattaccaaaatgtgacacagagacccaaagtgagcacatgctattggaaaaatggcagtctttttggatgcagttttgccataaaccttcaatttgtaaaaaaaaaagaaagaaagaaagaaaaaagaagaaaagagcaatatctgcaaaatatgataaaaataaagcaataaagtaaagtgcaataaaattagtctgcctggatttgcaaattctgtctccaaccagtgctgggatccataatatgcaaagaaccctcaaaattaaacattctgtgagtatcaaattcgagaatttggtataaaaatgcatctacttctaaaagtgaaaactacaacaaaaagaaggagttgctttgcttagaaacttttgaagcgcactgcattatttttatttatccgcatgattgccaggtaatctgcatatcaaaataagaggtttcagatgccataaaattaattaccattgaatttctgacagaggagatttgggagaatataggcaacattaaatataagaggaagtttgataagtttaagaactatgaccacaaaagctttttggatgtggcaactttcaattagaactgattgaaagtgaataaactttgagaagattttctaccactctgtgggttgtctgtttactctgctgattgtttcttttgctgtgcagaagctttttagttaagtcccatctatttatctttttgttgcatttgcttttgggttcttggtcatgaagtgtttgcataagccagtcatctagcagggtttttctgatgttatcatctagaatttttatggtttcaggtcttagatttaagtctttgatccatcttgacttgatttttatataagatgacagagctctttccttctgctgctgcggctgcagccatgagtactgctcaggcttcagaagaggctcgcctctagtgtcctccactgtggcaagaaggaggtctagttggaccccattgagaccaatgaaattgctaatgccaactctcatcagcagatccagaagctgatcaaagatgggctgatcatccacaagcctgtgattgtccattcccaggctcaatgctggaaaaacaccttggcctgccggaagggcaggcacatgggcataggtaagcagaagcgtacagccaatgcccaaataccagagaaggtcacatggatgaggaaaatactgcaccggctgctcagaagataccgtgaatcgaagaagattgatggccacatgtatcacagcctgtacctgaaggtaaaggggaatgtattcaaaaacaagtggattgtcatggaacacatcaacaagctgaaggcagacaaggcccacaagaagctcctggctgaccaggctgaggcccccaggtctaagacctaggaggcacgcaagcaccttgaagagtgcctccaggccaagaaggaagagatcatcaagactgcccaaagaggaagagaccaagaaataaaagctccccctttgtctgtacatactgccctctgtgattacatagatcagccattaaaataaaacaagccttaaaaaaaaaaagatgagagatgaggatctagtttcattcttctgcatgtggcttgccaattgtcccaggaccatctgttgaacagggtgtcctttccccatgttatgtttttgtttgctttgtctaagatcagttggctgtaagtatttggttatatttctgggttctgtattctttccattgatctatgagcctattttcatatcagtaccatgctgttttgatgaccatggccttatagcagagtttgaagttgggtaatgtgatgttccagatttgttctttttgcatagtcttgctttggctatgtgggctctttcttggtttcctgtgaattttaggattgttttctctagctctgtgatgaatgatggtggtattttgatgagaattgtgctgaatttgtacattgtttttggcggtatggtccttttcaccatattgattctacccacccatgagcatgggatgtgtttccatttgtttgtgtcatctataatttctttcagaagtgttttgtagttttccttgtagaggtctttcatgtccttgtttaggtataaacctaagagggtttgtgtgtgtgtgtgtggttttttttgcagctattgtaaaaggggttgagttcttgatttgattctcagcttggtctctgttggtatatagcagagctactgatttctgtacattaattttgtatcctgaaactttgttgaattcatttatacatctgacaaaggactaatatccagaatctacaaagaactcaaacaaatccgccaaaagaaaacaaacactcccatcaagaagtgagcaaaggacatgaacagacaattctcaaaagatacacaaatggccaacaaacataaggaaaaatgctcaacatcactaatgatcagggaaatgcaaatcaaaaccacaatgtgataccaccttactcctgcaagaatggccataataataaaaaatagatgttgacatgcatattgtgaaaagggaacacttaaggcatgaggcatgagatataatggactttggagacttgggggaaagtggggaggggagtgaggaataaaagactacacattgggtacagtgcatactgtttgggtaataggtgcaccaaaagctcagaaatcactactaaacaacttatttatgtcatcgaataccacctgttccccaaaaaccaatcggaataaaaatataaacaaaaacaaaaaaagaaagtgaataaactaccatgaataaagctaataattaaagttattttaattatccatctagaggacttattggctagtgttaccttccaacagctatggttatgtgccacagtttgtaacaatgggatatgagtggaaatgatcactgactttactaaatcttggccttaaaacatgcacttcatcttctacccccttccccttcccgttgcaaagtcatggtgataaaccaggtttgttcatgcagatgacaatacttttggaaatgatggcagagaaataaaatgaaaagaatattgttgtgggagaatgatggctggtggtgtaggggtaaaagaatttacaaagagagttgtaggtaaagaaaggcagatttattagagaaagtagaaaaatatgttaccagggagacaatgggcaagtcagcagaagctcactgcaaggaaacaaaagcttgccagagattttatagcacggtgttcatgctgtctattgaagaaggctttgtgtagaaggttgcagtgagctaacttgcaggtgtctggtgatagctgggcacaggaagacagtgagctacttgtgcaggacagctatgagtcctggaccatgaagaaaggcagatttgtggcttatctgctttctctttttgctttcccttgctcctaccagcctgacttcttttccccaatcaggactccgcaaatatagttcacttaatgatcacgtaaattggagtttattacccatgtgacttttgcatatatccagactaatatgtgacaatatatatttctactttgtctgtgccacagtatttgtatatctttagttgtctgatctacagtattgtatgtcttgttatggaacaacttatactagtatagaattattagctgtgttttaaaatttttttgtagacatgttgtgtgttctcacatccaatagaagtgtgtaacaggttatcttctacccatttttctcaatatctgtgtcatttcaaaatccatcaattgtggaggcaaaaggaacatacttatcttttttgtaataatgaggttaagtatatttttatttttgtagaaatttgcaatttttggtctttttatatgttttgatcactttccattttttagagttctgtaactaatttgtagccaatgggtaagatttatctggtttatcaggtatggtttatttaaaagccattttttccattttgttaccttttgttaattattttataagctttttggctgcagattagttttgtttatttccaacgcattaatattttctttttttcttctttgtatatgtgcttggaagaccttcttctgtgatatcagatcaaactcagatattcaagatttgttgctaagacattatttcattagcgtagaaaagaaattaagttaatttaccttaatatttataaatcaagttaaactcacataacaatatggtaaatattattttgcatagttcaggaatgtgtttaatgattttacttgaactgactgactggctacaagtcaatgaatttgtgcttggtaaagattcagcatcaaaaactacataattcttagatcaaaagtaaggtgtatcatttcagttgaaataaattacttataacagttttgaggtataactgacataaaataaactcacatagtgtatttttttcatcaaagaatgcaaaatttcaacagatttgaaaagggtatatataacccaaaacattagtgagtacttattctctaatttattcttcctaataagattaatgttggtctaagtttatcatgtgtatgatttatcatatggaaaaaaatgttcctttaaagctaattcttaaatatgtgcactgaagattctcaaataacatttagacaaatacaacgataatattgtgatttcttgcatagtggttgcattatttatcatgttatataagaatttccttttagctttgaggtgaaatagtttctgccactaatattttctatgctgctaatataaaattagcattaaatttttttattccttgaataactatttacaacatattagtagggttatagatctttaaaaaaacatagctattccagtatctagttatgcaactaactttttgccacatctctaaaacattgtaatggacagattattttttaaaaatacaacacactggcatttatttgtaatacagttttgctttgttgtttgttaattccattgtgtagggaaaaaaagaaaaaaaggaagaggaagagatggagaagaaataagaatacaaacaagaaatagaaaaagcagctaagaaaatgaagaggagcaagaataagatgagaagatgaagacaagtcaagaagaaaggagaaaaagcaggtgagggaatttagaaaccctcttatacgataaatctatttttccctcactgattcataaaatttgaaaacatccaggactatcacaaccaaaaacaagcaaaaagatacaaaaataattatgcccgaaattttttaaatgtacatatgtattttttgctatgacaaagcctctcttctcacttactagttttatcaatgcttgcttcaatatttcagaaatagaatttttcatgttgtgactttcctgaattgtcaagagattgaatttggattgaactctggaatttattgattatcaatattttaatagcacaggacaagtatatatttttcaggaaatatgttttgcatgatgttttaccctaataatttactttcatagagtgattaaaactctgcaaacagtaagcatgatatttaagtattcaaatatttttaaatatttgtcattttctttgataaatgtcataactttcaaatgtatatatctgaggtaacagtgagtttgaatttttccatcactgactatattataaataagtcaattagctcttattagtattaggcttttgttattgatgtgaacctactcaatattatacaaaataagttactatttatacttcaaacctgtgatggtggtttttaaattatagcaaaaatacatataaaatttaccatcttaatcattttaagtgtacagatcataagtattaactatattcacactgctgtgcaacagatttgcagaaatttcccatctggcaaaactgtaattctaaagccactgagtaacaactccccatttcctgcctcttgtggtggttttaaatacaatgcaatatatactagctgaaaatagaaaaaagaaatatacgaaaatattaaatgtatagcacaaaaaatgaataataggataactttggctatgactttaaatgagagaatccaaagtaaaataatggtatataatataaatatataagatgcacaagtacacttaaaatatttaaaatttaatattaacaaaaataaatgtaatataccacacaaataggtattcaacaaaactaaatacaattatgtttaatacttttaactatgttataccatgaataaaatcctatcaacttttgaatatctaggcaaggaaaccaactacatctcttctttaagaaagatcccacaatgaaaactataacacattgatgagatattaaagcagacacaagtacatggaaacatatcctatgtccatgcactagaatattgttaaaatatctatatcacccaatgtgatctacagaaacagtgcaatccatgttaaattacaaaagacattcttcatagaaataaaaaactaacattcacatggaaatccaaaatacctcaggtagacaaaataatcttgaaaaaaaagaaaaaagctggaggcatgacactccctgatttcaaaatatactacaaatctatagtaaccaaagcaacatggtactgtcaaaaaaaagcggggcaggagagacagagaaagagacgaatgacagacagacagacatagacaaataaaacagaaaacagaaattcacacatttacagtgaactcatttttaacaaaggcaccaagaacacacattcgggaaggacaatctcttcaataaactgtgctacgaaagcccaacccacatgtagaagactgtatctagaccattatcttaacatacacaaaaatcaactcaaagatttaggacctgaaactgtgaaaccactggagaaaaaaacatagaatgaatgcttcattcaattggttagaacaaggaattttcaaatagacatcaaaagcacaagcaacaaaagcaaaaatagacaaatgcaattacattaaacttaaaagcttcagcaaggtggaggaagcagtagaattaagaaacaatccagagaatggcagaaagtatttggaaactatgcatcaggcaaggggttaataaaaaaaaataaagaaataaaactactcaaaagcaaaaatacaaataatctgattttaaaaatcagaaaaatatctacccaaaacctttgtctcccaccattatttccccaccttcttttcccgaccgcctttggccccctccctctcgccaccctttttcttcctccatctaccccaaaactttttccccaccatcttttccccaccgtccttttgcaacgccttctcgtgctcgctaccctcttttccctttggcaccaaccacgctgtttagccccctccatctatcccaaaactagtttccttctcctaccactccagccgcgctgcagtctccgtggccaccaccaacagtcaccaccaacaaccagagggaggcgagctgtggggtcacaagctccagcctccagcgtactgccagcgatttcccattcctggtcctccaagccaggcactgagcagctcaacagtccagccacgctgcagtctctgttgccaccaccaaccgcagcgaggtgggccgcagtgttgcacgctccagcctacagctggggatttcccattcctggtcctctaagccagagactgagcaactcaacacgaaggtatgggaaactggaagggcctgacttcccttcggcatcagagttatgcacatgggggttcctgtactgcatgttctgattggatgagaaaaaacctccaggcttactcggattggactttattatcatgttctgattggatgagagcaagtcttaaaacaagcaatcacagcatgaaagtaaagtccaattagagtaggccttcgggttttctctcatccaatcagaacatgtagtccaggaaccgcaggtgcgtaacctcagtatataaagcatgcagaggcagtgtcaggtcattttaggctcttctgtgttagcgctgtgtacgtggcttagagaactaggagaagaggccactgcctgccactggctggagcccggggcactggctagctgtggttggtggtggcgacggagcagtaggagggcgacgggcagtgggagtttttcctgccaggctggaggacaaggagaagggagaggcattgccgcatgttggaggctgaagcctgcgccaccgaggctcccctcgctggggttggtggtgacgtcggacactacagctcagctagagtggtagaaatgttgtggggtaggtgagttttccagggctgcactgcctgcctctgggggcaggggttgggtgtcccattgggtctcaccaccagaggctgcactgcctgtggcaggagactggttgggggcactctctggggttgaattgctggcagtggggcaggttggctggctatggggggctacattgcctgcagtggtgggggtggtgtggggaggcaggttgtgtgcactaacgtgtactgccagtggagggggatgggttggggtgctatcttctgtgcactaccggtggcagggggtgggttgggtggagttctttggggctacaatgctggcagtagggggtggtttaggggcattgtcgggtgctgcactgtccgtgactgggggtgcgctatcaggagctgcactgctcgaggtggggttgggggggcaggtttcgggtgctatctagtgcagcaacacccatggctgggtcaggttgtgggcactattgggtgctacactgcctgctctgggggagggagggtgctttgggggggatattggggttacacaccctgcagctggtgcggggtttgtttggtgtgctatccaggggctacactgttggtggcaggcagcaggcggcaggttaggggtgctatcaggggctacactgctagtggcgttggcaggctgcggaggtggcagtgacagcagtggcctccttcctccttcaggtggtctccaaggaagggaccgttctcctcttccccaattccagactctagagagtgatctcctcctccttgcacaatcttgagtatgacagggcccccacacccaccgtggttctctggcccatgctctcatgctctgtgttgcagagacaacctgggactactgggcagggagtagtgggcaccactgtggtgggggtggggggatagggcactgtgggtggaggcatcaggaacgggaaccagaacttgggtgggcagggctggctgggcctgagtttctcctactcctgctccctgaggagtgcagccctggtggacccagcaatttctgtccagcaggacctgacctagggctggtttcagcaaaggcacacacactcaccctgggccccagttcctggccagcttttgccagaaggagaggctggactttggagggtgggtgtgagtgcctttgctgaaactggtccctgccacccagtggccagcgtgacaaggtgaggctctaatgctaccactccctgcatcccgttttaggcttttctagctttgcccatctagctgctccaagccaggctggaggaggaggaagaggaggagtcatctatggtacattggagcctgcagatggcatggctttgcagctcgccttatgcggttggtggcagcaacagagactgcagctcccccggagcagtaggagggctactgcgggtccaggtggtaggatccttgcagggtgggctggcgcattgagggcgacagcagttgtattggcatcggtgctagtggtggtagcagcagcaagtctggggatctggagcactgcaggacccagcccgacctggggtggggaggaacttgccggtgctgtactgtgggccatggtggcagtggtggaggtgcacctagagcaagaaggagtcctcccccttttcctgccatctctaaagggtgccctcctcctgctagtgcctgaggcaggcgtgagtggcaccattgtctcattcttaacaaaaagatacacagattcttaactatttgtgtatctttttgcttgttttttgttgtgatagtcttggactttttcaaatgtcatgaatcggggaagggataaaaggtatcataataggccttccaattcctacatctgttctttttcctttcttccagtttgtattttcttcttcttattttcttgttcctcttcattttctttgctgctgcttctgtttcatctttctattcttgtttctcttcctgtttttgttttctttatgccaaccaatggccttaacaaacaacaaaccaaaactgagttaaaaagaaactacttgtccctgtggtgtatttttaaaataactggtcccttactgtgttttagagttgaggaaaaaaaatagttgcataattagttacacaaataactatgctttcatgatcctgttaacccacttatgcaaagagtgttccattattgcaatgctatgcatgtgggagttatttgctccctactgctcaaggtcatcaccaaggtctgatttttcactcagcaaaaattcaaaaaactgcaaccttctgcacaaatgggttaatgcatcataagtagttattcgaggaatcaaaaaatgaagcatcacataaaatattggtagcaaacagccatttcacctctcacaaatatttgtctggagctatgcaagaggctcaggggtaataagttccaatttatgagattattaagtgaaccgtatcccttcattggccaggcacggtggctcatgcctgtaatcccagcactttgggaggccgaggtgggtggatcatgaggtcaggagatcgagaccatcctggctaacagggtgaaaccccgtctctactaacaatacaaaaaaaaaatagctggacgtggcggtgtgtgcctgtagtcccagctgctggggaggctgaggcaggagaatggtgtgaacccgggaggcggagcttgcagtgagccgagattgtgctactgcagtccagcctgagtgacagagcgagactccatctcaaaaaaaaaaaaaaaagaatccaagctagtttttaatttaaaataggagtaatttttccagataaaaatattgttatgaggtttttcattgtcttctcatgagatataagctccataagaatggaggccttgtcggttgtgtccactactagagaaaacatcattttagggtccagaatagtgcctcacatatagcagaatttctctaaatattgatgaattaatggatggaaatagttcagcaaagttcaatacttgatttctagtaaacgttcttatataataaatggtagatactattagtaataatattcataacacaaagtgcctattgtatacactgtacttgttgtctgtcttgtatttttattagatctttataaaaacatcttatgggccaggtgcagtggctaacgcctgtaatcccaacactttgggaggctgaggcgggcagatcacaaggtcatgagatcgagaccatcctggctaacacggtgaaaccccgtctctactaaaaatacaaaaaattagccgggcgtggtggtgggtgcctgtagtcccagctactcgggaggctgaggtaggagaatggtatgaacctgggaggcagagtttgcagccagcctgggtgacagagcgagactctgtctcaaaaaaaaaaaaaaagcttatggtaaaattatcatctgcactgtacagatcaggacgtaaggacaggctgagtggtgagctcaacttaactagtggtggagcaaatctagataaactgagttcttaacctctatgctgtgcaaataattacaataatgatgatgatgttggcgatgataaggatgatggtgatgatagtgatggtaattatgatggtgatgatggtgaagatgatggtgatgttggtgagtatggtgatgtgatgttggtgatgatggttaatgctggtgatgacagtgatgggggtcatggtagtgatgatggtgatgatgatgatgaagatcacaaagttgaagaagcagcaggaagaggcagccatgaacttgctcctaacgctggttctatcaacatagttaggaaacataatatatagtttctaatctcctgtgtaatttctggccatagttgccctctggcaaggagcaagatgcagacaagccatagctaaacgaactcaagaaggcatcaggctgtatcactaggtcaccctagctggtgttgcaagattccagatgatggtgaggcttcaggattcaggagctagctcactgaagaaagagcatggcaagatctgagcagagtatcagagccctaaccaagtcagccacaggttaggacagggccagagactcaccaggaaatggagagccaagtagagaaaccaaggcagctatccaagaataagacatcattcaatgggtggaagacttttgcaaagtcaaaattgaatagaactgtggatgcccatggctgctccttgcacacacgagaatttattcatcgcaaaacgtttataacacatctgtgtgctaacactggggacacaacaaaaatgaaacaacccagctcacactctcgtgtacttcaaattctagttgatgcagtacaaaacatcctaataaataagcaaggtagttctagattgtggtaagagtaatgaagtaaatagacatgatcatgtgaagaatgagtgggaaaagtacttcagatagagtcatttgaatataactctttgagaaagtcagaatttgatcttcaacagggcaccctggataccagatccaaagcattaaaactaattctagatgcttctggctggtagtctgaagctgttaaatggccctgtagctcaagccaggacagccccaaaaagatcagggatgttagtagcccctgaaggtagaaacagaggaagcaggagaatggggcacagcagacctatactgcacactttagatttgttaattaatccaacctcctttgcaatcctatgagttaggcattaattgctcttttacagatgagaatactgagatgcagagaggtcaccttttttgcataactcttttatagcacagcttagatgtgaatctaagtttaaatgactccagtgataattctatttccattataccgggggaaatataattcccctagctgagtgaaagggacacttattctcaggcttttaatgctgagaagaattgtttctatatcctcatgaaagaggaggttgtagagcctcacattcaaggaaaagataatgttagaagtatgaacccatagggacttttatgactgtctcagagaggatgtgaggcttctcatgcataatagctgagaagtctggaagattctggaaactttgtcaaggccccatatttgcaaaattatttcttcttcatggggtaatacatggtgttctgcagtaaacacattttggagaaagagctagtgagatatcttctggaggagtgcatggggctgaaatacagtgagaaactgggaaactattgagatgggaccctgttgtacatcagagtgagggagagtcccaaaggaggtgaaggcaacccagccaggctcagggcctgtgtttgaagaagttcagcagcttcaagttacctaaaagaaatacaacaaaaagggaaggcactgttacagaaaggagtatgaaaataaatgaattgatccatgtaaacacttaacatatctgttgagagatgaaaaccctgagctaggacacttacattcattaacttttttaactttcgtgataaccacattgagtacactttttcctattttatatagcatgaagctgagtcccagagtggtcaaattaatggctgctgagtagtgtaaagactttgttcagagtcacagaactagtatgtgttgaacctggaattcagaccctggtgtgcctccaagaccttagttctttcacccataccaaataactccactagaaagggagcagagtcagtcttctgtgatgcctcatggtaatcattgctttcttttccaagggttcatatccttttataacccaatcaaggaccatgcccctgaattatataaatttctcagtctattgcttgcaaaactcactttgttcctttttttgtccatcgtcaaatcactgacatctcaccgagttatcataagacaaatagtaacagtgaataattatcagagcaactataataacagagacctcaaagtctttctcaactccccctctcctccatatttttgacctgagaatcctatgtcttaaacccgttatcctgttgttttcttcctttcatgcccttctcatctctcacctgtaggtcaacgggcctcactccatccaggtcatctcgctactcatcatccacaccagggtccatctttcaaagacggagtcatgactactccctcccctgtttagcaccctttgtggccttgccatcacctctgactaccagattccttcactatctgtcctgtaagtcctggaagacatgatcttgggatctggcctttgtccctctttccaaaaatgtttcttctcatccctgtataggtgctcaaaacactagctaccaaaatgggccctgtgaccctctctaatacatttaaatggagaactccttctgccttgaacacacaatcctataccttgaaccagctcacttcttgagagccaaaggtttgcctcctcctggatgtcttccctgattacactgttttaggtactctacctttgcacccccatagtgctctgtgctacacctatccctttgctgatacttcctgtgcttattggaaatattgttcggcaaatatccagtcgcttgccctcccattgttggagagtagggtataggttcctgccccactgaggctgggcttggccatatgacctattttggccaatggaatgttagcagggatgatataagcagaggcttaaatgtgcttgcatgattgggcttgccctcctgcgctcctatgatacgttatgagaacagaatgccctgagtagttgctgatcctttagcctggctgcagaatgaatccacagggaacagacatgaaccaagctctcagcctggagccaaaccagcttattggtcatgtaaaacaggagtgactagctgagttcagccctagagtattcttgtcctaaaatattccaagctggaatattctcatagacctgaaaatatgagaagacatagttgttgaaggccagtggtttaccacacaggactacatttcaattgacaacaaatatttatttttttacctgctttttcccctctctaaagctatgaacaactgaagggcaaagactgtctctcatacatataagactacaccttcttggccgggcacggtggctcatgcctgtaatcccagaactttgggaggctgagatgggcggatcacaaggtcaggagatcgagaccatcctggctaacatggtgaaactccgtctctaccaaaaaaaaaaaaaaaaattagccaggcgtggtggcgggcgcctgtagtcccagctactcgggaggctgaggcaggagaatggcgtgaacccgggaggcagagcttgcggtgagccgagattgtgccactgcactccagcctgggcgacagagcaagactccgtctccaaaaaaaaaaaaaaaaaagactacacccccccacatccaacatgcaatttggcatcttagagagtgccctatgtgtgtttaaagaaagaagggagggagaaggaaagagaaggaggagggtagaagagaagaaggcaaggggaaggaaaagagaaaggaaagaaagaaggaaagaatgatgatattcttagtaaagtgcccaagcctttgttaaaatagcctttcattggtacttgaatttaatgattaaaccccatgccaacaaaactgtcagaaaagatacagaaaggaagaaataaagtgaaaagttaccaaaatgaccataaatcaacctaaattcattccagaaagactgaaactaggctacttcaccatcttcaaggctgtccaggtcctacaaaaatgaagttacttctagcagtggttggacatcaattgacacaatgacatctactgaagaagacgaagagggtaatcagagaagagtgggcaagagccgtgaggcagagattcttctggggccacagcagtaaccatcgcggacatgatctcctgcttcccttgcctatcctgcccaggtggggatgattgacattgagtgccatacgtaaaagttgagtgggcatcagtgagagggaatttatgacaaacagcaggtgtgttaaagtcaggatttcatacttgctgatgatttggcatgaactatcttccttaagccttctcgtttgtagaaataatttttacttttattttcatctttcctgacaccttaggaaagacagcaccaagttcaaatttctgatccaaaggtttttcagttttcaagactgtactttatccagacaaggaagataaaaaattattcaaactttccttagaggttccctaatagcctccccaatggctgcccagtctcccacccaaatacccttcctaggtagggagaataatgtgtcggcagctgtggagacccctgccttctgctgttctggacaggggctgcttgcccttggtatacccagcaggtccaggcagcaatgaataagaacagggatttcagagagtgttctatttgggtttgaattccagtattgccatttacttgatgattgaccttggcaggttatgtaccctgggcttcagtgtccttaccagtaagtataaaagcacctgctcctttggtgcccatttcccattcctcttcttctggtgctggcaccctgaccctcttcaatgtgacatgctgcctctacacctttggccttctgcacatgctgtccctttgcctttcttatactcccttttctagatactccaaaccttcccatcccacactcctctcactggcttcctctgcagcagactcctattcagtgccaggatcctgcctccttcaggaagcctcctctcctccactggaccatacgttctgtgaggaaggaacaacatcagtcctgggcaacagtgcccagcatagggccctgaagcattgcagatccatattcattgtttctgaaagaataagaaaggaacaattctggaatatgactgtaggttttgtgtgtgtgtgtgtgtgtgtgtgtgtgtgtgtgcgcctgtgcgtgcatgtgcatgcagatatttggattccatggcgatcctccccaagattctggcaatagcacagatgtggataccctcttctcagcttggcctggcttctcatctccttcccgctgcctttcttcactaacaatctattccaggtagccttcttctctagcatgctcctgtttctcagctggggctcctgctctccattccctctgctttgttacgctagtgagttgtgatgtacacattggaaacttcaggtactctcttcaaccctattctaaaaatcctagagctggagctcatcaaataacagcaacagctaacacttaattggtctctggctatgttccaggcactttcaaatgtgtattccctccttgaatctccacacaactctccatgttaggtagtattattacctttatatccccagttaatagactatgactctaaaggccagagagtttaagcatcttgccaaagttcataaagctagcaggtggtgcggctagggttccacatggtttatcaatcgtctgtactatcttttgtggtttatcaatggtctgtactatcttttggccaaaagagtggacaccttgcccccttcttccaccattcagtctctcatcttgttccttgcagttttcaaagagcttaggtttgatactcataccctcaatgccttttctggctctattttcttccagctctgttctgctgctagatacttgacaatgtctctccagtgtctgaccttgacctgtggttcagactaggggaatcccaacctggtttttggcttctgtttagaacttgtctggcctggtgtaaccctggcagtcattcaactcaaggtcatggctattctctgtcacagttcctcctttctgaccctttggataccaaatccacttgcttacacttattatacctccatcccacccattagaattgggaatatctgtctatggcttctatgcccctcactccctctggattccctgtataggcacccttttccctgccaagtgtcctaagcaaacatcacagactctgagtcttattatgaaaagagcaattattatagaaataagagattaccatctgccatgtactgagcaaaggggtttacatatattaactcatctgaccctcccattggcattctgtgagatggaggtaacacaattctgtattaaaggtgagggggctgagattcagagaagtaaaagaatggcatgttttaggctgggcacggtggttcacacctgtaatcccagcactttgggaggctgaggtgggcagatcacgaggtcaggagatcaagaccatcctggccaacatggtgaaaccccatctctactaaaaacacaaaaattagctgggcatggtggcacctgcctgtaatcccaactactcgggaggctgaggcgggagaatcacttgaaccagggagttggaagttgcagtgagctgtgatcgtgccactgcactaaagcctggtgacagagcaagactgcatctcaaaaaaaaaaaaaagcatgttttatgtggcagagcctggtttaaactcccaacccgtaagactcccaagtctgtgctctatgctaccatcatctgaacccaaacagacccttgcactggggttgggctccccttcctctcctgacctttcctgctggttcctcaactccaaccagcatcatctttcctctgatgtcatcttctgttctttgaccacacccttccatcctaaaggacatggtctgaggcttcttccaaattctactgctaaagtgtctcttatttctgtgaagggacaaactagaaatgacagagtaacaaaggaagggaagtggctgtttccagaaactcctggaggtttaggccattgcctgtgccgtttgccatcttgtcactggtttgtccctggcctggccattggaagctcactagggcttgagtcctttcagtttgggaatcatcacactcctccctcttctcaatattgccttcccttacagtatgggcagatgacaccctcttctcaatcattcagcatattcagtcagcagtaaaatgtttttgaggtttgtagagttcctcctttgtgccttagctttcaccaggttgttcttagcagagttggaaaggaccaagtaagaacaggcaatcacaaagccacatgataaggtgtcagatagacctgagttcaaatttgagctccttcacttattcacaacacatcccttaaggaacttaatctatttatctaagtctcagttaatagactgagactactctctatcctgttcagagtagggaagatagagcatggagatagtatttaccttatagggtagttgtgatataatgcatataaaagcactcatctcagtgacagacacataaaaagggctcaataataatcgtaataaattgctgtgaaaatgatggtggttatgatggtggtactgatggtgttggtagtgatagtggaggtggtgatggtagtgatgatggtggcaatgatggttgttgttggtggtggtggtattggtgatgatggtgatggttgtgtggtgacactggtgatgatgatgatggtggtgacagtggtggtggtggtgatgatcatggtggtggtgaacacagacagaatcagagcactctggaaacggcatagagttgggagtgagaggaaggtgcttagtgggagttgcccagaaatgagtcctaaaatgagtttttaaaataagaacaagcaaaagagttgaagcagaaagttgggtcaaaagtaaaagggtattttaggcaggagaagataatttgcaaaaggtaagaaggtagagaaaccatgtaacaggcaacccacccacccctagaggctctgaaggagggctggataccttgcagaattgaaagccttttccaacttttttttttttttttttgagatggagtctcgctctgtcgcccaggctggagtgtggtggcgccatcttggctcactgcaagctccatctcctgggttcatgccattctcctgcctcagcctccggagtagctgggactacaagcgcccgccaccacgcctggctaatttttttttatttttagtagagacggagtttcaccgtgtgagccaggatggtgtcgatctcctgacctcgtgatctgcccgctttggcctcccaaagtgctgggattacaggcgtgagccaccgcccccagcccttttccaacttttgaatcagatttgactcttgcttctcatactcccgggtttctatttccagcccctggagtcattcagaagatatcacgccttttttctggaattatatttctgctatctggggtgggggtgccttgtgactcagccccccagggctaagggtcaggctgaaatgtgcctgaactcaaatggactggaggaggacaggcacccagaggagagacagctgcttggatgtctagggtcccttgggacaaagctgcctcctgtgactaaggtgccagatttcaggactcaggggtccagggtgcagaggcctgggctcctgcatgcctgcagcagtcacctggcttgtccacatgaactgcctgcgtccctcctctctgtgcctgcatgtcctgggatccaaggctgtggcaccctcagcaactccatctccatgtggtagctcacaaggtcagggtgctggcggcacgtgcagcactgcaggttgtttgtggcaatagagaagggctgggcagtggtgtccaggaggtgctccagccgctgcttctggaccagcagcaggtctgactctttgccagcacctccacctcacgctgcagctccgacttccagccgtggaatcccgcaggtgctcactcaccctgacgtggagtcccataccacacctgtgcctgggtctgggctgccagttgctggctctcgggccactaccactctgactgctggcagtctgactgctggtgatctgcgaaggcctggtggcagtggccatagcagttctagaaccactcgtccagcaggtggttggctgagcccgcagtggccaggcctgaggagtgcagtcacctgtgttgcaagccacgtagtccatcttacaggggcggcaaagtctgtggtgccaggtgcatagtcaggagcacatccatctacactgtggtgccaggcgcccatcagggctggggcagtgaagggtgtggtcagctgggtgcagttaatggggcagctccagttgctctgacccagagaaggatgtgcctccctgttgcctgggtgacactgtacacaccaagggccttttgttgctgggcaatggggatccctcccctggtggctggaggaggggcattcaaggtgggcagaactgccctcttaaagtgccaggcaggcccaggcccaccctccctccccctgccatgagccaagcagcagtggccaagggttctctccacctagaggatcctagggcgctctctccccttctttggttcatccaattgttgttccaggtttgatatctgatcccatcctgcgaggagctcagggctcaggatgaacaggacagaagaggctctgcccacctgcacccccattggggcagatgggctgtggcttttgggtgggcctcagggtgggtgttgtgggtgctgactgggacggtgttatcgtatatctaaacatctaaatcctacagcagggtggctgttccccgtgccctagtggccccatacaccagcgttcagaacctgggggtggggtcaggaaggccctggaggcccccacactcctttccacactctgcttgcattcccccagggacggggtgctccttcttcatggaaaccctgagggaccccccacagtgtgatcccactttcagggtctgccagccagagagtggggccctcaggccacgtgcagcctgctgggtctcagcctcacaggctcccaggtgctggcagcccactgagccccaggtcagggggtgtccatgagagttccttgggcagagtccagagatggggagggcagggctgaggtcaccccagtcactcggcagccaccaggaggtaggggccctgtgatgggtgttcctgtggcagggatgattggagggacagagttgcctgctcaggggctgagaggcagtcatgagaccatagaaggggaccttgaacactgggtggccccagggaggttttggttttttggcataactttgttgccctggagaatggggaggccttggagttaattcagctgggaactgaggagcagcagataagaataagggtgcttggactagaccccaaaggtcctgcaggaggaaagaagaaaggagcactgccctggtcagctggctctgggactcagcccagtgggatgaaacctgacagctgtagcagctgagcaagagtagcgcctctgtgaaccaggtcatggtggactcctttgtgcccctatactttgccagtctgcagggccaggcatggtgcatgcagctactgctggctgcgggggcctaggtgagtggcccttccggacagaacccccagacccactgaagctgccagaatggagaagattagctcaggtgcactctgcggggaggaaaagaagtaaagggtggtcagcattctgtgaaatgcaagctcacagccttaccagagcccattgaggggacttcagaggaaaggcaggaggggacagaacagggtgtgcttggagctgagggaggagagactacacctggtccactgcacagggggagcaggaagcccagggcttggctgtcaggaggtcatggaggctgaaggaaaggcagtctgaggccgggtgcggtggctcacacctgtagtcccagcgctttgggaggcgaggcaggcagaacacgaggtcaggagatcgagaaaatcctggctaacacggtgaaatcccggtgaaaccctgtctctactaaaaattcaaaaaattagctgggcgtggtggcgggcacctgtagtcccaactactcgggaggctgaggcacaagaatcccttgaacctgggaggcagaggttgcagtgagccaagatcgcgccactgcactccagcctgggtgacagagcgagactctgtctcaaaaaaagaaaagaaaagaaaagaaaaaagaaaaggcagtctgagcaaaatggtggtgggagaaccagccctgcagtgggccggggccagcaggccagcatctgatagacacaggctcctgggtgtagctgggctcgggtgcagagctgccatttgagcccaaagagaatggtataggctctaggatgcctgagagggacactggaaaaccagctatctgagaaaaagagcaaaaccaacattctgctttgcagctttccctggtgaaaatcctcactctttggctgtttttcagctgtgagtggtttccagccagcagaattactggctatttagcagctggctctgctgagcagcaaatactggccctgtacacccctggacaatttctaacggattcccccctgccccccatctcagagttcaaagggtgaggaggaagtgaagacagtgggagtactgtttactcttcccaaaagcttggaatggaaaaagtgccagagtgtacccaaatagaagctgaatttgtacaaattctaagtagaatttgccaatttgaggggctgcctttttcctggcccctctctgttatgctagagaaggtgtggtcagtgatctcaggcagtccttcctgttggggcttgagtttttattgactgcctctctcccagcttggaacctagggctcctctgtcctgctctgtttttagtaggtgttaggggtagggctagtgagggggaagctgagcttatcctgtcctgacacaaaataaccccaaatgggatggcttctacactcaggaggctatgggtgctccccttagctctgggaagctgagccacaaggcatccccaccccaaggatgctcctggctgaaacagttgcttcagaggtggaaacccaggcctgggccatcactgcaggtgtggacaggtggggtgggctgggagccactgctctcattcatcctatacagagccctggccccaacgatctgcacccccaggtcccctcttttccgaatgtcctttgtcccttccgaatccacaacttgtccatggggcagccccataggatgagggagttccccagtcctgaccccagtgctagctctgaagaattctgtcacctctcagaacctgggacctccctgtgaacgcactgtaggcctgtggacattcatgaaagatgtgggttgggagcagctggtccggggcctcagggagcccctttgttgcacccccaaactcaggccaaaaccttgagtccctccctccccctcatgccttccctcttccctgccttcctttcccccagacccctccccctgcaccctctcagtgcttcaagaactccctcagctcctatgcaaagggccaagggtgcctgcccagtgatggaaacactgagagtgcaggaacagaggcaaactcacaggacagaggggcacaagacttgtgccctggcacacaaggaggtatcccgtggtggagacgaagactccagtcacagagaagagggttgctcccatacacagaaaatgaaactgtccaggcactgaaaagaaatgtggggttcccctcctgttcttggtgtgaggatagcctctgtcagcacagaaccccatggggcagcctggataggcatttgggccccatgggttggggtcctcagggggctgtccggggaccaggggcaggctgacatcccttggtgcattgggcaagcagcagtgatgacccccagaagtacatggcctaccgcgtccattatcccaccatcgtacagctggccagctaccagcgagcggctggcactgtgcaggcaccatccagtgcttcctgtccctcgtccccaaataaagagcatgttagctttctttctttcttttttttttttttttttgagttggagtctcgctctgttgcccaggctggagtgcagtggcgcaaccttggctccctgcaagctccgcctcccgggttcacgccattctcctgcctcagcctcccgagtagctgggactacaggctcccgccaccacacccagctaattttttgtgttttttagtagagacggggtttcaccatgttagccaggatggtctctgtctcctgaacttgtgatccgcctgcctcggcctcccaaagtgctgggattacaggcgtgagccaccatgcctggcaaagggcgtgttagctttctgcatgggacgtgtgtgccaggtgcagcctctagttgccatccgtctgggttggcatctcagtccccttgtgccccactctgcccatggactcaacatcccaactgtggaagacacagggtcagagccaaggacaaggagtccctgtgcctcagagaacaggacaagccctggtagggactggggctccacagcgcagcccagctggaccgtgtgtctagcccagagccgggccatccagctccctctccctgctccctcaccagtgctggcttctctgtcccttcaccagagtcttgaggccttgagacatactttgggaccactgcatcactcactccacttcctctccctgcacctccaggtcccccgcttcagctcacaatacccctcaggacagggcactcaccccatccaaagctcctcccactgctggatgtacctgctggggcgaccccccagacagggccttgcccagacagtgccccctttagcagcccctttctgtccccaatgtcagtgcccaccccccgcccagttctcagtgcccaggatccccgaggctcagatgggcagatcagcaggggcacgtggagctcccacagcactccgcaggacgggacccacccagaaagcatgtgggtggggggcccttttccaggacccaggcccacagggctcttgtcccagcctggaggggatgggcgggtaacaggtaccagcccctctacccatgtggacacccagctgggcatgtactcccacagggcagggcgtgggcaggtagcacccaagctctctgatctcttacaaggacacaaatcctattggatcagggcccacccttatgacctcacttaacctttaccatctccttataggccttgtctgcaaatacagtcaggttgggcattagaacttcagcatctaatattgggggtggggagcgggacacaattcagtccttagccctctccttcctcaggactccagccacatcatgcacagaactatggcctgtatcccatggtgctcctcagtacagtctgggatacattctcagaaatgaatcattaggtgatttcattgttgtgagaagatcatagggtgtatgtagacaaacctagacggtgtagcctactgcacacccagatcacgtggtacagcatattgtccctcagctacagaccatatagcaagtatttgtgcatctaaacacagaaaagctacagtaaaaatatgacattataatcatatgggaccactgttgtatatgcagtctgtcattgaccaaaacatcattatatgccgcatgactataatatttatttttctgattacaaaagtaacacataatcccggtagaaagtaaatcttactagtaccaatcctccataattggggatacttcaaattttcattattataaatagcacttcaatcaacacgtttagccatcagtctctttttgcatttctagttatttctctggagctgatgagtcaaatgattggatcaaaggacatgtgcagttgtggactcttgctgcatgataaattgccttccaaaaggttgtgccagttagcattcccacaagtagagtttgggaatgccagttgcacacctccttatattttaatagtttcctgaggtcaccagaacatgaacatctggaggacagcagcttgcttgggcatcacggaccccatgtccagctcaatgtacagcacatagtagggaattgcgttacatgaacgaagatgtttttgattaactttctggaaacagtcttaaaattagagaaaagttctaagttttacacaaagaacattttcccccagaaacatttgagagtaaatcaccccagattactttggtgagtgttgctacgggtcagaacattctaactacaatgcaactttcataatcagaaagttaatatgaatacattgttaggtaatacattctgttatgtaaccctcagattctttttaagttttattacttgtctgtaatgtcctttacagcaaaaggatctcattcaaattcatggattgcatttagttgtcatgtctcttagactccttcagtctggaacagctcctcagtctttccttgaccttcatgacctttactcttttgaaaagcaaagtccagtaatgtagaaatttcctcagttgggtttctctgatgtttcttttagtattagacttggaccatacattttttgatgagtatcctgtgatctcattgcatcttaccatgggacctacaattttgatttgttttgttattggtgatgttagccttgatcaccaatggtggcatatgctgggtttctcctctgtcatgttattttttcaccttgtaattaatttgtattttgtgaggaggaaatttgagactatggaaatacatctgttcctcattagactttcaatttactcatttactggtatcaacatggattcatggcttatttcattcagtgggttataatttgttaatattttttaaatcagcttttctttttagaaatgctttatttttacaatttcagatttagagaaaaaaattataagaattgtacaaaaaattcttggatgtaattcctcagatattaacactttaccacatttgctttattcattctcctccttttctctttctagataaatacaaatatatatatataatgaattttttgtgaacattttgtaagttttgaacctgatgcctctgtaaatatttcagtgtgtgcttcctaaaaataattatcttacattattatggtatgattcacaaatgaggaaattcaagtttgtctaatattaatatctaatctacagaccttattcagattgtgccagctgtctccctaatatcctttgtagccaaagaaaatcaaagatggggattcacagtccatgatgttttgtgtccagttatcctgtttctttagtctcttaatctgagatagtttctcagtctttttggttttcatggcatttatgtttatttttgttctgttttgtttggtttggtttttttgagacggagcctcattgctgaacgtgaaaatacattgctcatctgatatgtgtatatacatgtatgttgtaaatactttgcaagtatgttgtgttttgttgattttttttcttatatatggggtgttttaatttttattttgctaaaccaaccttcaaaatgtttgctcgtgaagtccttaggaaggtctttgtcaacgtgaaaatgtatctgtatgccaggcgcggtggctcatgcctgtaatcccagcactttgggaggctgaggcgggtggatcaggagttcgagatcagcctgaccaacatggtgaaaccccgtttctactaaaaatacaaaaattagctgggcatggtggtgcatgcctgtaatcctagctacttgggaggctgaggcaagaggattgcttgaacctgggaggcggaggttacagtgagccaagatcgcgccactgcactctagcctgggtgacagggcgagactctctttctcaaaaaaaaaaaaaaaagtatctgtataaataggcatttgtgttttcttctggtagttttctcattttgtatatttaaaatttttaatctatattccaccaggaacctatttttgtgacataaaaatcagctagttttctccaaacagcaggcattccatttatgaataattcatctttttctactaatatgaaatgtcaccattatcaagttctaaattatttcatatatatgggtgtttctggattttctagtctgttccattcatttatgtctttcagctgttagtaaatgacttatagaaattaatggcacattttgatatcgaggaaggcaagtcatttttcgttgcattacaaaaaaattttaatgtcatcataacagtaaaagacagcaagtgtaatttttaaacgttaaaactttggtgtttttatttggtttaggcaaaattgataaatacagaaagagctcacatcttgagaaaattctttctattcaagaacatgaaccatcttcccactttccttctaaggttcctcagtaaagtatatatttacataggggtacgtggatagaaaatggatattggattttatctaaagaatttttagcccagaagttgatacattatgggaactatttctctcattatacacttttctataatgtgaataacatgtttaaaagtgtataccttaaaaatattatatagacaattctgtgagttaaatcactttaaaattgtctctaaagtgcactatagggagattatgggtgcactggaaaccagctaaagtgttgttttcattttgctgctcatagagagacccaggccttgactcctctgaggcttccacatcccaggtgctgcgggccctgcttagctgtattcctaggtattttatgttctgtgtgtgtggctattatgaatgtgattgtgttctagatttggcactcagcttgaacactattggtgtatagaaatgcttattatttttgtaaattgattttatatccaaaaaccctgctgaagttgtttatcatacctaggagcttttggggagatactatggagttttctaggtataaaatcatatcatctgcaaacagagataaatttgacttcatctcttcttattttaggataccttttgttcctttctcttgcctgattgctctggctaggacttccggtagtatattgaataggagtggtgagaatgggcatccttgtcttgctccagttctcaaggggaatgcttccagcttttgcctgttcagtatgatgttgactgtgggtttgtcatagattgctgttatgattttgagttatgttcctttaatgccagtttgttggcggtttttaacatgaagggatgctgaattttatcaaaatccttttctacctctattgagatgatcatgtggtttttattttttgttctgtttagatggatgaattacatttattgatttgcatatattgaaccaaacttgtatcccagggataaagcctactttatcatggtgaatgagctttctgatgcgttgctggattcagttggctagtattttgttgaggatgtttgcatctatgtttatcaaggatattggcctgaacttttcttttttattgtgtctctgccaggtttgggcatcaagatggcactggtctcatagagtgagttagggaggagccccttctcctcaatttttggaatagtttcagtaggaatggtaccagctcttccttatatgtttggtagaattcaattgtgaatcaatctggtcctgggcttttggtaggctttttattattgatcccatttaagaattcattattagcatgtttagggtttgagtttcttcctggttctctcttggggagttgtatatttccaggaatttacccatttgttctaggttttctactttgtgtgcaaagaggtgttcacaatagtctctgatggatttctgtatttccttggggttggtggtaatgtcccctttgtcatttcttactgtgtttatttggatattcacaaaccactgttcattgaaataaaagaggatacaaacaaatggaagaacattccatgctctgggtaggaagaatcaatatggtgaaaatggacatactgcccaaggtaatttatagattcaataccatccccatcaagctaccaatgactttcttcacagaattgataaaaactactttaaagttcacaaatttcatataagcattcagtcacttcatatttttggctaaggttgatggtggtttttgataactgtgggagttttttttcaaaataatacaaagattcctttttttcttcttgggaattctgtttaacagccagtttctcacatttcctctctaatttgtctcccttcttctaccattttatcccacttctgcctctttcatcaactggtttatgatttctaagagagttacacagaagtaacaagcatctctggtttaagaacaacaggttgtcaacatgctccaggacaacagtagcaaaatatatgaggttagagtctaaaatcatttctgcagagcagaaaagatgaggaagcataaaagataagcacatttaagtaaaattgttcacttatatataattcttcagtaataaagggcaaccacagagacgttctcactatacatacatctccctcagaatccatataatccatgcttttttgcattataaccatttttatttaaatatagaccctactcagtagacacccatctactgaaacataaaaccatctccttttaatttgctcatttggtagattcactggacaatatatatctaaggagagaaatataatatctggaatatatatatgtatatattggacacatatatagagagagagaacataagatctggaaaatattaaaggttttttcatttctttataacatgaaatactccatttcattatttttaactccaaaaaagtctgcatctgattgctaatggtatatcaattcaccttaaaaattccatttaggtgttcagtaaacaaaacccagaaatactactttcttcctaaaggaaagcaaaaaaacatgatcatccactttaattacatggtctctatcacataatttatggaacctgtgggttttaactgtgcaaatttggtgtaaaaaaaaattgacatggatgagattactaactagaggtctttaagatgagtttgatttaactgctgctgcttctgcttcactcactataagtccatcaacatcctcttctagtcttacagttaagtctgaaggctttcagcattaagaaatatatatacagggccaggcgtggtggctcacacctgtaatcccagcactttgggaggctgaggtgggcggatcatgaggtcaggagttcaagaccagcttggccaacatggtgaaacccccatccttactaaaaatacaaaattagccgggtgtggtggtgcacaccaaaaatcccagctactcaggaggctgaggcaggagaatcacttgaacctgggaagcagaggttgcagtgagccaagattgcaccattgcactccagcctgggtgagagagcaagactccatctcaaaaaaaaaaaaaaaaaaagagaaaagaaatacatatacaaaagactcgtgtaactctgtgtcccataaggttgaattctaagagactttcattagtaataaatgtatgcaatatatatgattttgaacctaaatgacactaactggttgagcaaggataaagtgcttcttctatgaaaccaatccagaagaccttagaatttcacatgctagagatcttaaattttcactcatttgacagatccttctgtgtgacagatactcttatcctgggtcacaatcttgccttatattttttttctttttcttaaaaagaagtcagactttcccctacaggaaggcattccaccagtctttttgagatggagtctcactctgtcccccaggctggagtgcagaatgcgatggcacgaacacagctcactgcaacctcctcctcccaggttcaagcgattctcctttctcagcctcccgagtagctgggattacaggggtacaccaccctgcctggctaatttttgtatatttttagtggagatggggcttcaccatgttggccaggctggtcttgaacccctgacctcaagtgatccgtccgcctcagcctcccaaagtgctggggttacaggtgtgagccaccacgcctggcccaccagtctttttactacaatactctccaggatattttcagagatgaaaaaggcacttaatactcctattctctgcagcattttttaaccctcctcagagagtctgatccctctattctaatgctctgcctgatgctgagagaatgaggaaatttcatctattgaatacctattaaaatgtattaggtacctacctataaagcactccatttagctttagagatgcaaaggtgttcaaaagaagcttcctggaactccgcaagtggggaaggcagaaatagacacaataaattatagaacagtttattacaaaagtacaaatcaaacattgtgaagaaacagagaaagcagctggaaatacatcctaaacagaaaaaagctagagggatagtctttcccttgcactaaggtacaacagcataccgaggagagaaatacagagagacactaaacaaaaacaaggctataacctgagttaaccaacatgagaggaaggacaaagaatgaggctctcacaaggtcattcctgagttttaacataatcagataggaaagctttcagcagaatgcaaggggaatcagaaggcaacatcatctcccactgtcccttatcaattaaatatgtacatgttcttccgcccaggctgaaaacatgattctcaaggaatataaaaaacccagtgctgctttaattgacaaagcactgaaacagactgtccctccccacgtaatgataaaaatgcgccaaagtcggccgggcatggtggctcatgcctgtaatcccagcactttgggaggtcaaggcaggatcacgaggtcaggagatcgagaccatcctggctaataccgtgagaccccgtctctactaaaaatacaaaaacttagccgggcccggtggcgggcgtctgtagtcccagctgctggggaggctgaggcaggagaatggcgtgaacccgggaggcggagcttgcagtgaacagagatcgcgccgctgcactccagcctgggcaacagagcgagacaatgtctcggggaaaaaagaaagccccaaagtcagagttaatcagctggggcctgtcgcagtctggccacatgcagtaagggaaggaggcaggcacagttcttcttccctaattccatccaccctccctcagctaccaaattatggtttctgatcctgcaagagtcaaatttgcaaagggtggttgagttcttatctgactgataacagttgtaagataatttccagcaatctttatatggcattgaaaggtgacaatgtgctagcagcccttgcttgctctcggcgcctccttggcctcggcgtcccttctggccacgctggagaagcccttcagcccaccgctgcgctgtgggggcccctctcggggtctggccggagcccgctccctctgctggcggggaggtgtggagggacaggcgcgggcgggagcccgggctgcgcagggcgctggagggctggcgcggttccgggttgggcgcgcctctgctgccctgcactccgcgccgccgtcgggcgcctgctgggcttgattggaggacgggctccctctgggctgcaagagtgccccggctaggtgccgcaaagtcccgcagccagtgccattgagaggtgaagcctgctgggcttctggttgggtggggacttggagagcctttctgtctagctaaaggtttgtaaacgcaccaatcagcactctgtgtctgtgccacccgagccagtgggggcaacacgtttgggtttccttccttgctgtggaaggtttgttcttttgctctttgtgctaaatcttgctgctgctcgctctttgggtccgtgctgcctttatgagctgtaacagtcactgctaaggtatgcagcttcactctgaggccaggcccgcgagaccacgaacccactggaagaaagaacaactccagaggcgccgcctttaagagctgtagcactcaccgggaaggtctgcagtttcagtcctgaagtcagcaagaccatgaacccaccagcaggaagaaactctggacacatatgaacatctgaaggaacaaactccagacacaccatctttaaaaactgtaacactcgccgcgagggcccgtggcttcattcttgaagtcagcaagaccaagaacccaccaattccagacacagcatttattttaaaaccaactctctcaggagtatttctctgcccacgggtgtcctcacctccaattgctttaacctgaatgaacgcactccatcctggcctttgttttctcacagctcctaaggcatccagagatccactttgaattatactcttctgaggcctcttcacacctttaataggccctttcacatgggatttaaaatggatcctccctccccataatggctcactgtcttttgcccgtgaccaacatctgggcctctgtaaacactcaagcattctttgccaaaacaaattcggagagtgcagacaagtctcaacacagtaacaattctccctttctcagacaaagcagctcaccagccaccagcccttctctcagccttgatttcctggatgagtcaaatacctgcttccagaagcagaacattcacagcaagctctctgaagtaggatttatttaagaaataagtgtcctcccaccctccctgtttggcaacttagtaatttttttaatgaaatgcgttctcacattcataacagattagccacccgttatattgtcatggtgatggaagatggaagtagttcagaaaacatcgcttttatatataatttaattaagtttctattgtgaaagggaaggaaagattatattcctgactaaaataaggattcatgtgtaacagagtggggacagaaaggtatttgcatagaaataaaatatttgtttcaaaggtaccaactctccaaatcatgtccactactcagtattattttttcaatccaaagtctttattccgacatattttattaaaacatgacacattaaaattaagaaatatgcttataactaaatggatgtggttttcaaagtgactgtagaattttttattctaacaagcagtgtatgagggttatagtttctccacatcttttacggtacttcttatggtctgccttttttattgtccattttaaaatgttataaccatttaaattctgattgtaactgaattacaactctctactcttagatttaaacattttatatgcagttaatttgaagcacaattactgcatcttaagtttccattgatgtacataaaattatgatttaccaacaaccaaataatattttattataaaagataaatggtaatatcaagagataatggatatccttcaacaattttagcttgcaaattaaaaatgcttcccaagagctaagggcacaatttttattcgcatctagtagagtcaccaaccataaaatcatttctttcaactttatgactgacatttctcaaataagctgttctaaatcctgattgttctttttttaaatatgcatgctgcaaggttgctaatttgcaataggtgtcatcatgacaatagactgacaaagtatctcacacccttgaattatactaactcaagaatggatgggaaagcattgccaaagagagactaatgcttccattcttcaatgaaactagtaatacatccctatcaagaagagagttatctcacttccagtttctttcttcccctcaagaacaacttgaatctctttggcatccaaagtctcagaggccaataaagcctctgctagattcttacactcttttgcatgagtgttcaagatatgttttgctcattcatatgagtcctgaaatagaaaagcagatacataaaaagcagaaaatgtgggctgggtgcggtggctcatgcttgtaatcccagtactttgggagactgaggcaggtggatcgcttgaccctcaggagtaggagaccagcctgggcaacatggcaaaaccccatctgtacaaaaaatacaaaaacaaattagccaggcatggtatcacactcttgttgtcccagctactcaggaggctgaggcaggaggatcactcaaacccggaagacagaggttgcagcgagccgagattgtgccactgcactctagtccaagtgacagagggcagaccctgtctcaaaaaaatggaggaaggaaggaaggaaggagaaagaaaggaaagagagaaagaaagatgaaagataaaaaaaggaaggaaaggaaagagaaagaaagaaatgtaggggaaacaaaacccaaactcaatgggtaaagctatagaaactttatatatccttaaaaatgtgaaatctatagatttaaatttataaaagcttggttttgtagtgtaaataatttgtgcatcataaatagtaaggaaaagagaatatgctttctagaaaggcagagacctcatcttctgacagtccctaaacctttccattatacaaactttcatatacttaactagtctaaagcattcctttgacctcctcaaattaaaacctggctctctcctgccaagactacctttcctaaatcctctcaagtgttatttcttcacttgagggtgaagcagtgagctcttcgtacccatcaccacttccagaccgttactaacccatcctcttgtagaaagcagtcttcctgtgaagagaccaaaccattcaaccaaagttctatccaaccccctttgttgtgccatctaacaaataccctaattaaattcttcattcactagggactctggcacttagctcagtattcctcttcattccaagacctccctgaaaggatcagtaacttcaacatcgagatggaacacataaccaacataaccagcctctccactgagctacagacccacatattctaccttgaaatctttaaccaagatagctaaaattcaacatgtataaaactaaactcatgaagctgggtacaggggcacacacctgtagtcccagctactcaggaggctgaggtggaggatggtatcctttcagccttggaattcaagtccagcgtggaaagcatagcaagatcctatctccaaaaaacaaaaacgaaaaaactacgcacttccagtccagtttagtctccagtttctgcagtgaaaggcacaaacagttgcatgaggcagaaatctggaaaacagctttaattgctctttcacccctcacatccaaaacattgcaaagacacactaattccactacatcagtatctcttgaactcacccacatttcttcatttctactttcaccaacctaacccaaccatcactgctctgcgaggccagagtccaggggttctcattccggaatcaactgtgtgacctccttgttgggggtctcggacagggcaggaagaaggtgttccctcccctttgatttattttttattttttatttttgtttttgtttttttgttttttttgtttttgagacggagtctcgctttgtctcccaggctggagtgcagtggcgcaatcttggctcactgcaagctccacctccccgattcaagcgattctcctgcctcagcctcccgagtaactgggactataggcgcccgccaccacgcccagctaattttttgtatttttagtagagacgggggttcaccatgttggccaggatggtctcgatctcctgacctcgtgatccacccgcctcggcctcccaaagtgctgggattacaggtgtgagccaccgcgcccggccttcattttttattaagcactgtgccagcggtctccgtgggtgtgagcccttgtactgcacggggttcgagggacaaactgcgacagcatcaaggcagacaacaccacagcagtctacaaatactatcaaggactcgcgggatgcggtggatcccggaagaggctgctggcgcaccgaccccgtgagccaccaggccctgggccgtcctggcagtgcggtctcccgccgtaaggtggaatgggccgtagagagtgattgtgttgccagccatgtgtccgcgttgcctgacatggagccactcagccggctccatggcacctggaggagagccacaccccctcctcactccttgcccgcttctgtggagttttttgacaaccagaagtagccaattaatttgagctgcccgaagcacttgataccttggtttaggagaaactctggatgactcaaagtttcacaatttaggaatgagattcaccagacacccgttagacggcaaaacgtagctgtgccccggactggtgctgccacctggtggggccagtctgtaagcaagggcggcctagtggccgtcattgtagcccaccaaaccaccctgcttgctgggcccgctgcttcaataggttttattattatttaggtaacattattcagattaggaaatgactgatattgaaaagataagacatgagtgacgctgaaacattttactcacagttcccgagagagcacgtgttatggggtggggaggggtttgattagctcagagtgagagagtccagtggttgcaagtatgaacttaatcgggtgcccaagaagggaaactgacctctagccagggcctcaaaagtgggtcaaggcagcatttttaaaactttgttataggaatccactgtttttgcagtttgtccctccacgtgctctgtcttgggttgaacagtgtctccccatcaaaaagaaaaaaaatatcgtgtctacccacaacctcagaagatgatttaatttgggaatagaatcttgcagatgtaattaagttaaggtgatttgtactggattagagtaggctcttttttctgtgtgtgtttttttttttttttttttttttttgtctgtttgttttgttttgttttgtttgtttggagatggagtttcacttttgttgcccaggctagagtgcagtagcgctctctcggcccacagcaacctccgcctcctgggttcaagtgattcttctgccttagcctcccaagtagctgggattacaggcatgcgccaccatgcccaggtaattttgtattttcggtagagacggggtttctccatgttggtcaggctggtctccaactcccaacctcaggtgatccacctgcctcgctctcccaaattgctgggattataggcgtgagccaccacacccagcttagagtaggttctatatccagtgactgctgttcttgcaggagaaggagaggacacgtggatacatatggagaagaaggccacgtgaaggatggggccagagatcagagcgatgtagctacaactcaaggagtgccagggacaatcagaaccaccagaagctaggacaagcagagaagcgttcttccctagagccttcagaggacacacaggtctgccagcacctggattccagacttctgactttcataactgtgagaggataaattatgaagtttgtgttaaattactgtggcagcctaggaaaccaatacagacactggtgccaggaagtaggatgtttctgtaacaaataactaaaacgtggaaggagctttggaatcagggagaggctggaagaagtttgaggcacgtgatagaaaaagcctagaatccattaaggaaacagttgatggagatgtggacagtaactctaatgaaagctcagaaggaagtgagaagagctgtagagaagcttctatcctcttagcaggggtccccaacccccaggccaaggactggtacaggtccctggctgttaggaaccaggccacacagcaggaggtgagcggccagtgatccagcattaccgcctgagctccgcctcctgtcataccagcggggcattagattctcataggagcatgaaccctattgggaactgtgcatgctggggatcgaagctgtgcagtccttatgagaatctaactaatgcctgatgatctaaggtggaacagcttcatcctgaagccatcccataatcctcccagccccccagcccctgtccctggtgccaaaaaggttgaggactgatgctcttagagaatacatatattgtcatgaacagaatgttagtagaaacctaatgttaaaggtgcctctggtgaggtcttagaaagaaatgaggaacatattctttgacagctgagtaaaagagatctttgttataaagtggtagagaacttgactaaattgtgttctgttgttatgtggaaagtagacatgataaataataagcttggatattaaacgcttggatatttagttgagggaagtgttgaaggtacaacctgcttgctgctaataggaactgtgagaggaaaaagttacatcgagcaaagaacagtcaagcagaaaggagctggcacttaatgatttaggggctctcgggatgtccagattacaaagactacaaaaattaggaaactcactgttagaaagtgtactctggaaagaggaccaagggtgtggctggataacattttgctaaagagattggacatgtgactcatggaaccactccaccacctcagcagaagccagaaatagagatggggttaccaaggaaagatctgtggagggcccctttgtctgttggctgaaaccccatgaattatgcaggagacaaaggttttgagattctgatagcagtagaaacatggcagcctggaatctaagggacagagatggaatggaataaaggaaggccatggggcttccaaaattccacaggcaggcaactggctgatggaggcattctgctgcagaaatgttttatctcccatcttgtaattttctgttgaaagccaaacatgcataaggtgagaggaactgaggtaaataggcttttagtgtgaagttttatatttatctgactaaggagggaggctgtgtttcttgtttgctgtagctgtaaatgtcagaggctaaaatttcctctagtgtccttgtttttgcatcccctgttgcctttgggtttccctagagactgcttcttacataaattctgggccttgcagttctttcagctgcaatcccttgttaatatataggagccctaagtgatgtggcagtaagatgtggggacagcagggagtggtctataaacccatgatcagggcccagtcttgttgtgaaccagtggtccctaggctgtgccactcacaagtgcttctcagcttttttttaatgtgagttggaagactaaagcagactggaggtggatattttccttcccttgggttgggtaggctctggtagttgctctgactttaagcctttgttaaagaggacaggacgttatgtgtgcatttcaaagtggttacactttcctccccttgccagaagctccagcagatttttctctgattttcacccaagaacaagatagaattcctggagctaaaacccatgagactgtgggggccccttaaggctatgtccccagcatcttttctctcttatgcttacatgcccaggctctagcagttagtcagttaccctttaagttttcctacaggttgctggctgcagcagcagcttctgtgcctggcaagctgtagctctgtatttgcctttccttctcattttcaggggagtggtttgccacgtgacctcaattttctgaggaatcgaagagttgttgattttccagttcgttcagcttttttcttgttgtaaggatggaagtgatgattttgaagctctttatgtgccagaacaaaaattttcattggtatgcttactagtgataattataaaaaacaaaggtatgaatgaatgaatgaatgagtgtggcagtaattgctgaagacatgacctcagccttacatacaatctccctggattaattgagcaagccaaaaaacaatgtcttttttagttaagaggtctgactctgtagcccaggttggagggtactggcatgacctcggctcactgcagcctcaacctcctgggctcaggcgatcctccagcctcagcctccttagtagctgggactgaagctgccgcctcacccagctgggttctcctttccaccggacatgtgtttgtgtgctggcacgaaggcatcattgaagtttgaagttggttttctgctgggggagtggagtcaagcccggactgtcccagtgagaaaacgggaaccctgactactggacaaaacaaagcagcagcaagagagaaaggtaaatttttccagagtgctatgctcccagtagacttcctaggacttcctatccctgccttgcagaggcagctcacggacccgaggtggctcctgccaacctgagcaagtgcgctggagcgtgatggaggccagtggggatctgccttctgctgggggttccacagcaacacattttgaatattttcaatgttatcgggcatttcactacttctaatattcacatctgcgatgtatatagcatctaatatactcagtaagctattgatggtcaaaacaactagctaatgtcatgatgaaaatggtcactgccatcaaaacacacagcgatggggcccggatctccctgggcctgtttctccaagttcaagtgaagaggaaatacccaatctggcctggagcgttctagtggcgaaaagtcaaagttcttctggcgaacattttcaagttgaaagaaaaaaatatacacccgcaaaaaaaaaaaaaaaagccacttttgttcccataccgggagtcgaacccgggccacctgggtgaaaaccaggaatcctaaccgctagaccatatgggaactgctgaaaggtgacgccaccgtgtctgtatacgtgacatgcgtcagcttcaccgccagcgcctcccaactaccactgcgcagcactgagctcctgctgtccctgtagaaactcgtatgactgcagccgtgccagactcgctgcatgaacccagtctctcgacttagccctggtgggacaagccacttccccacagaagccagaatcccctttcctggcggtctccccaagagctggagttagggcagaaggtcagggcagcaagttaaggatgctttgctaaagatttgctgtcttcatccaaccctatttgcagagcccatggcctcgccctgataggaggatggccacctgtgagtccagccccaagccagcagtgggaggcacgtgcccaccccagtgtccgcccacaatcagcagcgaagggcgtgctccacggggtcgcacctcctcctggaagaatttgtggccccagcaaaattgacttatttttttccttactttggcttcagaatctcactaactggaaccttgtggataggatctttgttacaaaaggcaacctttggtgaggtttgggggcagatacccgtttttcctgcagtcacaggggttccatttgagttcccccattagtcttttccctggcaactcaaggtcaacagggccaataaacgacccctcaacccaacgcgaatctgccatacagggattatgttaaagttcaagaagtaaaacaatgtggtactggtgtattgacagtaatgtccacgaaacagaatgaaaacccccaaattacattaggtttacactgggagttagcaaaacaaaagggcagcattaaccgacatacagcacgtgggaggatggtggaaaagctggacatgactcactggacatttcaactgaaaccacagaggttcttgaaaatgctggagaattccctgattgccttatcagttacaaacccaaattcagaatcatgtgacagctggatacattcaactgtacgtacaaataatgatcaaaaaacacaaaagttgggtagtggttaccatagcttttactgtagttattcattaagctattcaactgttctgtgcagtttgatgttttattttacaataaaaagtcaaaaaaaataagcaaaaagataaactggaaaataagacttacatctcatatatatggacaaaggaccaattacctccaaacataaacagctcctagaaattactgcaaagatcaacaacccagtagaaaaatgaatgaagttcccagaacagaaaacacaagtggcccttcaaaaaaatgaagagaggctcagcctcttatggtaagacaaagagacaggattttaaaaacctaggcctcttcctagagttcccttaaatatctaggccagatcatttttacttcctggcttagaccctgccaagggctgcccagctactcaggtgtttgtgtccttgtggactcaagtcatattgtcctgatcttttggctgagtacggttttctcctccagcaaagacaatttggaggatgtactaagcatgaagcgctacttcctggcccccatctctcttcgcacagtgttccatcatccagccatgaaagcacagctgagtgatccaagaggcagttccaattgttgactaacgtgtacctgcctatgtgagtgtgtcctatgggaactcaggccttagaatggtttcaaagtagtggctttcaaaattactgtttgcctcttcaaacttcacacctaaggaaaatggaaacatgcagagcagggacacagaaggggcattagctggcgtggggtaggggcaagagctaattgtgaaggaagaaggcctgagatcacgtagccatgtcggagaacagctgtgctcgctgccctgcctctttgcgcgcatgtcaggcagccccaggctccagctgcttgagtttctcttggagtccccggagctggcttcgaccccagtcaatgcggttctggaggctggctatgtctgcggccagctgcaggcctggaggaaaggagagaaggtcaccatggtatctgtagtgtaacacacgacccaggaggatctggatatccccagaaattggaaaggcttcaggcctctctgccccccacacttgtcccaaaacattccaggtacggccctgcattggctgctccagaacctctgaggccttacacctccttcaggtctttgctaaaatgtcacctccttagacttcctggacccattatatcacccaccaggaactaaaaattcacagatagtaataccatttcatgccctcatttccttccttcccccattattacagcatctctctgccctcacctgctctccctccacttcttttctctgttagtccacactctggatccacctctagatggcttttgctgatgtctctgctggaacagctgctgcccagtcctccgggcagctctcgtcttcggcctcctgttcagcagcagggctgaccacacattggatcactcgctccaggaaacactttctcttcttggcctccaggacacctgcccccaggtgttgctcctcagtttccttgactggcttctcccctcttctccctcacctcccgtccatactccccaggccctctgctgatctcatcctatctcagctttaaaccagtgtttgtgtcaaaaactttggaatttaaacaccagtgctatgcagtggactcccaaatctctctccagcccaggcctctcccaaactccagatacatgtgcccaagtgcccactcagactctccagcagggcgtcggtggataccacacagaccacaccaactcctgccttctggaatcctctcagctgcccacagcaggtgagggtcgctccatcctcccaggggttctgggtggagaccgcaggctctcctggactcctttccttcccttactcccatatcttatctgtcagcaaattctggggcttctattcttaaaacctgtgcaggttcccaccacttacctcctcctccagtgacgctatctgcttctcacactggctgctccctgacacctacttcctccctctgctctgtgtccccgcccagcacccaagcattcctgtgaccctgtacagccagttgcaccatcctctgctcagagcctctctgtgggtcccacagtcttcatcagggcttacatcacctgactccactctaggccaccggcctcggcacataccagatatatctggcttcagggcttttgtcctggctggttcctccatctagagcactgttccccaaaatcacccacaaagcttttccttcacctcctcagagagacctcccctggcccactcctgtcccactccattatgtgtttttcataacaattttcacagcctgacttatgttaagggcctacttatttgcacgttgcctttgtctgcttctaaacattacatgaaaagtgtttgtctcttttgttccctgctgtatccccagcagctagcatgaacccgaatgctgccaacaaccagtaaatgcttttggaaaaaataatgggtgtacaacggaagtttggatggaggaaaacctgcaaagcctttcacagactaaccccagccatggcagcagtgctcaagtgttccctgtggatagagggtctgagggccacagagccaaacaacacggtccactcaccatcccggaagcttgcttgagcctgacgtagactgtgaggaactaggattccaaaccagttcagggggtcctgaggggcctcagaggactccggttctggggtcttagtggggcccttgcgcctccgcagacctgaggaaagaaaggttggaggaggctgggatcttactccctgacctttatcatcttggtgacaatgttgagcttgatctgagctcatgattctataaaacactgttggttggaaaattccaactttggggttccaggaaacagcttaccacaaaacacagcctttccccttgtgattcagatgagactgtttgtccactctttcccgtgactcctgtaagacccactgatgaccctgtttgcctgtgacactgatcttacccattgtacctgaacatgccaacagaccagacatagacgttccaactccccattctttgtctcaggatgattaactgggattagaagtttgtccctctgaaactagctagacacacagataaatattttctgttcagctgactgaaatgtatgtgattgtaaatctattcccagtgtaaagcaactcaccaacaatttctctacttcctataaaagtctaaggcaaaaccaccctacaaaaacattctgttcttctgctctgggatgctctctcttatcgcaaaaacctaatttaaatcatctccataatttgcattttgtctttgacactgggaaggggttctgcagaaggaagagggggctcacctgcttcgcgaggccccacctcctctggggcgtggacaccagctctcaccaccttgaacttctggagtccctcctgggcctcgctgaaggacgagaagggaggatggagctttggcagcccgggcctagaacgcgcccgcccgcccacccagcccagcatggaagcttcctcacctggcgtggaggcagacctggggctccatgtgggaagcatactgcaggggccctaccgacttggcgcccatcgcgtagcgagccttggcgagcgagagccagccctgcagggagaggaaagcggtgagactcagtttacgcccgtgtaccctcctgcccgccccaggcgcctacctcctccacccgggcgttcaacaccgttcgtttcccctccagctcctccaggtccccaagcagctgcaggaccagcgaatccagctccgctcgcaggtcaagcgccgccatggacacacctccagatctggagccaccttcttccttgtcaccctccgcagtttggcaggacagccaataggcacacgagatcctccatcaaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaaggtaaggcatcggccccgcgggcgtctgcgtggtaaaccaccccggcacgcatttgtgttcgaatatccgagcgtctttccaaatgcttgccggccgttttccttgcccattgggttctcctgttggttttgagagtgtttcttccgtgtgatggtattaattacttgtcactgacgttgcagtacccgggttttgcagcttgcccgctgtgtgcagtgtgtcaagttcgtcccaagttttaaagactttatcttgtcctgtagaaattctctttagagcggtggctcactgctgtaatcccagcactttgggaggccgaggcgggcggatcatgaggtcaggagttcgagcctgaccaacatggtgaaatctcgtctctactaaacatacaaaaattagccggccgtggtggcacgcgcctgtaatcccagctactcaggaggctgaggcaggagaatcgcttgaacccgggaggcggaggttgcagtgagccgagatcctgccactgcactccagcctgggcaaaaaagcaagactccgtctcaaaaaaaaaaaaaaaaagaaattctctctaaagactatctggatagcgctggtgctgcagactgcgctgcccatcctccctgcaggagttcctctgagctccgtggggaacagtgctggccccgagtgcgcacctggagcgctgtgctctgcggtaggcagcctgtggtccagggcccgctgaagccatgccttcgaagcgctgtgggcatcgtgaccaacggttttgctgtctgagagcttaaaggtctctggtccaccatcatacgtacagaacagtctatatttcttttcaaaagtaatttttaaggccgagcgctgtggctcacgcctgtaatcccagcactttgggaggccgaagcgggtggatcacgaggtcaggagatcgagaccatcctggctaacacggtgaaaccccgtctctactaaaaatataaaaaattagccgggcgccgtggcgggctcctgtagtcccagctactcgccagcctgaggcaggagaatggcgtgaacccaggaagcggagcttgcagtgagccgagatggcaccactgcactgctctgcctgggtgacagagcgagactccgtctcaaaaaaaaaaaaaatcgatgtttagatttctacctgattataaaagcaatacagtacattaagatattttagaaagtcctcaagtcatgagactaaagaaaatgaagtcctagtaaccactgtttatgggggttggcctgtagaaagttttgtcacctctatccatgctttatccaagctcagaaagggctgaggtatttttatttcaagcatgtgcaggctaataagctgtggtgtattggatgagctgaggtctccatgcttgtgactcactcagcccctctctcttccctctgcagaaaaccgcctgattcccactgagttacgccgagaggctctggccttacaggggtccctggagtttgatgatgctggaggtgaaggtaactatacaaggtagccctccccaacactgagctggcaggtctccagtccttcctcagacacaccgggcaccatcccatcagaggaaactgctcctggaactgtcccccatgcccttgtcactgcacagatggcattgcagggctctccctgagtgtgccctgtcccacttacatggcacacatgggagtgcctcactgactctgcacctggcttgttaattacctcccccactggagtgcctgctggggaaagacagtgtccctcacacattattggtgcccatacgtttattcactgcattattcaagaaacaagaaaggaatcccaaacattatagatatttgttacgagggaaaagagtttgtcaccgttggccttagcagagtgtggatttcgttgtgtaatggagtagctgcttagccccatgtgactaatatagcttaagcaaactacaattaaacaaaagattctgtttctcagccacgcttgtgctcagcagccagagtagttggaggctgccctcttgcccggtgtgcatgtggagcattcctattgttgaaggcttcggcagacagcgacatccaggcggtcttggctgccccgaagttagcatttcattcccaagactgtcatgttcttgcccctcgtgctcctgacaggtgtgaccagccacgtggatgatgaataccgatgggcaggagtcgaggatcccaaggttatgatcactacctcccgagaccccagttcccgcctcaagatgtttgcaaaggtactggtgagcagggagtgagggagagacacccaggacacacagccccagtcctgactgtacactgccatccacgcccaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctggtaaggccggagggagggagtcggggtgggagccgtctgagggcagacggggtctctgacagccacctttccccgccagtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtgagtctgggggccttcaggctggggctgcgggccaggccaggcatttgccactctgtttccctctctttccttgtgccccaggtctctgacatcctccgatacctatttcccgtgcccaaagatgacagccaccgggtcatcaccttcgcaaaccaggacgactacatatcattccggtgggtccacgggccatgccccaggaaagcatccccaccctgtgtacctcgtgctgcttgccgttgacccacagctgttccctcccaggcaccatgtgtataagaagacagaccaccgcaacgtggagctcactgaggtcgggccccgctttgagctgaagcgtgagtttgaggctgaatcccgtgtctggggtggggaggggaggctggctgtgccggggctgatgccatccctgcctgcagtgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagctacccagtctgtggtattttgttagaacagcccaagttgagacagatagtaaccctttaccagatacatggtttgcaaatagtttttcccactctgtagatatagccattgagaagctcctcaagatagacattaaatacaaagaagcatggtgtgaaacgccatgtgtgatatgctgtcagtgtgcaaaagaggcagggagggccctgcacttgcatgtatgtgctgcatcatccccagaaggctgaactccttgctggtgcactgggtacccagggaggagggaggttctttactgtaatgttagcaggtgaacattgtatccacttgaccacgaagaactgccctcttgagttctctgcccattttttgggggggtacaggcggacacttggaagacatccttatgataaaaaagcatacagaaggcctggtgcagtcactcacacctgtaataatcccagcgctttgggaggtcaaggcaaggaggttcacttgaagtcaggagtttgagaccagcctgggcaatacagggagagctcatctctacaaaacatttttaaaaacacacacaagtgcacatggtgaaaagtaaaccatcatcctccttccaccccaaagaacccatccctagtctccagaggtcatcagtattgactttttaaagaagctggactgatatcttttattcatggtatccataagtttgttgactgttaattatattttaacctgaaagggatcatgttgtgcacactactctgaaccttgcatcttaccctttaatgacaaatggatgccacagggctccaaggctgtctagtacacatggatctgcctccttccttgtggctacattgttgggtggcttcctgtttttacccccacaaatactgcttcgagagcatcattgaacatacttctgtgcatatttatgcaagtgtatctgatgcatacatccctacaagaggaattcgggcgtggtggctcacacctgtaatcccagcacttcgggaggctgaggcgggcggatcacctgaggtccggaattcaagaccagcctggccaacatagtgaaaccccatctctactaaaaatacaaaaaattgacctggcatggtggcgggtgcctgtaatcccagcagctcaggaggctgaggcaggagaatcgcttgaacccgggaagtagaggttgcagtgagccaagatcacgccattgcactccagcctgggcaacaagagcaagactccgtctcaataaaaagaaaacactaaaataaaatgatagtagaggttgtgtctctccacaggcaccatcacaagatgtgagcacctgctccccaggtgagccctgggcatcatcagaggttttaacctctgtcacgcactaggtgcaaaatgtttccccaattgcatttgcatttctttagttactctggaggttgtgcctcttttcaaatacttactggccttgtgtgttatgtattttctgtgatgggtctgctctccttatagatgcatttgttcacctctagattgattgttttaaatcttgttagttgtggaaaatttgaaacatacaagagcagagaagatggtatagtgagtcgctgagccggttttgatgtgagccagtcttcatagctcacccactccctgtatccactccaccagtttttaaagtagatctcagacatcagagcatttcatccatatgtatttccatgtatatctctaaaagataaggactcaacaacaacaaaaaaattattacacataaaattatcaatgatcattcctttatatcatcagatatccacttaatgttcagcttgccttgattagagtgtgcttgtttcgactaagatcgacatcaggtccattcattgcaaataattgacaagtcttttaaaaacagctttattgcgatagtcaacatattacacaattcacagcgcaggttgaactcacagccttgtgcgcccgtccctgtgcatcaatgattttttaaaaatcatattcatagggctgtgtaaccatcaccacaatctaattttggaacattttttgtccccctctgcccccactgccccggagagaaaccccatacgcattagctgtcactctaatcccctccctcccaccaggccccagcccctctggcaaccactagtctacttttggccagactctgctgagacattagaacaggatttatttatttattttattttattttatttttgagacggagtctcgctctgtcgcccaggctggagtgcagtggtgcaacctcggctcactgcaagctccgcctcccgggttcacgccattctcctgcctcagcctcccgagtagctgggactacaggtgcctgccaccacacctggctcattttttgtatttttagtagagacggggtttcaccgtgttagccaggatggtctcgatctcctgacctcatgatctgcccacctcggcctcccaaagtgctgagattacaggcgtgagccactgtgcccagccttagaacaggattttttttttttaattaatacttttggtctctatagatttgctgtttctgaacatttcatgtaaatggaataatacgtcttttctgactggcttcttccacttagcataatgttttctaagcttattcacagtgtaatttatttatgtcagcacttcatttcttttcattgccaaataatattccatgtatgtccctatacatggggtattattatatgccacatttgatccatcagttgatgaaatttaggttgtttgccacatttgggccattgtgaacaatgctgctatgagcatttgtgtgttaagtcttgagtctctctataagattgtctgtttctttgcagtttactcagttaggaaactggtttgtcttaatagacctttcaccgtctggatgttgctgatcttaacactgtggtgtcatttaacatttttgtctgccgttgtgttttctctgaattaatattgagatctagaggctcaatcagatatacctgcaaatttttttagcagtaatacttgatgagggtgttatgttctttcattaggaatctcagtgcctgcctgggagtcgtttttgtgatgtcagtaggcagtattattgcatagctccattaatttattaggggttcaaacttggtgcctatttctcaagaaattaatatggaagctttttgcattacagtttcaaattcattaaactggtgtgtgtaagtacttagtgtagtttttttcttttttttttttttttgagatggagtctcgttctgttgcccaggctggagtgcagtggcgcaatcgctgctcactccgcctccggggttcaagcgattctcctgcctccgcctcccaagtagctgggactacaggcgcccgccaccatgcctggctaattttttgtatttttagtagagatgaggtttcaccatgttagccaggatggtctcgatctcctgacctcgtgatccacccacctcggcttcccaaagtactaggattacaggcatgagccaccacgcctggcctagttagtgtattttaactagctaccttattaaattttctcataagtccttacagtttttcataagagtttctaaaactttgtagctgattatgctatatgccagttagcatttctgatgggcccctccctcctttctccttgccaccctgcattgcctaggacttcagaacaccctggtcagcagcagcagtgagggtgccccctcattataggaatccttccagaggtgtttacactcacccaagcatggatgcacactcatttctctctggtgttataattgatgggcagacagcaatgcacacggatccatgcatccctttggttgtcctgggaactgcactcagccatgacacatgggctgtgcaatcagggcccacagacacggccctcatctgtgcaggaccctggccggcatttgctgacaataacatggccagttggtcttttctaaataaagcaccgcatacagaggaagtatgctgaagctgggctagcatcaggtgtagaaactgcaggctgaggaggcagcagcctgacccggcctgtcagtcatggaagtcccagagtgctgccagcgttgctgttagagcacttgtctgcccgagtttatttcctccaggggcacatcgggggcctgctctgggccatgcagatgcccaggctctgccctggagtagtgggggaaaagttggtatgagcattttaaagatggggaagagggctttcccctctattcctagtggtttcccctcctttctgaagcagaattgcaggacagctcccgagggcagcaggtcagcctccacaaagagctgggggttgtggggtttggtggtagcgctgagaaggggtagggtggctttctctttggcctctttctctttggctttctctttccaccgcgctgagctgctgaccctttcccatggagcgatcaggaggagtctttgattcagaacactgaaacctggcacgcctgaggagagttagaggagacaggaacaaaagctctcccagaggacttagagctctcaggcatcggacgggagggggacacagccacatgcttcctcttgcactgaagagggttgcctttttcctgtttgctaaatgccagacttgtggatggaccaacaggacaacttgcccagcttgaaggtttttaacagaatgaagcaatgggaaaatgttttcaaatttatgcccccccttccacttttgttttaacttagaggagggagtaaggaggtgggcgtggcaatatcagaaagggaaactagcagtgtaataataatattaatagtaccaagtgtatactgcaagccaagtgctgttctatctaaatgctttatatacaatgatttccttaaattctcacaataaagcaacaagaagagacacagtcctacagaggaggaaattgagacatagaaattaaatgacttgcccaaggtcatactgagaaagtcatggtgccagaattctaactcaaacattttggttccagtcttctgccctttttttatttttatttattgattttttttttttgaggcggagtcttgctctgtcgcccaggctggagtgcagtggcacaatctcggctcactgcaagctccgcctcccgggttcaagccattctcctgcctcagcctcccgagcagctgggactacaggtgcccgccaccacgcccggctaattttttgtacttttaatagagaacggggtttcactgtgttagccaggatggtctctgcccttttttaactaagcaaaaaaggaagctggagaagaactgtaccctggagatgccagcagtctccaaggagctccccgcaagcatcccagaggaaggggtgtctgccaggggtctccactgtagtttctcttttcccctttgcaggctcagagcaggctgaactcacagccttgtgcacctgtccctgtgcatcttcctctaccttgtcctcttggctctgttgagcggcccatgtagccacactgactggtgggcaggtgacagactggcacatggcacgtgggctttggtacacttggggtctctgtagcagtgccagcagctcccactgtgcaagactgctgctggcagcgtgaacaggagggccaccagcagcagtgagtctcattgcaagaacacagctggcagtcctccgggagagaaaagccggggtgggccagggcctctggaagatgtggggtcttcccatcccccacacctagcctgagctgaacagagggcaagctaagagtttggatgtttggagagacatgaggaacggtcaggtgtcaggaggacaggtgggttaaacaacaaggtggggcttggagtgagggtgaacacgaggacagaaagacactcaaggcagctggaagtacaaatggcagactacagcctcagccacttaatgttcacaggccacaaggcagcatctggctagtcactcagatcctctaatagacaaaccaccaaacacacacacacacacacacacacacacacaccctggctggacagacttccagatggacagaatcccagggaaacacccagctggacaaacagacagattactgacagatgggtagaccctcagccagacatccaaataggcctgtggccagagagacacctgggccccccagccaggcaaaggtcagaatccctcaaggacaggtgccctccccaaaatggacagagacattaccccagaggagagaacaccccacccacctagtcaaccagaccttcagctggacgacatgccctccaccagtcagacagacctcagcctatgaggacaggccctcaacaggatccctgctgctggacagagatcctctagcccataaagactgccctgaataaccatgtgtgctcaggggctcacattttcccagaaaatgtctttattttctgaaagcttactgatgcttctgtattctacctccctggatctccatggccatccacaaaccctcaatgattatactgagagtcactatcatgcactgagcagagctctcaatgacttcccagactcttcggacccttcaattactaacactccaaatcccaatggccccacaattactttcacttcttgtcccaagtatccactggcctcccaatgactgtcattaatatctactgacacccccccccccatgaacatccaagggaccccgactggcttccaatgaattccctatcaccaccatcctaaacaattacctccctgagaatgctcaaagatgaaactgataaatgatgaacatgaatctcacagtgacccctgcggaccccacgataaatcaaacagccctagctgctgatccccacagagccactttgatcgctccatcacttcagccaaggtcagcaaacgacagcctgtaggccacacacacacactagaataattcatgacacatgaacattacatgaaattctgatttctttgtccataaatggtttctttgggacacagccacactatattgtctgctttcatgctgccacagctgagttaagcagctggggcagcgatagcaaagccaaaaccacttcctaccgggacctttaagaaagtgtgcccttaaatactctgatagcccctagtgaattaaattgaccacctgacatcatgcccctgttgacccttcagagactcaggcacacatccaggccccaatgctacctttcaacccctcaacgacctcaaactggtgtccactgacgccccttccagtgacacccctcttaattcttccgacctcggcgagaagggggctaacctaggcctgtccttgaagagacccaggtgccagtccattctctccagcctcccctcggtgatcccggaagctggaacggcggctctcctctgacctctgcacactttctgaagatgggagtgtcagggcaggcaaaaaagagaagctcttcgttccccagaacccacttccagtgcctcagttctgtttcccagcaggcttgtgcaggtcgagatgctcacacaggactgaccctggtgccccagcgcatccgggaaaaaggaaccacaaattcctcgggaaatacacagagaagatcccgctgccacttggcctttcccacggcgtggctgcccctccccggcctcccttgggcccggctggagcgcacagcgcgggacgcccccgacccggggtcctctggcacgaggggcagcctgatctcggcgaccgtctccacccaaggctgctgcccgccccagctcggactccgcgcggcctggctcccaggggacgggcgggagggcccggcgagaccgctcggccgtccacccagagccggcacccggaggtcggcccctgggcgcggatcccgatctgagggcgggtcccaagcggcagggagcgaacctgggaccgtgccacccccccaccagtgggcgcggcagccgaaaaaaaggggaagcgccggcgctggactctgctcagggcagcccgcgaggacctagggctccggccacagcggcccgagcgcccggggtggggctacgcgggctcagaacacggtggctggggcgccctgcccgccgctgcgcgcttccattggctgccgaggcaagggcggggactcagtcaccggcctccgcctcccgcggcgtccacactcgccgcgcgcgcggcggccgggctggaccttgctggcccgcggcgccatgagccgcagcctggactcggcgcggagcttcctggagcggctggaagcgcggggcggccgggagggggcagtcctcgccggcgagttcagcgtgagtggcacacggggtccgcgagcggcgcgccccggccctggccctgcgtacgcctgtcctccgcgcacggcgggctctgcctttctgtctcggtgtccccggtgtctccccgcctcggggggtctctccgtgtttctctccccagcacttctctgtcgctcttgctgtctccgtcttcactctctgccccccggccccggagcgcgacgtccacggccaggccgggacggaccgtgcacaccctcgttcccggtgtcctcgtcgcgctcccggaacaacctggctgcgggcgggacaggtggggcgggcgccgcaggggagggcgggcggccctgctgcgctggacagccccggccccgccgcttctggcgacctgactgtcccctgtgaccacaggaaggaaggggctgcagcagggcgaagaggaacacggaggctgtggcgtggtgagggtgtgaacgccgggctcgaatccgcgtccgggcccgaatccgcttcccgtcccgaatccgcgtcccggccatccgcgtgtggtccaggcggtctacctggcccctctgacctcggcttctcccttggtgaaatggggacatgaatgaccaaactggtctaaggattaaatgatgtgggtgaaaagcacttagtacatattgggcgcacacttcgtaggggcgttcgtcactgcctataaagattctaaacgtgggccaggtgcggtggctcacacctgtaatcccagcactttgggaggccgaggtgggaggatcgcttgagctcaggagttcgagaccagcctgggcaacacagcgaaaccccgtctctactaaaaatacaaaaatcaactgggcatgggcgcatgcctgtaatcccagctactagggagcagagacaggggactcgcttgaacctgggaggcagaggttgcagtgagctgagatggttccactgcacagctgagatggtgccactgcactccagcctgggccacagagtgagatcccatctcaaacaaaacaaaaccaaacaaaaaatctaaacgttacaatacaggtagtgcaagcccagcattaggaaggctcacgcagaatgctaggcactgtacattacagttgatgacgtgtttaaagtgtaatcgcttatgtaccagacatagaaacataccatacaaacgcataaactgatatatggtgacatgtatcaagtttagaaatatgacaaatatataaaagtattataaatgaccgtttatacaataaacattgcataactgcataaaacaatacaacaaatgaatataacaaagattataatttataaaatgaccaaagttatttgataaattcataagtagatataaaatatgtaacagatggccgggcacggtggctcacgcctataatcccagcactttgggaggccgaggcgggcggatcacgaggtcaggagatccacaccatcctggctaacacggtgaaaccccgtctctactaaacacacaaaaaattagctgggcgtggtggcgggcgcctgtagtcccagctactcgggtggctgaggcaggagaatggcgtgaacccgggaggcggagcttgcagtgagccgagatcgcgccactgcagtccagcctgggcaacagagcgagactccatctcaaaaaaaaaaaaaaaaaaagtaacagataattataaacctaagtaatttacacacatgtagaaacattgtatataagaaactaagaaatgcataataaatgtaaaatatataattatacaatataagaatgtgtgtaacaaatgtaaacataatacccatgtgatatatgacatcatgcgactgggtgggttctgaaccgtgtacagtgcggagggcctcacatgcggaaggctgggtggcgagggcacccctgctccccaagcctgcctcccgcatgtgcaggaatcactgcgctcttctaggtgttcccactacacaagggcatcatgagggcttaaatgacccaatggacacaagtaaagcacttagaatagtggctggcacacagtggtggcatgggtgttacttattatcattgagattacgaatacctgacgatgatggtaatacacgattcactaattattattataatctcccagtaacacagtgcctatagtatcttgtacataatatgttatccattataatgcctatgcattcattgtacattgtcttatatgtttagctacatagcccataatatatttcattacagttattgcttacaagacaatgtcacagattgagtgtgcagggggtgggtgccgagagggtctgagttcaaccctcaccgtgtgacttcctggttgggaccttccacaagtcgctgaaccacgtggtgcataaactttcccgcctgcacaatggggacgtcaataatagtacccacgtcgtaggaacctgtgatgattacatgcccttagcacagagagtggcacagagaaggtgccctgggtcactatttcggtatcattattattaggcaggcccagtgccatcagggtctgcactcacctccccaggccactggctttgtatcctgcaagcgtgcctaggtggcctgggactctgacctggctcctctcctgtcttctcccctccctgacccactcataatgctctaccaggacatccaggcctgctcggccgcctggaaggctgacggcgtgtgctccaccgtggccggcagtcggccagagaacgtgaggaagaaccgctacaaagacgtgctgccttgtaagtcggggcttccgtagggagtcggtgcagccttgcacgccctgccacgtccaggcgtcagtgtgcactggagtcacccactgtgctctcctcccagagcctcaccctctgcactgctcagcagcccacaagggcaccttggtgggatctctgcatgtgtgtggtcccctgctggctttcagctagggggctgtcagaggctccgtcaccctatcctacccaaactccacgtttctcaccttatctgctgacagatgatcagacgcgagtaatcctctccctgctccaggaagagggacacagcgactacattaatggcaacttcatccgggtgagggttggggtcacggaaggaggtggactgggagtggccaggggtgggccgcagaatctcagtcgtgaattcggccttcaccagggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcgggtaggtgccctctgcccccaggtttcatgtccttgtgggaggagggaggagggatcttgctagctcctccttgaccccaggacccgagggtccagctcttggagtgaccttattgtagctctgtgggaagccccattgttcctctaagtttttgttgatatgttattcatcccccagtgttggcaacccctctcctgctgggcttcccagccatttcacaccttagaccataaggccctattctgactgcttcccctgtaggctctgatctctctttccacctctcttccctttattcactccactctaacaactctggtctctgctgttcccatgttccagggatggctctgcctcagggtctgtgccttggctattccttcagcctaggacatccttccctgtggcttgctctatcacctccttcaggtctttgctcaaatggtaattcctcaatgagaccttccggggtgggtcttcacaccattttaaactctcagcacttccattctccctcccttgtcctacttttccttctttcttcacagttcttatgaactcctaacacactggataatctacaaatgtattatgtacattgtttatgcttaatctccctgatttagaaggtaagatccacaaggccagggatttttgttttgcctgttaacataaattagttactaaataaataaatgcatgtcaatattgaaggctgaaggcacatagcttcatgtggtttctacattcttgcctactccatggatggggtaggggttccctggggtgactagctgatggtggaggctgtatgatctgtagtcttgtctctttctcattcctgattttggtaatttgtgttctctctctctctctgtctcatctctctatttcgctatctcttttttcatgctcctgcctgttttttgtaaacagtgtattagaacacagccacactcatttatttacatattgtgtatgcctgcttttatgctacagtggcagagttgagtagttgcaagttgaataaattatatggcctgtaaattctaaagtatttatctgaccctttataaaaatgtcagccaatctttggactagaagtttatcattttattattttttcaaagaacctgctttggttgtattcatttgtattcattttctctattgattttttcattttccactttttttttttttgagacagagtcttgctctgttgcccagactggagtgcagtggtgcaatcttagctcactgcaacctctgcctcccaagttcaagcaattctcctgccccagactcctgagtagctaggaatacagacacatgccaccacgcccaactaattcattttctactttaatttcaagtgtacttgaaaacaatgtgtattctgctttggttggctggagtgtcctgtaaataccaattaggtcaactgacagactttttaaaaagacacttttatatctttactgtatattttatatctttactgatttattttctctaaatgtatggattgcttagagaggagtgttgaaattaccaactgttcaataagtattaattaggtcaagtttgtcaacagcactattcaagtcttatttctgacaattttttttgtctgcttgccctattatttgctgaaagaggaatgttgaaatctgctttaactattctttcagttttacttttcatgttttaaaactttatgattgagtacatatacatttaggattatgtcttcctaatgattggatccctttctaatatgtaatgactctttatttgttaatatttttttctgaagtgtactttgatattaatacagccatttaaatttctttcttttctttctctttctttctttctttctttctttctttctttctttctttctttctttctttcctttctttcctttctttcctttctttctttctgtttttttgagatgcagtttccctcgtcacccaggctggagttcaatggcgcgatcttggctcactgcaacctttgcctcccaggttcaagcgattctcctgcctcagcctctcgagtagctgggattgcaggtgcctgccaccacgcccagctaatttttgtatttttagtagagatggggtttcaccatgttggccaggctggtctcaaactcctgccctcaggtgatccacccgcctcagcctcccaaagtcctgagattacaggcatgagccaccgccctcggccttaaatttctttagagtttgcatatgtcttttcccattcttttactttgtatctatgttcatctttattttttagtgtgtttcttgtaggtggtgtattgtagggactttttttttttaagacagaggggaatggagtggtgcaatcatagttcactgtaacctcaaaatcctgggctcaaatgatcatgctagcgcagcctccctgaggagttgggactacaggcatacaccaccgtgcctgattaattgttttttatttcttgtagagattaagtctcacgtataatccaggctggtctcgaactcctggcctcaagctgtccttccacctcggcctcccaaagtgctaagattacaggcatgagccactgcatctagccaggacttacttttaaatctaatctgacagtctctgcctttaattggaatattcagcctttaatgtaattatcaataatgttgggtttaaacctaccatcttgctatttgttttctatttgctctgtttgttcttttcttctttttttctctttcagagtgagaattttttattaatctattgcatagtaattattcccttattagctatacatctttattttaaatatttagttgtggctttagggtttacaatatatatctttaacttatagtctatagtcaaataatattctacatttcatgtaaaatgtcagaactttactgtagtatatttcgattacccctttccatgctttgtgctattgttactatatattatagttctatatataaaatatactccacagtacactgctattatagttgttttagaatatctttttaaacagctttattgatatacaattcagtcatttaaagtgtacagttccatcatttttctatattcctgagctatgcaactattaccacagtaagatttttgtttttgtttttgtttttgtttttgagacggagcctcgctctgtcctccaggctggagtgcaatggcgcgatctcagctcgctgcaacctccgcctcccgggtccacgccattctcctgcctcagcctcccgagtagctaggactacaggcgcctgccaccacgcccggctaattttttgtatttttagtagagacggggtttcaccgtgttagccaggatggtctcaatctcctgacctcgtgatccgcccacctcagcctcccaaagtgctgggattacaggcatgagccaccgtgcccggcctaccacaataagtttttgaacattttcatcattccataaaaaaatccaggccagacatggtggctcatgcctgtaatcccagcactttgggaggctgagactggtggatcacgaggtcaggagatcaagaccatcctggccaacatagtgaaaccccgtctctactaaaaatacaaacattagctgggcatggtggcatgtgcctgtaatcccagcaactcgggaggctgaggcagaagaatagcttgaaccagggagttggaggttgcagtgagctgagattgtgccactacactgcagcctggccacagagcaagactgtctctcaaaaaaaaagaaaaagaaaagaaatcctatatccattagcagtcactccccatttcccagcaacctctacagccccagacaatccctaatctatttttgcctttatacatttgcttactttggacatttcatataattgaatcacataatatgtagcctttttttgcttagcatttttgttttgttttgttttgtttgctgaatactattccattgaatggatctaccacattttacttattggttgacagaaattgggttctttctactttttggctattatgaacagtgctgctatcaacactgatatacaagtctctgtgtagatgtgggttttcatgtctcttgggtattgctgggaattgctgggctatatggaaactctatttttaacattttgaggaagtgccaaactgttttccacagtggcagcatcattttacatttccacggcaatgtttgagggtccccatttcttctccctgatgcttgttactgtcttttttttttttttaattatagccatcctaggggttgtgaagtggtatgccattgtgtctttctttaaattatgtggtaaaatatacataacataaaatttgccagtttataggtgctgtgaggaatgttaaaaataattttgccatttaaaccatttcaagtgtacaattcaattgaattaagtacattcacaatggattaaccattcctactgtctattttcagaacatgttcatcatcccaaacagaaattctgtattcattaaacaataactccccattcccccatttccaggtaacctctattctcctttctgtccctatgaatttgcctattctaggtacctcatgcaagtggaatcaggaatacactaatatacaatacttgtccttttttcaaggttcatccatgttgcagtgtgtatcagaatttcactgttttcaaggccaaataatatttcattgtatgtatatatcacattttgtttatccattcgcctgttggacatctgggttgtttgtaccttttgactattgtaaataaggcggctacaaacattggtatacaggctggacacagtggctcacgcctgtaatcccagcactttgggaggccgaagcaggcagatcacgaggtcaggagatcgagaccagcctggctaacacgatgaaatcccacctctactaaaaatacaaaaaattagccaggcgtggtggcagccgcctgtagtcccagctactcgggaggctgaggcaagagaatggtgtgaacccatgaggcggagcttgcagtgagccgagatcgcaccaccgcactccagcctgggcgacagagcgagactccgtctcaaaacaacaacaacaacaacaacaaaaaattggtatactagtatctgtttgaatccctgttttcagttccctgggtatacacctagcatggaattgctggatcatatgataacgctatgttcaacattttgttttccacagtggctgtaccattttacgttcccatcagcagagagagagagagggagggagggacatgtgtagtttaatgacagggatatggtctgcattgttaagactatcttgtcattgtgtaaacatcatagagtatacttacacaaacatagatagtatatacattttttatttatatatttttcatatggaaaaccaaatgtcccagcaccattactgagtatcaatcatttccccaacttaatatgcagtgtcaatatcaagtgccatgtatcaggtttctacatatgctccattataatctatggcaccaccattgtatatgtggtctgttgttaaccaaaacatcattatgtggcatatgacaatgacatatatgccatcctaatgagtgggaagtggtacctcattgtggttttggttttcatgtgcttattcgtccatttgtatatcttctctggccaaatgtctattcatgtcatttattcattttaaaattgggctatttggggttgtctttttattattgagttgtaagcgttattctgtatataagtcccttatcagtacatgatttaaaatgtctttcccattctgtgggttgtcattccactttcttgatggtgtgttttgaagcacaaacattttgtgaaactttaattccaatctattgtgttgctgtgcttttggtgtatctgagaagtcattgtctaatcagaggtcataaagacttactcctgttcttccttctaagtgttttatagttttcttgcttacagttaggtctcagatttactttgaatgaacttttgtatgtgatgtgagataggggtccacattcactcttttgcatgtgactatccagttgttccagcaccatttgttgaaaagactatgctttgcccattgaaccgtcttggcccctttgttgaaaattaattggccataaatataagggtttatttctgaactctcaattttattaagctgattgatgtgtttatccttgtgccagtgtaacatagttttgattattatacctttgtagaagttctgaaatcaggaagtatgagtcttccaaatttgttcttttttccaagattgttttggctattttgggtaggtcccctgctgtgcagaagagttaaacatggcaagcataaatgtttatgcttagaaaggccttcctgtaaggttgactcttgggtggcctctagaaacctaggtttctgataacagtggctcactatgcctgaactgttaatacaaacaatatgctttatgcagaacacctgttctcctgctggtagtctgacattttggtacaggctaggcagagtgtgcctacattctgtgcagacggtgccccaataaaaatcctgggcactgagtttctaatgaacttttttatgaaacgctgttgagttttgtcaaattttgttctttgcatctattcagatgatcgtgtgttttgtattctactaatatggtgtatgacattgactttcatatgttgaaccaatcttgcattcctggaattaatcccacttagtcatggtgtttaatactttgctagtacttcattgagaatttttgtgtctatgtttgtgagatattggttagtagttttcttttcttgtgatgtctttggttttggtgccagggtaatactagcctcatacaatatgttgggaaatggttcctctcagttttttgcaagagtttgtgaaaggctggtattaattcctctttgtttgataaaattcactagattatcttttaaagatgtttaaaatgaaatatcttttacatttagccacttacttttctccctgttattttgtgtagatctgtatttccatttgtatcacgttccttttgtatgcagagcttacttattctatttatttaagagatagggtctcactctgtcatacaggctggagtgcagtgtgcagtcaccactcactgcagcctcaaactcctgggcttaagcaatcctcccacctcagcctgccaagtagttgggagtacaggtgtgccactgcactcagctaactaaaaaagattttttttagatacaggctagctatgttgccaacacacctagctaattttaattttttttttttttttttttttttttttaagatacaggctatgttgctcaggctggtgttgaagtggcctcaagcaatcctcctgccttagcctctcaaatagctggagcagccactgtctgtaagcatctgaagagcttactctaatatttctcataatgcagatttgtttgtgatgaattccctcagctttcatttgtctgaaaaggttttcagcatttttaggatatcatagcattgacttgccgtttctgacaaaatgttgctataattcttaactttgttcctcagtatgtgatgtgtccttttgtgcataatgcttttaagattttctcttctggggcctggtgtggtggctcatgcctgtaatcccagcactttgggaggccaaggtaggtgtatcacttgaggtcaggagttcgagaccagcccggccaacctggtgaaaccctgtctctactaaaaatacaaaaaaaggttggacatggtggtgtgtgtctgtaatcccagctactcaggagcctgaggcaggagaatcgcttgaacctgggagttgcaggttgcagtgagccgagattgagccactgcacgccaagcctgggtgacagagcaagggtctcaaaaaaaaatttttttttctcttcttcattctttttcagtaatttgatcatgatctgccttggcgtgactttctttaggtttaggtttattctccctctggttcattgactttcttggatttgtgggttcatagtttcatcgaatttgggaaaattttcacctattatttctttacataaagtttctgttatccccctttctcctttccttctggactccacgtgcacatacactagactggtatatttctacagagaactgattctttttcatttttttcatttcattttgaattatttatattgctatgttttcatgtctattgatcctttcttctagtgtctaccctgctattagtggatttttcatttcatatattttatttttcctctttataaattccattcaggttattttttgtatctttcattccactctgcatcatgttcatgttttccttttcatctttgagtgtatttgtaatagccattttaagatttttgcttctttcctgaactgttatttctgggccctttcctattgactaatttttctcctggttatgggtcacactttcctgcttctttgtatgtccagcaaaattttattggatgcttgatattttgaattttgcacaggtaagtgttggattgttttctttagagtgttttgccttttcaggaacttttggatggttgatcaagtagcctttgttctagaattaatttagccgtacttctaatgtgtggtcattctaggttccctactaaatgccccttatagttgataatgcctctacactctagctagagggaatgtgaattctttctcatcatgagctcaaggaaatgttcatcctacagatccctactattctttcatggtaagttattcttgcctggcctcatggggtttcatgttgtatatattcagattattcaaccaaagaatcaaggaggggacttctatgcaagttattgttttgtttttatttgcatacctctgttccttccaggactctgccctgcaaattctagctgcttttgcctccttgagccatggtctctggctcaactcagtgggatcattagactcatgtcttacagcctggtgacacttccatgcaataagccggagtggtctgttcagtgaccacagtactgcaacacctgccaaccagtgtctgaaaatagtggctcatgtattttgtccagtttctagttgcttacagtgggagggtatcctggactgtatttcccctgcatggtcagcagcgcacctccattgagtctgcatgtgtttaatctgatggctctgttggctggcgtctgttataggttataagtatagctgcctgtgcttccaccacgagcacctggggtgtcttgtggcatgattgagctagctctgaagctgactccctcttctcactccctgccttttctcccttaccttttgcagaaaaggtgtgagcggtactgggcccaggagcaggagccactgcagactgggcttttctgcatcactctggtgagctgtgggagttttcaaggaagattcccagggtggaaaggctttgggttgggcctaaaaggttgaatgatttaacccacagtccactcatactgcaggaaaccctctggtgttagcctgcaaatagttagaacttactatagggatagcctttgcatttttattttggctacaatcagttaatctctgtcatgtaaatgtgcctggttaggttgttgaaattcttacttctcttaccatttcaaaagagcttggggaactctctcaagtcatacatacagttagtacttaataaatgcaataaaagtttcattttagaacaaaagacatctcttttcattgcaaaagggcttgtgtttttataatagttcctcttttgctcctgtgtcaaatgtttccttaatgaaagctttggggaaagtttgggctatatgaatttttaaaatgttttctgtatttgattttttaatcaggaatgctttgctttctataaatgtcttctggtacctatgatctttgttctcctccctcttcttacttgccccaccccccttactcagataaaggagaagtggctgaatgaggacatcatgctcaggaccctcaaggtcacattccagaaggtactgtgacaggggaggaggaggtaaaggggctcctgaaaggggagaggtttcctctcctgtaaaaatgggcatcatactagtacccacttcctcagttattgtctggtagacataaatggaagatgcctagaagtgggcctggtgtatagtagatggccaattaatgcttttttcttttttttcctaagtcttttgctcatctttttctgtgtttcaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagaggtacagaggctcctttcccactctcctgtccaccatcagcaccctcagagaccaggaccccgagcagggtccagcccccgggactactgggagcaggcactgactatgacatccacctgtgccctcctccaggcatccttatcaggctctcccatcttaagctttctcccagagccccttgagaggcctggccagcttcctccctcaggagcctcccctcctgtttttcttcagaattgtgccccactctacgacgatgccctcttcctccggactccccaggcacttctcgccataccccgcccaccaggaggggtcctcaggtacccggctccatccccggattcttccctgcccaatttctcaggctaaccccttcttcatccttggaacaccagtccgttccttgttcacttcgccaagtgttcgctggccctttcttcgaattgagctctgggaacccaccccaagatgattcaattatcccaagatgattcatttaccccttgcctctgcctctaaggcttgccctgccttctgagttaggcctttcctggatcctctaatcaaaccttaattcaggtggctcacccctgtaatcccagcacttcgggaggccaaggagggcggatcacttgagcccagctggagaccagcctggttaacatggtgaaaccctgtctctactaaaaatacaaaaattagccaggcgtgctggtgagagcctgtaatcccagctactccggaggctgaggcaggagagtcgcttgagcccgggaggtggaggttgcagtaagccgagatcgcaccacggcagtccagcctgggcgacagagcgagatcctgtctcaaaaaaacaacaaaaaaaattcagcaaataattctagacgccgccttcttgtcaggccgcacgttgggtgctgcggacatgggattgagccgccttcgcagcggagacttaaggcccttgtccttgcggccatcccttcctgtcttctatgccacttccgcattcttttgttcagtagacgttgacacagaaatgaccacccctcaaaccaacactctgccccaaattaccctccaggctgaccccgttcctccttcatccccctaacttgcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcggtgagtcgaggcttgctccttctcagggcatcatcctgctgtgatccgcagggcggaaccatcctgcagtggtccgtcaggccctggcggccgcggggaccccagccgctagcctggccacgccccgacgctgatgtccaggcgtccctggccacgccccggaagcgccccctggcggtcgcagtcgcggtccaggggcagggttcctggcaatacttgtcttggccgcgcccaaaggctggaggccacgtccggggtgtgtgccttctcccgcccggcgccctcggctctccccttcgggcctccggggaagcgtccccgctaggggtggggtcttgggactccctggggcttccggagctgacccgtggggggtctgctgccctcagttcctgctgaccaaagtcctgccggatctggcgcctacgaggacgtggcgggtggagctcagaccggtgggctaggtaagtcaggtagagcctgggttgctgggactttgctgctttgagtgaacccaggagtctggggttgatggggcatggagcttagtcctgtggatgtggctgcagtgaaccaggaggacctggaggcggggggatggccttcttcatgtctgccagcttccacacacctcagcttctccatgagacccacggcacccttcttctcccaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccgattcagaggtctgtttttcctttttttcttccccaaagatggagtcttgctctgtcgcccaggctggagtacaatgtcgcaatcttggctcactacaacctctgtctccgcctcccaggttcaagcaattcttctgcctcagcctctcaagtagctgggattaaacgcgtgtaccactatgcccagctaatatttgtatttttagtagagatggggtttcaccacgttggcaaggctggtctcgaactcctgacctcgtgatctacctgcccctgcctcacgaagtgctgggattactggcgtgagtcactgctcccggccttggtctggtgttttatacacatgtgcatgtgatgtggagctgtgcaggccaccttgtcagcatgcgaggagggtccagtctctgcgccttcttggtttctgacttcacacccagtagcctcactcctggcccagcatggcaagcacagtttccactcaggcatttgccctggttattctctctgccttggatacttttctcctagattctgcctctaatatatttgaacatttacctcttaatattgtttcctgtctctcctgatcagaatgtaagctgcgtgagggcaggagtttttgtttggtttacagctactgtcccagctccgagaacagtgctgacacttaggaagtgtgcaggctgatttatctcacaccatttactccgggtttcctcacttctagtaaagtatgacaccttgtctcaaatattcttttcctctttccagacccatgtctttgctcatgtagatcactacttcaggctgacataaaaaccgttctcttgttaagaaagctcagcaatgggagaggcaatcctccacccgtctcttgctctcctacaggtctttcctggaggtagtgggttgaatggtggcccccaaaaagataggtccaagtcctaacttctagaacctgtgaatgcgaccttatttggaaaaagggtctttgcaaatgtaattaaaacacctggagatgaaatcatcctgtatttaggatgggccctaaacccaatgatgtctttataagagaaaagagagagagacgcagagacaaagagaagaaggtcattgagatggaggcagagatggggatgaagtgtctgcaaaccaaggaatgccaaagattgccagcaaaccaccaggggccaggagagaggcctggccgattctccctcacagacagtagagggaaccaccctgctgacccgtcagtttcaggctttgggacctcagaactgtaagagaataaacatgttttgagccacacggtttatagtcatttgttatggcagccacaggaaactcacacactgggtatccaggaatgcaaggcctggccgctcctgaactgggcatctcagagctgtgtttgcaataggacactgcagcaggtgatgtttccttctggatatgccctgagctcagggctcctcttctgcagtgcagcccactgggtgcacagcatctgtctgggctctcacaaacccccatgggatgtgggggtcaatgggaccgttgcaggcaccatactcgtgttgctttgtttctgacccagtaggaacagtgaaggctcagctgtcagtttccaagtaggatcggatctgatgatgcctccttttcacaggagttagttacttctccttttctgctttcaacatcccctgccttgacttctctcctttgtatggcatttgtttgtcttagaccgtgacgtcctgagagaaaactaggccccatttgtggttaggttggtttccaatctcaggggcagagagctgctttacataattgatgaaaactttgtttctgtttcctaactctcgattcagtgcttttttcacatactcccaagcttacatgtccttgctaccttcagaaacaaaacatggtattaaaagttgctgctggatattgggcagctgatatctgacctcatgaagcagaaggggagggtgaggaattgccacttgcaatagggatcccctgagcttccctgatactaacatggtgggggggggggcttgataaaaaacaaagggcaggctcaagagctcagggctgctgctgagagtctaatggcttctcagcccctggtaaccttaccctccaggccctactcccacctcctctcctgcctcccacccggtcagtgctccaccaaacttcactgccttactggagtgctcctccctaccctctccttcggcccagtctccttcatcccgggagacccagctcacatctcacctgccctggggatgtggggccttctccctctccagaatttctcttccctcacactgctcctcagagcacttggtgtccacttcatcacacccctgccctgggccggcaggatccgggggctacaggcaggttctatgggtcagggatgggtcttgctcctctttgccacctaggtgtttggagcttcccctgcacagagcagtgctccgcaaatgcttgtggatttcagctcagtcagtgtaattgctcagttgtgtaccagagaaatggtcttgttggaaagagcctgcagaatgccaactgcagcctcagcgaaggtgatagaaaatatcactaagcaacgatggcttatcactctttgttcaattatagctaagttcagcccaaacataaggtcaatatctgaataaactatgcagtaagtgggaattgtttcatttattttatggcatagttattttagaatatacaaaatggtcgaggagacatgaatccttaagagtgtatgaaaaagacaagtgtttataaagccataccagcatccaatcaatgtcagaagctttaagagctgagaaatgtccaaacataaagtgtacttgagaagtgatttccattggattccattgctctcaaacagaccctggctctgcagccttacttttgaggatgacttctccaacagatctgtctgcctgtctggggacagatgattgatgaggtcagcaagctgaacgatgtcacctctccagccccaagcctttttcaggtaccagaaatgggaatttttatattatctcatttaacatgtcttggcgagcaggaccccaggtttttaagtctttgggttctcccataggtttagcactgagttgttgatcaataaacattttttgaatttaataagaaaagaaaagcttggtgggaaagagctctaaagttgaactttctccaccctgaccttcaaaccagtcaaagagccccaccagggtttgggatcagtagctctgccactgccagccaatgtttcaaatttgcattgtcatatgtacagcagatgcctctaagcagtcagcatccagaatatcaacaattacttgcaatattttggtgagatagccgacttccccagaaatgtgcctactgtatacacaccatccccagtgttgacatttggaaaatgggagaatctcatgatctccttgaacctgggacaaatgtgtttggtcccttcctcactgaggctgaacaaagtccattccaaccctgcaatacagaaatgtggcccaagttgctgagtgagtggggaggaagtagtcgctgcataggccgctggcaactactcattcagaggcctttgttcgtttgattttgcttagacaaacctgaccccataggcacactcaattcatcagctcatgtgtcccatgtgccagcaacagaatagtgtgcctaagatgtgttctctaagtgactgaactttcctgcttttcaggcagtctagtgatgggtcaagagagcctaagagctatttgaattgaggaggattttgattacactagaataatcagacttcaagaaatttaccattaacaccaactatgtgcagctctcaccattagtgtctgtcttcctacacaagtttattgttaaattatatttgtctttttttttttcctggaaaggcaagttagatgtctaggggattttatgtctgataaatgcctctagttggagatgtattacaaagaaatttagactccccaggactgagtggagtaattagtgtatttctagaatggcttcaccatttgctggaagacagaatatgcttcatggccatctcctaccaatttttggctccttctttctcctccccaatgccccacccctactctttccaacatcagctatttttatgttttccccaaatctgaagcttcttgatatatgtagttttgaagagagacgcacaacactgttttcttctagatagctgagttctgtggttctaagatgaatagctagttctagctttaatgtggaattgaggacatggtgttttgggtaggtgagagacagaaaatcatgatatgttagaactagaaagcaccatgtttcctagatgagggaaaggggagaggatgcaggtagtggtggtgaggaactcagtcaggagacagttaccagtggatgtgaagaaggataagggcaacagaaatggaggtgcgactacaaagtggtaaaagaacattgactacctgctcagggccaatgacctgcaggcaagcaggtcaaagcagggagttcttggcaggtgaaatttataacaagatagagtgcttcttgcagtgtctgttcttttttttagggacagcgtctcattctgtcacccaggctggagtgcagtggctggatcatggctcactgcagcctcggccacctgagctcaagcagtcctcgcatctcagcctcccaggttgatgggactgcaggcacatgccaccatgtccagcctagtgtctgttcttcaggttagcaagagcagggtggatctagggctctgagcaggactggctgatcaaatgtcttattcacactgggaagctgttcccccgcatgagagcaagagataagcccacatcctgtgtggcctctggatgccctttgaagctgtatctgggttccagcttagggagctagagtcactgggagggcagagcaggcacaggagagtcagagttgccagtcttgctttggttccacaggtttaagggacagaatttgcttcagtggctttgtctccacctggtttcattcccacattcacacccacaggggtgacactcggaatgtgtggaaggaggagccagggtgttgggacagggcaggctgggggcaaggccagttttcaaccccatggacctgcgagggggtggcatgcattcagcccctgcctgtgtctctggtctggaaggaattgttggcattaaaggacgtgccaagggctaggcacactcagagagcagggtgcaagtgggaggcgaggaaggaggggatgctgtgcagggtactgggggcatgtgcagccgctcacctgacctgctggacaggccatggctcaggcaccggcctgcgaccagcacaggtggatcagattggtctcccagtcaggagttgggaagttgagggccaggagttactggattacccagaatactcagacttaaaaagcaagcggagaaacttgctgtgtgtgcttagatgtggacatggaaaggccttgctggaaaaaaaaagagcagaatgtaaagtatacgttgcaggagatgagtagacccagacgtggggttgtactgtgcctgagatgccatgggacaccctgttctggaggaccccgaatagccacacccagattcctgactcagggaagctgtgagataagaagtattgttgttcaagcttctaagattgggaataatttgttttacacagtagatatgaaatgtaaaacatgtcacctgaaaggacatggactgtttggggactcccctaaaatccatcctttagatcaggagcctgcccaggatttgctctcaccctctgggacctggtgactctcgtccaagatgctccttctcacctggctttaattctggggccagcctgacccctgccaaggccgaatattaggtctttctgctaccagaaagttcctgagcacgactgagctgtcctctcactggagaagtcatccccagctggcagtcaacagagtggatttacaactgtgcccataccctcttggcagtcaccaaaacacgaacttggttgtcattgtttggtcctcagaagcgtcatcaatttggagtatatggggaaaacatccaatttctggacctcagcagctggtagttatgcctcatgaagccaggtccaggaacttagccagtctccctctaggacattctatgtcatctccctataccatcatcacagtgaaaagacggacaaggggcaggtctgtcccctagggagtcagtcctcaggaagtatttgttgaatgaataaagattttcccttacatgactgatagtacactatatttatagtcgtatgtctcacttctctatttagcactgtccttgagtgtctctgggccagtgagccatctttgtagggctgcatcacacaccagcttatggtggccactcgtggtcatgccatcctcagccttgtctgcactctgccctgcccagcatggcctgtggcacgtatttgctttgtaaaacttctttactgcacctatatatggagggcattttctctgttaataataatggtgagatgtacatacattttttctttctttctttttttttttttttgttgagtctgtcgccaggctggagtgcagtggcgtaatctcggctcactgcaaccttcgcctcccaggttcaagcgattctcctgcctcagcctcccgagtagctgggattacaggcgtgagtcactgtacccggccttacatttttcatttgcgtgtgtatctatttgcttatgattgatgcccaaaagtggactccttgggttaaaaggcagtgagaaagagaacagcagcccctgacatgcaggagctgggccctggtattctgctgaatgtaaactatgtcatggaacataacatgtcaggcaagtccaccccgaccatgagggatcgagacaggaccaagcccctctggactcacatctgagcacaaatgcaccatccccgccacagaagccacgatgccctgtgctggctgcttgagcatggcggctgccttgctgggcagctcttgcctggcttccttcctcctgcttgtaaagaaagacccccaaccctagagctagccccacttcctgacagcatccatccaagcagagcccgggttcctcaaacccccttgcaggtcacccaagccctaatcctatcatcgtttctttctaacaaccttactgagtgggacacacaaggctccccagggtatgcgttcttccttgctgcaatgaggaacaagcccagtttattagcctacagtgtgctctggtggtctctgactgaggggtaggggagaacatggttaagacacattaaaccaaactctttttccaaaaggttgtaccaatttacattcccacctgcaggtgaatctgcattgtcttccttccagaattgttgagaagatcaaattaaatgaaatgatgtggtgttgaccaaacaaaggcctttctccatggggaagttgctcttcctcaacagagagcaccttcccagggatcttacccctggaggggagttagccctaaaaccaaggttggtgttcaaataagatggcaaatttcacatctcaaatgccatcactccaaattcactcattcattctatgaatattcagtgtctatgatatgccttgcagatagatcagtgaatagatcaatgaaagctctgccctttttaactcaaagttttcacttatagcaagaagagatggacaataaatctaaaatatgcataaataatgttgacatattatttgttgctgaccaatgccataaagaaaactagaaagtgagggagaggaaggcttctggcatgggcagacagattgctcttggccagtgaccagggctgcatgtcagagggaggccatgtggaaatgggggctgtttggggagtgagggaggaaagcccattgactcacctccaccttcagactatattgtgttctttgtcagcttagaaaatactgcatatttaatcaagttaccaaaataatttgaaaatgaaatttgacaaatggattctactattcatctgtgagagaaaatgtccaggaacagctttaaattttaagagctgtagcaattaaggccgggcgcagtgcctcacacctgtaatcccagcactttgggaggccgaggcgggtggatcacgaggtcaggagttcaagacgagcctggccaaaatggtgaaatcccctctctactaaaactaaagaaaattagctaggcatggtggcgggtgccttgtagtcccagctactcgggaggctgaggcaggagaatcgcttgaatccggaaggtggagtttgcagtgagccgagattgcaccactgcactccagcctgggcgacagagtgagactccatctcaaaaataaaaaaaaaaaaaaaaaaagaaagaaaaaagagctatagcaattaaaatggcagagatggagcaatggaacaaaatttaggtctgaaaaaaagcccatgtatattgggaattatgggatgttttgaatgggtgggaaaagtgaatagattggtgtttagagaactgattacaaaggtggaaaaaaataatttggcagctctgtttttcaccttaacaaacatacatttcacaaggattttttttttttctttttgagatggagtctcgctctatagcccaggctgaagtacagtatggcacaatcttggctcactgcaacctccgcctcccaggttcaagcaattcttctgcctcagcctcccaagtagctgggactacaggtgcacgccaccacacccggctaatttttgtatttttggtaaggacacggtttcaccatattagccaggctggtcttgaactcctgacctcatgatccacccgcctcggcctcccaaagtgctgggattataggcgtgagccactgcacctggacagatttcacaaggaatttttaaaagctaaacatttagggccgggtgcggtggctcatgcctgtaatcccaacactttgggaggccaaggcgggcagatcacaaggtcaggaaatcgagaccatcctggccaacatggtgaaaccccatctctactaaaaatacaaaaaattagctgggcggcgtgtgcctgtaatcccaggtaattgggaggctgaggcaggaaaatggcgtgaacccaggaggcagagcttgcagtgagccgagatcgtgcctctgcgctccagcctgagcaacagagtgagactccatctcaaaaaaaaaaaaaaagctaaatattaaaaaaattatagaggtatatctgaaaatatggaatattacatacccttggggtagaaaatgcctatccacatatctagcatctgtctctcttatgactatatttggaagtaatacatgtgatcaaaataaatgaaaagaatggaagaactttttttttttttgagacagcgtctcactcttgttgcccgggctggagtgcagtggtatgatcttggctcactgcaacctcgacctcccaagttcaaacaattctcctgcctcagcctcccaagtcactgggactacaggcgcctgccaccacacccagctattttttttttttttttggtatttgtagcagagatagggtttcaccatgttggccaggatggtctcgatatcttgacctcatgatccacccccctcagcctcccaaagtgctgagattataggcgtgagccaccgcgttcagccaggaagaattttttaaaggttaaaatatatgtatgtgtatatatgtatatatgtatatgtcaactaaaattggcttacaattctaactctctttaataattatagaacacttaactagggtccctagatgaattatcaggcattgtcaatactatttgccttgaaaagggtccaatatattgctccctttgggaaatgctagtgcacaccacagatggtgcaggaaaccactggcagagtggccactctctctcccaccccgtcattgacatgacaaacagcatcccctcgttttacactaggccagatcatgaagaaactaagctatgcttcattttgtgcaaatccattgcatccagatttgtaagccatcatgtatgaggtaatgatttgtttttaccaaactatacaataacatttttggttccacatgtaagagccaggaacagccagagagtgttggttagctgatccagctaaccaactgtaaggcacagtcccctgctctggttctgacaagtactgatggccacatctgggacctgaggcagcaaagacccttctcggtggccactcagccagacttcacacaggcccggggtgctgctcatggccattcagatatacagctgcaaggcctggaggccacacttcaaaaacggcaacaggcaattctcattcttctcctctgcctcttcccactatttctctgttttcaattcctctttcttgttttgcacacaaagttccctgagatgtgcttaactcagctggcttagccacagcccagcatagggcactcagctatgccctgttctcaaagcagacccatcacaggctgctgggcttcctagagccagcatccttatgcaggtgtcacttatctaatacaggtgccactagccatgtgtggctatttcaattcgtttattaaaagcaaataaaaattttaaaaatccagtccctccattgcaccagtcacatttttttttttttttttttgagacggagtctcgcactctcgccaacgctggagtacagtggtgccatctcagctcactgcaagctccgcctcccaggttcacaccattctcctacctcagcctcccgagtagctgggactaccggcgcccgccactacacctggtaattttttgtatttttggtagagacagagtttcaccatgttagccaagatggtctcgatctcctgaccttgtgatctgcctgccttggcctcccaaagtgctgggattacaggcatgagccaccatgcccagcctccaccagtcacatttcaattgctcagtaagcacacatggcttgtggcagccatgctggatccaggtccagaacattccacggtggcaggaagtgctactggacagtgctgctgtccccagcactgaggacagtggttgccaagttatcctcccctacagctttgtccattgacatgtctgcagagcacaatgacagtgactgttccccagaccttaccatcggggctattaccaaacttttcagtccttgcttataagacttttttatttttttgcttgaatttgcaagtttttaattatcagtgaggttgagtatgtctcatatgcttgtgaccaagtgtattctttttttctgaagtaacattcatatccttcatcatttttccacttttttttatctcattgattgaaaagtttctttgataaggtcctttgcatattgagaacaaaggtcaccattgtttctatgggtgaagaggcctcaagcttagtggggtgggcacttaagaagtgtgaacatttatgcgctttgacccacttgcaataatttattctccaaaaacaactgaaagttcaacagaaggcaagagctgtgtgtccagtggtattcatttaaaaagaaaaaaaaaaaaagcaaaggaaacaggctgggtggggtggcttatgcatttggcaggctgaggcaggaggatggcttgagcccagcagtttgagactaggctgggaagcacggtgagacctcgtctctacaaaaaatttaaaaacttttaaaaaacaggaaacaaccaacccctacagttgagaattattttgggatgatatgcaccatggaaaatgcttccgatacaatattgagtgaaataagccaaatgcaaactcgctacatgagaataacagccacagagaaatatgcaaatttcctcatgcaaatagcctcttcccggaaaagaatatggaaaaatagaaacagcgatgtgtaacaggtggagttgcaggagacccttttaccaataaacttaatcaggagataatgtgcccagaggtggagagggatggaagcaagtgggcagaggtgcacgtgtcctctgagagaaggtattcactggacattaccccatgtactggaaaggagccctccttcctatccgggtgccccagcatcagtcacagggcacaactatgtcatgtttgtcgtggctgtctctgatttttttctgtttttcttaacatttttctttggatgtcatctgatccttctttttacttttcacatcacaaataccagtacaattaataaaataaaaatattttcatcagagtactctgtaattattacatcacccccagaagtgcacacgccagggtctggggaatgcaagagactaaaggaactacatgttggcttgacacttttgttctgctgaatgagctcagtttagatggtgctcaagccaacagaggagcttcctggacacagcctgtttgcggctttgccctgagccccctgccaggtcagcaagactgcaaatgcctggagccacactgagcagatgctgggcctccggctcggcagggctgtcagcaatggacactgggtggagagcctggtgttagaggccactgactactgatgatgatttagcaaagtacaagaaatggtttctttccagagtctcttacccaaaattaagcagtgggtaagataaatattcttaggaatgaacctcctggataaaagcaccagctctgggagaactctgacaagcaaatggcaaaggtgctgggtgacaaccatggcccctaagcctggttgcagctccccagcttccagagtacacctactctctagctggaaaaacttaagaaatcgttactactggaagtgggggtatgagtctccactttacatttccacgttcccacgttatctgcctggctgctctccagagagtgggtggacatggagaaacaggagcacagcattcaaaagggatcatctcaaatccaaggttatccatggacatgacttaccttttctttgggttagcacacactgtttcattgtcagagatattaaaaataggatcggggaaagaggggcctagtttgctagtttgcatggcagcaacagtgagcacaagctcgtgactttctgctcacagcagttgctgtggttggttccttgacaactcagaggttgactgtgtgctcacaccatgggcacctcacacacagatgtgagtgtctcaggcaggcaagcgctgcctgttgttcctgagttccatgttgatctcagaccatatcttcatgcctgctctcactccccatcttagctctaggtcaaatgtctggtatgttgtctaggcccctgattctctcccgaacatgcggatgccacactagacatttgacctggggatcagaagtcccgcatgcatctcacttgactaactcaaggaatcagcaagactgctttccttctggggtctctaggggagaatctgtatcctgtgtcttccagcttccagtggctgcagcagtccttggcctgtggccccttcctccatcttcaaagctagctgcatagcatctttaaatctctctctgaccttgcttccgtcatcgtctctcctctgactgactttcttcctccctcttccacatttgaggacccttgtgattccactgggccaacctgagtcaccagtataccctccttatctgggatcagctagttggcaaccttaatcttacctgcaaccttgatttcccctttgttatataaaccactatagtcacagattccagcaattgtgacagggacatctctgaggggccattaatttgcccaccatagatgttaattaatattacatgaataaaaggaatggagttttctgttaaagagttttattttcaaagggacatacagctgttgatacatgaaggtatactatatctttccaaaagaggaatctcatagtcagagttctccaaagtgatgtcaccacagaacctccttccacagagttgctcccaggcccaactgttgggaaacactgtgacaaagctagagtgctccaggttttcaacgaggcacttacaaggttccctcatgatagctctgtgtgtgacaaggagaaacgcgctggatgactttattattaagtggactttcaactattcgagagccagtaaacagaacgatggcaacctgggagcagggtctacagtgcgtgccatggggcttcctccttgtccaagggatgaatgaggactttctcattcacttaagtattttcagttagtgcaaacagtaggctgtgaatgctctgggtaactaggatcttgacaagcttgggagaccatggcagtgctctgggcccgcagcaccactgagcatagtgtaactcacccacctctaaagcctttgcccttagatggtgtcctgccaagcggctcttttgggaagagtttaacacttgcttggctcgtgtggggtggttagctgggtggatcacttccacctctgaaggctcaagccctgctaaggagcccaaatctttcatgcttttaaagccttttacttaggaggaaaaaatgctagaagatgagctaacctggtactttagaatcacttcagttgtaactgggatctttctccaagcccaagatgtgagtgttcccatatctcagtcccagaagccccaatagtggactgcatactttctgcccaaatgacaagctcccatcgactgagcgtcatcatagtttaacctgtgtttaaaagcagattctttgccaggcattctagggcactgaaaaactgtgatgagcaatgcagactacctacctggagtgcattgcagtttctggggtcactggtgacccaggccctcacagtgtcctcccacccagccacccccacttgctgacatacctcccacccacccggcagcaaccgtgccagcctcagatgggaatcgagggtgtgcccatcagggctgcccacttttcttgcagctgagaggagtcaagtgacttagttctggtctcctagggaagtggtttcttccacacaagacaggcttgcaaggcggcctgtgttccttctacttcctggtggagtgcagccatctgcggccatgaaacaaccagtctcaggacaagatggcttccagctgctccctgccaagcaggaagaaggaaacacacaaggtgctggtggccttgggcagctgaacacacccagggatgtctgcttccagcttccttgtttagggcggctgagtggctgggggagctacacagacctgcgggggtttagggctgcagccaatgcgccctggctggggtctcccttcggacccacacccaccctggccacctgcctgaaacccaggaggttggctggggaacctccagggtgtacagttacacgctgtactctggggtggcggacagggggtcacttgcactctgtccccagggtacccgtgcagtccctgcccttccggcccgcggtgggagtgtgctgcagcctcgggcgctgatctgcagcctgtcacctgcgccaacgccccttaacgcccttcttctcatccccattttccggtgcccaccagtcccctcgtgctgacagacgactcagcgtgtctccccagagctgctctgcgaactgcacccgtggaggagcccatactttctgaacagccgctttgatctacttaagcactgccgtgttttcatagctatggcccagctatatcataggacatatatcctatgtcatagcatagcggtgacagcagcaggcggcgttggggcggggcggggccagagtgacaggcagccctgcgggcccctggcccctccccacagcccctgagacttgtgcggcccgcaggaatcttctggcggccacccggttcgccggcagcactgtatcagtttctacatggctcctctcccagccccttacgtggcttatttcgtgtcaattctagggaggttctaccgtttccgttcgccgggggtctggaacgcgcacgggccctgggcgagcctccctgagcgccgccacgtccgccttcgtcgtcctcccaaccggaccccgcacccccgccctccctagcgctgtgctggacgcttctctgtgaggagagtccctcgccccttcttcagatttgggaatggactctcgggcacctgaagcgcctgctcaggatcaggccggcacctggacatgaatcccaaacagaaagcctgagccctgcctggcgctttcgcggctgctggcacggctgcgcagaaacgccagcgtccctggaccgagcgcggggaggggcaggcttccagcagcgctgtccactgggaagaagacacaacccacatttttagattttccagtttccacgttgaaaaagcaaaaagacatgagattgatttgtgacccagtgtatcaaaaatattatttaaccgattaatcaatatgaacaattgttcattagatattttacttgtttttaggactacgttttcaaaatccggtgagaattttatactcacagcacatctcagcgctgcagctcacgcaggggcgcctccagcgtcaggctttctgggctcctggctgcgtgctgctgggcacgttgcttaatatggcaaagtccccatttttctcatccagaaaacggagatcaaagtacaggtgccaatttcataggactacagtgaagatcaaatgagagagctcagccaagaatataagacccatgcatggtctgtggaagtctcgtggtctttaaggtaatttgcatgatttggggattctgaaagattttggagtcaggacagatagattacagcaccactctgccactcaccaatcacttattaggctggtcacctcctctagcctggcccttccatctgcacagcctttgcccctgggcagtgagccttgggtctccttcccagccgtggctcacgcctgtaatcctagcactttggaaggcaggggcggatggatcacatgaagtcaggagttggagaccagcctgatcaatatggtgaaaccccgtctctattaaaaatacaaaaattagccgggcatggtggcatgtgcctatagtcctagctacttgggaggctgaggcaggagaatcgcttgaacctgggaggcagaggttgcagtgagctgagatggcgccactgcactcaagcctggataacagagcgagactttgtctcaaaaaaaaagagaatcgtctagaagggttttaaaacacccgtgtcaggggcccaccaacaaatattctctccaaaaagatacactttgtggctttttttttttttttttttttttttttgagacagagtctcgctctgtcgcccaggctggagagcagtggcaccatcttactgaaacctctgcctcccgggctcaagcagtcctcccacctcagcctcccaagtagctgggactacaggcacacactaccacgcccaactaatttttttattttttttgtagagacagggtttcaccatgttgcccaggctggtctcaaactcccaggctcaagcaatttgctggcctcggcctcccaaagtgctgagattacaggcatgagccactgcacctggcct

SEQ ID NO: 123 - DNA, 1516 bp, Homo sapiens
aaaataaaatacggatttttttaaagatttcacaaataatgaatgaatgagtcatagggctgtgggaaggcccctagcctgagtgtagagagacctgaatttctagttcttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaatttctagttcttgaatttaccagtaactacttaccccatctgctaattagtctcctccattgcctccaacctgtacccagtccctacacatatttcaccatagcatgcacatttaaaatagttcatttgtgagggctgtgaacaattaaatgtctcactataaaaggctgaattaagtaagttcctagcagcagaacaagtagtacacgcaatttgtaagatacactgtgttgggcaagattaatctttctaccagtagatggggttagtatgataggtatgataatgtgcatttgccaagttagaaactcgccctaatggacacaagagccttagagttaaattaatttagagctagacaaagtctagagttcagcccaactcctctgtttcacagatgtggaaatgatggccagcgaggtcacagtctgaccagccaagaccaaaacctacatctcagttcctaaccagtcctctttactcaataaataatttctgaaaccaaaaaaactaaaactcaggatttcatgagagtataaagtccagtcagtctaggcttgtttatcaacttgtgcttttcttttctaaagttaaataattatgggaaaggggtctgtaaatattaacttaaagcatgactgccaagttcatagatatgactcttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccagatatgactcttaacaacttccttcaagtaactcattttgagacagtcaaaaaattccttcattttattgtctaaaattatgcataacaaatgactcagaaataaaatctatttttatttta

SEQ ID NO: 124 - DNA, 11814 bp, Homo sapiens
ctatttatagtttcagccttttgggcaacaacatctcttccaagttttgacctttggtataaaacaggatgtctctgaatgtgtcctgaatcagcttttagagtcccgggggtctctcatgttctgtcactgagactcagtaaacagacttctgtacatacggtattgctatagaaaacgtgcacacggtggggcgcggtggctcacgcctgtaatcccagcactttggggtgccaaggcgggtggatcatgaggtcaggagtttgagaccagcctggccaacacaggagttcgagaccagcctggccaacgtggtgaaaccccgtctctactaaaaatacaaaaattagctgggcatggtggcacgtgcctgcagtcccagctacttgggaggctgaggcaggagaatcgcttgaacctgggaggcggaggttgtggtgagccgagatcgcgccactgcactccagcctgggcgacagtgcgagactccatctcgaaaaaaaagaatacatgcacacacatatgtctgtaacacagtaacgtcctcctctgctaggtttaatatgttcatactctagatgtgtaaccagacagtaagggctttgagggcaggaactgtgttctataataaaccaacgaatatgcctggcacctgccacaggctgctgggctgcacactcaggctttgcctgccaggatcttacagcctcccagggaagatgagagcaacacgcggaccagtgaagggaagcaggatgctcactcgggccaggtactgcgtgtgtcacttagacattctgtagagggtgaccaagtgtccaccataacttttccacaactcttccagataagtattgacaccaccattttccagatgaggaaatcgaggctgacaggtgacatggcttgctcagggccagtctatggccagagctgtcatttttccctctcgtgccatgcaagtgccaaatgggggcacaggtggaaaaggtaccacagcacacaggaggtggtgttattttgggctgagagggggacttggaaggcttcctgagggaggagtcagggtctgaactgagctttgggtgggaagatgatttggagcagctgacgataggagggagacagtggggaggagggctccagtccggacagccctcctgcattcccaccggggccccacagggcaggacacgcggtcctgggctcaccgacatggccaggtgcagcggggtgttgccgtgctctccgcgggcatccgcgttggccccgtgggtcagcagcactatggcacagtcgaagcggttgcgcatcaccgccacgtgcagggccgtgttccccgcggagctggtgctgttcacgttgcagccccgtttcagcagcatgcgggccatctgcgggagacggtcaggctgagttagcacaggcactcggggagctgccgcaccccgggacacgtgggcactgccacttctgctctgagaggcctacaggtactgggatgttggaaagcgctagcaagaggattccaggggcaggccccagttctaggggggcctagactgcctcccatcccatcagcatcccaagactagggacaaaaagccaaagatgtgctgactgttttaagaggcttctggtcctttcctagtgccaacagaacccactctccttgcaaaggctcctctggggcctgtcctgaagcaccccgctccctgcatccctccctggaaccctgcaaaggtatcacctctcactgggccttggcaatgcacatccctggcagagccttgggaacagggaggggagcctggctttggagtcacagacctgagcccaaagcccagcttcactcatcccagctgcctgcgcttggatgggtcactgtagccatgtgcacttcagggcttctgtgaagatgggaatgcaagtccccacctcacagcatgtgatgacaatgagtgaccaaacctacacggaagggcctgactcggtgtccggctcctggaatgcagaggtaccctgaggctggcagtgccctccctcctggcccatcacattgagaagtaggccatgaactctggggcatcccattctctgtcaagctgtgcttcctggtgatgagaccagaggcctccatcctcccaggaggacagagcttagcttaggggaagaactcagaggagatgcccagccaggctccctgtgtgtgcagctaggcccagcaccaccaccaccaccatcatcatccatcatcatcatcatcatcttgatggttaataatgagtgtcaacttgattggattgaaggatgtaaagtattgaccctgggtgtgtctgagagggtgctgctaacggagattaacatttgagtcagtaggggaaggcagacctacccttaatctgggtgggcaccatctaatcagctgccagcacggccagaatataaagcaggcagaaaaaaatgtgaaaaggctagactggcttagcctcccagcctacatctttctcccgtgctggatgcttcctgccctcaaacatcagactccaagtccttcagctctgggacttggactggcttccttgctcctcagcttgcgatggcctattgtgggaccttgtgatcgtgtgagttaatgctccttaataaatccccctttaggccaggcacggtggctcacgcctataatcccagcactttgggaggccaaggcaggcagatcacgaggtcaggagatcgagaccatcctggctaacacggtgaaacctcgtctctactaaaaatacaaaaaaattagccgggtgtggtggcgggcgcctgtagtcccagctactcaggaggctgaggcaggagaatggcatgaacctgggaggcagagcttgcagtgagccaagattgtgccactgcactccagcctgggcgacagagcgagactccgtctcaaaaaaaataaaataaaaaaataaacccccctctctctctatatatatatctcctgttagttctggccctctagagaatcctgactaataatacaatcatcatcacgccaccttctatttgggaagcactttacaatttgtgccgagttttgtcacacactgccttgctgacttcatcacatcgccaaagcagaattcatggatgaggaaactgaggcacagggcggatccccccgcccagccagagagcagcagagccctgccaggatcccagctcttcatggacttctctgcctgcacacccactgcaaggtcagcccccaagtgctagcctcagggtcctctcgggaacctgcttcctgagggccctgaggacctgcggggcccggccccctgccccacccacccacctcaggatccactcacctctgcgttcttggcccagtggagggggctggctccgtaacgggggtctttgctgtggatctggctgctgtccatgctgatgatcatctccgcacacctggtgagagaggggccccggttggtgagcagaagctagggtctgcgtggcgtgggatgaagccaggacttggagcttcatctactgcttacagagagcatcactgcaaacaaagttcagcaaacccaaccagcacactcaccatggttaaggctgtactgagcccctcaaggcacaactaaccccctcctccaggaagccttcctgatgctgccaccagcaatgatcaccctccctggtactggctttagagtcagatgggcttgaagtcaagccccagcttcctcactggtggcctccagaagctgagcaacatggagagagtgctgagaggagtggctggggtgtaaggaagaccaggcatttcagagcccagttctgtgcctggcacacagccaccctccacctccttaccacactgtcagtgagtcacacagtgacctgcatgctataggaagcagtatgacagagtgggaaagagcacaattgctttctactcggtgcctgaggcaagcagtgtccaccagagatcttagcatctccagcctcagagcagaggccccgggttcacaagcctcattaggccccgcctggcccaaagaaagtgctccatcattgtatcatgggtaggaatctcggttcacaagttcagctgtgcaaggagaagactttaaaatttttctggctgggcgcggtgtctcacgcctgtaatcccaacactttgggaggctgaggcaggcggatcacctgaggtcggaagtatcaaaggacggaatgcagggacttgaatggacatttgcagacccatgtacacagcagcattcttcacaacagacaaaaggtggaaacaacccaggcgtctatcagtgaaggactgaatggataaacaaaatagtattctgccttaaaaagaaaggaaattctgatacgtgctgcaacatggatgagccttgaagacatcatgctaagtgaaataagccaggcacaaaaggacaaacgctgtatgatttcactgatacgaggttctagaacaggcaagttctgagagacagagaggatatgggacttatcgggggctgtggggaggggagaatcgggagttattaatggttacagtttctgtttgaggtgataagaaaagttttagaaaggggtaatggttggacaacattgtaaatgtgattaaaaccaccgaattgtacacttaaaagtggttaaaatgggccgggtgtggtggctcacgcctgtaatcccagcactttgggaggccaaggtgggtggatcacctgaggtcgggagttcgagaccagcctgaccaacatggagaaaccctgtctctactaaaaaatacaaaattaactgggcatggtggtgcatgcctgtaatcccagctactactcgggaggctgaggcaggagaatcacttgaacccgggaggtggaggtaacggtaagccgagatcacaccattgcactccagcctgagcaacgagagcgaaactctgtctcaaaaacaaaaaacaaaagtggttaaaatggcaaattttatgttatatataatctatcacagttggaaaaaataaacataatatatcagaatcattgtatactttcaataggtggattgtatggaataggaactatatctcaataaagcttttttttttttttttttttagtgcaattactaggacagcccacatgggtttaattcccaggtctggcacttactgactgcctgactttgagcaaattacttaatctctctaagccctggtttcctcatctgttttttgtttgtttgtttgagacaggatttccctttgtcacccaggctggagggcaatggcatgatcatagctcactgtagcctcaaactcctaggctcaagcgatcctcctgcctcagcctcccaaagtgctgggattagaggcatgagccaccacacttggccctcagctttagagggggaataaaatacatcagctctctgggctatagtgaaatagcccacatgaaggctaagccggtggctgggacagcgttagtgttcagctgctgttctctattattaggggtgcccagcacaggcccaggatttatgctgcccagctccctacagcccttatgccagcgcttggtgctcagcactaggcacatggagtcaggcccagcttctttccctgggccctctggagccccccaagtcttcacccgagtggccagctccggctagtgtccatggcttggctcgggctctgctgcccccaaaccttccctgaactccagctgcctgatgccgtctctgagctcctagtgcagcccccaggcatcctcagtctcagcctccatctcactgtctgggattatctgtttcccttcctcagcaggggcttaaccatctgagaaccgcaggcacaaaccgagctttgtgggaaaggtcagctgcattgaaaaacagcagaggtggccaggcgcggtggctcacgcctgtaatcccagcatgttgggagggcgaggcaagtagatcacctgaggtcaggagttcaagactagcctggtcaacatgatgaaaccccatctctactaaaaatacaaaaattagctgggcatagtggcgcacacctgtaatcccagctccttgggaggctgaggcaggagaatcagttgaacctgggaggcagaggttgcagtgagccaagatcatgccattgcactccagcctgggtgacagagtgaaactctgtctcaaaaacaaaacaaagaaaagaaaagaaaaagaaaaacagcgagggagctcctagtctgagctgtgagggaaccacttgtcagtaacactgaggccgtgggattcttggagtagggctgtgctggctgccaagtcgataagggatctccctgctccactcaaggtaggagcctcttcctttgtcttctgtgcaaagatcctcttatgtgatgggacgctggacccacccaggatggcctgtgtggggacagagggaccggtgagggctgaggttgtttgaagagagagaaaactggtcaattacagctcctgcccagtacagctcagggtggctggagacaagcaagagtggggccatgtgccagccctctgggtagagaagagcatcacctggtgtccactcaggtcacaacctgcaaatggggaacctgactgcggggctgggggtgttggtatcttctctgtttggtcaagtatttctgaaagctctagctcattctggctgtgcttgggagattcaaggaaaggagggtttgtccaggcttggtccagcccttagaagggctagcaatgccccatggggctagcaaggtggatgcagctcccagaggaaggaacaacctgaggacaggcacaagtgccagcctccctgcctgagtgctgcccgtccatgccttctcactgcttgtctggcactgcgctatgagattctgggtggctggggtgtctcctgtcctggagtggcttattcatttcggtgaggctggtgctttagcacagtgccaggatcgaaggactcattggctcattcattcattctagatgttgttcctgttagatagtattttttttcttgagatggagtcttgttctgtcgccctggctggagtgctgtggcacaatctcaaatcactgcaacctctgcctcccagtttcaaacaattctcctgtctcagcctcctgagtagctgggactacaggcacacaccaccacacctggctaatttttgtatttttagtagagacagggtttcaccatattggtcaggctggtctcgaactcctgacttcaggtgatccacccaccttggcctcccaaactgctgggattacaggtgtgagccaccgcgcctggcctagatagtattttgagatttgagatattcatttatctttttatctcatcccctacccctttgaagacaattttcctgacaccaggggttcccaggctcccaaaacatgagcctgtacctgcctcccaacgtgccaccagccagaaaggaaagaggcatctaggtggacgggcactcggccaccttaccaagcatttcccaggctttgagctgggcacacaagaaaccaaggagcactgaagccatcggggggctgttcagatcaggctgggctgggttagaggaggggccaggtgggccttggggttgcatcagactccagaactggagcaccacctggaggggagctggaaagaggagaccccaaagagggctaagattggttgtctccagttttatagagggagattcactcctaggaattaaggtacattaaataaatttatttttatttatttatttatttatttatttatttattttttgagacagtttcgctcttattgcccaggctggagtgcaacggtgcgatctcggctcactgcaacctccgcctcccgggttcaaccgattctcctgcctcagccttccaagtagctgggattacaggcatgtgtcaccacgcccagctaattttgtattttttagtagagatggggtttcttcatgttggtcaggctggtctcgaactcccgacctcaggtgatctgcccacctcagcctcccaaagtgttgggattacaggcgtgagacaccgcgcccagccagaaaaattttaaagtctcctccttgcacagctgaacttgtgaaccgagattcctacccatgatacaatgatggagcaccttctttgggccaggcggggcctaatgaggcttgtgaacccggggcctctgctctgaggctggagatgctaagatctatggtggatactgcttgcctcaggcacgggacaggtgacaggagagctggagcccagcaggccagcagatggggaggggaggaggtcttaccccttctgagagaacttcatggccgagtggatggggtagccgttggggcccatgatgttgcaccgagcattgcacagcagcagcacgcggaccatctcctgcttccccagctggcaggccaggtgcagcggggtcagcccttggttattcacctggttcaggccagccactgcgttccttccaaggagctgatgaaagaggaagggaagtttgactccataggatgctgataagaacgtaaagaggccgggcgcagtggctcatgcctgtaatcctagcactttgggaggccaaggtgggtggatcacctgaggtcaagagtttgagaccagcctggccaacatggtgaaatgtcgtctcttctaacgatacaaaaattagccgggcatggtggcaggcacctgtaatcccagctactcaggaacctgaggaaagagaatcgcttgaacccaggaggcagaggttgcagtgagctgagattgcatcattgcactctagcctgggcaatagagcaaaaactctgtctaaaaaaaaagaacgtaaagagaagcaccaggaaagccaagtgccagtgtggatgggagggaaggggtcgacctggcatgactgtggctcacatgaaacatttctgagtcaaggaacttaaaaggtagctgtatctcaggatgggcactgggggtccaggtgggaatgattcttgcttttcattctgtcctgactgatttttttctacatgcaggtactatgttttcaatgaaagaacagcagtattaaaaagagagccaggggccaggcgcagtggctcatgcttgtaattccaacacactgggaggtgagaggatcacttgagaccaagagtgtgataccagcctcggcaacatagggagaccccatctttaccaaaaaaattttaaaaattagctggcgtggcctgggtgtggtggctcacgcctgtaatcccagcactttgggaggccgaggcaggcggatcacaaggtcaggagaccaagaccatcctggcgaacacggtgaaaccctgtctctactaaaaatacaaaaaaaattagccgggtgtggtggcgggcgcctgtagtcccagctactctggaggctgaggcaggaggatggcatgaacccgggaggcagagcttgcagtgagccaagatcgcgccactgcactccagcctgggcgacagagcaagactccgtctcaaaaaaaaaaaaaattagcccatgtggtggcacgagcctgtagtcccagctgctcaggaggctgaggtgggaggatcacctgagtccaggaggttgaggctgcagtgagccacaatcacaccactgcactccagcctgggcgacagagctagatgctgtctcaaaaaaaagaaagtgctaggagggttttactgtctcacttttggctcagtgctgtccccatgaggttcattacaaccacagtgtacccatgtgacaccagggtcacctcacagcagtcccactggacctgaaggcaggccagagacacagcaggaagagcaaagggctggcatcgaggccaatgtaaggtcaagccccactctctcagctttgtggccctccctgggcacgcttcttaattaacaacactgaacctcagtttcttcggagaggaaaggggaataatgacctccaccccatgagtgtattctaagaattaactggaacacatacaacactcagttcaaggtcaggcaccaatcagcaccggataaaggacagctgcagtcgtgcatgactatcgagaagcgggtgtgcacacccccgcatggaggcagggtctgcgcggcaccatgctgggtgcgcagaggattctcggtgaaagtggagttcaacagtgggtggagaattcccttccctgagagcaagaagcataagatatgaatccacattttctgggccgggcacagtggctcacacctgtaatcccggcattttgggaggctgaggcaggtggatcacttaaggccaggagttggagaccagcctgggcaacatggcaaaaccccatccctactaaaaatacggaaactacccaggcatggtggcacatgcctgtaatcccagctactcaggaagctgaggcacgagcatcacttcaacccaggaggtggaggttgcagtgagccgagatcgcaccactgcactctagcctgggagacatagggaaactctgtctcaaaaaaaaaaaaaaaaaaaaaaaaaaaggaatccacattttctggtataacgtagttgcattctgatgccaaggcagagagaacatgatctttagaagaattttctaattctagacaataaaacataatccaacatcctgccttttctgttcaatctaatatatgaaatagctatttaatagtatcaccccatctgcttgcccacaattaaaaaatcacatcttttgcccaggtaatcaaaaacgttaacaggagggcctctggcacaaatgcctacaggaactggagacagtttggtttgcttggtttgaattcctgtaaaatagggttgtccaatattttggcctccctgggccacatcagaagaattgtcttgggtcacacataaaatacatgaacgctaacaacagctgatctaaaaaaaaggtccatgcatggatctcataatgttttaagaaagtttgtgaatttgtgttgggccacattcaaagccgtcctgggctgcatgcagcctgcagggccacagattggacaagcttgcaaaaggttaagcccaggtcccgctggcccacgagcccctccaggcaggcatctggctcacagtttgtgctcaggaaaagtggaactgaactaactgactggagctgggccttttttggggtttattttgctgggttggaggccgtccccaggtttatcaagcaaagagactgaggacgtggctcctggaaaagggctgggagggaagagccagggaggggtctgcaccctccatgaaggagctcaggcctcaaggaccaatgggggacagtgagaggcctgagagtgacacctgagcctaggggcccaaagggaaccgtggacaccgggaggtatcagtaccagtcaccctgcccctccccctgctcacctgcagcacctgagaattgtcaccctggacagcataatggaagacggtctctcccttgtagtcggtgacatccatctgagtgtggcagtactgcaccagctccaccaggatctccccatcacccttgcggcaggccaggtgcaggggtgtgcagccctcctcgttctccgcgcaattggcacagctgcaggagagggccagggtgagcagaggtgagcaggtgtggtacaaggtggcagggggacctaagtgcacatgcagggaagtgcactcggaaactcggactttctggtttatttgagctcaagagcattcccgccactcagcta

SEQ ID NO: 125 - DNA, 158364 bp, Homo sapiens
tttttcttttttagcagaaccattgcttacaattggcttggttttcaagtttcagagtgcagtgggtggaccgaggtaaccctctcctgtgctcctgtggagccttcaaatagcccactgcttgcccctcctcctcccccctccagccacgcactgccacaggggcctttttcaaaatgtgtttaggttgttctgctcagaactcctccagtgcgtctcttcactcaggataaagacccaactcctccccatggtcctcggggccctgcagggctggtctatctcctcatctcctgccagtaggcaagctgccttagtgacccctcagtccctgccacatctcctgagcactctttctccaggacctttgcacatgctgttctctcctcctggcgtgtggcatttccaagaagccttccttctttcccctccttcacccctgcccagcctaggtctcatcctgttacaccttcttacaacatgggaagcacaattctcctgcctcagcctcccaatagctagaattgcaggcgtgcactgccatgcccagctcattttggggttttttgtattttgagacagagtctcactctgtcgtccaggctggagtgcagtggcgtgatctcggctcactgcaacctctgcctcctgggttcaagcgattctcctgcctcagcctcccgagtagctgggactacaggtgcctgccaccacgtctggctaatttttgcttttgttttttgttgttgttttgttttgttttgtttttttgagacagagtctcgctgtgtcaccaggctggaatgcagtggcgcgatcttggctcactgcaacctccacttcctgggttcaagtgattcttgtgcctcagcctcccgagtagctgggactacgggcacatgccactatgtctggctaatttttgtatttttagtgagacgaggtttcgccatgttggccaggatggtctggaactcctgacctcgtgatccacccacctctgccttccaaagtggaagcactctttaacagtcacaatctcacaatgatttccgtgactatttgaggtatgtcatagtgtggctaccctgtccccctggctgagctctgtgggagcagcgattttgcctactcctacatttcccatagtgcctggtacataggcacttgataagcatttgggcagacacggtgtgacatagtatgatgcggtgaggtgctgggtcattgtagtcccaggccaaagcaaaatcctgggcccctctcattgttctaggtagagaaatgggactttctgctgtcacttgagagtattggccacacccttggtctccaatgattgctccaagatggaacaccaggttggggaccaggacccagtctcctgttagttcactgccctgctgcttccctgccactctctaaccccagctttctcccacagggatcttcattgccttgctgctgcgctttgacatcaggtgagtgagtgagggcctgccccagcatgggcttctccagggattctccagtggccttcaggagcccagagaaggtacctcaggagaccagaccctccacccccacagcagccagagcaattctgattttatctgcattttgcatcttgaagttctaagtatttgaagagcctgtggtcaaaaaattgttttaagaatcataggccaagagatttaaacccacaagggcctggtggtactcacagtgctttctcactgtgtgaccttgacaagtggcctgaccttcctgagcctctggtttctcatcttgagttaataacaagagttcctaccatgaaaatctggagagagtgctgagcacacactgacctcagtcgctcttggttgaatcctggttgcagtcatcatcatcatcttttatcagcctagcgtcaggtcaccatgtctcagctgctctagctgttccctgccctctctttactcagacatttttcagtctgttgtagacagtgagcacgagggggagaaggtgggcaacttaggtcagcgtttaaaacacaagaaaggtcttatccaagttaatgcacctatgcaatgggacttgccgtcagcagggggcgccagcaacagctccatcattttatgccccgtcatccctgtgagggctggcaatgttgcacttaactttgaggtggtttgtgaacttctcttgatttcctcatgcctgatagttgcaaaagcagtaataacagtgacagtggtaatgagaaacttactaccagcatcattgaaatccagtttccatgtgaaacttaggtttttcccactcacatacacctgggttatttgtgtagtgccacttcaaaccttaggagcatatgggctcacagtcacctttggaagagacctggccagtctgtaagtagagggatgtctgtgccagccgtctctactcctggctgttcagaggtaatacaaagtgaaacccataagaagcccccaggctatttgctggagacagattcaactgccagcaccctcagagacagagtctcattttttagcctgggctcacagcataagcagctcctcagctgatttccagaatcagtgcaacattcccaaagggagtcacttgtatcccagttctcaagataggtgagttctcaaggtacttgcagccgaaggcttagaagcacccaggacaaggagagaagggggtcagaagcactcattcattccacaaatgttaattgagtccatagtactggctgggcacatcccaggtgctggggacatgcagaggttacggagctggcattggagagggaagtcacgtaatggcaatgccgggctgtatatgattcatctgttctgaagctgatcttggatgaatcacctccaggaagccactggcatttattcatgcagccagcatctagttagtaccacaaataggctattgaactattacgtccactgcacttaaaagtagtaacttatctttgcagtttctgtatctgtgtttctcaaagcatgatccaacggtatgagattcacctcagatgtttttttcaaaatgcagattcctgggccctgctctagagctattagatcagactccctgggggtgggacctagaatcctgcattttttcacaagctttccagatgatttttatgctgactaaagtcttacagccactgttataagttgcagcatttgatattcataactaccaaggagatgagctcattttcccattttgcagatgagtaaactgaggctaagagaaggaaagcaacttgtccagagacacatagctgggggcagtatcagcgtgcacacccacctccagactcccagcccagagctcagtcacccccccacaacctctagggtcttccccagctccctcagaaggggtattactagttcagtccctatatctaaccctcctcctctttcttcacaccttccctgcagcttgaagaagaatacccacacctacttctacaccagctttgcagcctacatcttcggcctgggccttaccatcttcatcatgcacatcttcaagcatgctcaggtgggcaggacggtatcagagtgtcaggaatgcctcactgcaaatagagggacttacagagggatttatttgtaaatgcaagcagtccagagataggcactccccactggtgttggagcagtcatgtctgtgattctcttggccttccatttgtggttgcaagatggctgccactgctctaggcagcatgggcacgttagaggcaagaaggagggaaaagcgtaacagccatgcctgctgccttcatcaggaaggcaggaactttcccagaaccctttcagcatctcatgggccagactggggtcctaaagccaccctggctacaggagagtccaggaaagaggatttggcttctcagccttggtagtgggaagcaggcagagaagaacaggattggagtgggtgttgggtattggggcgtccctccccctactccctagtagaccaggctctgcctccttctcccaccaagatgaggatggagtactgagctgccacagaatgaagcaacatagcacaaagactgggagccctcagtgtggcctggagaggggaagattcaggggaaagtgagcagacaggattgccctactttctactggaaataataagagctcctgtttgttaagcacttccacatgtcaggctctgcactcatgaggatccttgtgaacaggtggggaaactggagttcaggtgacacactgcaagtatgtggtaaagccaggattcaaacctgggtcagcatggaaaccacacccaggctctcaagccctggccatgggaaacgcagcattgaacaggggctaagggagccctgttgtgaatcccagcaccacccagtaaccatggaactctgggcttgctgcttctgtcccctttccccttccccagggcccaaatacagacgagccatctttgaattaatcacaaaagctggggtttttttaatcactctgtgccaggcactgtgctaaactcttttgctaataactcatttagtcctagtacagtattactttatagaaggtcaaaaggcccctagcccataattagaaaaaccaagaacaaccattgtggaactgcctctcacttctgctcaagggcttcaatggcgtgtaaggtgagagtaacatgcgtatggcaagggtcacagagagtgactggacctggtttggaggactagttaagagaccttttggaggtctctgcagctcccggccccttattggagtccaagcccagagccaattcccccagtggccataaggtggcagcctcaccctctgcctggctggactgagaagaggctcccattcagagctctggcacacaggagtcctctcctttatcggaaaactgcagcgctgagagaacgcgaacactacatcaggctgggccctgggtggcgatctggactccagactaatgaactcctgaaccctgccccaaggcctgtgttactccccagcagcagcccagcccttctccccagtcatccaagtgggtacctctctgaaaatccttggaaaggggatccaggacatgaggggaccctgtcccatggggtcccctgctctccaacacacaggtagtcccagtgctagcattggtctaggtaagggtcacctctgcctttgtgcagtggtgtgatctcagctcattggagctccgcctcctgggctcaagcaattctcctgcctcagcctcccaagtagctgggattacaggcgtgcaccaccacacccagctgatttttatatttttagtagagacagggtatcaccatgttggccagtctggtttcaaactcctgacctcaactgacctgcccacctcagcctcccaaagtgctgggattacaagcgtgagccaccacacccatcctacttagggattgttagattcaataatttaatatacataaagcagtattgatcacagcccacctatgacagatggcaagaaataagtctgaatgttaggatcaagggcatgcgggaaagacttctttgttctctggccaagggctggctttacgttaagaatgaagtctccggccaggcgtggtggctcacacctgtaatcccagcactttgggaggccaaggtgggtggatcacctgaggtcgggagtttgagaccagcctgacctacatggagaaaccccatctctactaaaaacacaaaattagccgggcttggtggagaatgcctgtaatcccagctacttgggaggctgaggcaggagaatcgcttgaactgagaggcggaggttgcagtgagccgagatcgcaccactgcactccagcctgggcaacaagaaggaaactctgtctcagaaaaaaaaaaaaaaagaatgaagtttcctcaccctctccaggacaatctcttcacttcatgagcacccatgaagacgcaccatgaaggagccattcactgagtatttaccaggccctcttcagtatgcagggcacactacggtgagcaagacagctgtgggcccgccctcactgaactcaccacctatggggatgttccattacaaattgctggggaggccaggcacgatggctcacacccataatcccagcacgttgggaggcaaaagcaggtggatcacttgagctcaggagttcaagaccagcctggggaaaatggtgacaaccagtctctacaaaaaatacaaaaattagccaggcatggaggcgcacacctgtaggcccagcaacttgtaggactgaggcgagaggatcacttgagcccaggaggtcaaggctacagtgagccatgttcatatcactgcacttccgtctgggagacaaagtgagaccctgtctcaaaaaaaaaaaaattgctgaggaatgctgtgagggaaattagagggacttacagagcacgtagcaagggacctgactccatgtgaaagaactcaagtgcaccagcctggccaacatggtgaaaccgcatctctactgaaaaatacaaatattagccgggcatggtggcgcatgcctgtaatcccagttactcaggaggcggaggttgcaatgagccaagatcgcaccattgcactccagtctgggagacagagcaagactctatctcaaaatcacaaaaaaaaaaaaaaagaaaagaaaagaaactcggccaggcgcggtgtctcacgcttgtaatcccagcactttgggaggccaaggcaggcagatcacaaggtcaagagatcgagaccatcctggccaacacggtgaaaccctgtctctactaaaaatacaaaaaaattagccgggcatggtggcaggcacctgtagtcccagctactccggaggctaaggcagaagaatggtgtgaacctgggaggcagagcttgcagtgagccaagatcacaccactgcactccagcctgggtgacagagccagactccatctcaaaaaaaaaaaaaaaagaaagaaactctttgggctgggcgtggtgcctcaggcctataatcccagcaatttgggaggccgaggcaggtggatcacctgaggtcaggagttcgagaccaccatggcgaacgtggtgaaaccccatctctagtaaaaatacaaaaattagccaggcgtggtggcaggcacctgtagtcccagctactcaggaggctgaggcaggagaatcgcttgaaccctggaggcggaggttgcagtgagccaagattgcaccattgcactccagcctgggcaacaagagtcagagactctgtctcaaaaaaaaaaaaaaaaaaagatttgggtctctgagtcctgggctattttccctctccttgtgaagcattggtcttcctcctctgcaaaaggataaccatcatgggatgtggcagtgggctgacttcctgggaaggctaagctcagtgcctgcacagtagatgttcatgaacagggtcttagtataaccgtccttttctccaaacccagctttaccaggagtctcagcacagacatgccaaattgcttgggtgtgaatcctgggggagccagtgaccagctaggtcaccttaatacaggctgcaacaagtagttattacatagcagctgtggtgtcatcatcactataatagcatctcctggagcatttgctaaaatgcaggtgtgagccccagacctcaggaagcagagtctctgggagtaggaccaaaccaggaagttgctttttgaacctggtgacctaggtgattcagatgctgccagccaaacccctgggaacccttgaagccctgcctacttgagtttcttagttttcttgcattccctctcgggaggagcaacccttgtctgggagttaggagccctgggttcaggcccagccactgacttgctatggtcctggaccagtcactgtccttcagtccagcccagaaggggtttggggtgctgggcacggccctgaggcagtgccgtgcccagcatggcttcaccagcctgtgtcctctcatagcctgccctcctatacctggtccccgcctgcatcggttttcctgtcctggtggcgctggccaagggagaagtgacagagatgttcaggtaaggcagagtggggggcagatgtcctcatgggcaccagtgtgcctgctggcagtcagtggaacctgctgggggtatctttacacctctccaggggaacattgttcctgccaccagccccaccccttgcctttttcagcagtacatgggtacctggcctgtggacaccagtgggaaccttaccctgggccaggagccaggggagcgcaaggcatcagagccctctaggcatcccccatccaaatgttagctggatcttaagaatagctgttgtggatttttctctgcctactgtcagaagtcctaggtgactctgcccccaggtgacttcaggcatgtcttcccctcccatggcctcagttttcacatgtgagtaatagaacagggggcgtgtgggatgccctagtgtggtagaaagtgccccgagtagaaggcaggtgtcagtccctgttcattcacctctgtggctttaacccacagctcactgctttctctatatctgtatctcacacagataccccttccccagggccatatccacacctaccacaccctgcacacagccccacccataccgcaaggcctgcgtgactccaacaggtgtctgcccccagcactgccgaccctgcctgccagggacctagaaatagctgtcagttgcgattaaagctgcctactcgggtgccttccgcccagttccacctgcctggcctccaagctgtccctagagcgcttgccagggcctcctgtgcacctggctccccgcaggggagcctgtgactcacccctcccccggacctgcctctgccctccctgtcctgtctagaatccccagccccccgcctgcctgcccacattgcctcgcccagcaaagctctgtggtctgaggcaagtgggggctaggggtgaacttggggacaggtctcagggagctttgggagcaggcatggcacccgatccctgagcttagcacccatccttcaccctccctctgcttcccatccagcccaggtttccctgcccctccccttggggtaaccacccaatgctattgtgccctcatcaggcaaagctctgaatacacaaggcagagggtgcccctggcctttacctgcttggtgctaaatgctctgccatacaggtaccctgcccccactgtttgccctccactcccaccctggacattcttagattggggtaaaaagcaagtgatctctctctctctctctctccctcctttctccccatttctctcccaattctccacctttttacttttcccttctattctcctcctttttttattgatttacttatttttatattggtaccacattcacatagttaaaaattccaaagctgtaacagagagagcaccctcatgctccagctaccccacagaggccagcagtgttacacagacattcagacacctgtgcactgatgtgtgtatactttttcttgcacagacggtggcattcttggagcattctgcacattgggtttctacggtatttcttagaggtgtttccacagcagcacatacacttctagagcatgcttgttcttctgcacagtggcctgatgtgcctttgtctaggtgcatctttcttttttcattctccaaataatatcagcttctttccataaaatctggaagtgcaaaaataggtaaaaacaagacagttctgctctctgctccttggaaaggaagtctctgtcctcccttagtctttccctatccatctctttttttctgtctcttctctctctctcacacagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatgtaatgcccagcgggtgcccacctgcccgcttccccctactgccccggggcccaaggtagggcagacactgcagctccagtgcatagggcagggaccattgccaggagtaggccgcaagagcagctcctccacaaccaccaggcagtggttgcaccgagccatagggctgggaagcaggacaaccccgaagcttcctgccctcaccagtaatgcggggcccacatcatagtggatggaaatggcccttgtcatgcagtagtagatactgttaccattcaaggtatatgtataaccttaggcaagttactttcttcatctgtaagtgggcacattcctgcctcacggggtttatctggtgaggaaagatttgtattatctttggcatgaactcagttgcttgaaaaatgaagcccatagaagaagctaagccagggtgtctgtcttcagagcagcaccttgccgcttgccagtacagcagtgccctcacctctggggctgagctgtttgattcatgctgtgtgccctgggaggcagcctatctccatctcttgtagccttgtcatggccacccctttttccacgctacagcagaaggttcaggaagcttgaaatcagcccacacaagcccaggcccaacctctcttccattggctgctgcccttgctgcctcctggtacccccaggctcagagaaagcagagcagcctgcctgaggagggcatgtggtagggctggggccaggcgctgttaggtgctgggcagtggacacagggctgacgctctgcatgtgaccaggcgctttcctaggatgggggtgggggaaggggacaaccaaggttctgctcaccctctcctctaaatgaatttttattgttgtttttttttttttggtcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaagattctctgtttaagcacccagtgtcttgccctgggttttctaggtctcacctgcccacccaaaatcttttctgcaagccccttaagggtgcccaccccagtgcctggccagccctgcacccgtaaaacaccttttagccagtagagggggcccacgagccctctctcaccagctagcacttttctcaccaccttcctcgaaatacttgggggcagcaagggtgttggcagatgagagtctcccactcaccatggtgagagtggtggggagtacccagggctgacctgactcacaagggaagcagtaactgtagaacctgccagcctccctggtccctgtgcccatatggcttcggctgatgagggctcagactctaggttgccctgaagatcaaggctttgtctcccattctgcccattcctgggtttcttcccaaaatgactactgtggggccagtcatggcacaagggccaggacctctagaggctggggtggggaaggactgagctagtgattcttagaggccttctggggcctaagagctgaaatctcagcgcccgggtttccctaaagtttgctgaagacagcagccccggccagcaggagaccgaccgggcaccaccccaaaccaggcaaacggtggccacaaccctcatccacccacctggtatgaggtcactgagtggggaaacagacaggagcgggtggccaccatactgacagacccggggctctcccttgcccaagcttcaggttcaaaggctgaaaataacagtggcttccagtttggaagtggccaaaggacaatcatgaccagagactcaggagtatgactgtaataccctcactaggtattgacatgcactaagcaccttgatataggatttcacttccttctgagtcttgggctgtatgtgctattattcgctccgctgtgcagatgagggaattgaggcagcttgcccatggacatcgatttgaccttagccaagccaaacaattccaggttcctaaggaccgcagctcctccccagacccctgggaccaagtcactggctggtgtgctgggcatccctgagccccagccacccaattttactggctccagggttctataggaaggaaaaggggtagaaaatttcaaaaggcttcttcctttcagggaggggggttccctttcaggggcttctggaatctctacccactccagccaactctgaggccatgtggtcctggaacaaggcccctctgaggcagatggggcaggcggcccaggcacatagcatggttggctctgcggcccagggcgcacaaaggccttattgagtcaccaccagcccccggcagaggctgaggtggcagtggcgccgagcgcctgccacctaatgactgtcctggtccagccagatgttccacagacctccggagcagcggactagggcccgcccggccagccggcaccgcagaggccactgtaattccaattaaccagcttcagctgagcaaacagcgggcagtggtggcccagcccaggcggtaggcctggcccgcagagcctgcgagtctagactccagatgtgaaccgccaccatcagagtcccatggaaaaatggcaccaggccgggcaaggattgggcctgcatgctggggagggggtgtgggtggttgggcagggccccgagtgggctagatgccagcctcacctggtttggggtggattattaggaaactgctctagaacccaagttctaccctgctttattagattctgtttctgtgcctcagtctcccatgactgcgacaagagagagggttccaaggggaaaaccagccctgctgagaccccagtgtgcactgactgtatttcacgtgactagcattatgctagtgcaactgacccttgaacaacacagggattaggggcaccaacccatcatggtcgaaaatctgtataacttttcagtcccgcaaaacaactaatagtctgctgttgaccagaagccttacctgataacataaacagtcaaaacatcttgtatgttatacgtactacactgtctaccatagagtaagctagagaaaatgtaattaagaaaatcctaagagccaggcatggtggctcatgcctgtaatcccagcattttgggaggccaagatgggcagatcaggaggtcaggagatcgagaccatcctggctaacatggtgaaacccccgtttctactaaaaatacaaaaaattagccgggcatgatggcaggcgcctgtagtctcagctactcgggaggctgaggcaggagaatggcctgaacccgggaggcagagcttgcagtaagccgagagaggcaggcggatcacaaagtcaggagttcgagaccagcctggccaatatggtgaaaccccgactctactaaaaatacaaaaattagcctggcatggtggcaggcgactgtagtcccagctactcaggaggctgaggtgggagaatcacttgaacccaagaggcggaggttgcagtgagccaagattgcaccaccgcactccagcctgggggacagagtgagactccgtctcaaaaaaaaaaaaattattcagtgaaagtggatcatcataaataaagatcttcatcctggtctctgtgttgaggaagaggagggggttggtcttggtgtctcaggggtggcagaggtagaaaaaaagtccacgtttaagtgcacctgcacaattgaaacccgtgttcaagtttcaaatgtatcttaagatttacttaatcgttgtaacaacactttgaggtacctacatcattcttacgatggggaaactgaggcagagaccgtaagggcgggcccagggggcatgtgaacccagagtgtctggcttccaagactcgtattcaccgtggtgccgtttgacatgatcaggataatggatccctggttccttttgggggcagcattggagaagggggtttggcaccgtcagtctgacagcagggctggctcctgcagtgtgaatgaagcggtcttgtgctcgactgtgaaggggggttaggacctgcttcccagggcgggtccagctttctgagggaaagccttcagagcctccatcaggccggcaccaggtaccagttaagcactgggcagggaacagaagtggtcaaacgccgcttgccgcgacttgaaactgctgaataaatggataatgtcaagcgctatggcttagggcagtagtacctccggttcctacgatcgtgtctggggtccctgaggagcaaggcaagagtcggccattcaggaggtcagagttcagctgttcttgcacaagcagggaagctgagtcaccccaaacacgggcaagactagcggtggtatcaaatggctatcaggggcggggcctcaggggcctgcccctgcctccccgccctgcgtttggattccctccagcattccgggccagggcgcgggaggcggaggccgaggagaggacgggaggaggctgcatcctgccctggtgcgtcaggaagggccgagcgagcgggaaggaaagcaccaccccccacccccgccgcggccacacctgggttctccaggcgggcaggggggcccccgggccggcgcctggctccagcaagtctgggccgcctccccgcgccgccccgcgggggccgccagatgggctgcccgcccgccagctcagcgacgcaggcaggaaacgccggccgggctgccaggaacgcgcgcaggggagggggcgggcccggccgggccacgcccgccggaggggaaggaggggccaagcaccgcccggcggggactggtgagctccaagagcctgcgatcccggtccctgcctttactagatgggtttccttgggtaggtcgttttacttctctgtgcctcactttccctacctgtaaagcggggctgcctgtctccgctctttttcccttttctcttttatttgtgcagcagggtttcactctgtcgcccaggctgaagtgcagtggcgcgatcacggcccactgcaacctcgacctcctgggctcaagcgatcctcccacctcaggtgggaatataggtgtgtcccaccacgcctggcttttttttttttcccctagttgaaacggcggttctcactcttgctcaggctggtctcgaactcaggctcaagcaatcttcccacctcggcctcccaaagtgctgggattagaggcgtgagccaccgcgccgtgcctcagctattttcgtgtgaccgtgtgatctcaggacactttctttcccttctcttccttggttttcttacctgaaaaatggggtgaacaattgaacctccctcaaccatgggctaagcctttgttttcctctccaccgtagccccaacacttggcccattgcctgaaacatgaaggcactcagtatttgttgtaagagtgactataaaggtttgggacaatcctgagggcctggctacagcaggcacttcataaatggacacaaattatcaaattacctagagtctaatgtttaccaacctgcggcttcaggcaagtgacttcccatctctgagcttcactttcctcgtctacataatggctgtgaggattaagtaaaataaataaatacatggaaatcacacatagtgtgttctcaatagatatttatggaagagtctccaaaatattaaaaaaagggagatactattttgagtaaatttgagggcaaggaatatacaaaggagttaggtggcttggaagaagatttttgctatatatgtaaactaagctgtgtgtgggtgggtattttgcttgttggtttttgagacaggctctcactgtagtccaggctggagtgcagtgtggcagtcatagctcactgtaaccttgaactcctgcactcaagccatcctcccacttcagcctcctgagtagttaggactacaggtgcgtgctaccacaccctgctcactttgcattttttttttattttatttatttatttttttgagacatagtctcgctgtgtcgcccatgctggagtgcagtggcgcaatctcggctcactgcaagctccacctcccgggttcatgccattctcctgcctcagcctcccaagtagctgggactacaggcgcccaccaccaccctggctaatttttttttgtatttttagtagagacggggtttcaccgtgttaaccaggatggtctccatctcctgacctcatgatccgcccgtctaggcctcccaaacatgctgggattagaggcgtgaaccaccacgcccggcctcattttgtatttttaaaactttggcccgggcgcgctgtggctcacctctgtaatccagcactttgggaggccacggcaggcagatcacgaggtcaggagttagagaccagcctgaccaacatggtgaaaccctgtctgtattaaaaagaaatatggtcaggtgcagtggctcacgcctgtaatcccaacacttcgggaggccaaggcggactgatcatttgaggtcaggagtttgagagcagcctggccaacatggtgaaatcccgtttctactaaaaatgaaataaaattagctgggtgtggtggcacgcgcctgtagtcccagctactcgggaggcagaggcaggagaattgcttgaacccaggaggtggaggttgcagtgagccgagatggtgccattgcactccagcctgggcaacaagagtgaaactccgtctcaaaaaaaaaaaaaaaagaaaagttttttaattaggctggacatggctcacacctgtaatcccagcacttgggacgcaaaaggatgtagaatgcttgaggccaggagttcaagaccagcctgagcaacatagcaagactcctcccaatctctaaaaaattttcttggccgggcgcggtggctcatgcctgtaatcccagcactttgggaggccgagacaggtggatcacctgaggtgaggagctcgagaccagcctgaccaacatggtgaaaccccgtctctactaaaaaatacaaaaattagccaggaatggtggtgggtgcctgtaatcccagctacttgggagcctgaggcaggaaaatctcttgaacgcgggaggcagaagttgcaagtgagccgagatcatgccattgcactctagcctaggcaacagagcacgactccttatcaaaaaaagaaaaaaaaaaaaaggtcgggcacagtggtttacgcctgtaatcccagtactttgggaggccgaggcgggtggatcacgaggtcaggagtttgagatcagcctggccaacatggtgaaagcccatctctactaaaaaaaaataacaaaaattagccaagtgtggtggtgggcagctataatcctagttacttaggaggctgaggcaggagattgcttgaacccaggcgggagaagttgcagtgagccgagatggtaccactgcactccagcctgggcaacagagggagactcagtctcaaaaaaaaaaaaaaaaaaaaattaggctggacacggtggctcacatctgtaataccagcattttgggatgccgaggtgtgtggattgcttgaggccaggagtttgaaactatcgtcggcaacatagcaagacttcatctttacagaattaaaatttaatattagccagaaatgatggcacacacctgtagtgtcagctactcacgaggcagaggcaggaggattgtttgagccaaggaggactgcttgagcttgggaggtcaaggctgggtgagccatgatagtgccactgcacttcagcctgtgcaacagaccaagaccaggtctcaaaaaaggccgggcaccatggcttaagcctgtaatcccagcactgtggtaggccacggcaggtggatcgcttgagcccaggagttacagactggcatggacatcatggcgaaactatctctacaaaaaaatacaaaaattagccggatctggtggctcacacctgaggtcccagctactcgggaggctgagatgggaggatcacctgaactggaggtgagccatgatcgcaccactgcactccagccttggtgacagagaccctgtctcagaaaaaaaaagaaaattagatgtaaaaaacattgaaaataaaacagcacatttggccacccatagattactttcagatttttttctatgctttttttttttaacccaaatcagatctaaatgaagtattttttccatagttaactttcttcccatttcagtcagttgccatttcatctcacacccagacagcatccaacctttgtcattttaaggcagacaggtgtgacaaacaaggctatcttcatgtgaaggcagacccctgcagagaatgcctggtggagtctttgatgggccctccctactgccttcccaaaaccatgggtcccagctctgtgccccctgggatcagcccagttgggggtacccagcgaaggtgctgcttcaagacccccatgggcctgtccacctcagacaggtgctttcctttgctgccagacccccatgggcctgcccacctcagacagatgctttcctttgctgccggaagctggccacccaccccctctcaggctaccccaggtcccagctgggctctgaagtgcgggaggggaggtggaggcactggtaacactcagatgcagaggtggtgagggaaaacccagggtactgagtctggaaaacagatttcttaggtgtggactttgggggagaagctgagcctctttctgcctgaccgggatcctttcttcttgacaggttctctatgcaactatgcgtgcatgttgcggggacggggtaggtgtttgactgacagtgtctgctcctgtgagaatctattctgatggaccgggtttggtggctcatgccagttatcccagcactttgggaggccaaggcgggtggatcaccttaagtcaggagttcacaaccagcctgctcaacatggttaaactaaaaatacaaaaattactccggcgtggtggcacacacctatagtcgcattgtgtctgtaattggcaggttcttggtctacactgacttcaaaaacgaagctgcagaccctcgcagtgaatgttacagttcttaaaggcagcgtgtctggaatttgttccttgtgatgttcggatgtgctgggagttttttccttctggtgggttcgtgatctcactggctcaggaatgaagctgcagaccctcgcggtgagtgttacagttcttaaggcggcgtatccggagttgttcgttcctccccgtgggtttgtggtctcgctggcttcaaaagtgaagctgtagacctttacagcgagtatcacagctcacaaaagcaatgtggaaccaaacagcaaaaaaaaaaaaaaaaaaaaaaaaaaaaaaaaaaaaaaacaccaccacacacacacaccccatgcagaaaggaaccccagtacattaccactgcagagccgggcagcctgcttttattctcttatctggccctacccacatcctgctgattggtccattttacagagagctgattggtctgtttcacagagagctgattggtccgttttgacagggtgctcattggtgcttttacaatccctgatctagacccaaaagttctccacgtccctactagattagctagatacagagtgctgattggtgtatttacaaaccctgagctagacacagattgctaattggtgcatttacaaaccttgagctagatacagagtgcctattggtgtattcacaatcccttagctagacataaaggttctccaagtccccaccagattagctagatacagagtgccgattagtgcatccacaaaccctgagctagacacagggtactgattggtgtgtttataatcccttagctagacataaaggttctccaagtccccactagactcaggagcccggctggcttcaccctgtggatcccgcacaggggctgcaggtggagctgcctgccaatcccaggccgtgtgccgaccgcactcctcagcccttggggggtcgatgggaccgggcgccatggaggagggggcggcgctcgtaggggaggcttgggctgcacaggagcccatggggcgggggggcatggcgggctgcaggtccccagccgtgtcccacggggaggcagctaaggcccggcaagaaatccagcgcagcgccggtgggccagcactgcttggggacccggtgcaccctctgcagctgctggcccgggtgctaagcccctcactgcctggggcggcgggccggccagccgctccaagtgcggggcccgccaagcccatgcccacccgggactctagctggcccgcaagcgccaggcgcagccccggttaccacccctgcctctctctccacacctccccgaaggctgagggagccggctccggcctcggccatcccaggaaggggcttccacagtgcagcggcgggctgaagggctcctcaagcgcagccagagtgggcgccgaggccaaggaagccccaagagcgagggagggctgccagcacactcacctctcgccatctactcaggaggctgaggcaggagaatcacttgaacctgggaggcggaggttgcagtgaactgagatcgcaccactgcattccagcctgggcgacaaaatgagactgtctcaaaaaaaaaaaggagagtctatgctaatgtttgggtttctacaagttgtgggtaatggtaaagttgaaatcttacgtggaccagtgctgtagatgggtttctatatggttgtgattgtgaatgcatgattgtgtgtttgtgtctaagtatgtttaggagtatgtgtttctgagaacatttgtgagcaagtgcctgcattggtgggtgggtgtgtgtaattggtgtgtgggtataagagagacagatcatgtggaagtgtttgggttgataaaagggcttttgcaagggcattgcctgtgcgagtttgtgaatgtgtgctgtcccatctgcttgcttgcttgttttttttcttttttgttttttgagacggagcttcgccgttgttgcccaggctggagtggaacagcgggatctcggctcaccgtaacctccgcatcccaggttcaagcgattctcctgcttcagcctcccgagtagctgggattacaggcatgcaccaccacgctcggctaattttgtatttttagtagagagggggtttctccatgttggtcaggctggtctcgaactcccgacctcaggtgatctgcccgcctcggcctcccaaagtgctaggattactggtgtgagccactgtgcccagccctttctgcgtgtgtgtgtgtgtgtgtgtgtgtgtgtttcaggtcttgtttctttggttcatgcttccctttgcctgggtcatcccccagtggtgcagtcacagctcactgcagcctcaagctctcaagctcctggtctcaagcaatcctcccacctcagcctcccaagtagctagaactacatgtgtacaccactggcctggctaattttttttttttttttttttttttttttgagacagtgtctgcctctgttgcccagggtggagtgcagttgcgcaatttcggctcactgcaacctccgcctcccgggttcaagcgattctcctgccacagcctcccaagtagctgggattacaggtgcacgccaccacgcccggttaattttttgtatttttagtagggacggggtttcaccatgttggccaggctggtctccaatttctgacctcaagtgatgcgcctgccttggcctcccaaagtgctgggcttacaggcgtgagccacaacgtccggccaggctaattttttaatatttttgtagagacgggatctcactgtattgcccaggctggtctcaaactcctatcctcaagcagtcctccttcctcagcctcccagagtgctgggattgcaggcatgagaccccgcacagtctgtttctacagcggcctctctgcggcttcctctcttctggcctcatggagaaaccccagaaagagcatagactctggaattagagaaacagggtttggaattctgtgccattctctccctgtgtggtttggccaactgattcaaaggctgtttcctcatttgtaaaatggagatatatagtcagtggtccttgttattatctccctgctacctgcccccttcccaaacaccagccagtcttctctgctctggccaaattgataatagcttttgtttttcaagcctaaaaccagcttcttccaatttgctcagcagctatttgctaatcatccagagtgacctaggacgtatttacatgagcggaagagccactcggggagagtgctgctgggaatgcctccacagagatgctgattgtacgcatgctgcgtaagcctcagatttttctgttcaggcccaaatgcgcagcacaatctgtgggaaagttgcaacagagaaagcaaaaaaaaaacaaaaagcaaaaaacgagtttttacttccttaataaaattggttttggtgctcactttggcagcacatatactaaaattggaactagacagagattggcattgcccccgagcaagaatgacacgcaaattcgtgaagccttcaataaaaaataaaataattttgttttcccaatctgtgtctcttttaagccccacaggatagaaatgtcctaaaataagaaattaaataagaggggaagccccatgatctgttctggtttttttgggtggtggtggtggtggtgttttttaatgggtctctcaggattccaccagacccacttcccagccgctgtgtggtctgggcctgagaacaccaagccccccgacctgcggcccacgcccacccaccacccagcctcggcagtgctttcccaggattcacatggtaatgaaggcatccatcttctcccagacacacactgggccctgcgaccctcccagggcccacacaatggcccacagcgccgcggccccaccacctgttggattttcccagggaagggagtgagggggtggaggggaagggcagtccgtctcttcccagcccccagccccatttgcaccctggtcgcaagagtcagtcagcgagggcacccatgtcctcggactctcagtccatcctcagcaccctgtttcctcatcctcaaactgcaaggtggttgggaggattctaatgggaatggtagtaaggacacgctcaggaactgtggattgccagacaaagagagcaaaaggccgggcgcggtggctcacgcctgtaatcccagcaccttgggaggccaaggtgggcggatcatgaggtcaggagttcgagaccagccttgccaaaatggtgaaactcccatctctactaaaaatacaaaaattagccaggcgtggtggcgcgcgcctgtaatcccagctactcaggatctgaggcaggagaatcgcttgaacccgggaggcagagcttgcagtgagccgagatcaccccattacactctagcctgggcaacagagcgagactccatctcaaaaaaaaaaaaaaagccatcaataataatgaacttgataatgactaattaataataaacaggctcatgcctgtaattctgacactttgagaggccaaagttcaagcgggaggattgcttgaacccaggagttcgagactagcctaggcaacatagcgagatcccctctctacacaaagtacaaaataataataataaacaataataaggccggacaaggtggctcacacgtataatcccagaactttgggggtggaagcaggtggatttcttgaggccagtaacttgagaccagcctgggcaacacctgtctctaaaaaaatacaaaaattgggctgggcatggtggcttccgtctgtaatcccagcactttgggaggctgaggcaggcagatcatgaggtcaagagatggagaccatcctggccaacatggtgaaacccaatctgtactaaaaatagaaaaattagctgggtgtggtggcatgcacctgtagtcccagctacttgggaggctgaggcaggagaatcccttgaaccaggaagcggaggttgcagtgagccaagatcgcgccactgcactccagcctggcaacagaacgagactccgtctcaaaaaaaaaaaaaaaattggccaggctgcagggctcatgcctgtaatcccagcactttgggaggccacagcaggtagatcacctgaggtcaggagttcaagaccagcctggcgaacatggtgaaaccccatctctactaaaagtacaaaaattaactgggcgtgttggagggtgcttttaattccagctactcaggaggctgaggcaggagaatcgcttgaatctgggaggcagaggttacagtgaaccaagattgcaccactgcgctccagcctggataacagggtgagaccctgtctcaaaaaaaaaaaaatatatatatatatatatatatatatatatatatatatatatatacaaaaattagttagggcccggcgcagtggctcaaggcctataatcccagcatgttgggaggccgaggcgggcagatcacgaggtcaagagatcgagaccatcctggccaacatggtgaaaccctgtctctactaaaaatacaaaaattagccgggagtggtggtgcgtgcctatattcccatctactcaggaggctgaggcaggaggagacttgcttgaaccccagaggcagaggttgcagtgagcctagatcacaccaatgcactccagcctagcaacagagtgagactccgtctcaaaaaaaaaaaaaattagctgggattttagatgtgtaccaccatatccgactaatttttatatttttagtagcgacggggttttgccaagtaagccaggctggtctcgaactcttaacctaagtgatctgcccacctcggcctcccaaagtgctgggattacaggtgtgagccaccacacacatctgagttgtacaatttaaatgggtgaattgtatggtatgtaaatcatctctcaataaacctgttaaagaaaaaaaagggggctgggcgcggtggctcacacctgtgatcccagcactttgggaggccaaggcgggtggatcacgaggtcaggaaatcaagaccatcctggctaacatggtgaaaccccgtctctactaaaaatacaaaaaattagccaggcgtggtggcatgtgcctgtaatcccagctactcaggaggctgaggcagaagaatcgcttgaacccgggaggtggaggttgcagtgtgccaagattgtgccactgtactccagcccgggcgacagtgcgagactgcatttcaaaaaaaaaaaggtaaattctagaaatgctcctgtttctgagcatccagtacaatgataaggcaatcactacctccaaggtccccacttcccatatccctcccccactgcactcccatcccacttccaggtggctatgactgagcaactattagacctaattaatcatgggtccaggtgagttttgcccacttgttgttcacagatgtctccaaactacacaatctcagagtgggtaaaaaccccagggccatagggctttttttaatcttttctggatccagacctctcccctttatattttaatttcatttcatttttgaacatgtattacctaatacatgttcctgatacaacgctgaaaaacaacggatgtctcccttcttccctattggaggcagccacagtcatcagtttcctagtgagatacaagcaaatacatatgtaattttgtttgtttgtttgtttttttaagaaactgggtctaggctggcctagaactcctgggctcaagtgatccttggcctcagcctccaaagtagctggagctacaggagcatgccaccatgctccacttcagacacaagtggtgtttccatacagggtcagttaaaaacaacaaaaaacactgatggtgatgagacatgaatactaataggtggtcacatgagaatagaaaattgcaggctaggtgtggtggctcacacatgtaattccaacgctttgggaggccaaggaaggaggacctcttgaggccagaagtccaagaccagcctgggcaacatagtgaaactccgtttctacaaaaaaatacaaatattggccaggcgtggtggctcacacctgtaatcctagcactttgggagactgaggtgggtggatcacttgaggtcaggagttcgagaccagcctggccaacacggtgaaaccccatctctactaaaaatacaaaattagccagacgtcgtgaggcacacctgtaatcccagctacttgggaggctgaagcaagagaatcggttgaacccaggaggcagaggttgcagtgagcttagattgtgctactgcactccagcctgggcaaagagcaagacaacatctcaaaaaaacaaaacaaaacaaaaaaaaacaaaaaactagccaggtgtgatagtgcaagcctatagtcccagttcctcaagaagctgaggcgggaggataaattgagcctgggaaatcggaagccttgactcccatttctggatgggagaggtagctaaattttttttttttttttttttttttgtgacggagtctggctctgttgcccaggctggagtgcagtggtgtgatttcagctcactgctacctctgcctcctgggttcaagcgattctcctgcctcaggccctgagtagcttggattacaggcgcctgccaccacacccggctaatttttgtatttagtagagacagggtttcaccatgttggccaggctggtcttgaactcccaacctcaggtgatcctcccgcctgggcctcccaaagtgctgggattacaggagtgagccaccccgcctggcgcctaatttttatcaccagatgagatcacagatattgcacttactgtgttgtcccccacagaataaaaaccgcacaagactgagacttctgttgattctgttcactatatacaagcgtaaaaccaaaaataaaatgctaggggcccccaaccatctgaacggacccctcctctctgccaagagcattccaaaatgaatttgaaaaatgagtttaggccatgatggaagcgggtgagggggaagcgtcgaacttgtctcattacaccctccttccttttggaattcaggaaaagctgactagcattaacatcaacacagacgttaagtctgataagaaacatttacagtctattcttacttaaacctgccacctggaggtttcatctgcataataaaaccttggtcgccacaaccacttattgtaacccagacattcccttctacaaccctgggcacactcctgaggctgtgtcatgggtacatccttaacctcggcaaaacaaaagttctttttttttttttgagacggagtcttgctctgtcgcccaggctggagtgcagtggtgcaatctcggctcactgcaacctccgcctcctgggttcaaatgattctcctgccccagattcccaagttgctgggatgacaggcgcgaaccaccatgcccagctaatgtttgtatttttagtagagatggggtttcaccatgttggccaggctggtctcaaactcctgacgccaggtgatccatccgcctcgatctcccaaagtgctgggattacaggcgtgaaccaccaagcccagccgtttttgtttgtttgtttgttttattttttcaatgtagagacagggtctccttgtgttgcccaggctggtctcaaactcctaggcccaagcaatccatctgctttggcctcctaaagtgctactattacaggtgtgagccactgtgctaggccaaaataaactttctaaattgattaagacctgtttcagatgcttttgggttcacaccagtcataatagattagtacaacaacaatattctgctcactgtaatatgccagcgctggcccacagcctggcaagcaagagatgctccacagcttccagaatcctggactccagccccagccctgcctggtactcgctgccaccgtggacaagttacttatcactcaggagctccctgttcatagtccctcacctgaaagggatttttttttgagacggagtctcaccctgtcgcccaggctggagtgcaatggcgagatctcggctcactgcaacctcagcctccgggttcaaacgattcttctgcctcagcctccagagtagctgggattacaggtgcccgccaccacgcccagcttttttttttttttttttttttgtgagacggagactcgctctgtcgcccaggctggagtacaatggcgtgatgtcttctcactgcaagctccgcctcccgggttcacgccattctcctgcctcagcttcccgggtagctgggactacaggcgcccgccaccaccacgcccggctaattttttgtatttttatagagacggtgtttcaccgtgttagccaggatggtctcgatctcctgacctcgtgatccggccgcatcggcctccgaaagtgctgggattacaggcgtcagtcaccgcgcccggcctacgcccagctattttttatatttttagtagtgacggggttttaccgtgttggccaggctggtgtcgaactcctgagctcgtgatccgcccgccttggccttccaaaatgctgggattacaggcgtgagccaccgcacccggcggattgattttttttttttttttaactttttcattctgtctcggctgcttaaatcagaatagagacgaccttcagcacagagtggctgtaagaattaaataagataatgctttaaagcgctggtaagagctttataagtatcagcgaacactgctgccactatgctcatggtggtgtggcagacagcggggtgcagaagaagaggggtggggggaaggcggtcacatagggcaggggggttcagaccagattcctgagatgtcatttttagtactctccagcaagaaggtgggacggctggtgtggtggaggaggctagaggtacaagcttcacctgagatgtccttagaccctgacctcagctcccaccgtcctagtggtgccgggcggcggccacgccagccgcaccttcccccggccagcccagagctgccgctggggaagggcggagggaaggcaagctggtttttcccaggctccccccgctcctggaacatctggccgcgaacatctgcccttcgcttttgtggcgcggccgcaggccggcctcgcacccatctgccgcctcaccggcccccgccccatctgcgcgccgctcccctggggcggttcctggcgccctcgcccccgcccgccgggcctggttcccacgggccgagtgcgggaagccggggcggcccatctgccgcgagcggctgccaggcgcggcgagtccagcgccgaggcgtccccaaagggcgggaccggcgcccagcaatgtctttcaggcgggtgcgcccccgaacaaagtcggggtgcacggcctctccccgcgcggctggacccaaagtcgctgcccggggctgctgggtccaagagcggccgccgcccctcctgcttctccccagaagggcccgcgtgcccccgctgtccgccgcccaacacccgctcttcctcctgcaccgaacacttcgggctcactgacgcgccgtctccatcctaagccccaaaccttcaaagtgcaggagacaactgtcacgtcaccctgcaaaaaatgctaacgtctgataatataaaatgctggtgtggacgtgggaaaatagaaactcccaactgcgttggcccctcagcctggaataccccttgtcctcattgcctgcttaactcttgattttgtgaaatataaaaagtaccgagaaatatagcgatttatgttcctaataccacattcccaccacccaggactgacaactgtcagctgtatttgcgcctatttctcctcctccaaagaacaaacctttacagatagtgctcctgtctttttgtgttttttgttttgttttgctttgttttgttttgttttgttttgttttgagacagagtctcgctctgtccccaggctagagtgcaatggcgcaatctcggctcactgcaacctctgcctcccgggttcaggcgattcccctgccccgtagtcctccccagtagctgggactacaagcgcatgccaccacacccagctaatttttgtatttttagtagagacggagtttcaccatgttgtccaggatggtttcaatctcttgacctcatgatccgcccgcctcagcctcccataaagctgggattacaggcatgagccatcgcccccggcctttttgtgttttttgtttgtttgagacagagcctcactctgtcacccaggctggagtggtgcagtggtgtgatcacagctcactgcagccttgaactccagggctcaagggatctgcccactgcagcctccacagtagctgggactagaggtgcccatcaccaggagcagctaatttttgttttgaagagacaggtctcactatattgcccaggctggtctggaagtcctgggctcaagtgatcctcctgccttggcctcccaaagtgctgggattacaggcatgagccagcaaaccgagccactagccttcttttaaccagggccctcttcccttttctctaagactatttgccaccccacccaccatgcaatcccccaattactattaatataatgacttgggtgttttcttccgggttatgtttcttgttacttttactacatgtaaatatattagcattgtgtgtttttttaaatttatacttctaaaaaaatcattctgcattttccctaagcaacattatgcaggtatctagcagaatacacacagacgtagctcattcctgttcaatgctgggtacgattccatcaccatttccctgttttcttgtcattggacaagtaagtagttttcaatttttgggttttttttttttttaattaaaatagacatggagtctcgctatgttgacctggctggtcttgaactcctggccttaactgatcctcccatctcggcctcccaaaatgctggggttacaggcatgagccacttgcaaccggcctagttttcaatttgttgttgttgtagaaatggctgtcacattcttgcccacatctgctttcttgtgtgcaggcctcccagggtatgtccgtgggagtgaatcactggctcatagggtgttttcaaatgttcacttttggtggatattgccaaattgagttcccaagtggtcataccagtttacacacccaccagcactggatgagtgttattttcccacatgctcaccaacattttttttttctttgagatggagtctcgctctgtcgcccaggctggagtgcagtggtgcgatctcggctcactgcaagctccgcctcctgggttcacgccattctcctgcctcagcctcccgagtagctgggaccacaggcgcccgccgccacacccagctaatttttttgtatttttaatagagagagggtttcaccgtgttagccaggatggtctcaatctcctgacctcatgatctgcccgcctcggcctcccaaagtgctaggattacaggcgtgagccactatgcccggcttcaccaacattttctatattatcagactttaaacttttgttttattaatttttttctttttgaagacaggcctttattttaattttattttttgagacagcatgtcactttgtcacccaggctgaagtgcagtggcagcatctttgctcactgcagcctcaacctcccaggctcaagtgatcctcctgcctcagcctccctggtagctgggactacagacatgccatcatgcctgtctaattatttccttaaactattttcttttttttttttgagacggagtttcgctcttgtcacccaagctggagtgcaatggcgcgatctcggctcaccgcaaactccgcttcccgggttcaagcgattctcctgcctcagcctcccgggtagctgggattacaggtgcctgccactatgcccgtctaatttttgtatttttagtagagactgggtttcaccatgtaggccaggctggtcttgaactcctgacctcaggtgatccacctgccttggcctcccaaagtgctgggattacaggtatgagccaccacgcccagccctttaaaatattttctggagatgagatctcactgtattacccagtctggtctcaaaatcctgcgttcaagtcatccttccaccttggcctcccaaagtgctggaattattggtgtgagccacgtgccaagccagactttaatgttttttgcagggtgacacagcagttgcctcctgctgacatcccagatatgcaaatgctggggctcaggagcatcggcctaacccttcctcactttgtctgtctcagctggactatcacctcctccttcaggaaggcctccccagtctaccttagctgactggcagcttcccataacctcgcgtgctttcccatcacagcactgggaacttgaggggtgactgtctcattatggtctgtcttccccagcggactgtgagctccccaggaagaggtcacatttgcagggccattgaacaggctgaaaggaacacaaagttgctacaaatagtacttttgtggaaggctccatctacttgaagtaaggagttcctttctctaattcctacaaagtacgcccttgggatggcagtagctcacctacccaccacacctctgtgtcctcagcatctggatacagcagcaaggaagcaccacatggctggtggtgtttattcccatttgggtaccctcaactaaatgtagctctgaagagcatgagcctaggtcatgttctttccatgctttgcctagcacaaagcaagtgtacaataaccatttattatttaatgattctaaagctctgtatttcagtggtggaggatatacccaattagaggtattatagtcactgtaataataactagtgcctactgaatgctgactgccaggaacctgtgtggtttttttcttttcttttccttcttttttttttttgaaacagaatctcacccacgctggagtgcagtggcgcaatctcagttcactgcaacctccacctcctgggttcaagcaattctcctgcctcagtctcctgagtagctgggattacaagcactctccaccacacctggctaatttttgtatttttagcagagacggtttcaccatgttggccaggctggtctcaaactccagacctcaggtgatctgccctcctcggcctcccaaagtgttgggattacaggcgtgagctactgccccggccccagctttaacaaaatttttttttgtagagatagggtcttgctgtgttgcccaggctggtcttgaactcctggcctcaagtgatcctcctgccttggcttcccaaagtgctgggattacaggtgtgagccacctcacccagcccctcttttttttttttttaatacggtctccctctgttgcccaggcaggagtgcaatggcaagatcggggttcactgcggcgtcaactcctggacttaaggaatcttcccatctcaacctccccagtagctagcactacaggcatgtgccaccaggcccagctgatatttttttttaattttttttttttttttctgagacagagtctcactctgtcgcctaggctggagtgcagtggcgcgatcttgcctcactgcaagctccacctcctgggttcacgccattctcctgcctcagcctcctgagtagctgggactacaggcgcccgccaccacacctggctaattttttgtatttttagtagagagagggtttcaccgtgttagccaggatggtctcgatctcctgacctcgtgatccacccgtcacggcctcccaaagtgctgggattacagacgtgagccaccgcgccgggccttaatttttaatttttattattaatttatttatggagaggtcttgctatgttgcccacgctggtcttgaattcccggcctcaagtcatcctcccacctcagcctcttcaagtgttggtattacaggcattagccaccgcgcccagacttaaatcacataaactctttttttttgagaccaagtcttgctctgtcgcccaggctggagtgccgtggcacgatctcggtttactgtaacctccaccttcctggttcaagcgattattttgcctcagcctcctgagtagctgggactacaggcgcgaaccaccacgcctagctaatttttttttttttttttgagatggagtcttgctctgtcgcccaggctggagtgcagtggtgcaatcttggctcactgcaagctccgcctcctgggttcacgccattctcctgtctcagcctcctgagtagctgggactacaggcgcccgccaccacgcctgtctaattttttatatgtttttagtagagacggggtttcaccatgctagccaggatggtcttgatctcctgacgtcgtgatccgcccgcctcggcctcccaaagtgctgggattacaggcatgagccactgcacccggcctttttttgtattttcagtagagacagagtttcaccatgttggccaggctggtcttgaactcctgaactcaaagcctgccttggcctcccaaaatgctgggatcacaggcatgagtcaccgcacctggcctatagcttccttttaaacagcacatcgttgcttttgcatcagccagaaaaaaaaaatactttttagaagaaaacgtacattatcatgagtcatagtatttgaggagtacagctctgaagcggcctgaggtgagggtgcagctggaggcgccgccccctggtgactgggtactcagggttgggttgagccaggagggtggtggttgcctcaggctctgtgaggtgggcagggagctgggcagggagctgggcggggtcctgagacattcaacctcagctggttcctgggttccgggccctggagcagtgagggaagccagttatatgggaggcaggtgagtcaaaggagggtcaggctgggtgccagagaggagggccactgcttctgtgagggggcctctggggccttccgtccatcacccagtgggcatatggggacaccaccgaggcccagagacctcttgcccagtctccccactctcacctcagaggtccttgcagctaggggcagtggcctctgctgagctttgcccagggtgtagccagttggcctcagggcactcctgactggtggcatgagcctcccaggctgccagggtcaggtcagctcccacgcctccaccctgggcagggcccaggcctgcattcatgggtgcaagaggagagagaggcctgagccctggatgggtgtggttgtgtgtccttggggctgatgcaggattttttttttttttttgagacgatgtcttgctctgttgcccaggctgcagtgcagtggcacgatctcgtctcactgcaacctccatctcctgggttcaagcaattatcctgcctcagcctcccgagcagatggagttacaggcgtgcaccaccacgcctggctaattttcgtatttttagtagagagggagtttcaccatgtgggccaggctggtctcgaacttccgacctcatataatctgcctgccttggcctcccaaagtgccgggattacaggcgtgagccaccgcacctggcctttctgcaggattctgaattgtgtatgtgtggagagtaaggggactgtgtgctctagaagggctgtggtgggaggtctctggcctggtgcaggtgggtgttggttgggtctgtgcactgtgggagtgggtgcctgcaggaagccagtttatccttttgcaggcagtggacttctctaaggctgcgggcatgtgtgttggcatcttggagtcccaggtgttttggcgtgagtaatactgtatagatgtaagtgtgtgtagtgtttgcaatgttgtagtgtgggtgcatgtgtctgtgtgtcctgtttgttgagaggattcattgcatgtggttctgttaggagtgataatggggtgttttgagacatttcctccttggtctctattttttggtgtgttggttatgcagatttggtgtttcggtagtgtgcgcggaggtcagtgtgttggttgtatattatggtgtactgttgtgcgttgtgcatttggcaggttgtgtctattggtgtgtggctgttgggtttgtctgttgtgtcagtcgtacatataaatgccacgttgggcgtgtgggtgtgtgcatttgtatattgctctgtgggtgtgcgaagcagtgtgtttgtgtaaccctgcaggtttggcctatgctgagtaacctaagatgggagctccctgagccttggctctgcccttgcctttggctgctggagaccctgggcagcaatggccctttgtccagccacaggaaaaccccacccccctccatcggcaggggacttgggaggggcccagactggtaggctccagcctcccgtccattgttctggggcctctctggaaaacaggatgggaggtgaaaggtggacacaggcctggacccccacactccctgaaacaacccaggggcacagcacagaatccttaggagggagggcctggggacagtccccattttgtggatgagaaaactgaggggtttcattcctattaaaagggagagagcctgaagccccacaccctttatgtgcccacccacagcctcctgccgggtttgggggatggaaaaatgacaccccagaatggaaacaaaacggtctattgtggtttccatttctgaatgcttaccatgtgctaagtgcagaagtgtcataactctgcaggttaagttcatattttgtacccattttgcacaggagtacactgaaccataaggcaacaatttattcttcaaaggacactactctaaacattactgtatttcaagtagtacgctgtgtgaccttgagcaagttgcttaccttctctgggccaggccctagttcagctctgggacacagcagtgaccaaaggagccgtggttcctgctctcttagagcccatagcctgggcagggaggaggaggcaaggaatggcaaatacacaagaaaacaaagatcatttctgatggtaatgaattcagtgaataagagcaggagaatgtaaaagaaagtagcctagggggatctgagaaggcctctggggaggcgacatttgacctgagacttgaagaatgaggagtctggcaaagacctggggctgatcagtgttctaggaacaagtaacagcaagggcaagggccctgaggcaggacagagctattaatagtttaaggagggaggcctctgggctggtgagagaaagggaaggggcccagttgggtagtgggcaggggaggagtttggatcttattctccgtgagatgtgctggttctggtggtagtgggggggcctgtagtctcctgttacaagggttgggggtgtggggacagccagagccaaaggtctctcccccacagctccggcagtcccagcccagaggcgccggcctggcggctggaagattgcactgtgggcacatctggggagcagctgccgagccagggccagagtgggtcacgtggcacagggcaggaccgtcctggagcctacaaggccaagactcctaggaggggcagtggagaacactctggacgagaacagtgcgtcaacgaggaggaactgtgcactgtagacgtccaggcacacggccccctgcagccccacacagcccctgcctcaggacagagtgcctgggttcaatgccacctcccagctttgtgatctgaaacaagtcactcaacctctctgggtctcatggcctcagctgtgaaggggacatgatattactaccacagttccacaggctgttctttttttttttttttttttttttttttttttaattttttgagacgcagtctcactctgttgcccaggctggaatgcagtggcaccatctcagctcactgcaacctctgcctcccgggttcgagcgattctcctgcctcagcctccctagtagctgtagtagctgggactacaggctcccgccaccaggcctggctaattttttcatatttttagtggagatggggtttcaccatgttggccaggctggtctcaaactcttgacctcaggtgaaccacccacctcagcctcccaaagtgctcccaggctgtttatttctaattcaacaaatattcgttgagcacttcccacatgccaggtgctgcatgaggctctgcgtgacagcagggaacaggacctccgtggtcccttcccttctaagcacacaattaatgctttagaaccaggcctggcattgaggaaactcttagtaaatgtaagccatttgcctggagctctggaggccagaggaggcaccctggaaggcagagaaggaggtgtggtgacagaaaaatcctaaggaaagtgcactcccttttatcaccaggtgctgcagttggctcctggtatggctcatttcactctcacaaccaccctacgaagagggatgagcattagctccaatttatggatgaggaaactgaggcccagtttgtcaatggcacagccaggactggaggcagtgaagggctggtccctttttctctctggggctcaatattcccatctgtgaaatggggcattacaataatacagctgcaccagctccagggagcagttgtgaaatcagatgtgccaggtatgtgaaaagggcttcctgagagactatgaccatgaatgctgggttgggaatatgggggttcatttaaggagccctccgaacttcctggccaccagaagtgtcggttttcctaaggtgactcaggaaaggaggactgggaagaaaatgcacactcaattcacactaccaacaaggccagaaaaatgcccatctgacaacaagataagcaggcaatctttatttaaactccttgtcaggccttaaacatgtaaaagataaggccaggtgtggtggctcatgcctgtaaatcccagcagtttgggaggccaaagaagaaggatcacttgagtccaggagttctaaaccagcctggggcaacatagtaagaccccttctctacaaaaaaataaaaaattagccaggtgtggtggtacatgccagtagtcccagatacttgggaggctaaataggaggatcgcttgaccccaggaggtcgaggctgtggtgagccgtgattgcaccactgtactcagcctggtggacagagaaagagcctgtctccaagaagaaaaaattgcatagaactgaaaacacacacaaaaattagtgcatataaattgggtgaaaactgaatttcatgccatgcgcggtagttcatgcctgtaatcccagcaccttgggaggccaaggcgggcagatcatctgcagtcaagagttcaagaccagcctggccaacatggcaaaaccccatttctactaaaaatacaaaaaattaaccaggcgtggtggcgtgtgcctgtaatcctagctactcgacaggcaggacaattgctcgaatctgggaggcggaggtggcagtgagccgagatcgcaccactgcactccagcctgggcgacagagcactctgtctccaaaaaaaaaaaaaaaaaggccacgcgtagtagctcacgcctgtaatccggcactttgggaggccgaggcggatggatcatctaaggtcaggagttcaagacccgcctgaccaacatggtaaaaccctgtctctactaaatacaaaaaattagccaggcgtggtggcgcgtgccagtaatcccagctacttgggaggctgaggcaggagaatcgcttgaacccgggaggcaaaggttgcagtgagccaagattaatgccattgcactccagcctgggcaacaagagcgaaactccatctccaaaaaacaaaaaagaaaactgaatttcacctgaattctggttgtgatattgtactgtagttatacaacataccaactgttggagtgttagagaggatgtggaagaactggacctctcaaatactgttgataggaatataaaatgatacaaccacctttggaaaacagtttggctgggtttttttgttttgtttggaggcagggttttactctgttgcccagggtggagtgtagtggcacgatgatcttggctcattgtagcctcaacctcccaggctgaagcaatcctcctgcctcaacctcccaggctgaagcaatcctcctgcctcaacctcccaagtagctgggactacatgtgtgcaccaccacatctggctaatttttgtactttttgtaagagatggggtttcaccatcttgcccatgctggtcttgaatacctgagctcaggcattctgcctacctcggccacacaaagtgctgggattacaggcatgcactgtgcccagtgagtttggcagttcttttgtaaagttaaacaaatacggccagttgtggtggctcacgcctgtaatgccagtactttgggaggccgaggtgggcagatcacttgaggtcaggagttcaagatcagcctggccaacatggtgaaactccatctctattgaaaatacaaaacttagccagtcgtgatggtgggcgcctgtaatcccagctactccagaggctgaggtgggagaatcgcttgaacccaggaggcggaggttacagtgagccaagattgtgccactgcactccaggctggacgacagagcaagactgagtatacattcacataaacacctgtatacaagagttcatggccaggcacagtggctcacccctgtaatcccagcaccttgggaggctgaggcaggcggatcacgaggtcaggagatcgagatcgagaccatcctggctaacacggtgaaaccccatctctactaaaaatacaaaaaaaaaaaaaaaattagccgtgcgcggtggcaggcgcttgtagtcccagctactcgggaggctgaggcaggagaatggcgtgaacccaggaggcggagcttgcagtgagccgcaatctcgccactgcactccagcctggacgacagagcgagactctgtctcaaaaaaaaaaaaaagttcatagcagttttattttactaaccaaaaactacgaacaatccaaatgcccctcaccaaatgtctggataaacaaatggtggtatatccatataatggaacactacttagcaataagaaggaatgaccgccggcccggtggctcacgcctgtaatcctagcactttgggaggcagaggcgggtggatcaccacctgaggtcaggagttggagaccaccagcctggccaatgtggcaaaaccccatctctacgaaaaatacaaaaattagccaggtgtggtggcaggcccctataatcccagctactcaggaggctgatgcaggagaatcgcttgaacctggaaggcagaggttgcagtgagccaagatcgcaccactgtactccagcctgggaacagagcgagactccgtctcaaaaaataaaaagaaaaaaggccgggcacagtggctcactcctgtaatctcagcactttgggaggccgaggcaggtggatcacaaggtcaggagttcaagaccagcctggccaagatggtgaaaccctgtctctactaaaaaaaaaaatacaaaaattagctgagcatggtggcgggcacctgtaatcccagctactcgggaggctgaggcagagaattgcttgaacctgggaggcggaggttgcagtgagctgagatcatgccactgcactccagcctgggcgacttgagtgaggctctgtctcaaaaaacaaaaaagaaaaagaaagaaggccaggtgcagtggctcatgcctgtaataccagcactttgggaggccgaggtgggcagatcacgaggtcaggagatcgagaccatcctagctaacacggtgaaaccctgtctctactaaaaatacaaaaaattagccgggcgtggtggcgcgtgcctgtagtcccagctactcgggaggctgaggcaggagaatggcgtgaacccaggaggcagagcttgcagtgagctgagatcgtaccactgcactccagcctgggcgacagagcgagactgcatctcaaaaaaaaaaaaaagaagaaaagaaaaacattagccaggcgtggtggcgggcacctgtagtcccagctactcaggaggctgaggcaggagaatgtcatgaacccgggaggcggaggttgcagtgagccgagaccgtgccattgcactccagccttggggacagagcgagactgtgtctcaaaaaacaaaaaacaaaaacaaaaaaagaccgggcgcggtgactcacgcctgcaagtgtagcatttttgggaagtggaaaagggcggataacctgaggtcaggagttcgagaccagcctggctaatgtggcgaaatcccatctctactaaaaatacaaaaattagccaggtgtggtggtgggcacctgtaatcccagctactcgcgaggctgaggcaggagaattgcttgaatctgggaggtagaggttgcagtgagcggagatcgtgccattgcactctagcctgggtgacagagcgagattccgtctcaaaaaaaaaaaaaagtggatagaaggatatgcataggttttatacaaatactatgtcattttatttattttatgtatttatattttgagacagggtcttgctttgtcacccaggctggaatgccgtggtggcatcttggctcactgcaatctccacttcttgggttcatgaaattctcttgccttagcctcccaagtagctgggattacaggtgtgcaccaccacgccctgctaatttttctatttttagtagagatgaggtttcaccatgttggccagattgatctcgaactcctgacctcaggttatccacctggcttggccttacaaactgctgggattacaggcgtgagccactgcgcctggccctgaattaatttctacagcataattttctctcttatttttatttttttgaatcagaatctcactctgtcgcccaggctggagtgcagtggcttggtctcggctctctgcaacctccacctcctgggttcaaatgattctcctgcctcagcctcccaggtacttgggactacaggcgcccaccaccacacctggctaatttttgtatttttagtagagactgggttttgctatgttggccaagctggtttctctggaattcattgcagtaaacagaattgctggatcaattaattcacagttgaaggccaggcactgtggctcacgcctgtaatcccagtactttgggagtctgaggtggagagatcacaaggtcaggagtttgagaccagcctggccaacatagtgaaaccccgtctctactaaaaagacaaaaaatttagcctggtgtggtggcgggcacctgtaatcccagctacttgggaggctgaggcagaagaatcgcttgaacccaggaggcggaggttgcagtgaaccaagactgtgctattgcactccagcctgggtgacagtctgagactctatctcaaaaaaaaataaataaatagttggtgatggccaggcacggtggctcatgcctgtaatcccagcactttgggaggccaaggcgggcggatcacctgaggtcaggagtttgagaccaccctaggcaacatggcaaaaccccgtctccactaaaaatacaaaaattagatgggcgtggtggtgggtgcctgtaatcccagcctgaggcaggagaatgacttgaactcaggaggtggtggttgcagtgagctgagatcgcgccactgcactccagtctgggcaacagagcgagactctgcctcaaaaataaacaaaaataaacacttggtgatgaattaatactctaatttcctctggttgactgttgttcttccaattatttggcaattcttttgagcagcaaactattccctcccatcattaatttaggattgctaaacaaggcgtagggagtttagagagttttggtgtgtgtggtaaggggatgaggagtctggctaattaattgatgatgtctctctcttttgaagctggtctcactgattggtttggttttcctggtttcctgatgtggaggcagaaggctcctttacttttccctcatcccccgaacttctgtgggaaaacggaacctgctgataactcagtgaattaattgctgcggggtagtgcggtggagcggagcagggagggaccataatatcaccctccactggtgagcacagatttttacccctgctaatgttgtgtggctttgggtgactaatctgagcttcggtttccccacctgtggcatgtccaggactctgcagtcagactgcctgctctcagcaggaagcggttgcattacaacactgtaccctccttataataacacaactatggttatgacttaggcgtcgtgtggagcctcagtttcctttgtataaagaaaccaaagagctcctttctttagagttgtgaaaaagactacagaagttgatcaagccgggtgacagagtaagaccctgtatcattattattttattttgaaacagagtcccactctgtcgcccaggctggagtgcagtggcataatctcggctcactacaacctccgcctcctgggttccagcgagtctcctgcctcagcctcctgagtagctggggtattacaggtgcgcgccaccacacctggctaatttttcatttttagtagagacgggatttcaccatgttggtcaggctggtctcgaactcctgacctcgtgatctgcccaccacggcctcccaaagtgctgggattacaggcgtgagccactgcgcccggccccctgtatccttttttttttttttttttttgagacgagtctcactctgtcgccaggcttgagtgcagtggtgcgatctcggctcactgcaacctccgcctcccaggttcaagcaattctcctgtctcagcctcccgagtagctgggattacaggcgaacgctaccatgcccggctaatttttgtatttttagtagagatggggtttcaccatattggtcaggctggtctcgaactcctgacctcaggcaatccacccgcctcggccttccaaattgttgggattacaggcgtgagccaccgcgcagcccttcattttttaaaataagaaataaatgaaaaaagatgatcaagacaaactcttcatacagtgcccgctgtacaaagtaagaaattaataatggtcacgtttgtgattattatttaaacaccaagcagatattaaatattagggctcagagagggcatgcgacccgcctgaattcactcagctgcagagctggaaagagaactcaggcctttttccccacgctggaaggggtagctggggcggagaggtggggggagcggtgaagaaaccccaagcggcccaagctgtgggtctgggttgggagactcgcaggtgtggggcggggaggtaaggtgacccttgctcagcgaccgcgcccgcaagaaacgcattcccaggcctcccgcccggggtctgcaggtgacgggctggggggagcacgggaactagctagaccagtttgtcgtctccatggcgaccgcccgcgcggcgccagcctgacagtccgtccgggttttatgaatgggtgacgtcacaggcctggcgtctaacggtctgagccgctggttcagacgctgacacagaccggcccgggaagggaggggggagactgtagctccgcagctgccgcgccgtgggagggagaccctgctctgaggtctttgagaagaaaatttaaaaagcagccaaaaatgggaaaaaacattaaaaaatcacgaactgttgcaggttcaggaaatttttgcaaggagctgcaaattcaaggtggaatcgaatgcagcctcactccactgcgctctatctagttcacttcccagccacccagccccaaacttactagactttcccgaattaattgctcccacccgggagggatctgggtaggccctccgggtctcaggaacacgaacagcaacattatttaggaattgagaaagcccaggggagcagatgtaaaggagcgcccgctttaaatttcggtcctgatatttgtagatcagggtccgagaagcatcttccaagagggtccggaaacccaggctctctgggctatccagagccagccgcttctccgttcgggcctcaatttctctcatctgtgaaatggagctggagaagtgagaaagtgaatatgggaaaaactgattcctgaggtcttttcattataaggcaatgcctgcttagcttccttgcctccttccagaggagcccagtgcggccctcgcctctacccgctgccctgcccggtgccctgccaccgacccacccttgctgttctgaaacccgggtcgtctttccacactgcgagcaggcactagacgagcaggaggctggacctaggagcgcgggtcacgcccccatgccgcccattggctgcttttgaacgttctgagcccgcccctccgggggccgtggcgtgtttataaaagacaagctgtggctccgcactctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtggtaaagttgtagtgacttcttgggttgaggggaggggcctgggctgggggttgacccctgaccctcttcacagctggttctgggaggagaattggagggctacatctggattgttgctcttaccggcctgaatgagtgtttccggtgtctttaaagtctattcttcccccaccatccctgcccatttccctgctccccagtgttataaaactaaatactccagacctctggggtttctcacagtgatcattgggccatctagatcacctggggaggttgttaaaatgcagatgaacctgccagggccccctctgtattgggagtattgagcaagccatttaagttggagaacctggccgctggaccacccacttccttgccaagatgtggataaagtgagacccagtggaaagggacttgcttagggccatagcttgtgagaggcagtgattctatcaccccattccccagttggaggtgcctcccccaacagcctacctctgggttccagcaggcagccctggggctcctggctcatccaagtgggtgagcaagttggcagggccaggctgggcacagctgccgagacacctgctctgggtccagactcggcctcctcactctggcctggctctgtcggcagttcaaacaaatctcccccaccaaccccggggctcctgcgtaggatctgaggagtggacgagtctcattacccagctcctgagcaggaaaaatatgtcattggcaagggtctaagaatcttcctggacatgtatgtggatttctactcaggggagcatgtatgagtgtctacgcctgtgtatgtaacaggagtaagctgatcttcccccactactcccacagtggggatgggccaactgttcacatataggcttgggggagggggtgtaagtaggagtatgcttgggggtgtgtgcagaagggcaaatgagagcacatgtgttctgcagataagtgtggaacctccagctgtttgggcttgtgtgttctgcctaaatgcattgtaggcatctctgcatgggtctggcatgatggatgggtttgtgtgtctgggggccacagaaccacactgtgggtttctgtgtgtataactgttctatagattggttggcattcctgggcctctgcgggtctggagtgaaggtggggacagctgtgtttgggcaaacccttcctcaaaagttcacgtggcaactccctgggctatcgttaggtcctgggggcaccaaccctcaaggattgctgccaggtaaacccccctgtattacatatggagaaactgagtcccaggaatgacaaagaacttgtcccagacaggtaagggctattaatatattttgtcaataaacaatagaataaaatcaatagcccttagcaccagaagcctggctctgctcaactgaaccctttacaaaaacgatttcatggatccctgtggggctaaaggcaagactgtgatcccagttttacagcagaaggaacaagctcagagaggggatgaacaaaaaatcaaatgaaagattatgatttgagcactaacattaagccaggtacaccccctccacagtttatggattttatcgaagaacccagtacttgcaggcgaattatgttctttgctacctcctccccaccggctgctgtattacagtactaacctcacggaatgtagtacagaataaatgaaataaagtaagtgtgtaaaacgtttagcacagtgcttggcacagaatgtttcatagttataaattattattgtcgcctgtgagtccttggagtgtcctcggaggcacacgtgtgcacgcacgcactctcacgtgtgggcccccgcctgcaagcccacccacggggtctgagcgggttccccctcgcgtactccgacatgcagggcctttttccaggggaggaaggggctgcggcgggggcctgggccacctcccccgccattcaggcacactctggattccacgtttccctctgttcccctttggcccagacccagcccatctggaggccggctccgcggcggcctgggagcgtttccatcagctgggcccgaggaatgcggagctatttaacctgagcatccccaggtgtacggaggcgcctggctgtctggggcccgcagcctttggcacagccgcgctagacaaacagcgcgccgcccccgccctgcccctccgcccccagctgcagccgggcctgggaaccggcgggcgccggcggcttgcataagaggctccgggcctcgcagagggaggggggacagaggccaccggtgtgtgtgcatgtaacacacaaaaccctgctcctttggaaatcattaactccttaacccctcctggacaggacgaagccaggagctggggtggaagatgccgagaaacccgaggaccaagtttcttgggcactggactctgcctttccggggctgtactgttaattttatttaagaaatacagagagcttattgtgtgctgggcaccatgctaaactctttacaatatcaattcatttaatcgtcagaacttgttaacgaggccagtgctatcatcatatgctcattttaataagagcaaccaccaccactacaacaagagtaataggctaacattttagtagggaggcaggtagaacacaagcccagaatcaaccttgatgctcatcacttcacctgtcagagcctcttcttttttggaaaacgggcttcagaacctgggcttcaaggattaattgaaccaatgcacctaaaaagcatagcacaggctcatggtagatacttagtgcatattgcaataaagtgttttgagcggattgtctcaacagccctaccaggtgtgggcctactggtatattcacttttttggtttttttgagacagagtctccctctattgcccaggctggggtgcggtggcaccatcttggctcactgcaacctccacctcccaggttcaagtgatcctcctgcctcagcctcccgagtagctgggattacaggcacgtgccaccatgcccagctaatttttgtattttttttgtagaaaagggttttcaccatgttggccaggctagtctcgaactcttgacctgaagggatctgcccacctcagcttcccgaagagctgggattacagatgtaagccaccgtgcccggcctgtgttcacttttcagatgagaaaacggaggcatcaaagaggtgaggtgacccacccaaggccacattgcacattaccttagaggactttccagaaatcagacttgtctaaatcaggtttatgaggggcctcatgttcccacagtatgtccagtttataaagcctttcatcttatttccaactgaaatcatacctggtcattatatttatttgttttaaaagcataactcagataaatgcaagaaatatacacatatcacaatttttgcaacccatattggggaatgtctatttttttttttaagacagttttcctcgtcacccaggctggagtgcaatggggcgatctcgactcaaccgcaacctccgcttcccagtttcaagcaattcttctgcctcagcttcccaagaagctgggattacaggcatatgccaacacgcccagctaatttttgtatttttagtagagacagggtttcaccatgtttgccaggctgctctcgaactcctgacctcaggtgatctaccctcctcagcctcccaaagtgcatgaggccaccgtgcccggctctttttttttttttttttttttttttgagacagagtctcgctctgtcgcccaggctggagtgcagtggcgtgatcttggctcattgcaacctccgcctcccgggttcaagcaattctcatgcctcagcctcctgagtagctgagattacagacgcgcaccaccacatctggctaatttttatatatttagtagagacggggtttcaccatgttgcccaggctggcctcgaactcctgacctcaggtgatcagccctcctcaacctcccaaagtgctgggattacaggcgtgagccaccacacccgacccatgccagtcactcttattgagcaccaggaactgccagccagagagagctccctgctgcccagtgtcacacacagcagggcttcctggtggcaggcaggtctcacatcctagcatggctgccggaaagaaaggaggtgagtcacagggccaggccaggagctgggcgaggctggggccagggtccaggcaggcgccactttccaggaaagggaagggaagaggaaaccagaaggccaggaggagcacagggaggggcgagggtgcccttatctccctggacctgccctggctggtgctgcttcctgctgcaactcttgcaaaacctcgttcccaacgctgtcctcaagcagggtgccccaggccagtacagggttgcatcaaggccttgtgcaaggggggttaaagggaggacagtggctgggagcaaaggcagggcaagaggcaaggcaaatgcgggttctaggcccagtgccacttctggttgggcacctgcttcacctcctgggctcttaggatccccagcatttttttttttttttttgagacggagtctcactctgttgccaacctctgcctcctgggttcaagcaattctcctgcctcagcccctccagtagctgagtctaccggtgtgcaccacgacgcccagcaatttttgtatttttagtagagacagggtttctacatgttggccaggttggtctcgaactactgacctcaggtgatccacctgccttggcctcccaaattgttgggattacaggtgtgagccactgcaccctgccatccccagcattttttttttttttttttttttgagacagagtctccctctcttgctagcctggagtgcagtggcaggagctcagctcactgcaacctgtgtctcccaggttcaagtgattctcctgcctcaccctcccaagtagctggggttataggcacgtgccaccacgcccagctaatttttgtgtttttagtagagacggggtttcaccgtgttggccaggttggtcttgaccttctgacctcgtggtctgcccgccttggcctcccaaagtgctgggattacaggtgtgagccaccatgtcgcccagcctcattcccagcttttaaatgggtgttatactcaccgttttgaggtttcagtgatatcatcccaaacctttgcactcctcaagcctcaggctaggccattgtacttctacctgtgaaactagccccaactggttctttcaacaaatagtttataaagcttctacaatatactaggaaccgggccccaggagttaacaattcagatacaaattcttgcagtcttggaacttacattcttagtgggagacacgcagtagataaatatgcagatgtgtaatcagaggtgcatttacctggaaattacttaagcttaaacttcaagcctcctcacatggaaagagtatcagccatgtgttagcatgatttctgtgtgttttgcaagatttgcaaaatgttgtattcttttccttagaggctgcacaaacctagatcctcttctttatatatagacgagaccgagcagggcccaagcttgaaggcatagctgcagaagacaaagaatcgtgtctgtgggtgctgttcgttgcttgggtttgttttgttattttattaatttatttttatttatttatatattttttgagacagtttcctccttgtcacccaggctggagtgcaatggtaccatctcaactcactgcaacccccgcctcctgggttcaagcgattttcctgcctcagcctcccaagtagctggggttacaggtgcctgccaccacgcccagctaattttttttttttttttaattgtgagacaaagtctcgttctgtcaccaggctagagtgcagtggcgcaatctcgactcattgcaacctctgccttctgggttcaagcgattcttctgcctcagcctcccgagtagctgggactatggcgtgcaccaccacgtccagctaattttttgtatttttagtagagacgggatttcatcatgttggccaggatggtctccaacgcctgacctcaggtgatccatccgcctcggcctcccaaagtgctgagattacaggcgtgaaccaccgggcccggcctgttgttgttttaatagagacggggtcttgcatggttgcccaggctggcctcaaaatcctgggctcaagcaatcctcccgcctctgcctcccaaagcactgggattacaggcgtgagccaccctgtccggcccggtttttgggtttgagaccctaaaatctctgggcggcagagaagagctgggaagcgggccagcgctttccagagcacctggtctcatgcagctgcaaacgcaggcgctgtgcccgcccccgtcttcctttggccaccagcgccccctcccgggcagagcccgggctatgccaccgtgggcgagaaaggcggcctggttgcggcgagaggcggaggctgatgccttggtggcctctagtggacgccttgggaactgcagtcagagctgcaagcgtgttaggagagtgaagagttctgcgcacatgtaaaccctcagccccttctctcaggccccctttggctaccgtttcccccattctctcatcctctttcctcttccttgcttgtgacaaccccctatgagcctcattccctccctttttttttttttttttctgagatggagtctcgctctgtcgcccaggctggagtgcagtggcacgatctcggctcactgcaaccttcgcctccagggttcacgccattctcctgcctcggcctccggagtagctgggactacaggcgcccgccaccacgcccagctaattttttgtatttttagtagagagggggtttcaccgtgttagccagaatggtctcgatctcctgacctcgtgatgcgcccgcctcagcctcccaaagtgctgggattacaggcgtgagccagcgtgcccggcattccttcccttttaaaggaggagatcttgggctaatcttggaaatttcttttctttttctttttcttttctttcttctttcttttcttttctttttttttttctttgagacggagtctggctctgtcgcccaggctggagtgcagtggctcgatctcggctcactgcaagctccgcctcccgggttcacgccattctcctgactcagcctccccaatagctgggactacaggcgcccgccaccgcacccggctaatttttttgtatttttagtagagacggggtttcaccgtggtctcgatctcctgacctcgtgatccgcttgcctcggcctcccaaaatgctgggattacaggcgtgagccaccgctcccggcttttttttttttttttttttttttgtagcccaggctggagtgcagtggcgcgatcttggctcattgcaaactcatctcctgggttcaagcgattctcctgcctcagcctcccgagtagctaggattacaggcgccagccaccacgcctggctaattttgtatttttggtagagacgggtttctccatgttgatcaggctggtctcgaacttccgacctcaggtgataagcctgcctcagcctctcaaagtgctgggattacaggcgtgagccacggcgctcaagctaattttgttttttgtttttgtttttgttttttgttttttgtttttgaggcagagtttcactctttcgcccaggctagagtgcagtggcgcaatctgggctcgccaccaagcctggctcattttttgtatttttagtagagatggggtttcaccatgtggaccaggctggtcttgaactcctgacctcaggtgatctgcctacctcggcctcccagagtgctgggattacaggtgtgagccatcacgcctggcctaatcttggaaatttctttttttcaattgtgaaatgtatcacacctacaatagagcagatatcacacgtctgcagtttaaagataataataaaaccggccaggtgcggtggctcacgcctttaatcccagcactttgggaggccgagattgcgccactgcactccagcttgggcaacaaagactctgtctcaaaaaaaaaaaaaaatgtgtgtgtgtgtgtgtgtgtgtatatgtgtgtatatatatgtgtgtgtatatatatgtatatatgtatgtgtatgtatatatgtatatatgtatatacatatgtatacatgtgtatatatgtatatatgtatatacatatgtatacatgtgtatatatgtatatacacatgtatacatgtgtatatatgtatatatacacacatatatgtatatacacacatatgtatatatacacatatatgtatatatataaaactataaaacacacaagtaccagcctctctgcttgaaatagaatattagttcatttgaagcctgtgtttgcccttcaggataaaatccccataagattttacctcttatccagaactttgtgttaatcaattgcttgttcttttattttttttcacatatgtacaagtatgcatccttaaacaatccattacttgatattacctggttttgccttttatataaataaaatcatattatatgcaattttctgcaacctgattttctcatgcaacatgaattacatgagagtcatccatgttgatttcttgccttcattcattcatttccaccactttgtagtattcttttttttttttttgagatggagttttgctcatgttgcccaacctggagtgcaatggcacgatctcagcttaccgcaacctctgcctcctgggttcaagcgattctcctgcctcagcctcccgagtagctgggattacaggcatgcgccaccatgcccagctaattttgtatttttagtagagacggggtttctccattttggtcaggctggtctcgaactcccgacctcaggtgatccgccaccttggcctcccaatgtgcagagattacaggcgtgagccaccgcacccagcccactttgtagtattctattatatgatttattgccccagtctcctgtgatggacctttggattgtttcataggttttgctgttatcagcagtgctgctctgaatgccctcagtgaatatgcgttaaaaggagtaggatggctgcatcctaggtgatgcacaatttaaacattactaggttggactggagtctattttgattaaacagaataatcagaactggaaggtcccttacatacagcttaacccagcgcactcattgtagagataggaaaaggaaagcccggagaagttcagtgacttgcccaggatccctcagacctggcctcttgggctaaggtcatagccttggaagtgattctgggagtgaggcatgagaatatatttccttctcattttgaagatgaacaagactgtattttacccttaaaatagtcttctaggctggttttagaatctgggcagctgggcacggtgggctcacacctgtcatctcagcactttgagaggctgaggtgggcggatcacgaggtcaggagtttgagaccagcctgaccaacatggtgacaccttgtctctactaaaaacacaaaaattagccgggcatggtggtgcacgcctgtaatcccagctactcaggaggctgagacaggagaattgcttgaacccaggaggcggaagttgcagtgagccaagatctggccactgcactccagcctgagcaacagagcaaggctccgtctcaaaaaataataataataatctgggcaaactagaaacacaggatgctccttgaaaaccatcccgccgggcgtggtggctcacacctgtaatcccagcactttaggagaccgaggtgggtggatcacgaggtcaggagattgagatcatcctggctgacattgtgaaaccccatttctactaaaaatacaaaaattagccaggcgtggtggcatgcaactgtagtcccagctacttgagaggctgaggcaggagaattgcttgaacctgggaggcagaggctgcagtaagctgagattgcaccactgcactccagcctgggtgacagagcgagactccatctcaaaaaaaaaaaaaaaagaaaaaaccatcccaagacaaatacacattcacactcactgcatctccaagtcctgccaactctaatgcttttttttccaccccctcaaagacaaagtctcactctgtggcgcaggctggagtgcagtggtgcagtcttgattcactgcaacatctgtctcctgggctcaagcgatcctcccacctcagcctcccaagtagctgagactacaggtgtgcaccaccacacctggctaatttttgtattttttgtttcatcatgctacccaggctggtctcaaactcctgggctcaattgacccacctgcctcggcctcccaaaatgctgggattacagacgtcagccagtgcgcctggtcttaccgccttttttttttttgagatggtgtcttgctctgtcgcccaggctgtagtgcagtggcaggatctcggcccactgcaacctctgcctcccaggttcaggcaattctactgcttcagcctcctgagtagctgggattacaggcatgtgccaccacgctcggctaatttttgtatttttagtggagatggggtttcaccatgttgtccaggctggtctcgaactccttgacctcaggtgatctacctgcctcagcctcacaaagtgttgggattagaggcatgagccaccatgcccggccttaactcttaaatatatcccaaatttacgcatttctgcccttccccttggccattaccctggtgcccatcatctcactgggatactgcaatagcctcctcagtcaccctgcttccatttccccctcattctccacatgacagccagagagatccttctaaaaaatacaaggatcacgtcacttgcttgcttaaatgctccctgtggcattcgttacttttggaataaaatcctaatttgttaccatagcctacaaggcacagtaaggcctggttcctgcctacatccacccacttcccctaactctccccttgccactcccctccagtcactttggtttcctttcagttgctctttcataactggggagactttgcctgtgcctcaaattctacaccctgcgtatcttcatgtccttcagctttcagcccaaaggttggctcagagggtcttccccgaccatcccatctccttctttttttttttttttttttttttttgagacagggtcctcactctgtaggctggagtactgtggggcaatcatgactcacttcagccttgaactcttggactgaagtgatcctctcgcctcagcctcccatgtagctgggaccacaggtgtgtgccatcacgcctggctaattttttttcttttcatttttgtagagatggggtcacactttgttgtccaggctagtctcaaattcctgggatcaagcagtccttccaagtagggcttctcagagtgctcaagtgatcctcccacctcagcctcccaagtagctgggactacaggtgcacgccaccatgcccagctaatttttgtattttttgtttcaccatgttgcccaggctggtctcaaactcctgggctcaattgatccacctggctcagcctcccaaagtgctgggattacagcaccatttcgctgtaatctactggttcaagcagtcacagaagccctctcaggttcaaaagggaggagacatacaccccccttttgacaggaagaatgtcaaaaatttgaggccattaagaaataaaatggccaggtgcagtggctcacgcctgtaatcccagcactttgggaggccaaggcaggcggatcacctaaggtcgggagtttgagaccagcctgaccaacatggagaagccgcgtctctactaaaaaaaatacaaaaatattagccggacatggtggcacatgcctgtaatcccagctcctctggaggctgaggcaggagaatcgcttgaacccgggaggcggaggtttcggtgagccaagatggcgccattgcactccagcctgggcaacaggagcgaaactttgtctcaaaaagaaaaaaaacaaaaaacaaaaaacaaagaaagaaaagaaaagaaactaagccggggtgccagggtgcatctgtagtcccagctactttggaggctgaggggacaggaccacctgagcctgagcccaggagtgggtaacataatgagaccctgtctctaattataaaacaaacaaacaaacaaaaactgtcatgaggataataagctattctaagtgcagtgtgttcagagaggttcagttccttgcccagaggacaattacagatgtgaatagtgataaagaaggaaacaacaaaaaacaggttgaaaggagatgggggccgggtgtgatggctcatgcctttaatagcagcactttgggaggccgaggtgggtggatcacctgaggtcaggagttggagaccagcctggccaacatggtgaaaccccatctctactaaaaatacaaaaaaacttagccggctgggcgcgtggctcacacctgtaaaaatacaaaaaacttagccgggaatggtggcaaacatctgtaatcccagctactcaggaggctgaggcaggagaatctcttgaacccgggagggggaggttgcagtgagccaagatcgtgccactgcactccagcctgggtgacaagagcaaaactctgtctccaaaaaaaaaaaaaaaattagccaggcatggtggtgcatgcctgtaatcccagctaattgggaggctgaggtaggagaattgcttgaacctgggaaggtggaggttgcagtgaactgagatcatgccactgcactccatcttgggctacagagtgagactctgactcaaaaaaataaaaacaaaaacagggaacagaagaattattcaactatgctccactttaatccctgacccacagaatctgtgagatatagtaaaacggttgtcgttttaagccactaaattttggggtaatttgttatggagcatttgttatggtaatttgttgtagccagaaccatcatgtttatttgattgcttaccatgttttctgtctctggaatgggtgctccatgaactgctctgttctctgccatgtgctcactgtccagcccagagcctggcacatagttggtgcttaataaatatttgctgaataaatgagagagtggattaatagatgtatgcccaccacactcgggttcaactccgttcatccatctgggtagagtttctgggataatcctgcatatgccttgacattgggaagaggggcactcaggcacctgccatcccctggcagcctcgtccccagccctggaagggggtactgagagtggctttggtcaccaaaacctattgttgcatgagggctcagttagtgcctacctgccatgacctcccttttctgttccaacctccagactttgcataaatgacttccagtgatgtcttccaagtctcatttttctgaattcacctcctccagaaagctggtctagtttggaaactctctcaggctcccttcctgacctccagagacaaccctcctccctcttgttgactacagacaattgcagggattgcttcaggatcattcccacccagagccccctggtgccccacatggccacctcccaccctgcacaattcagtcccctagcaatgacattcccaaaccaaaatccctgctatgtgtcaaatcctgtgctgggtgttttgctgtcagtatctcggttcaacacacctccacaactcagtgaggtcagatccatgattgtcccattttatgaatgagaaaggtgaggctccaagaggaaaaactagttccaggtacctggctggcaagtgctcttctaggatccagttcatcatcatcatcgtcatcatcatcatgactataacttactaagcactgacagtgaagataacgatctaccaaaggatgcccaattcaaggggttaaacttcaagcagaaaaaggatattttcttagtttcaaagtatctccctaagtatatttaataactacacagagtaaaataattttttttttttgagatggagtctcactttatcacccaggatggagtgcagtggtgcaatctcagctcaccacaacctccacctcccgggttcaagcaattctcctgcttcagcctccccagtagctgggattaaaggtgcacaccaccacgcccagctaattttgtatttttagtagagacggggtttcaccatgttggccaggctggtcttgaactcctgaccttgtgatccacccgcctcggcctcccaaagtactgggattacaggcctgagccatcgcacccggcctaaaataataattttacagtggagaagtccagtacatactgccctagataactgatcaaggttaacattggtggtcatacatgtcaacatcagggcctctgcaaggatgcactgagaaaggcatgacaccacttctgtgacattttccccataattcatgacttcaatttgatcacaagaaaatctcagacaaatccaacttgaaagacattctaccaagcagctgaataggactcttcaaaagtgtcaaggtcacaaaaaagaaggaaagaccgaggaactgtcacagattgaaaaagactgctggtgccgggtgtggtggctcacacctgtaatcccagcactttgagagcctgagcaggaggattgcttgagctcaggagtttgagaacagtctgggcaacatggtgaaaccctgtctctacaaaaaaaatacaagaaattagctgggtgtggtgggctcactcctgtagtccgggctactcagaaggctgaggtgggaggatcgctggagcctggggggcggaggttgcaatgagctgagatcatgccactacactcctgcctggggcatagagtgagactctgtctgaaaagaaaaaacaagaaaagaaaaatctggtttaggccgggcggggtggctcacgcttgtgatcccagcactttgggaggccaaggcgggcagatcgtgagatcaggagatccagaccatcctggctaacatggtgaaaccctgtctctacttaaaaaaaaaaaaaaaaaaaaaaaaaaattagccaggcatggtggcgggagcctgtagtcccagctacttgggaggtgaggcaggagaatggcttgaacctgggaggtggagcttgcagtgagccaagattgcaccactgcactccatcctgggcaacagtgcaagactccgtctaaaaaaaacaaaagaaagaaaaaaaaagatcctggtttggatcccagaacagaaaaaggacataagtaggaaaacagatgaaatcgaaaaacttctgtactttagttcatagtaatgtaccaaggttaatttcttagttttgataaatgttctgtcactgtttgagatgttgacagaaggggaagccaggtgaagggtatacaggaactccctgtactatttttacatcttctgtaagactaaaattatctcaaaaggaaaaaagacattaaaataaaagagaaaggctgggtgtggtggctcacgcctgtaatcccagcacttttcgaggccaaagcatgaggattgcttgatcccaggagttcaagaccagcctgggcaacatagtgaggtcttgtctcaaaaaaaagtaaaaaaattagccgagcatggtgacacaagcctgtactcccaggtattgggaggctaaagtggaaggatcgtttgagcccaggaggttgaggctacagtgaaccatgatcacacaccactgcactccagctgagaccctgttccccgcccccccaaaaaaaagagcgagagagagaatgaaggctaaagtggagtaagactaccatagccctctctcccactgattacaacaaaaaactctggacagcctgggcacggtggctcacgcctgtaatcccagcactttgggaggccaaggaaggtggatcactagaggtcaggagttcgagaccagcctggtcaacatggcgaaacactgtctctactaaaaatacaaaaattagctgggcatggtggcgggcacctgtaatcccagctacttgggaggctgaagcagaagaatcacttgaacccaggaggcagagggtgcagtgagccaagttcgtgccactgcactccagcctaggctgcagagcgagcctccgtctaaaaaagaaaaaagaaaacaaaaaacaaaaatcaaactctggacaaatacagaaagcacctacttaaggaggacctctgaaaagtaaacaatagaaaatagattggcataggaagtcaacatttgaagaacagccagcatggcagtggaaagtttcctggtgaattttctttctgtattttctggccttgacccaaaggactctgaatcaggaaactgtgtttgacaccagcagcaaaaaccttcaaaagaaaagtttaatattctggccagagaaccaggaaaacacgcccctgttagccagacagtgtgaggagaattttgagtattttgttgttgttgttgtttaaattattatgaatattattattattgagacagggtctgactctgtcacctaagctggagtgcagtggtgcagtaacagctcactgcagcctccacctccctggttcaagcaatccttccacctcagcctcccaagtagctgggactacaggtgtgtgccaccatgcctggctaattttttttgtatttttctttttttgagatgcagtctcgctctgtcacccaggctggagtgcagtggagtgatctcggctcgctgcaagcttcgcctcctaggttcatgccattctcctgcctcggcctcccgagtagctgggactacaggtgcccgccaccacgcccggttaatttttttgtatttttagtagagatggggtttcaccgtgttagccaggatggtctcgatctcctgacctcgtgatccacccgcctcggcctcccaaagtgctggaattacaagcatgagccaccacacttggccttttttttttttttgtatttttcatagagacaaggtttcatcatgctgcccaggctgatctcaaactcctaggctcaagcgatcctcccacttcagcctcccaaggtgctgagatgatgggtgcaagccactgtgctgggtccttcacaggcttttaacaggacccagagtctcacaagacaatattttatttatttatttattatttattactttttttgagacagagtttcactcttgttgctcaggttggacaggttggagtgcaatggcacgatctcaactcattgcaacctccgcctcccaggttgaagccattctcctgcctcagcctctggagtagctgagattacaggctgccaccatcacacccggctcattttttgtgtttttagtagagatggggtttcaccatgctggccaggctggtcttgactcctgacctcaggtgatccacccgccttggcctcccaaattgctgtgattacaggcatgaaccaccacacctggccacaagacaatattttattttatttatttatttttatttatttttttttttgagacggagttttgctgttgttgcccagtctggagtgcaatggcgcaatcttggctcaccacaacctcggcctcccaggttcaagcgattctcctgcctcagcctcctgagtagctggaattacaggcatgcaccaccacgcccggctaattttgtatttttagtagagacggggtttctccatgttggtcaggctggtctcaaactcccaaccccaggtgatctgccctcggccttccgaagtgctgggattacagaagtgagccaccgcgcccggccaccagacaatattttaaatgcccaggatacaacacaaagttactcaacaaggaaaatctcaccaaatctcaaagaaaaaaacaatcaatagatgccagcacacacacacacacacacacacacacacacacacacacacacacccagccattagaattgacatacaaggccaggcatggtggtttacgcctgtaatccctgcactctgtgaggctgaggtgggaggatcctttgaacccaggagttcaagaccaacctgggtaatacaggagaccctgtctctgcaaaatttttttttttttttgagacagagtcttgctctgtcgcctagactggagtgcagtggggcaatcttggctaactgcaagctccactcccgggttcacgccattctcctgcctcagcctcccgagtagctgggactacaggcgcccaccaccacacctagctaattttttttgtattttagtagagacggggtttcaccatgttagccaggatggtctcgatctcctgacctcgtgatctgcacgcctcggcctcctaaagtgctgggattacaggggtgagctgccatgccaggccaaaatattttttttaataaaataaaaattttttaaaagttgaaatgattatattgataacaagtagatttagaacaagaaaaaaattatcagagaaaaaaggacattatatgatgattaaagggttaattcatcaagaagacatgacaattctgaatgtgtacgcgcttataaagttcctaaatatataatgcaaaaatgatctaaaaagggaaataaagtcaccattatacttgcggatatcaactctcttctttcagtaaatgataaaacagaaaatcagcaaggactgggcacggtggctcatgtctgtaatcccagcactttggaaggctgcagtgggcagatcacctgaagtcagtagtttgagaccaggctggccaacctggtgagacgctgtctctactaaaaatacaaaaaattagccgggaatggtggtgcatgcctgtaatcccagatcccagctactcgggagtctgaggcaggagaatgacttgaacccgggaggtggaggttgcggtgagccgagattgtgccattgcactccagcctgggcaaaaagagcaaaactccatctcaaaaaaaaaaaaagaaaaaaagaaagaaaaatcagcaaggacataaaagagctgaacaacactatcaaccaatttaatcaaattgttttttgtttgtttgtttgcttttgagaccaagtctccctctgttgcccaggctggagtgcagtggtgcgatcttggttcactgcgacctccacctcccaggtgcaagtgattctcctgcctgtgccaccacgcctggctaatttttgtatttttaaacttttgtttgtttgtttgtttttgtttttgagatggagtctcgttctgttacccaggctggagagcagtggcaagatctcagctcactgcaatctctgcctcctgggttcaagcgatgctcctgcctcagcctccccagtagctgggattacaggcaccagccaccgcgcccagataatgtttgtatttttattagagacagggtttcaccatgttggccaggctggtctcgaactcctgatctcaggtgatccacctgcctcggcctcccaaagtgctgggattacaggcgtgagccaccacacgtggctgatttcttgatttctagtgtaattccattatgatcagagaatgtatcacctacatttttaaacattttttaaatataaaggcccagaatatggtctatcttggtgaatgttccaagtgtacttgaaaataatgttttgtctctactaaaatgcaaaagttagctgggcgtggtgcagggtgcctgtaaccccagccactggggcggctgaggctcaagaatcacttgaaccagggaggtggaggttgcagtgagccatgatagcaccacttcactccagcctgggtgatagagggagaccctatctcaaattaaaaaaaaaaaaagaactgaaaaatatctggaaaacccctaaatatttggaaatgaagcaacacgcttctaaataaatcatgggccagagaagaagtctcaagagaaattagaaaatatatacatgtgtagttttgtctgtgtgcatgtgtgacgtagtctcgctctttcacccagggtggaatgaagtggtgtgatcttggctcactacaacctccgcccctggtttcaagagcttctcctgcctcagcctcctgagtagcagggattacaggcgcttgccactgcacccagctaatttttgtatttttagtagagacggggttttaccatgttggccaggctgatctcgaactcctgacctcaggtgattcgcctgtcttggcctcccaaagtgccaggattacaggcgtgagccactgtgcctggccagaaaatattttaaactgacttaatgaaataaaattacaacatattaaacttcataaaatagagcagagagaactttctactttttttttttgagaccgagtctcacactatcacccgggctggagtgcaatggcacaatctccgctcactgcaacctccacctcccaggttcacactattctcctgcctcagcctcctgagtagctgggattacaggcaactgccaccacacccggctaattcctttttttttttttttttttttttgagatggagtgtcgctctgtctctcaggctggaggctggagtgcagtggcacgatttcggctcactgcaagctccgcctcccgggttcccgccattctcctgcctcagcctcccgagtagctgggactacaggctcccgccactgtgcctggctaaattttttaaatattttttagtagagacggggtttcaccgtgttagccaggatggtctcgatctcctgacctcatgatccacccacctcggcctcccaaagtgctgggattacaggcgtgagccaccacgcccggcctgtacctggctaatttttcgtatttttagtagaaatggggtttcactatgttggccagactggcctcgaactcctgaccttgtgatccgcctttctcggccccgcaaagtgttgggattacaggcgtgagccaccgtgcccagcctcaaattttctggtattaaatgggtatatgagaatagaagagtcttaaatcaatagtacaaacttccactttcagaaactagaaaaataacagccaattaaacccaaagcaagtagacagaaaacataataaacaccagaagtcaatgctattggatatagaaaaacaatagagagaaaataaatgaaacaaaagcttgttctttgaaaagatcaatatgcatattagtggtctccttcaaaaaaggggaaatctggacacagaagtagacatagagggaagatggcgtaaagagacaagagaggacagccatccatagtccaaggagagaggccaggaacacatcctccctcacagcccttaaaaggaaccaatccagggatctagaactagaaataccatttgacccagccatcccattactgggtatatacccaaaggactataaatcatgctgctataaagacacatgcacacgtatgtttattgtggcactactcacgatagcaaagacttggaaccaacccaaatgtccaacaatgatacactggattaagaaaatgtggtacatatacaccatggaatactatgcagccataaaaaatgatgagttcatgtcctttgtagggacatggatgaagctggaaaccatcattctgagcaaactatcacaaggacaaaaaaccaagcactgcatgttctcactcataggtgggaactgaacaatgagaacacttggacacaagaaggggaacatcacacaccagggcctgttgtggggttgggggaggggggagggatagcattaggagatatacctaatgtaaatgacgagttaattgggtgcagcacaccaacatggcacatgtatgcatatgtaacaaacctgcacgttgtgcacatgtaccctaaaactacaagtataataataaaaaaaatatatatatataaaaggaaccaatcctaccaactccttgattttgtacttccagcctccagaattgtgagataatacatttctgtcagccagtctctagtactttcttacagcagtcctagcaaactaatacaactaataaatgaatttagcagggttgtaaaatataaggtcaatatacaaaaatcaattgcatttctttttttctttttgagatggagtcttctttgtcgtccaggctaaagtgcagtggcgccatcttggctcactgcaacctctgcctcccaggttcaagtgattctcaagtctcagcctcacaagtagctgggactatagtcatgcaccaccacgcccagttaatttttgtatctttagtaaagatggggttttgccatgttggccaggctggtctcgaactcctgacctcaagtgaactgcctacctcagcctcccaaagtgctggaattataggagtgatccactgtgtccagccgcatttctatataatatcaatgaacaattggaaattgatttttttttttattttttagagacagggtcttgctatattatccaggctgggctcaaactcctgggttcaagcaatcctcccacctcagcctcctgagtagttacaggcacgcactaccacgcttggcttgaaatttttcaaaagtatgatttacaattgcaccaataggccgagtgcggtggctcatgcctgtaatcctagcacttttggaggctgaggcgggtggatcacctgaggtcagaagttcaagaccagcctggccaacatggagaaacactgtctctactaaaaatacaaaaaagaaaaaaaaaaaaaaattaggcagatgtggtggcatgtgcctgtaatcccaaatacttgggaggctgaggcaggagaatcacttgaacccaggaggcagaggttgcagtgaaccgagatcacaccactttactccagcctgggcaaaacagtgaaactctgtctcaaaaaaacaaaacaaaacaaaaacaaagcaattgcaccaataaaaattaagtagtgagtatcagtgtaacagccagatcctacttcatccccatgtagaggtggagggactgagtgaacaggcttggtgtgcagaagatgcaggccaggcaagcctgtgcataattttggataatgaaaaatactatgaggaaaataaatctagccaggtgcagtgactcacgcctggaggcctagcactttgggaggccgaggcaggcaggtagcttgagttcaggagttcaagaccagcctgggcaacatggcaaaacttcatctctacaagaaatacaaaaatttttgccagggatggtggcacacacctgtagtcccagctacttggagggcctgaggcaggaagattgcttgaatccaggaggctgaggctgcagtgagtcaagatcccaccatagcactccagtctgggtgaccatatgagaccctgtttaaaaaaaaaaaaagaaaagaaatctaaactgcataggggtcttagggaagggctctctgagatgacatttaagctgcaatttgaaggacagtggttagggtttggatgtcaatacataacaacttcttctttgcccaagttctgacacaacagagagcagatgaggaatcaggtatattgaaatcaaaataacacttccttactgttccattcactgttcctgcatgacaaaccacctacaaaccacctggtgtttagtgtgcaaaataactgatgctcatggtttctgtgggccaggaggtcagagagggcacagcagggatgacttgtctctgccccatgaagtctggggcctcagctggaaagactcaatggctatgaggtccttgatggctggggctggaatcatctggagttgtacatgtctggaaatggatgctggctgtaggctggcacctcagcagggccttgagccagcacatctacacatgacttctccatatggtctctccacctgggctggcttggctccctcatagcatgatggctgggttcccagggagaatgtcctaacagaccacgtggcttttttcttcttctttttttgagatggagttgtgttctgttgcccaggctggagtgcagtggcacaatctcagctcactgcaacctctgcctcccgggttcaagtaattctctgcctcagcctcccgagtagctgggattacaggcgcctgtcaccatgcctgggtaatttttttttttttttttttttttttttgagacagagtctcgcttgttacccaggctgcagtgcagtggtgcgatctcagctcactgcaacctccgcctcccgggttcaagcgattctcctgcctcaggttcctgagtagttggggttacaggcgcccaccaccacgcccggctaatttttgtatttttagcagagacagggtttcatcatgttggtcagcctggtctcgaactcctgatctcaggttatccacctgcctcggcctcccaaagtgctgggattacaggcatgagccacggcgttgagcctatttttttgtatttttagcagagatggggtttcaccattttggccaggctggtcttgaactcctgacctcacaatccacccacctcagcctcccaaagtgctgggattacaggcgtgagccaccccacccgggcccacatggcatttttatgatctagaagtcacatagcaactttcaccatattctgctgtttaatgctgtcacaaaggtacatccaggctgaaggaagggggacatagatcccacactcaagtgtcaaggtcataattgtacaatgagcatgtcgaattggagatattgataggctatcttctttgaaaatacaatttgccacaattcctgataaactagtttgtaaagcatagctttggtctgtgggtgagaggccgggtgtattgctccggtagagctctctcagatggaacaggtgagtgggaataagacttgcccttgagagaagagcatttcagcagagggaagagcaattacaaaggccctgtcatgggcaaggtgggtgtgttctaggaactgaagcccagtgtggctggggcatggtgggagagcaagagaggctgatgaagaagctgtatttggaaggtttggtagtggggaccttgaacgtcaggctaaggagtttattgggaagccagcggtgccaagaaaggctcaaggataccatgaggctgtccccacataggctgtccccacatctgggggccaaatacccatgcccatgtgcaggagccaattgtgtctcagagaagacagaggccctggcctccaggatgtgaaggcactagtgcctacccctagggctgatgtgacacctgcactcccagatctcaccacctcagcccctttgccaggttggacgcctccctcagccccactcctctagtgtgtctgccctggtagggaggaggagacggcaatggtatgaagagatctgacctgccccaggaagtttccatctctaggccacctgtcctgtcctgtcccggtgaaatctagccaagggcattcatctaccccgatcatgctatgggttctgcggcaggccaggaaacctgccattagtggccatccactcctatggcagtcccagctcaacgtcagtttgtttttttgagacaggatcttgctctgtcacccaggctggaatgtagtggtgcaatcacagctcactgcagcctcgacctcccaggttcaagcactcctcccacctcagcctccttagttgggactgcaggtgtgcgccaccacatcctgctaattttttgatttttttttttttttttttttatatagagacaaggtctcaccattttgcccaggctggtcttgaactactgatctcaagcaatcctcccacctcagcttcccaaagtgctaggattacaggggcgagccaccgtgcccagccctcagtgttggttctggcctggcgtgtctgtccacggttttagaagcgcttgctggacggtccaccagagctgcgggtcttcccgcgacgtcctccgagcctgagctgctgccgagacaccctcagcgttcggtgattcccatagctccgcagagcctccgctcccacaggtgagctgggtgggccttgctctccgctcctggccagggccctcggctcactgacctcgcccatcggctcgctggctctgccccctcggcgcccggttcccttgctgtcgcctggccccgctccttgtggttagctctgcccactctcgcctctccccgctcctcctgtactagacctcctccctgggttcaaggggctcccgggcctcctgaagggctgggggtctgggtctgtgacgctttgtccagctcctcttcctattttcaccttagggtcctgcgtgaggcctagctcttccacagtatcccctctgggctggcaggccggaggtgggtcctgtgtgatacctagagcctggctggtggggggatgctgaggccatggctcaggtctttgcatctgggcagaatctgggggctccctggagctgatcaagtgagcgtgagctgccatccctcctgctggcaggtctcagcctatcccagagctctcagcatgtcgggcctgtcacgacaagtggcctgaatgccgtgtccggagtcccttccacccttggaccccccgcggttccaggagaagacccttattcctcggctctgggaccccgagtggcctgccttaagggacagtccgtctcttcccaggttcaggaccttgaaaggaggctccgcagttgtcctgcaggctatattcaccgtgagctactcagggccggcctccaccccatggccctcagtccggggctgggcttcccccacagatgttccttatcacagcatcactcaacttctggagcctgatgttcccacagaggcgggggcggaagagggcagggaagaacagaggatcgcctttcccaaatgccttcccttggaagaccctgtgaaactgaggagatgggggaaactgaggcccagaaatggtgccgcttggccagagtggctgtagtagagccatgcatagacacaggccactcactccagtgcagccaccgccctcccagccaccctgaaaaaggtctggcaagactcatgaccttccgcctggcgcagtggttcacgcctataatcccagctctttgggagaccaaggcaggaggatcccttgagctcaggagttcaagactaacctgggcaacataacaagaccctgtctctacaaagcttaaaaaaaaaaaaaaaaaaagacaaggcatgctctcctccaggttcttaaagaaggagtgtcttcccctgtcctctgtccatagggctgttctgtagaacatcctgctcagtgaccgaggtaaggggtggtcctttttttttttttttttttttggaaagggagtctcactctgtggcccaggctgcagtgcagtggtgcgacttcggctcactgcaacctccgcctcgcgggttcaagcgattctcctgcctcagcctcccaagtagctgagattacaagtgccccccccaccacgcccagctaatttttgtctttttactagagacggggtttcgccatgttggccaggctggtctcgagctcctgacgtcagatgatccacccgccttggtctcccaaagttctgggagtacaggcatgaaccacggtgcctggccaaggtgatccttttgggggtctctcacgtttggaattaccttggttggggaaggggaggagcagctcccagagtgaccagcagagggcgctgggcccaacatggtcagttctgggagctggactcttggaactcgggaagactcccaagctgccttctcaaagttttgtctctggcagcgtctagaatggaggtgatgtgcactctagggtccctctaacaccttcccttgagcccctcgccttctaggctcatctgcccccaggactaagccccctccctttatttatttatttatttatttatttattgagacagagtctcgctgtgtcgcccaggctggagtgcagtggtgcgatctcgggtcactgcaacctccgcctcagcctccctagtagctggtactacaggtatgtgccacgacacttggctaatttttgtatttttagtagagacaggttttcttcatgttggccaggctaatctcgaacttctgacctccagtgatctgcccaccttggccccccaaagtgctgagattacaggcatgagccaccatgcctggccagcctttagaaactgtctttagcaggcccctgtggactcactagggtataggaaccctgatggaaggcatgggggctgggcataccccatggacctagagccaggagacctggaaagctctggtctccaggccaccgaggggacccccagccctctcccattcatccaccatccgtatactaacagtcccgggacacatttactgaacttgtgctctgcttcatttgaacacatcactcctcttcttaactttggttgcctcccaccttcattttattttatttatttatttatttattgagacagggtctcattctgttgcccaggttggagtgcagtggtgcaatctcagtttactgcaacctccacctcctgcctcagcctcctgagcacctgggactacaggggtgtgccaccatgccagcttaatcaccttctttaaataaaatccaagctcctcactaccgcctacaggtccttctcggtggtccagcccacctctccctccatccagcctcccctttaaccatgacactctggccaagatgacctctcttcttttgttattgtttttgttgttgctttgagatggagtttcgctcttgttgcccaggctggagtgcaacggtgggatcttggctcactgcaacctccgcctcccagattcaagcgattctcctgcctcagcctcccgagtagctgggattacagatgtgcaccaccacacctggccaatttttttatttttagtagagacggggtttcaccatgttggccaggctggtctcaaactcccgacctcaggtgatccattcgcctcggcctcccaaagtgctgggattataggcatgagccaccgcacctggctgtctcttctgttcagttgtttttttttttttttttgagacggagtctcgttctgtcgcccaggctggagtgcaatggtgcaatcttggctcactgcaacctccacctcccgggttcaagcgattctcctgcctcagcctcccaagtagctgggactacaggtgcatgccaccacgcctggctaattttttgtatttttggtagagatggggtttcaccgtgttagccaggctggtctcgatctcctgatcttgtgatccacctgccttgacctcccaaagtgctgggattacagcgtgagccactgcacctggcctgtctcttctgttttttgaacatgctgtgttttcctgcctctgggtctttgcacaggccttttcctctgcctagaacagaattgtaagccctgtgggggcaggaactatgtctggttttttttggctctatagcccccaacatttatcctggtaaacaagtatgcaataaatgccagctgaaacaggtctttataagttttttttaagtttttttttttttttttttttttttgaggagtctcactctaccacccaggctggagtgcagtggtgcgatcttggctcactgcaacgtctgcctcccaggttcaagcgattatctagcctcagcctcccgagtagctggaattataggtgtcccctgccacactcggctaatttttgtatttttagtagagacgggatttcaccacgttggccagggtggtctcaaactcttgacgttaggtgatctgctcgcctccgcctcccagagtgctgggattgcaggcatgagccaccacgcccagttttataagtaattcttgaataaatgtgcctgagccttgtctattttttttttttttttttttgagatggagtctcgctctgtcactaggctcgagtgcagtggcatgatcttggctcaccgcaacctctgccttgcgggttcaagccattctcctgcctcagcctcctgagtagctgggaccacaggcgcctgccaccatgcctggctaattttgtttgcatttttagtagagacggggtttcgctgtgttagccaggatggtctccatctcctgacctcatgatctgccccccttggcctcccaaagtgctgggaattttttttttctttttctttttctttttttctgagacagagtcttgttctgttgcccaggctggagtgcagtggcccgatctcggctcactgcaacagccgcttcccaggttcaagtgattctcctgcctcagccctctgtgaagctgggactataggtgcgcgccaccacgccctgctaactttttttttttttttttttttttttgagatggagtctagctctgctgcccaggctagagtgcagtagccggatctcgactcaccgcaacctccgcctcccgggttcaagcgattctcctgcctcagcctcctgagtagctgggattacaggtgcgtgccaccacgcccagctaatttttgtattcttagtaaagatggggtttcaccatgttggctaagctgtctcaaactcctgacctcgtgatttgcctgccttggcctcccaaagcgctgagattacaggcatgagccaccgcgcccgcccaatttttctatttttaatagagaaggtgtttcgccatgctgggcaggctggtctcaaactcctgacctcaggtgatcctcccgcctcggcctcccaaagtgctaggattacaggcgtgagccactgctggcctaaaagatgcttctggagtaggaggcattgggcctggctggaaggtttgcgtctgcaaaggcctgaagagaacatcccaggtgggagaaacagcaaggaggggaggtgtggaggaggcagggagaccctgttcttgggactactgtctgcagagggtctccagaggcaggaccccggtagggacactgatgcaggaggcgctctgcagtgcctccccccaatctgtgggccggggtgcccccagggacgcaggctgtgcgctcccacgccctgccgaagcaggacgttcccacgctggggcggccccgagaaaggctgtggggcgggccgggggcgggcgcccgcactcaggtccctccgcagcgggttctcagttgctcgctgggcagacccaggtcgcgctcccactgccgagcccgcgaggtgagtgagttgggggaggaccccgccacccaagcccgcgcgggtcaggggcgcggctcggtctcctgccttcgccgctgggtcacgccccagtggtccctgtcttagagggttggggggcttcttgtaggttagagttgaagactcctggggagtctgcatatgtgtgccatctctttccccaaatatagattacatcctccctctcttgatatgtggagctctcccacccactaatcataatcactggccggagcccctcttttccagaagtgtgggccgccccctcccacttatcacctgtagtgtgccccctccctcactctatttgttgggtgcccctctctctccctagatgtgggactccccttcttttccccagatgtgtgtctccctccctctgacccagttaagtccccatcctctaaagcccctccccaccaccatggatgccaaaccctgagtcttccctgggggtgggagactgggctcagccagactggctaagcccagtccccaccccaaccagatccagcagagcaggcctgtgtgcacgtaggcagccaattaggggggaaggggtgggggccagaccgtctgtctgttctgccggtgcaggggcctctggcccctgcagggaagagagactcaagaactgctccctctccacctggaccccacccagcttcctctggggagcaaacaagtgagcggggttctccaatctggccagactgagctggggctggcaccagaacccaagccctcagcctcaaactcttcagaccctggcccaagacttaggcctcctcccacttctcagatggtgaattgaggtcccaaaaaggggcttcaaaggtctaggacccccattggccccccgctggggatatcagacaaaattagaagggtcaagggcatgagggtgaccttgaaacactgggacacccctaccactaccataccagtggaaaaggatttttccatctggccctgcggtttgggggcagagggtgatgtgggggcagaactcatctataccttcacgcccccagatgctccccagagctgcctggagcttggtgctgaggaaaggtggaggtggaagacgagggatgcacagctcagaaggcaccagtgagacctggactccttcctccctgcctaactccagagataggggcaggggtcccctctgcaggctgccccctttgcccttccatgccaccctgggcctgttcctaccacacttcccatgttcccatgatcccactccttggtccaaggtcaagtttctccaggaaatggagtgcgcggggtgagcagacagtggtcatctccattccaagcttccttaggagccagcccccaagcctcaggcccctagaccttttgttctgaggtggaggatgctgacagaaccttggaccctgattcctcctttccagaccctagtttcaatgctagtaagaagaaagagacctaaagtaggagagacttcagccagatagcagaagggccttgctgacccatggagaataacaaagataacatttattgagcccttactagtaccccaagctattataaacctcctttttttttttttttgagatagagtcttgctctgtcgctcaggctagagtgttcagtggcgcaatgtcggctcactgcaacctccgcctcctgggttcaaacaattctcctgactcagcctcccgagtagctgggattataggtgcccaccactgcgcccggctaatttttgtatttttagtagaggagaggttttactgtcttggccaggctggtctcgaactcctgacctcgtgatccacccgcctcagcctcccaaaatgctaggattacaggcatgagccaccaagcccggccaccttctttattaatatagttagagatagggtgtcccaagggcagcctggactcagctccctccattgtgtctgcagcccgtggtggggggaagatgtccccctacaccaactgctatgcccagcgctactaccccatgccagaagagcccttctgcacagaactcaacgctgaggagcaggccctgaaggagaaggagaagggaagctggacccagctgacccacgccgaaaaggtggcctgtaagtgtcagggtggggctggctggagagagtgggttgggggctgactttggaaagaatggcctgtcagggatcagagggcagagagaggcccccaagacagccagaaacctccaaacacctgaggggtgaagttcatgcctttgttcgtttctttattcactcacctgtttgtgcatagcctgatgctaggcaatgctggggacatgaggtgaatcacctggatagttcctgcccccatggtgcccccggtcccgtggggaaaaccaatacagactccaataattgtaatacagaacatgtggctagggtgaggtgtgttcaaggactgtgagatgaaatcttggtggacctcccagaggagggcacattccagctggcctttaagggtgaagaggagggcactgccagggagtgggaactgcatggggaagggtgtcagagcaggagactgtggagggccctggaattgagtgatgtgggggagatgggacagagagaggcaggtgaggcggttggggaggagccctctgaccctgggaggctggagggatgtgtggtcccttgtcatgtccaccagagcatccctgagctgaccctttgaaatttggagcaccttattttcattccatgaatgggaacactcagcctgacctccaagatttcaagggattcctagtggggaaaggttcatgcttctcacattcattcattcagtcaacatcttatttggcacctactacaataccatgcactgggaatgcagctgtgagccagccaggctccgttcctgcctgtgagcttgcatttccagccctctctcagcacctttaccccttctctctctctctctttctacacacacacacacacacacacacacacacacacacacacatcttggttttttcttcatccatttcagaaattgacactcttggggggagaggggaggaatagcattaggagatatacctaattctaaatgatgagttaatgggtgtagcacaccaacatggcacatgtatacatatgtaacaaaccacatgtaccctaaaacttaaagtataataataataaaatttaaaaaaaaaagagaaattgacactctttatctgagcatggtggcacatgcctgtcgtcccagctatttgggaggctgaggcaggaggatcacttgagcccaggggagctgaggctagagtgagctgtgattgtgctacggcattgcactccagcctgggtaacaaagtgagaccctgtctgaaaaaaaaaaaaaaaaagagagagagagaaagaaatgatggacattccccaagcaagatgataatgagcaccatccctaatatgtcctgcacgcttacatgtagcaggcaccgctgtggcgttaggttgctctcgttagctcacatttgagagactgaggctcagtggcgtgcagtcacttacagtggttgcacagctagagagtggtggaggcaagatttgaaaccacatagacaggcaccaggggtttcacccttagctgctacaccacattagctacaatgaaggtttggtgggatgcttggggagtttcagtgtaacctcacagctcaaacaactttttttttttccttttctttgagacagggtctctgtcacccaggctggagtgcagtggccccatctcggctcactgaaatctctgcctcctgggctcaagcgatcctcccactttggcctcctgagtagctgggactacaggcgggcgccaccacacctggctatttttttttttgtattttttttgtagagacagggtttcaccatgttggccagactggtctcgaactcctgatctcatgatccacccacctcagcctcccaaagtgctgggattacaggggtgagctaccatgcccggctatttatttatttatttatatttctgtagagacagagcagtctcactatggttgctcaggctggtcttgaactcctgggctcaagcaattctcctgcctcggcctcccaaagcactgggattacaggcatgagccatcatgccaggccaaatgccttgagtcttgtcagacctcttccagggcaggcaggcgtggcagcactggagtgcatggcctgtgtctatgcatggctctaccacagccacactgagtggcctccactggttgatttcattgtctcagcctgaaccgcccacccaagtatcttcccaaaacctaagacagttcccttttcccaaggaattctgctgccagctttgattttcctttagatatttattttcatatttatttaatgtactgagaaaggattacacacgtagggtaattttttttttttttttttttttttttgagacagagtctcgctctgtcgcctaggctggagtgcagtggcatgatctcggctcactgcaacctccgcctcccgggttcacgccattctcctgcctcagcctctcgagtagctgggactacaggtgcccgccaccactcctggctaatttttgtatttttagtagagacggggtttcactgtgttagccaggatggtctcgatctcctgacctcgtgatccaccacctcggcctcccaaagtgctgggattacaggcgtgagccactgcgcccggacttacctggctaatttttaaattttttctagagacagggtctcgctttattgcctaggatggtcttgaactcttggactgaagcaatccacccgtcttggtctcccaaaattctaggattacaggcatgagccaccaagcctggccccctccctaattctgttagaatgaaatccaaactcttctccatggattctaacaaggtcctgtgtgaaccggctctgcctctcatttgagagagccagcctctcatttgctaaattctctctcttttgctcatttcactccagctacagtggtcctcacttcacactttccctacccacttcctgcttcagggtttttgcacttccttccagttttcaccaactttctcccattgatttttcaaacctcagctccaatgtcacctcctctgagacaccttccctggccagccaactgtttgcctgaagcatttgccattgtctccccctctaaactccacaagggcagggattttcatctggctcattcactgctgtcacctgttcctggtcatgctgtgcatatagtacgtgctcagtaagaatttgctgaatgaacagcatctgctgcagggagggggaagccgggatcacttagagtggacgcacctgaggccccttccccacacccaactgcctccagtgtaccggctccagttcaatgagacctttgcggagatgaaccgtcgctccaatgagtggaagacagtgatgggttgtgtcttcttcttcattggattcgcagctctggtgatttggtggcagcgggtctacggtgagtggcaacacctcatctggctgcagtcctgggccatgcccttgtggtcacggccaccagacagtttcttaaaggaaccatgctggcactcatctgaagagctgaaaatttctgaagaggtgtagggtgaaggacagagcatggctgtctaggtttgaatgcaggaactttacctctctgggcctcagtttcgtcatctctaaaatgggaatagtaatgttccatctcagggtacttaagaggattttaatgagagagggctgtaggccagtgtttggctcatagtcatgaatggtgttgtaactgattgttgtgtatgaactgtgtgtttttcagtgtatatatatactgaacttctgcctccccagttcaaatgattcccctgcctcagcctcccgagtagctgggactacaagagtgtgccaccacgcccggctaatttttgtatttttagtagagacagggtttcgccatgttggccaggctggtctcaaactcctgacctcaagtgatccgcctgcctcgtcctcccaaagtgctgggattacaggcatgagccactgtgcccggtggcctgtccccatatttttaaagtgaacactcttacctacttcctactttcaaccctcttagaaagtaaaaggaattatttcatcctggaccctgcccagcaagtgggaacaaactcagtaattatataattatagtaggtaacatgtatcaggtgcttaatatttgtctaacattgtgccaacagctttggaaatactcagtccccacaatcctagtggataggacctcttttgacaggtaaggaaactgaggctcagagagatgaagtgacttgttgaaggtcgcagggcaagggagtggtagagccaggatttggattcaggcagtcttcaaatcagtgatcttattaccacagaccacagaggtaggtgaggtgactgagttgtgaaggaccttggcccagctcccacagtccttggggtctaaggcaaagctggggtcagaacccagaggtgcctgggacgatgctctaggagaaagtctggggtgcggggctagacagggtggagtgagctcctcagtgcaagatacttcaaccctggagtatcttgtaccgtcagccttgcgagtggctgggaggctacagggtggctggagaccctggctggtgtaggaagactggcaggatcctgatccaccccatgtactccctgcagtatttcctccaaagccgatcaccttgacggacgagcggaaagcccagcagctgcagcgcatgctggacatgaaggtgaatcctgtgcagggcctggcctcccgctgggactatgagaagaagcagtggaagaagtgacttgcatccccagctgtctccctgaggctccgccctggctgggagcctctggcggcccctcccctcccctgcccttaaccccagtaaagctccaaaaaaaaatttattctcttctgcctctcaccaccacttcagactttacttggcacctaaaattaggcattttaacaggtgaggggcaagaagggctcagaactcatctagtcaatgagggcttcctggaggagtgggggctacagccaaggcttaggtgggattaggaaaggcaagaagaagggaaggcattcggggtggagcaagtggcttaatcaaaggtgagaacactcttttattcagctaattaacaaatacttggccgggtgcgatggctcactcctgtaaccccagcactttgggaggccaaggagggcggatcacttgaggtcaggagttcaagaccagcctggccaacatggtgaaagccccatctctactaaaaatacaaaaaattagctgggctacttttacacccagctaatttttgtattttttttttttttttttgagacggagtctcgctctgtcgcccaggctggagtgcagtggcacgatcttggcttactgcaagctccgcctcccgggttcataccattctcctgcctcagcctcccacgtagctgggactacaggcgcctgccaccacgcccggctacttttttgtatttttagtagagacggggtttcaccgtgttagccaggatggtcttgatctcctgaccttgtgatctgcccgcctcggcctcccaaagtgctgggattacaggcgtgagccatggtgcccagcctagttttttctatttttagtagagacagggtttcaccacgctggccaggctcgtcttgaactcctgacctcatgatctgcccgccttgacctcccagagtgctgggattacaggcatgagccaccacgcccggccttttttattggtagagacagggctccactatgttgcccaggctggtctcgaactcctggcttcaagtgatcctcctgcctcagcctctcaaagcgctgggggattttattctaagtgtgatgggaagctgtgtccatttgggttctttgagaagcaaatgccaagaaggaattaaccatgtgaagagatttattgggggtgatgcctgtgagagataaaggagagaggaagcaggagtaggttgggagaatcttcagactgtggtgcagatctgacacctgtggaagaaaagaagggaagaaaggagagttgcataggaacagcctcagacttcagggcctctggatcattctgagtcccatcaggagacagaaaccacaaagcaatttaaacgggttgtttaatataaaaaaattattaatcttacacaggaaagtaaccataaagatgcgaaggccgggtgtggtggctcatgcctgtaatctcagcactttgggaggctgaggtgggcagatcacctgagatcaggagttgaagaccagcctggccaacatggaaaccctgtctctactaaaaatacaaaaattagccgggcatagtggcacacacctgtaatcccagctactcaggaggctgaggcaggagaattgcttgaacctgggggacggaggctgcaataagccaagattgcgccactgcactctagcctgagcaacagagcaagaccttgtctcaaaaataaataaataaataggcaaaggccaagcacagtggctcacgcctgtaatcccagcactttgggaggccgcagcgggtggattacctaaattgcgagtttgagaccagccagaccaacatggagaaaccccgtctttactaaaactacaaaattagccaggcgtggtggcgcatgcctttaatcccagctactcgggaggctgaggcaggagaatcacttgaacccgggaggtgaagtttgcagtgagccaagatcacgacattgcactccagtctgggcaacaagagggaaactctgtctcaaaaaaaaaaagaaggcacagagacctttaaaaggtacccaaggagagtccccaaggaaagataaacttgataaacttggaagggggtgccctccccaagtgaggctcagacctcactggagaaggtgtggttggttgcagcccactggatggcgagaagttgggtggcttgcctacggccaaagctggtccatagtcccctgcgtaagcaggaataaccctcagagggctaagggagctgagactggtgggcgggtggaattggggcacatttgcagatgtgaggcctaaagcttgaggcatctgcatcaggaggattgctggaagatggtccccgggcctgaagcctgcaatgttgctataggctatgcacactgggctcatggctggggcagatcaccactaaatgtcctcaccacactgctaagcaaccaaaaaacaggagcaagaacagcgcgtgcacacacacacacacaaacctcctctcctcctgaaagtctcttctagcactgactacttgcaaagctcagcatctcactgtcaaggagttcagttcatctccagtgtgcagagcagagtgcatttggagctgagcagtaatacattgataactggcccagcatctttcagaaagtcttggctaggccagtgggaagtcccagagcagtaatgcccgctagaggagtcctgtattgggcaaaattaatgcatccctagtgtattagggttctctagagggatagaactaataggatagatgtatctatgaaagggagttcattaaggagaatttattcacacgaccacaacgggaagtcccacagtaggccatcggcaagctgaggagaagccagtctgagtcccaaaacctcaaaagtaaggaggacgatagtgcagcctttagtctggctgaaggcctgagagcccctggcaaatcactggtgtaagtctaagagtccaaaagctgaagtctgatgaaaaacttggagtctgatgttcgagggcaggaagcacccagcatgggagaaagatgaggccagaagactcagccagtttagtacttccacgttcttatgtgtgattatttatttatttatttatttgagtcggagtctctctctgtctcccaggctggagtgcagtgccgtgatctcagctccctgcaacctctgccccctaggttcaagcaattctcctctctcagccttctgagtagctaggattacaggcatgggccaccagcctggctaagttttgtatttttaatagagatggggtttcaccatgttggccaggctggtcttgaactcctgacctcaggtgatccgcccacgttggcctcctaaagtgctgggattacaagcatgaaccaccacacccggcccctctgtctacttttaacccagctgtgctggcagctgattagatggtacctacccagattgagggtgagtctgcctctcctagtccactgactcaaacattaatctcctttggcaacaccctccaagacacacccaggaacaatactttgcatcctttaatccaatcaagttgacattcaatttttttttttttttttttttttttgagatggaatctcgctctgtcactcaggctggaatgcaatggcgcgatctcggctcactgcaacctctgcctcctgggttcacgccattctcctgcctcagcctcctgagtagctgggactacaggcgcccaccaccaagcctggctaattttttgtatttttagtagagacggggtttcactgtgttagcaggatggtctcgatctcctgacctcgtgatcctcccacctcggcctcccaaagtgccgggactacaggcatgagccactgcacccagctgacactcagtgttaaccatcacacctagtaactccattgtgctcagtccctggttgggagcggcccagaaagatcatggcctcagcatgaacactacagcaggtctgaaagtgtggcagctggaggtggtcacacaactaccctcttcatagcaggttctcttgaagaatctgagtagcacgtctccatagatgccctaggtgccaaaggaagaatttagcaaagcagttgtgacaacagtcattcaaccaacaaatatttattgtggattttaacttaatcagctatttatttatttatttatttatttatttatgagacagagtttctctcttgtcgtccaggctggagtgcagtggtgcgatctcggctcactgcaagctccgcctcccgggttcaaggagttctccttcgttcaagcagttctcctgcctcagcctcctgagtagctgggattacaggtgctcaccaccacacctggctaattttttgtatgtttagtagagatggggtttcactatgttggccaggctggtcttgaactcctgacctcgtgatccacccgcctcggcctcccaaaatgctgggattacaggcgtgagccactgtgtccggcttaatcacctcttttaaaaggtcttatctccaaatgcagtcccattctgaggtgctgggggttagaacatccacatatgaatttggggagacacaattgagaccacaatagttgggctcagggctaggcacggtggctcacggctgtaatcccaggatttgggaggctgagcagggcagatcacttgaggccaggagttctagaccagcccggccaacatggagaaaccccatctctactaaaaatacaaaaattagctggatgtgttggtgcacgcttgtaatcccagctacttgggaggctgagacacaagaatcgattgaacccagaggtgaatgttgcagtaaaccgagattgtgccactccactccagcctgggcaatagagcgagactctgtttcaggaaaaaaaaagttggactgaaggttattctgtttgtctttttgttctgggaccagtggacacctagggcatgttcttctcatggcagaagtctgagactttggcagggcagaggaatgggtggggacactcttaaagtccaggcccaaaacaagcacacacaaaactgcaccacattccactggccaaggtattccaattatgattgctgcattacaaacctacctgagactgactggcataaaacaattattttactatgttcagagattctgtgagtcagggatttgggccgggtatggtggaaaccccttgcctctgctctagaacatccggggcctcagctggaaacactcaagggctgtgactaggattggctggaggtgttttcactcacatatgtagcacttgatgctgggaccacagctggacctcagatcaactggaacaccactttgtggcttccctccatggtcactctgtgtggactagtttggtctcccttaaaacatggtagctggaggtcgggtgaggtggcttatgcctataatccctgcactttgggaggctgaggtaggcagaccatgaggtcaatagatcgagaccatcctggccaacacggtgaaaccctgtctctactaaaatacaaaaattagctgggtgtggtggcatgtgcctgtagtcccaactagtcgggaggctgaggcaggagaatcacttgaacccgagaggcggaggttgcagtgagccaagattgtaccactgcacaccagcctggagacagagcgagactcggtctcaaaaacaaaaacagtggctgggtcccaagagagcgaaggggaagtgccttgtctttctttcttttcttttcttttttttttttgagacagagtcttgctctgttgcccaggctggagtgcaatggcgccatctcggcttactgcaacctctgcctcctgggttcaagcgattcttgtgcctcagccacccaaatagctgggattagagacgtgcaccaccacgcccggcttttttgtgtgtatttttagtagagatggggtttcaccatgttggccaggctggtcttgaactcctgacctcaggtgatccgcccgccttggcctcccaaagtgctgggattacaagtgtgagccaccgtgcctggcctgcatggtctttttatgattcagcttcagaagacaaaaagcatcatttctgctggagcccaatggtcaaggcactaccaaaggtacacccaggttcaagagggagaggacatggagtccaccacccagtaggaggacatcaagatcccattgtaaaatgtggtgtgcatgggagaagggaaatttcttcttttttttttttttaattttattttaagttccaggatacatgtgcaaaacatgcaggtttgttacataggtaaacgtgtgccacggtggtttgttgtacctatgaactcatcacctaggtattaagccccgcgtgcattagctatttgtcctgatgctctccctcccctcgcccccacaggccctggtgtatgttgttcccctccctgtgtccatgtgttttcattgttcagctcccacttatgagtgagaacatgcgatgtttggttttctgttcctgtgttagtttgttgaggatgatggcttccagcttcatccatgtccctgcaaaggacatgatctcattcctctctttttgagaccaagcctcgctctgtcacccaggctggagtgcagtggaacgatcatagctcactgcagactcgaactcctgggctcaaggaatcctcccgcctcagcctcccaaagtgctgggattacaggcatgagccctgcacctggccaagagggaaaatttttgagatcattttcgaaaatacagtctaccacccgaggtcaagcccagtgtcgatggacagataaatatcctacagccaggatgtgcatggaggcatgaggagagaaggcagaattgtgagcagataataaaatattctacagatgtggagaaatgaccaacacaaaatgaagttgaaggctgggtgtggtggctcacacctgtagtcccaacacttttggaggttgaggcaggaggactgcctgaggccaggattttgagattagcctgggcaacataatgagacctatctcattacggttgttgttgttgttgttgttgttgttgttgttgttgtttgagacggagtcttgctctgtcgcccaggctggagtgcagtggcgcaatctcagctcactgacacttccgcctcctgggttgaagctattcttctgcctcagcctcctgagtagctgggattacaggtgcatgccaccatgcctggctaatttttgtatttttagtagagacagggtttcatcatgttggccaggatagtctccatctcttgacctcatgatctgccctcttggcctcccaaagtgctgggattacaggcatgagccaccacgcctggctgtgtctcaggtcttaaggtccctagctggtcagccttctttccacttttcagagtttccttttctttttctttctttcttttttttttgagatggagtctcactctgtggcccaggctggagtgcaatggcatgatctcagctcactgcaacctctacctcctgggttcaagcagttctcatgcctcagcctccttagcagctgggatcacaggcatgagccaccatgcctggctattttttgtatttttggtagatacagggttttgtcatgttgggcagaatggtctcaaactcctggcctcaagtgatccatctgcctcagcctcccaaagtgctgggatgacaggcataagccaccgcgcccagcctgagttttcttattcttattttatatacagtgtcaaaggttcttagttttacttaggaggagaaatagggaaaagtacatctgctccatcttcctggatgtggaagtccagtggttcttcctaatatatattaaaatatcttttgatatataatctctctctctctccctacccctccctccccttccatttcatttgttgaaaaaaattgagtcatttgtcctgaggatttcccccagtctgtattttggtaattgcaatcccatgtgtctcttattatgcccctctgtccccgttgttttctgtaaatggtgattacatttagaagcttagactcacgcttgatttttttggcaagaatattttatgggtgtgctgtgttctcttggcaggcagcacatgacgcctggttgtctttgtgtagcattagcagctttcattggtcattgtgtagattcattaacttattaggagtacagatggctttcaaatacatgaaaagatgccaacctcaattagatttttaaaaatgaaattttaaagtatgagtactattttttcatctaccagattgacaaggatcagagtgttaacacgaatgttggcaagagtgcagaggacaggcgatttcataggctgcctgattggactgtatccatcaaaatgactaatgtatacaccctttggcccagcaattctacttttagggatgtaccctgtggatacatgtgcatatatgcaaaatgatggattgcagtattgtttggattagcaggagttaaagcctgggcaacatagtgagaccttgtctctactacaaataaaaaaatattagccgggcatggtggtgcatgcctgtggtcccagctacttgggaggctgaggtgggaggatcctcaaatttgggaagtcaaggctgcagtaagtcacgatcatgtcactgcgctccagcctgggcaatagaacagaccctgtctccaaaaacaaaaacagtaacaacagaagttgagaactaccaaattgttccacctggagtgctacaaattatcacaacttgtggcagacgctgtgggcaatgtgcctgcaggatgctctctgaagctttggtggacagttctcattaaagggaacagccacctgtgtgtttttgaccaagcatggggcaggcaggaaatgccaaacgtcaaggagaaagtcctgaagcagccctcctcagccaatgagggatgagttggtggataaacaccttggtgttcttttccctcagtgatagaattttgagcagtgttccacgggtttttcaaaggatgccctggtggaggagccccattgcctggagtggcagcttactcattattacaccctatattggctgcctgtccttccttgtgtcacttccccacttaaatcatttgcccctgaatctttattctaggctttgcttttgggggaaatctacactaaggcagagcttggtggtggtttggcagcacagtctgatacaatttatagtagttactataaaaaatagtacttacagccgggcacggtggctcacacctgtaatcccagcactttgggaggccaaggtgggcggatcacaaggtcaggagatcgagaccatcctggctaacacggttaaaccccgtctctactaaaaaatacaaaaaaattagccgggcaaggtggcgggcacctgtagtcccagctctgtgggaggctgaggcaggagaatggcatgaatccgggaggcggagcttgcagtgagccgagatggcaccactgcactccagcctgaacgacagagagactccgtctcaaaaaaaaaaaaaaaaaaaaatagtacttacagtgccagataccatccttaagcactttacgagcattaaacctgtgtaactacctcatgaagtaggtatgattagcacccctattttttaggcaaaaaactcaggaacagagaggttacgtcacttgtccaagggcacctgcctcccctgggcagtctcgtttcagggtcctgctccaaaccattacactatcctttctctggtcccctgctgctccaccagcatgagctgagcttggccacggttggcctcttcgtttctggacctctactgtagtggtcagctgtggagaatggccatccacctaccctctacagtttgttttccaggtgcccagagagcttggcacaaagttcaggtaagattgatatacccttttggggacagccaaacagctgcggagggatgttccacttcataaatggtttgtaaactacagccctatcattattttaatttattattattatttttacagtgcaatcatagcagttatttctgggggaggtttgtttgttttttaagtttttttttttgtagggatggagtcttggtatgttgcccaggctggtctcaaactcctgggctgaagcaatcctcctgcgtcagtctcccaaagtgggattataggcataagccaccacgtccagctttttgtttgtttgtttgtttcgagatggagtttttgctcttgttgcccaggctggagtgcaatggtgtgatcttggctcactgcaacctccacctcctgggttcaagtgattctcctgcctcagcctcctgagtagctgggactacaggcacctgccaccacgcccagctaatttttgtatttttaccagagacggggtttcaccatgttggccaggctggtctggaactcctcacctcaggtgatccgcccaccttggcctcccaaagtgctgggattacaggcatgagccaccatgcctggcttgttttttacatcagtgcaattagagcctgacgtgggcacttgttgacgtgggtactggtcatttcctattcagcaacaaatttacaaaccatctcgttggccaggccactatgttatgtttatattattttctatttcatattcagaaaaactttttcttgctttatgtccacattcttggtatcttagtattttaaaaatgagttcctcaaattttaacattgacttgttaacagttcgtaatatggccatttaaatttcatttaagaacttcaagaattcacaagactctctataatgaaattattaaaactaattatttatatgtgaatttattgaaatgagatggcttaaataattcaggagagaatactcaacatggtcagaattctcatgtgagtttgtgcatattaattaaaaatcaggccaggcgcagtggctcacgcctgtaatactagcacttggtaggccaaggctggcgaatcgcctgaggtcaggagttcgagaccagcctggccaacatggtgaaaccctgtctctagtaaaaatacaaatttagctgggcatggtggcaggcacctgtagtcccagctactcgggaggctgaggcaggagaatcacttgaacccaggggacagaggttgcagtgagccaggatgcaccactgcactctagcctgggcggcagagcgagactctgtctcaaaaaaaaagaaagaaagaaatgaacatatatgatctatataaatgtaggtcttctttgatttttatttatttattttatttttttcgagatggagttttgctcttgttgcccaggctggagtgcaatggtgtgatctttgctcactgcaacttttgcctcctgggttcaagcgatcctcctgcctcagcctcccgagtagctgggattacaggcatgcaccaccacgcctggctaattttgtgtttttagtagagacggggtttctccatgttggtcaggctggtctcgaactcctgacctcaggtgatttgcccacctctgcctcccaaagtactgggattacaggcgtgagccaccgcacttggctatgcccagccatttctattattttctttttctttctttccttttttttttttgagacggagttttgctattgttgctcaggctggagtgcaatggcgcaatctcggctcactgcaacctctgcctcctgggttcaagtgattctcctgcctcagcctcccgagtagctgggattacagatacccaccaccatgcccagctaatttttttgtatttttagtagagatggggtttcaccatgttgccatgttggccaggctggtcttgaactcctgacctcgggtgatctgcccgccttggcttcccaaagtgctgggattacaggcacgagccaccacgcatggcccatttctattattttctatatagtaagaaatagttcttgttatttttgcctcatgacaaaggctatgatggtagagatagaaaaatagaaagctgggcattatgtaatacattattttattgtactttgtgtgtgtgtgtgtgttttttttttttgttttttgtttttttttgagacagcctctagctctgtcacccaggctggggtgcaatggcgtgatcttaggtcactgcaacttccacctcctgggttcaagcgattctcctgcctcagcctccagagtagctgggattacaggtgcgcgccaccacacctagctaatttttttttgtatttttagtagaaatgggatttcaccatgttggccaggctggtctcaaactcctgacctcaagtgatctgcccgcctcagcctgtcaaagtctggaattacaggcgagagccaccgcggccagtcgattttattttattttctgagtcagggtcttgctctgtcatccaggctggagttcagtgatgtgatcacagctcactgcagcctcaaccttctggtctcaagcgattatctcacctcaggctccctattagctgggaatacaggcacgtgccaccatgcccagctaatttttgtatttttttgtaaagacggggttttgccatgttgcccaggctggtctggaactcctgggttcaaacaatctgcccacctcagcctcccaaactgctggaattacaggtgtgagccaccacacctggcctatgtaataaatttgatcatgacataagttgctggtttttctgcgtgatttgtcaatttttaaaaattgcacaagtgaaccaggcacagtggttcacatctgtaatccctaaactttggggggttgaggcaggaggatcatttgagcccaggagttccagaccagcctgggcaacataaggaaaccctgtctctatttaaaaaaaaaaaacattgcacaagcaatacacaaaattattatcttaaacttctatagacccagaagactataaagaagtgaaagctggctaaaaagctttttttttttaaatttaataaatcatgaacaggtgttagctgggcaccgtggctcatgcctgtaaccccagcactttgggaggccgaggcaggcagatcaccggaggtcaggagttcgagaccagcctcgctaacatagcgaaaccccgttgctactaaaaatacaaaaattagctggacgtggtggcgggcatctgtaatcccagctactcaggaggctgagtcaggagaatcacttgaacttgggacgtggagactgtggcgagtcaagatggcaccactgcactccagcctgggcaacagagcgagactccatctcaaaaaaaaagaaaaaaatgaacaggtgttgaattttacaaaatactattttcatatctcctgaaataatcataagcattttctttgttaatttttcaatacaataaattacatagataaatttcttggctgggtgcggtggctcacgtctgtaattccagcactttgggaggccaaggcaggcggatcacttgaggtcaagagtccaagaccagcctggcaaacatggtgaaaccctgtctctattaaaaatacaaaaattagcctggcatggtggtgcatgcctgtaattccagctacttgggaggctgaggcaggagaatcacttgaactttggaggcagaggttgcagtgagccaagatggcgctactgcactccagcctgggctacagagtgagactccgtctcaaaaaaaaaaaagaaagcaaaaagaaaaaattcctatatgtagtcaatcttgtttacctggaataaaccctacaggttgtgatatattattcttttaatattatgttgtttgttaatattaggtttggtttattaatattataactttggcatacatgttcataagtaatagtgaccaataattccctttcttttccttcctttcttccttctttccttctgtgtttccctcactctctcccttctttccttccttcctctctcttccttggtgctgtacagccttgcccagttttttttgttttgttttgttttgttttttgagatggagtctccctctgtaacccaggctggagtgcagtggcacgatctcggctcactgcaagctctgcctcccaggttcatgccattctcctgcctcagcctcccgagtagctgggactacaggcgcccgccaccacgcccagctaatttttttgtatttttagtagagacggggtttcaccgtgttagccaggatggtcttgatcccctgacctcgtgatccacctgttttggcctcccaaagtgctgggattacaggcgtgagccactgcacccggcagccttgcccagttttaataacagttataatggtaaagaaagaaagaagagtttaaaagatttatatcttttcctgttttctgaactcattattttaaaatattcaaaatgaaaacgtacatttggattgatttcaaatccaactgaatacaagaaatattgacattaatttgtcagttatagaaaggaagagctattagaatgtttaaatataatttcaatagtaagctttggaatggcttacatttttctcttatttcctacttgagattataatgtctccttttttctgtttttttttttttttttttttttttttgagatagagtcttgctctgtggcccaggctggagtgcagtggcacaatctcagctcactgcaacctctgcttccctgtttcaagcatttctcctgcctcagcctctcgagtagctgggactacagatgtgggccaccacgcccagctaatttttgtatttttagtagagatggggtttcacccgggttcaagtgatctcaccatgttgccaggttggtctccaactcctgggcccaagcgatcctcccacctcggcatcccaaagtgctgggattacaggcataagccaccatgctgagccctgcgtgagccatttctttctttctttctctttttttttttttttttttttttgagacggagttgcgctctgtcacccaggctggagtgcagtgacacaacctcggctcactgcaacctccgcctcctgggttcaagcaattctcctgcctcagcctccagagtagctgggattacaggcacacgccaccacgccaccattcctggctaattttttctgtttttttttttttcagtagagatggggtttcaccatgctggccaggctctggtctcgaactcctgacctcatgatccgccaacctcagcctcccaaagtgctgggattacaggcgtgagctaccgtgcccggccgagccatttcaataataaaacctcatataaaaagttgcatttacaggaccaaagtcaagtttttaaagaaaaaattttaaaatattttatgtatttagatgttttaatcaaagataaaacttcatattttctctatgaaatatatttcatttctttcatcataaatatgtaatatatggaaattgaatgagtttttcaccaagaaccacatagagagtcccaaaccccctccagctttccctttgtgcaattccaagcatgttccatggcaatatataaagttgggaatcactgagcggtctggttaaaaacttgtggaataccacacagctagaaaaaaagaataaagttgacatcagttggtaattgttgaaactgcctggtgagtacatggggattcatgtgtgaatatggaaacttctacaaggctgggctaggtggctcaagcctgtaatcccagcactttgggaggccaaggtggatggatcacctgaggtcgggtaaacacaaaaattagctgggcgtggtgttgtgcgcctgtagtcacagctacttgggaggctgagataggagaattgcttgtacccagaaggtggagattgcaattctcgaaccgggaaggtggaggttgcagtgagccgagatcatgccactgcactttcggcttgggcgacagaaggagactctgtctcaaagaaaaaaaaaaacctctacaagatacagtatgcaggtggaaaaagcaagggaaagtgtgtttagtatgttactatttgtgtaaaaaattagtggaggatcaaaatatatatctgtgccaatatgtgaaaaaatgtttctgggctgggcacagtggctcacgcctgtaatcccagcactttgggaggccggggccaagtgatggcttgagaccaggagttcgagaccagcctgggcaacatggcaaaaccctgtctctgcaaaaatacaaaaaaattagccgggtatggtggcgtgctcctgtagtcacagtgggaggctgaggtgggaggatcacctgagcccaggaagtcgaggctgcagtgagctatgatcaggccactgcactccagcctgggcaacagagtgagaccctctctcaaaaaataaaaaataaataaataaataaataaaagagcgagtgaagacatttctggaagcacatggagaatgtgaggaagggacttgaacggctatggctaggggcaggagctgaggacacatcgtgggggaaggcgtgagtgggaggctggaggctttggtcttgaaccaaacaagatggcgattctaagctccagagagcccatacaagctctgaatccagtacctaagggttggaagtgtagctgtttttctggtgagtagggtagaggatggaggacattggggaaagtggccccccggcgagagaggtcgtgtgcactgagcgggagcagcttgagctggggctggctctcaggtcgcatcctgtggccaccagggggcagtgaagcccactccgaaaagcgggcggggcggggcggggcggggcgcctggggcatgtcccacctccaggcctgccctccagctggagctcctgaccgcttttcccagacccctcctggaccgctggacgcggccacgcgggactccgagagtgcagcacctcctctcttctcctggagagcccgggggaatgccgagtccatccccgcggtcaccctcaacatccagtcctcctccactgcttctaggttatctcattcaattgcccatcacacccattttgtagaggggaaagctggggcacagagagagtaggtaactcactcactggaagccacggctcgagaaatgacgacccgggacacaaatctggctgtccatcctcaaaaccggagcattcatgaaaccatggcttcctcactgatctccttgtttccactctgcttcccctccggaaccttctccacccatcagccagagttttgggggctctcgggctgtatcactccctaacttaccacctttctctggctgtcactgccctcaggatcaagttcagtcctctcaccccaccctctgtcatcatcttaaacccagcagcgccctctctcttagctctggacacaccagcttttcagcctgaagacaatgcctgctcatctggtgcatttactgcttcttccccaggcccactctcctgcctccccacttaattttaagttaaccgtgatgcactcttcaggccctggctctcatgtcaattcctccagggagccctccctgactcctgattcccagacgagctcagatcgcacttactatgagtctcttgggttgcactggcttcaaacatgcacttcatttttgtatctataatggcatcactattctaaaaatctgtcatccttgagtctctctgaagctatctctactccatctgaaatcctgtgggatgtgccttaaaaatctgaagtctgaccccttcttacctccttctctactaagtccttcatgtcttggtagaagaccaaaccgcttcctcatggtcgttgctttttcctcctttgcccttactggggcttagaaaacaataccccaaagtatggcactttggcataccgaatactttgaactaaaggaggctgaaaggcctcagaaacaagatctctgactttctcctgccttgctgtctcccatttctctttctcccctgaagcaagtaacagaaactagcattcattcctcttccccaaggtgggtcatagaaactagaactcctctccccaaagcaactcataaaacacagaaatatatatatatatatacacacacacatatatatacatatatatacacatatatacatatatatacacatatatatacacatatatatacacacacatacacacacacacacacacacacacatatatatatatatacacacacacacatatatatatatatattttttttttttgagacggagtcttgctctgtcgcccaggctggagtgcagtggcgcgatttcggctcactgcaagctccgcctcccgggttcacgccattctcctgcctcagcctcccgagtagctgggactacaggcgcccaccaccacgcccggctaatttttttttgtatttttagtagagacggggtttcactgtgtttgccaggatggtcttgatctcctgacctcgtgatccgctaaaacacagaaatattactgtaaccttcctctgctctactgtgtagaagctggccacaaattctcggctgggcatggggatcactggaggctaggtgttcgagaccagcctgggcaacataacaagatccccatctctacaaaaaaaaatttgaaaattagccaggcttggtggcactcacatgtaatttcagctgctcaagagactgaggcaggaggatcacttgagcccaggaatttgaagctgcagttatctatcacactactgcattccagcctgggtgacggggcaagaccctcttaaaaaacaaataaatactctgacctatgtcttgtctcctgtacaggagaggaaggaatgctacacagaggccaagaagaatctggactggccttgctgggttggctaatttaaaaatttttttgtagagacagggtctcactttgttgcccaggctgatcttgaactcctgaccttaagcaacccatcccccacccgcaaagtattgagattacagggtgtgaactgccactttgtttttcttttgttataggaatgtcagtcacagaaccttctgatgggtgaggaaaggcatcacacctttcccccacaccctacagcagctagagccgtgcttatgtctgtctcttccactagaatgaatgcttgtaaaggcaaaggttttgtttgaagaagtccccagtgcccaggactatgtctgtgtagagcagagctcagtaaacacttgccaagtggctgtgtctcccactagaatgtcagctcctgagggcagagactgtgtctgtcctgttcacatgcagccccagtgcccagcacacagcatgtacccagtaaaaccctgtcaccgtacaggtggataaattcaggcccagaaggaaggaaggacttgtccaaggccctcccctgagggcagcagagccaggaccagtacccagctctccagcggcccctcctttccccatcccggagcacacaagagcccaggctctttgttcactgagtaaacacagtttattactgaactgcactttcaccttcacacagactatttcaaagagctggaacaagtgtggggtgggggttgggggaggggcagatgcccctcaggagccaggaccctcggccagcttccctggaccagggcaggggagggagcatcaggccgtccaatctccgggcaccagctctccacgtgcacgcgcactgcaagccagcagctcctcacacataaatacagacacgcttaacaaaaatagtatatcatcttcacaaggaataaaaactagtctcaaatatgtacagcagagagcccggggtggctgggacccctggggatgagacaggccaagggtggagcagaagagagagggaggcctgaagagctcctggccaggccactctggccttggcagcctggctgcccaggctggacaggcatggggcacagatctgcctggccaggcaggactggcccttctagtcagccctaccccaccccatgcagcaggctctccttcctgcccttcctgcctgaggtagggaagaccctggggctcccatagctgttcctgatagctccctttcacctcagggctgagtcccctgaacccaccatgaggagcagcccaaggcaaagatgccacaggctgctcttgtaggaagtgaggcagctgaggccataaacagctctggggcatctgtcttgggcccagttggtccctcagtatggtcatgggagccagggaggggaagggactagggtggtgctgaactgcaagggccaccctagctttggcatggggtgcttcctgtagctatagccccctccctcctgggtggggctggcctctagccagaggcttctggaggacatttggactgggagtgaggactctagccagtccagaggtgaggagggagtcctggtccttgcatctttatcccaagcagcctgaatccctagtcaaaagtggcccctaaatggctcttagggggtagggatggaaggaaagggaacccaggttagtgtggggagagtggggggaaaatgatcaattctgaggccacaaacatcaaaacaaaggcaatctagtctcctttctggggaagaggttctgaaaactttcaagctccctggcagaaaaacattttcagggaggctaaggggtaagggttgcaccaatcaggtagggccctcctgcccccagccacaaacccttccatacctgccagcctcctttggacagattttgtggaaattttgtgaattctgaggccaagggaactgaggtgtgggggtctcacagaagtgtgataaattctagaaaactagctgcaagggaccagatctgggcccaaccctgtgatgggcaggtgggcatgggctgcatgtagtggttctcctggtggcaatggcggctggacggaggatgtggtggagcagagaagggggtgggagggtagagtggatggtcagtgtctggtcatttccgactgaagagtgagcccagcagaaccacgccggccacagtcatgcccgtcaggaaccagcggttgaagcgttcctggccctttcggctctcggctgctgcattgttcccatagagttccacaaaagtatcctgcagggagagagaaggaaggtgcagttttagtcctcagagagtgatgtaggtgggtggggaaaggggccatctgcatgctatggccttggtgatgtgaaaaactgtagccatctgtgcccactctgggccaggtaaagggctaagggtggtcctctttcttgaccctccattggtgataatcaaaccatgttactgctgagaaacaggtagagaggaggaaagtgccctgtctgaggtaagtcaagaagtagcacttactccagaatccaaggtgggaacgagatgggcagggtcagggaactgatggaagccaggtggctggagcagagtgcaggagaggagggcatgggggagatgatggtgcaggggtgagcaagagccagaccatacgtggcctggaagccgcaaggagcctagagttgagtctgagggtagtgtggagtgtggagccactaggcctcagattttctactgctgcaccagagggagggataaggaagcccagggctaaatccccagggtcatttgaggccaattcaggggtagaatgggtcctgggacttcagccagaggctcctccctctggagggagcctctggtgggcaggttggtgacaagaagagcagggcagaggagagagggtaacaatgatgcaggactgacaggcctccatcacggggtctgtgaggccttgtcccggacatcctccactgcagggggtgtgactctgggcccaggaggttgtgatcaacagccctctgccctgaatctaagtcagaagggaagcacatgacagggggaaggaggagctgtgggctaaattacccagcccagggtgcagcagcctgtggggcagggagaaggacgcttagaacataacttttatgagtaagcgtagtacccaatttgtcctttaatcctcccaacaattctgcaatgcaggctgtctctccccatttacaggccaagaagctgtgcctctgagggtccagggactggatcaaggtcacccagctgtgtcagtggtggagccagaatctaaaactggcatctggcacctagaaatatgtaagaaagaagtaagttccaggctgggtgcggtggctcatgcctataatcccagcactttgggaggctgaggtgggtggattgcctgaggtcaggagttcgagaccagcctggccaacatggtgaaaccctgtctctactaaaaatacaaaaattagccgggtgtggtggcacgcacctgtaatcccagttactcaggaggctgaggcacgagaattgtttgaacccgggagacggaggttgcagtgagcagaaatcgcaccacagcactccagtctgggtgacagagactccgttcaaaaaaaaaaaaggaagtaccatagtaccgtgtgtgtgtgtgtgtgtgtgtgtgtgtgtaaaatgaatgagttactggctggttcttgcctctctaccaagacctctgccacactgggcctacatttccaaccagtcccaaatggccgagtggctgctccctcaagacaggcatgccatctccagttggcctcaggtctcacctatcaatttgctcacttgtgacccctgccgtggcccacttccagtcttgacaaccccctcagtccatgctccacacagagctttctaagaacactggaagccctccagcagcattctcctgcacttagaagggcagcatcatttatttttgtatccctggtacctagcaaaatgccatgtgcactgagctgctaatttgactgaaggaatcctcaacattaaggcagtagagagcagtgacccatgaatctcagcccttgcagaagcacactccattcagtcactccaagttctcaaccttcccagggcttccatcacacctgaaataaagtccccactccttactctggccagcaaggtctagtgggatctggctccaacactttctggcctcctccccacccctgtcccctgaacttcactccagtcccactggcctccttgctgttcctccaacgtctcctgccgcaggagtctgctgttcctgcttgcctggagcacctgaccccaggtcgtcgcctgcctcactccctcatttcacaaccatgactcccctcaaatgtcacctcctaggggaggccttccctgactgccttgtctaaaacagtacaccacccccgtctctctctgcctgtccccttaccttccttgatttttcttctcagttttttttttttttgagacacagttttattctgtcccccaggctggagtgcagtggcacaaactgggctcacagcaacctttgcttcctgggtacaagcgattctcctgagtagctgggattacagacatgtgccaccatgcccagctaatttttatatttttagtagagataaggttttgccatattggccaggctggtctcaaactcctgacctcaagtgatccgcccacggcctcccaaagtgctgggattacaggcacgagccaccatatctggcctttttttttttttttttggagacagagttttacccttgttgcccaggctggagtacaatggcgcgatctcagctcactgcaacctccgcctcccaggttcaagcgattctcctgcctcagcctcccaagtagctgggattacaggcgcgtgccaccacacctggctaattttgtatttttagtagagacggggtttctccacgttgggtcaggctggtttcaaactcctgacctcaggtgatctgctcacctcggcctcccaaagtgctgggattacaggcatgagccaccatgcccagccaccattttttttttcttgtttttaaaagatgtgcccagactgactttgaactcctggactcaagcaatcttcctgcctcagcctcctgattacaggaactacactacacagaatgaccaccatgccagcttttcttctcagtgctttattttttaatttttaaatttttgtgacagtgtctcactctgttactcaggttagactgtagtggcgcaatcatggctcactgcagccttgacctcctgggctcagatgatcctcctgccccagcctcctgagtagctgccacactacaggcacacaccaccatgcctggctaatatttctaaattttttgtagagacagggtctcactttgttgcctaggctggtctcaaactcctgggctcaagggatccttctgcctcagcctcccaagtgctgagattacaggcgtgagccaccatgcccggcctcaccacctcaccacatttttcccccattaagctgtacttctcataactagattctgtactttgtttttgttgtgatgtgtcttccatactagatgtgtctttttttttttttagacgaagacttgctctgtcacctaggctggagtgcagtggtgcaatcttggctcactgcaacctccgcctcccgggttcaagccattctcctgcctcagccccccgagtagcgcctgccaccacgcctagctaatttttgtatttttagtagagatggggtttcaccatgttaaccaggctggtctcaaactcctgacctcaagtgatctgccctcttcagccccaaagtgctgggattataggcgtgagccactgccctcggcctatactagatgtgtcttgatgagggcagaggtcctgtctcgttcctatacacccagtgctcagaacagtgtcttgctctgtaaatacatgagaatacatgagttaacaaatgtattgcatgtctactacatgtcaggcattggtatcccatttcatcttcatcagaatcctgagatgtagatttgagccacatttcacaaataagatgcctgatatttaaagcagggaacactcagcaaacagatagcagagtcgggatcaaactgcaagactgcctagcttcaaagggagggctgctatgtcaggacacttccctgaagttggaggctggagggacctgtcctgtcagtagtgctgaaaggatggatttccaggagaaggaatgtgggagcagggttgaggtggaggatctggggaaaggagggcactagggccgtggctatgcttccctgtctccctctccatcctagctagcctctgcgggtcttggcagacaaaaatattcttacaggaggtttgattttgttgctcccaagtacacccaggtggagtcacaaaataggcttatctgtgatgggggagagttccacactatgaagagcataggagaaggccctggttatcccaagaggccaaatgtctctcaagaaaccagggacactggggttgcagccaaaatgggagaggcctggctcccttgatgggaactttcctgaagtagacggctggcagccacaggaaattttcagctctggggctgggttggagtaaacaggcgctgtccccacaagggcacaaagcattcactgtccagaaacagtcattcctgggtggagggaacattctcatttcagtgccatagaaacattctcatttcacctgccccagcttccactcatgtgttcctggtcatgacaaccttcatttccatttcagcttcttttcctggggaaggggagtagtatttccaaggggtgtggattctaaggattgcttttgcggagacagcatgagcaaaatggggcgtgctgttccagggcgggtgctggagaggcggtggcgtgggtatatttagcccatggttcacacgacacacttggaaataaacagagccattttctcagcaggcggctgctctggataaataaacaggattgcagagcagccctggtctggaaaagcagagataagcccctactgcaccttgggtggctcccactggttttaaccaggctggcatggtaggcaggggatgaggtttaagagtgggttgtagggaggtctctgatgtcacaaaggtttctaggagacccaggcccaagggcctgtctgcatcctctgcttgagttaagaggaaagtggggtagctgacttccatgtgggggtttgtagggccactggcgacaggcaatggctaatgacctccacaggagagtcatggattcctagccaggtaggcccatgaagtcagcaaggccaacccacctgcccattctacgtttccactgctggtttgtagtagagcctacactagaaaactgggtctcctgacttggcccctaggagatgcccaggctagtatcactttcaaggtccttcttccaatacttcaagaggcttcaacagtcctggccacccacttggaatggccccacactacatactcctgagtgcttcaggccctggtgcctttgccaacactgtcctttaactggtcactccatatcttcctcagttaaccaacccctactaagcctataggactccattttggagtcccctcttccctgctcatccctccccaacctctgggatgaatgtctcctttctgttcccagactccttggacttctgtttataccaggggtatgcactgaggctggcattggagactcagccgtgagcaaggcttccatggagcttatgttctagtccattctcaatggtggtaagatcacctccaatggcgtgaagtgaagcattcttagacattacagtgatttgtggctctccacagggccacagcacataaggagatatagagtatatagtatatatagtatataggtattgccctcccatgaaatttgaatacctcagctatactatactatatataccatatatatacacacaatatgtagtatatatagtactgtatatactatatatatactttacatatactatatattatatattatacatatctatatctatatatactatatatagtatagtatagctgaggtattcaaatttcatgggagggcaattaggacaaaaaaatctgaaaaagactccttgcaggggtggatgataaaaaaaaaaggttgagaaaccctgtcttactgggaagcagagaggataacaagaaaaaaaaaagataattttagagatgatagggttttaagtcctggggaggtgacagagaatatctgggggagccgggcacaatgactcatacctgtaatcccagcactttgggaggccgaggcaggcagatcacctgaggtcaggagttcaagaccagcctgaccaacatggtgaaaccctgtctctaccaaaaatacaaaattagctgggtgtggtggcaggcatctgtaatcccagctacctgggaggctgaggcaggaggactgcttgaacccaggagatggaggttgcagtgagccaagatcacattattgtactccagtctgggcaacaagagcaaaaccctgtctcaaaaaaaaaaaaaagcctgttttagcagaggtaataagtgcaaaggccctgaggtgggagggagaggaggggtgttcctgggttgatggcctctgtgtgcctggtttcccccaacagtctgggggctcagtgcaggcagggaccaagtctggcccaggacctactcagacaggcacagactgacttcagctagatctctgcccagaggcagccaactgaacgatgcaggtcaccttgtaggtgcctgtgaccctgtagaagtcaggtgaaaaggttggcatgatgccctgaggaaaggggcccaagtgccagaggaccagccagaggctgaagtatagtccctacttgaatctgatcttttagttcccatcctggcttcactgcccacatttccttctttttttttttcttgtaaatttttggagagatggagtctcactacattgcccagggtggtttcaaactcctggcctcatcctcctaccttggtcttccaaagtactgggattataggcatgagcaactgtgcccacccttcccacttcttccaagtagtgtgactttgagcaggttacttcacctctctggtccatggtgtccttgctttttttttttttttttttttgagatagcctctcactctgttgcccaggctggagtgcagtggcatgatcttggctcactgcaacctcagcctcccaggttcaagcaattcttctgccttagtctcccaagttgcctgggattacaggcacccgccaccacacctggctaattttttgtaattttagtagaggtggggttccactatgttggccaggctggtctggaactcctgacctcaggtgatccaccttccttggcctcccaaagtgctaggattaaagacatgagccaccgcacccagcccttacttgttaacagtaataaaatactttaggagctgaggcaggaggattgcttgagcccaggagtctgagaccagcctgggcaacacaggaggaccctgtctctacaaaaaaattaaaaaaaaaaaaaaaattagctgggtgtggtggtatgcatctatggtctcagcaactcaggatgctgaggaggatctttgagcctgggaggtcagggctgcattgaatcatgtttggggccactgtactccagcctgggcaacagagtgagaccctgtctcaaaaaaacaaaagataaaagcaaagaaacaaaaaactattattatgacagctgaccattaccaaacatttcagtgtttcacctgtgctgggcactgagctataaagcagtctatgcacactaggccatatttcccaattacatgtacaatcatcatattcacttgagagattattttttgtcctgtctcccccacttgactgtgtgtggctctgtcacctgtatctctagaacctggtgtgctatacttggaacacagcagatgccattctaaataaatctattttagaagaacaaatgaatgctttcatttgatcctcataacatttatcaatagccccattttacatatgtgaaaatggaggctccagaatttacccaagatccctatctaggaagtggcaagagtaggatctgtctgagttctggcctcacaccattctttttcttttaatctatccaagatagtacttcattcacactcattctgatgtccaatcttgccatcttagaccctgctatctctacccacagaaaacctgacttccttagtgacttcagcagcagcgcacacttcctgagcacatactctgtaaggtactcttcttggtttttttgtagattagttcattagttgtctctacactctgtcagtgggtactaccattaacccatatagctgatggatatgtggcccacagatgatctgtgaattgctcaaggccatgtagtgagctggtgacctaactgggatgcctacaccagcaatctggttcagtgcctttactcctaacgttgatgcagtactctgctcagtttctaaaggacaatcatgggccaggtccatgtacttctgtggctgaggaaggccttcattctaagtccaggtaacctgaggctcagagatactgagacctagctaaagtggataagtggcagctagctgtgatggctcacacctgtaatcccagcatctttgagagttcaaggtgggcagactgtttgagctcaggagttcgagaccagccagggcaatatggtgggacccccatctctataagaaaaatcttagaaatttagctgagtgtgttggcatgcacctatagtcccagctactcaggagactgaagtgggagaattgcttgaggctgggaggttgaaactgcagtgagctgtgacagcaccactgcactccagccagggcgacagaatgagaccccgtctcaaaaaaaaaaaaaaaaaaagggaagccatttttaagccccagtatgtttggcagcaaaccccatattctgagccagggccatggccctgggtctgtcaaggagggtaaagtagcctgaggccatcagctgaatgaataagcactggctcctgccagctgaggggaactggtgccacaggaaaaggatgtgacgaagaccaggagggaaagtgaaacccttccgtcctggcttcagtgaggaacaagcatgcctgtgccagacgaacccttccttcctcttgggtgactctggagggcccaggcccattgcttccttcctgcttggttatttcaggaaagaggtaggtggagaagaggaagaggctactagcagccaggaaaagtgccagggacaccagaactgtaccttgttctgtccttctcacatccctgcattggcaggctgtgagtcacctgcagagtcaccttatgctcctggcctcagtttccctgagggagaggctgataaatgtgtgctgaatagacaaacatggccttgctagaagatcgctgggagatggtaggaagggggtagggcaaacggagaggccttatcactcttttggcagggagttgcaggcggagactcggaagaagtgaggtttgtggttggaatccacttcctctggttttcccaggggagctgttggctcccgagatgtgagaagaacatggcctttctcctctcccccacggaaacataggcctggaggtgggcaacttggagaagcagctcagtggaggcagggcaaagagaggggtggcaagactgtgttggggtcaacacctcagtccagccggcccaggtatgggtgggtgccacagcaagccttttggcttctgagcctcagtttctcctgccttgacctccctagcagtagtggtgagatcagggggtgtcatagagggctcaagccatctgggctatagggaatatttggtggtatcctcacaacaaacttcatgtttatcttcctccaactctgacctgttcaattcagctgccagcctctcctcctccacctcctcccccaccattagttctaagaagctgtgcctgacagatgcacttgcatttctcagaaaaggaagcggttgtgccgggaggagataacacctccgctggggaatcgagaaagctatcaggcctagcagtgcgagtgtgggctctccatctctctggctcagaaccagggtgatgggcttgggggcaaagagagagaattcagaaaagcatttactgggggcagagatgctcatttgggggctcataacctccttccctggaaccgatggagataaaacagctgatgtttactaagtaccaggcatggtgctaagtgcttcgtgtgtaaagaatttgcttaatcctcacaataatcccaccgagtacatgctgttattactctccagcttacagatgaggaaacagaggcagagaggataaatcaccctcccaaggtcacagaggccacaagtggtagagttgggatttgaatacaggcagtctgtctccagagtccaaacatttaactgttcctgggtggctgctatgtgctcatataggctcatcccctgggattccgatgcctcccgtcatctcaactctctcatttcaaccctggtgactccctattctttcgtaagtagatggccacagccctccattcttctcccagtgtccagggtgagaaaaaccaatactcacccttggaacagagtcggagactccagggaccttacagcatgcccatccaaccttccatgtaatactcaagctcaccacgaacacccccatttcacagacagggttcagaagggtggagtgctgaagtcccacagtgggtctgtttcattctgatggtccacacccatgggagttggtagtcatctcgagggcattctctccttatgcacttatggagagctccctccttcctgggtgggacatttcatcttcggacagccccgttggaaaactcttccctgtcagggagctgatgctcgtctccctctgtctcccttgactggctggtcttagttctgctctctctccgctgctgctctcctgctctcctccaagtatcagttgtctcatttgtgaaatggaagtgctatctggataaaggcaattaatttctacttctctaccaagctgggctgccagagcacagagcaggcagagaaccaataagtcttgcaaactagattaagatattttgcttttgacctcatctgtaaaatgcggattaaaaaaatccttatttaatttttttttttttttttgagacagagtctcactctgtcgcccaggctggagtgcagtggcacaatcttggctcactgcaacctctgcctcccacgttcaagtgattcttctgcctcagcctcccaagtaattgggactacaggcatgcaccaccatgcctggctaatttttttgtatttttagtagagactggatttcaccatgttggtcaggctggtctcaaactcctgacctcaaatgatccacccacctcggccccccaaagtgctgagattacaggcgtcagccactgcatctggcccaaaatgtccttatttcaaaagaataccatgaggattcaaattaatacatgtaaaggtcttagaattgtgcatggcacatagttaactttgagtaaatgtctggtttattgttcttactagtagaccatggctcagcttgtgtctcggagccttctctatggcttacaagggcctgcagggttttctcagcttcacctagggccaggctgcttcattcctcacatgccatgttctgttcagactcaggacctttgcccacactggtgcttctaccaagctctgtcccacttatctctgaggtcttaatccacaggtcactttctcaaggagcctagctgctcacttcttcccccatctgaccatgggctctgtcccctaggccttgcccagtgctgggtccagagaaggtgctgaagagtctggctgagtgttggacagagaggagggaagagaagaaaggccagttcccactctcttcatccctttcctcactgcctggcaaaactagaaagaggccccaatatagcaggtgattatgcaaggtgtccagtattctccagacactttctctcaggataaggaaaggggacaggaagcttatgggaaagttctagaaaaggcatcttttgcactgtgctgaggcaacaggcaggaatggggtagcaatctccaaaaactaggacttctttctgaggtctttgaccccaagtgctccatagtccaaagcagcttctccttcctcctctccacccaaagctatggcgactcccttgtctgatgcagatcagtgctggatgctgtggggaagagagtactgggctgacagtcagtggatgtggattttgtttcccagttccatcgctgatttgcaggtgagtcctttcccctgcctgagactctgggaaagtatgggcctttccccaactgtcaaatgaagtgggaatcatctcaaagggctccgtctagggctacagcataaggagaatgaaagtaactcatgcagacagatgagtgactaccagggttctctctctcaggggtatccaaaagatccagtaattagtgtgtaaattgagaagcaacattctgaagtaggagaacttgttgccacaaaggagtctgatccttctccacctcaaagcccgctgggcattgctctgaacctgcaggattccaggggaagagagcaataggcacatctatgaccaggcagactcctgggcaaggctagatctttccacgctctagctcctgtggcctcgacctcttcaccccagcaccgcctccaactagtccagacaagtcccaagtattttcagccacctttatctgatcagaaatgtttggaattccacagcagaaggcaacagctctggaggatttggggaagggagcaaatccctgcaacacccttctctccccactgtacagatgaatgctcacaccccatgtaaccaaaaactcagggctgaaggcacccacggtgttgcatttccttctattctgtgatgtgatggaactgggaaacaaaacccacatccactgactgtcagcctcatactcttctctgcagcatccaacattgatctgcaccagacaagggagtgggttccttcttgttttctaccctattcatttctgccccagtccattacccctttaaggtgcagaacagtaagatgcctgagatggtgagaagagggctagggtactttgcctgatgtcgagggagggggcacccagaggtgtgctgttcacagtcaatacccagagcaccaccaccaggaggcctggaagcaactcactgtcccacttgatgtggcctgtggaccaccagaaatttcagagcgtcacagagatgtgtggttcgatcctgagcaggtaagaaactgaggcccagaggaagtgaagggatacctccaaggcttcatacagggacagagcacagcctggtctcaggcctccctaccctggagtgagacagtgtggcttccaaccctagttctgtgactacctggttgcaggacctggagcaagacactttccccctccaagcctggtgttccggctgcaaaatgaaaacagctgtacttacttcacaggcctagcagcagagttcaatggtccatggtaagcgttctgtaaatgttagctgctgctgctgctgttgttattattatcgttattaattgagacgaagtctcactctgtctctgtcgcccaggctggagtgcagtggtgtgatctctgctcactgcaacctctgcctcctgggttcaagcgattcttgtgcctcagcctcctgagtagctgggattataggcatgtgccaccacactaatttttgtatttttgcaggctaatttttgtatttttagtggaaatggggtttcgctatgttggccaggctggtctcgtactcctggcctcaagtgatctgcctgcctcagcctcccaaagtgctgggattataggcatgagccactgcacccagcctgtttttttatagctaaaaaatcagtggctccatttgtgcttctcatagtgtctctcttatttgtagctataaacaaacaaaaagtaacagctagtatttgctgaactaatatttactgtttgaattctcaaaatcttgcaagtaggtgctgttcccattttaccaatgaggaaactaaaattcagcgaagtgatgagactttgcctgaggcccctggttactagtgagggcattcaacttcacagcatgttaaatttaccagtgcaacaggatacatgaagagattttactaagaccttctttccttcaccctttcacctacccaatatttactgagaatctgctattcttaggccttcgaagtcagagatgactttaagtacatggaagtagcattcccccctggttccctgggtgccttgaggggtgagaaagggaagagtgtgctgaggctactcagtgatgaacccactttcccctaagccagatctgcaaggacagtacttgcagagagagttcctccctctgtctgatctttatcttggaaacaaaagtgatgccacgtagctttggtgaagctattagatgagttttctaagatgggacatgacctatttgtaagccaggctgacctatggagttgtaggaaggcccagacaggctgccttccctagctttggacactcagtcattcaacaaatcttcattaagtgcccactaagagtcaggcactgtactaagcgctggggataaagcagtgactaaatagaatgaaaattcgtacctgtatgagtttataatcaaatgggaagagacaggcaataaacatgtcagacggtgatgcattaagaaagaataaatgtgagaaagggggtacagagaaacatggaagaaggtaagattagaatccatggtcagggacaacttcttaaggaggtgaatttgatcagagacctgaatgaaatgaggaaacaggcactgcaaagatctgagaaaaggctgtgggaacaagtgcaaaggcccagaggcaggaacacgcttgaggtgctccaggaacaggaaaaatgccagtgtggctgaagtccagtgaatgtgaggagactggtggtgatgagatctggaggtagccaagggcccgattgtgtggggcctggtaggccatttaaagacttgggcttgtcctgggaaagcactgtagggttttgagcaggggaaggacatgacctgaccttggtgttaaatagcgtccgtctggctgctgggtggagatctccaggggtctggtgagataatcaggaaaatatgacagtggcttagccacaatggtgccagggaagttggtgagaagcagtcagtttcagaatttattttttaaagtaaggctgggccaggtgtagcggctcatgtctacaatcccagcacttgggaggccgaggtgagaggactgcttgagtccaaaagtttcagaccagtctgggcaacatgggaaaatcctatttttacaaaaaaatgacacaaagtagccaggcgtgatggcatgttccagctattccggaggctgaggtgggaggactgctggagcccaggaggctgaggctgcagtgagccatgactgcgccactgcacttcagcctggaagacacagcaagatactgttcttaatcaatcaatcaatcaataaaagtagagctgaaaggatttgctgatgaattagatgtggactgtgggagttgcctgccctcttggccctctgtttcccatctataaaaggcgagagaagaggcccttggggatttctttccagtttgataactatgaggacctatatgaagaaagagataaagcaactatttctgctgctctcatggaagcaaaatcatttgctcaccaggcctcaaagtgtggatggcaataagatgaggaaggcagagatggacagagacagtgcagcaaagggagggcagggctctgcctaggctgtggctattccactttcagcacacacattaccgccaggcatatgccaggccacagagtagacaggctccagtgggagcgggggtcagggtagcttgctttatattaggagagaagaagcatcagagctgccgttgtccagggcctactaggcagaaggtgctcagtgactgactgactgactgagtgaatgaatgaataaataaataaggtaatgccagaaggccagtatatgtgcaagaacttcccaagtccttccaaattaacaggaggtaggcctggtccaaaggattgctctcctgtcactttatctgcttattctaggctgagcttcaagttcttgttctctgtgaatgggagactatgtggtctgaatcactgaagcaggattttagagctggaaggcagcacagacacatttggtccactctatccacaatttcagccatcactgctttgaccttatatgtgattctgttattatttacttaacatttttcttttcaagacagggtctcactctgttgcccaggctagagtgcaatcgtgtgatcaaggctcactgaggcctcaacctcccaggctcaagcaatcctcctgcctcagcctcccgactaggtgggactacaggtgtgcatcaccatgcctggctaatttttttttctttttctttttttgtagagataaggtctcactatgttgcccagtctggtcctgaactactgagctcaagctattctctcgccttggccccccaaagtgctgggattatagctgtgagccactgtgcctggcctacttaacattattctatcaatttacttactttttataaatttaaatacatgtactgaaaattctcaatttattccctaaacctgttctttctgcatctttctcatccttaaatcccctctaacactcatctgtcaatatatcctgatgaatctgtattccaaatttatctagagtcccaccatttcccaccacctccactgctattatttggtccaagccagtatcatttcttgcctgtattgtcctaacagcctccttactggtctcccagcttcttatcgactccatggttccttcaccacatggcagccagaggggtcagcaaagtcagtttcctgtctgctcaaaaccctccactgccttcccatctcacccagaggaagaaccaaaatgtctcaccactgctcacacaaactttcctttccaatcacttctcctctgcttactctgttctagccacactgatctcccgtgctcttcctcaaacatgccaggcacaccattcccaccctttggcctctgcacttgttccttatgtctggaatgttttttccatagactgttacatggtttcctccctcagacagatcatgcagatctctgctcatatgcctgctcctcagaggccttccttaattatcctttattaaaaaggcaaacacataccaaaagctgcctaccaccggccacctaatcactctctgtcctcttagaatgtaaacttcatgatggcccggcgcagtggctcacgcctgtaatcccagcactctgggagaacgaggcaggtggatcacctgagatcaggagttcaagaccagcctggccaacacagtgaaaccccgtctctactaaaaatacaaaaattagctgggtgtggtggcgggcacctgtaatcccagctactcaagaggctgaggcaaaagaatcgcttgaacccgggagtcagaggttgcagtgagccgaggctgcgccactgcactccagcctgggcaacaagagtgaaactccatctcaaaaaaaaaaaaaaaaaaaaaaaaaaaaaaaaaaaaaagaatgtgaacttcatgaaggcaggtatccccagtagctagaatagtggttgacagatagtagacacttagcaaatatttgctaaataaataaatgcaatgaaaaggcaacttattattcttcctataaagagtatcatttgccccagatggaaatcaacataaaatacactgactattaaaacagaaaatgtccatctgcatatcacctctaagttaccttgaagatcctggtctaacacctttacagaggagatatttgagacccagggcagagtcagccagctgaccggaagccagtccagaatggcccacaggtaccccccaacatgccttggaaccacagccctgtcccccagggtgtggacaaagagactgaatctcaggaaaggtatagctaggttggaccaaaagaacctatctgaggggccagaaaagccctccctagcaaggcatagagctagcagttttcctgaagagaacaaaggccaaagaggcatgagtgtgccaggctgggagagcctcatggggctgcaccgtgggtgacaggcacgtacaaacctgtaagtgaggtccacagagaccagagagctgagagcagaaatgaaaacaggataggtcccaaagggtggcagcttcaatccgtaaacaccagacaggcgtggggttcaggtgtaggtctggggacccagctgagcccaggggaaggatgggacctccccagtctcctccgtcagtgatgattactctaaggtgagctgagcagaagcaccaccaatccagctatagtaacaccagacatcagacattaaggagggaagagccagatctacccttctcatctccacattccggatggtctgtctcctcccaaacccactccacccatatgagccctcggggatccaaaccctattaagaagggaccatccatttcccatctttgaggggcttagtgaacacggctacaggtgcaggggtgaagctagagatgttgtaactgccaagccagcaatgcctgacctacatctccacggttggttgcatacaaagaaaaataccagggatttccgttggtgttcaccacatgcagctgccaagggaaggctgggccttctgaaggcctgttgtgaatagggcaagacaagtgataagcttgctgggataggcgagaaggctggcctctaaatttactggctctggggacctccctagattttagagactctatataatttttacctgctttctaccaaggtcctccattaaagctttttcttcttctagtatatttttattaagaattgagaaagacagccaggcgtggtggctcacgcctgtaatcccagcactttgggaagccgaggtgggtggatcacgaagtcaggagatcaagaccatcctggctaacacggtgaaaccccgtctactaaaaatacaaaaaattagccaggcgtggtggcgggtgtctgtagtcccacctactcgggaggcttaggcaggagaatggcgtgaacccaggaggcggagcttgcagtgagctgagatcgtgccactgcactccagcctgagtgacagagcaagactccatctcaaaaaaaaaaaaagaattgagaaagagagaaaaagaagattctatttggaaaaatgttccccaaactaaacagctgttcttattgtaaaccactggtattttcagtgaggctctagttccgcacagaaaaaaggcaatttgaaagttccacatggtcaggttcaagaaacgtgagcttactcctgctttgtggtggctctatttggctatggtcctgtcaattaagcaccacgggcctcacttttctcatctgaaaagtgtggaggatggatcagatgatctctaaggctttctctccagttccaaagcactaagatcctatctccgggccctttttttttcccctcaagggagcagtggagtgtaagggaaaagtaagctttcttggcagacaaaagactgagttctaatctcagcaatgccatttattaacttactgtgtaacaatggcaacccacttcccctctgggggcacctcattttcttcatatataaaccaaagacccaaaagtgcagtgaacaggtactctaggaggcctttggcattattattatgcctcccttacattgttcacccattagcatatcctggcctcccaaagaacctgttctttacttgacattgctctgacttgcaaacccctgtccttgaaaattaacacgttccaagagctatgccataggagcccaaatagcctctgggtccccaacccccttctgatgtcaataaaaagatcactgctatttattcaatgttttgtatatgccaggccctcatgtgtgtttaaaattcttattttatgaagacatggatggtcacaaaggtgaattcacttgctcaagatccaacacacacaaaatggaggtggttcaaacccaggtgtgtctgactgcagagcctgtgttcttcccagtagagatgtggatgcagcacaaatggtagaaaggacctgagacttagtcagaagacctcagttcacccaaggtaagaggaaaaccctatttacctcctcctagcatcgtcagaggttcaatgagataatgtgtgaacacaaggaagcactagacaaactttagttaatgatcctatgctattattttatgactccagcctgggtttcaccacatttgcaaagagagtggaagtagcaagctgtaatatcttagagatgttacagccccacttctctgttttgtgtcctactcaggctttcttttgttcacatctggtccatccttctagattcctgttacttggaccctccaggccacccagcatgatacccacagtgttctccctgaaaggccatggagcggagggagtaaggggtaaatggaaaccacaagtcttctctaaaacagtgtgaagtagataatccagacttaccttccagaaagggcctcaagcaataagaaaaaataaaaaaaggcagagagagccaagggaagcccatggagaccatagttaagtgagggcttttgagtccaatatattggacttgtattctgtctttattagcattcaaccttaggactataatttaacttactttacactcagttttctaatctggacaatgaggacaataacatgtttcccaagaaggattattgtgaagattaaaaatactacactggccgagtctggtggctcacacctgtaatcccagaactttgggaggtccaggagggaggatcatatgaagtcaggagtttgagaccaacctggtcaagacaacaagacctccatctctacaaaaacaaaacaaaacaaaacaaactacactgtaccttacagcatcttgcacatggcaggcactcaataaatagcagcaactatactgtcattagtaaattaagcacagatgggtcatccctaaaggaccctctgatggccaatagatgcacactgagaaccagtgacttgaggctctctatagcaagtgaagctctgaacggagaaaattctcggtcgggcgcggtggctcacgcctgtaatcccagcactttgggaggcgtcggcctcccaaaggaaggaggataacgcaggaggataacgaggtcaggagatcgagaccattctggcaaacacggtgaaaccccttctctactaaaaatacaaaaaaaaatagccgggtgtggtggcacgcgcctgtaatcccagctactcaggaggctgaggcaggagaatcgcttgaacccgggagtcggaggttgcagtgagccaagattgccactccactcctccagcttggcgacagaaagagactctgtctcaaaaaaaaaaaaaaaaaaaagaaaattctcaaactctttccccgggagggaggcaggcagctcagtgtagaccagagacctctgatcagacatatgtgggttcctcatagcttccaggctggctgttttgtggccagttaccctctctgagcctgattccttatctgtattagacaataagaccatatgttcttcctcctgagaggcaggtaaaggtgtactgtaagagcacaggcatcagaggattgaaacctgggcttaatcctagctctgccacttaatagctggaccatgaccatggcaccctatttaacccttctgagcttcacttatctcatctaaaagccttcctctttgagtagttatgaggattatcagataatgtgctggtgcctggcaaatagtaacaatttcacttgatacatgaaagtgtttatcttatatccagggccaggtacaggaaggcactcaagaaatgtgctgatggccggcgcggtggctcacacctgtaaatcccagcaatttgataggctgaggtgggtggatcacctgaagtctggagtttgagaccagcctggcgaacatagcaaaaccctgtctctactaaaaatacaaaaattagcccagcaaggtggtgggcacctgtagtcccagctacttgggaggctgaggcagaagaactgcttaaacccaggaggtggaggttgcagtgagccaagatcgtgccactgcattccagcctgggtgacagagcaagactctgtctccaaaaaaaaaaaaaaaagaaagaaaagaaaaagaaaagaaaagaaaagaaagaaaaagaaaaagaaatgtgctgaaccaaactctccacttgggtggaagggtgttaagaaaaaagattctcctgtaaactggtacccactgctgtgggcccaggctaactaaccctattaaaatcccaagtacacatacccttggccccagtaattccacttttagggattcatcccccccagatatactgtattcatatatgggccaaatgacaaatatacagggctattcattgagtgtcactattataactgcaaaagactggaaaaaaatgtgtctaccaatgggaactggttaaagtatagaatagtgccctgtgtagaatactatgcagcattaaaaagactgagaaagcttttatgtactgacacagaaagatcttaagagatacaactttgatatttgcatcctatgacaacaaaataacaccactactgtgtaatcaaccacactagggttgctaccatctctgaccctttgtctttggatgctgttaagctaaaagcggaccaggatccatgatgaggttcctctatcctctgggttaagtctgtccaggtaaaataatagggaaagaagaataccattaaaataaaaattggctggacacagtggctcatgcctgtaatctcagcactttgggaagccgaggcaggaggactgcttgaggccaggagttcaggactagcctgggcaacgtggcaagaccctgtctctataattaaagaagaaaaggaaaggaagaaaggggaagggaaagggagggaaggggagggggagggcaggggaggggagggaaggaagaaagacagctgggtgcagtggcttatgcctgtaatcctactaacacttcaggaggctgaggcgggtggattgcttgagaccaggagttcgaaaccagcctgggagacatagtgagatcccgtctctacaaaaaaaagaaaaaaaaaaagaaagaaagaaaataaaaattatcccatggtggtcctggaagaaacaagggaaggtaggaaacttaatcctagaggcagtagtagtcaggctctaggagaagggctggcaaccgcctgaaaatcccctccccagtctttccttaccactccctctcctgttttctttaaaatcagtctcttccatgcctgctaagaccactttatcaggaactcctgaaagtagatggagactaaattggctctgaagaatacaaatggctaacaaaacgttaagaaaagatgttctgccaggcgcggtggcgcacgcctgtaatcccagcactttgggaggctgaggcgggcggatcacttgaggttgggagttcaagaccaccctgaccaacatggagaaatcctgtctctgctaaaaatacaaaaaattagctgggtgtggtggcacatgcctgtaatcccagctgctcgggaggctgaggcaggagaattgcttgaacccaggaggcggaggttgcggtgagctggagatcgcgctattgcactccagcctgggcaacaagagcgaaactctgtctcaaaaaagaaaaaaagaaaagatgtgctacctcacaagtagccctggaaatagtccttggatatttttaactttttttttccccctgtgacagggtctcactctcatccaggctggagtgcagtggcataatcatgactcagtgcagcttcaacctcccggactgaagagattctcctattttagcttcccaagtagctaggaagctaggactacaggtgtgtaccactgcaaatgactaattttttttttttgagagacacagggtctcactatgttgtccaggctggtctccaactcctgggctcaagccatccttccacctcagcctcccaaactgctgggattacaggtgtgagtcactgcacctggccaattttaaacttattcttatgataatatttaatcatgtacaaaagtagacagaataaaacgaacccatcattcaacttcaacaagtaccaacttggtgccaatctgatttcatctgttccccaaccactatctctcactccagtagtattttgaagcaaatcccacacacaggtcagtatgtattttttttttttttgcagacagagtctcactctgttgcccaggctggaatgcaatggcatgatctcagctcactgcaacctccgtctcctgggttcaagcaattctcatgtctcagcttcccaaggagctgggattacaggcgtgcgccatgatgcctggctgttttgataaactctctcccacatgctggctttgagaatcaattgaaaagttaaaaaagaaaaaaggaaaaaaagccccaactttttcccaaagagggtacctttgttcattatgagatattaatacagtaggccaggcacggtggctcaggcctgtaatcccagcactttgggaggccgaggtgggtggctcacctgaggtcaggcatttgagaccagcctggccaacatggtgaaaccccgtctctactaaaaatataaaaaaaattagccaggcatggtgacatatgcctgtaatcccagctaacttgggaggctgaggcaggagaatcgcttgaacccgggaggcagaggttgcagtgagccgagatcatgccattgcactccagcctgggcaacagggcgagactctgtctcaaaaaaaaaaaaaaaaaaaaaaaaaaaaaaaaaaaagaaatattaatacagtatatacaataagctctaggtataacttaagtcataaataattcaaatttacagcctttaacaccctatggaggccaggcatggaggctcacttgaggtcaggagttggagaccagcctggccaacatgttgaaactccgtctctactaaaaatacaaaaattagctgggtgtggtagtgcatgcctgtaattccagcttcttgaaaggctgaggcaggagaatcatttgaacctgggaggcggaggttgcaatgagccaagaccgtgccactgtactccagcctgggcgacagagcgagactctatctcaaaataaaaaataaaataaaataaaataaaataaaataaaataaaataaaataaacaggctgggtgtggtggcgcccggcgaacaaattaatcccagctactcaagaggctgaggcagaagaactgaaagactatatttgtaacatgcatagacaaagtattagtattcaaaatacattttaaaagcctacaaacccataagaaaaagtcaaatcaaaaggaaatggagcaaggacttgaacattttacaaagaggaaacatgaatggccaacagatgtaagaaaagattcacagccccacttgtaatctgagaaatgcaaattaaaaccgcaagataccatctcacacccaccagctccataaaaatttaagtctgaccatatcaagtattaacaaagaggtaaagtaatggaaaacccatatgctgttggtggctgtgtaaattcacacaaacacaggaaaacaatctgccattaccttctgatcaagcaattccacttctgtgtaaaccctacaacaatgattctcagtgaggtcccaggaccaagagtggcagcatcagctgagaagttgttagaagtgcaaattctgagggccccaaccctgacatacacaatcaaacactttgggggtggagcccagcaatctgaggtttaacaaaccttccaggtgattctgatgggcagctaaagtttgggaaccactgcctgggagaaactcttgaacatgtgcatgtgcaggagacacaaacagttttcataacagcattgtctgaaacagcaaaaacaaggggacaacccaaataaccactgacagcagaatggatacacagcttgagacatgatcatataaatggatacgaaaatgaacaaattatgctatgcaagtaacatggatggatctcaaccttgaatgaaaaaaggaaactgcagatgataaacacagcataatacctaaatgaagtttaaaagaatgcacaggctgggcgcagtggctcacgcctgtaatcccagcactttgggaggctgaggcaggcagatcacgaggtcaggagtttgagaccagcctggccaatgtggtgaaaccccatctctactaataatacaaaacttagggctgggcgccgtggctcacagctgtaatctcagcactttgggaggccgaggctggtggatcacgaggtcaggagttcaagaccagcctggccaagatggtgaaaccccatctctactaaaactacaaaaattagccaggcgcagtggcaggtgcctgtaatcccatctactagggagtctgaggcaagagaatcactttaacccgggtggcagaggttgcagtaagccaagatcgcaccacactgcactacagcctgggcgacagagtgagactcggtcttaaaaaaaaaaaattagtcaggtgtggtggcgtgcgcctgtagtccagctactcgggagactgaggcagaagaaccgcttgaacccaggaggcggaggttgcagtgagctgaggtcgcaccatagcactccagcctgggcgagaaagtgggaccgtctcaaaaaaaaaaaacaaaaacaaaaacaaaaaaaagcatgtagaagaatatcctatattgtttaggaatatatacctatatatatatagtaaaacttaaaaaaaaaaaaaaaaaaaggtagccaggtgtggtggctcacacctgtaatcccagtgctttgagaagctgaggtaggaggatcgcttgaagccaggagttctagaccagcccaggcaacatagtgagatcccatctctaaaaaaaataataataataattaaaaaattagctacttggcaggctgaggcaggaggatcacttgagcccagaggtttgaggctgaagtgaggtatgatcatgccactgcactctagcctggttgacatggtaagatatcacaaaagaaaacacagaactcaggagtatggatggtggggtagctgtgattggggagggggtacacagggggctctaaggtactcacgtttatttttgtttgtttttagagacaaggtctccctctgttgcccacactggagaacagtggcgcgatcatagcttactgcagccttaaactcctgggctcaggtgatccccgactcaaccttctgagtagctggagttataggcgtgcaccaccacgcccagctattttttaattttagtttttgtagagatggtggtctcactatgttgcccaggctagtctcaaacttctggcctcaagcattcctcctacctcagcctcccaagtgctgggattacaggcataagccatcatgcaaggcaaacatatgtttgattattaattaatctgggtgatgagtttacaagtgatgattttcctatttttaaaattgtacatatgcattagatattctctgttgtatttatgataaatttctttaaaaaaaaaaagtgtactgaaacagtgcaatactctgagccagaactgtaacaactaactcaacatatgcagtgtccgaagggttaagcctgtttctctgcctgtgggtgggagggcaggcagcagctggggcacagtgggagttcctggctccagctggctccagcctggatcaagcaccacgcccaggaactggcacctgtagggggggcttctggacaggtggcacctgtagcccttggtgacctgatacatgtgagaggctgggcccagtcagatgggtggtgggcttctgtcagagcccctccatctggtaaggaagtttgctggtggcagcttggagctggtgagaaggggaagagggtctaggacacaggatgggggtggggaaggaagtgggtgggctgggctcagataccaagggagggtggtgggattagcacctgctgagaatgagattaggtttcttgggaagggctcatctatctaatgctccccgaaagctgtctccctgtggcttttctctgctggacagatggtgtctgagctgcctcttggagggcgggctccttgagggggtggtggaggtggagtgtgacctgctgcctgctttccagaggaccttgaggccctgggacttcttgtcttccaacaatagtaataaggattagagctaactcttactgaaggtttaccatatgccaggcattgtcctaagcccttcatacaaattaccctcatttagttttcacagcacccaactgcctatcatctagacagtaggcttacattgaaggaaactaaggcttggcaaagtcaaacacttgctcaaagtcaaacagtaagcagggcctggtggcgtacctataatcccaggaagatagaggcgggaggatcacttgagcccaggagttcgagacaagcacaggcaacatagtgagacctcatctcaaaacaacaacaaaaacaaaacagtaagcaaactaggacttgaatgcaggcagttcaactccacagccctagcaggaaatcactatcagccaaggcatcttccccttattaaatggcagtaaggactttccagtttcttaagccaaaaacctggactcctttctctctcacctcttatccagcaaacatcagcaaatccagttggtccaaccttcaaattgtattgaagctctgaccactgctcgccacttccaccacccatccaccctggtataaactgctgttatcacccacctggcttctcactggtctcctgctcccgctcttacccatagagtttgttctccacatcagagagatccttctaaaacctgtcacttctttgcttaaaaatcctccatgcctttccactgcccttaaagcaaggtcccatgtggccctacaagacctggcccctggtgacgtctcagacctgattcctaccactggcttactctactctggccatactggccaacttgctgtactttaaatatgttggagagtctttttttgtacttgctttattttttaatttttttgaaacaaggtcttgctctgtcagccagactagagtggagggacaggatcatagctcactgcagcctcaaactcctggatttaagccatcttcctgcctcagtgtcccgagtagctagctaggactacagacatgcaccactatgcccaactaaactctggctttgtcgctctggctgatctcaaactctcagcatcaagtgatcctcctgccttggcctcccaaagtgttgggattataggcgtgagccactgcatctggcttttttttgttttacggcttgctgttctctatgcctacaacactattcccccatatatccgcacagctcatgccctcactgcattcagatccaatgtcactttatcagagaggccttcctaactaccctacccttccttttcccatccctaatcccttttctctgctttatttttccctatatcactaaatactacctcacatgttatttattttttagaggtgggttgtcactatgttgcccaggttggtctcgaactcctgggctcaagcaatactcccacttcagcttcccaaagtgctagaattaaaggcgagagccaccatgcctagccctgacatgttaatttacttaaaatctgtcacccaccttggaatgtccactgggtgagaatagggactttggttcgttcagactgtatgtccaacctttagctcagtccctgatatatgacaggaatgcaataaatacttgttaatgaacaaatgaatgaatgaccaatatccctcaggaaatgactcagactcaaaggggagtaaggctgcctgagtgtccttggctttcacagccctgatgacctttggtaccccatggcagcggtcaacgtccttccctattatgaaatgtcctgggtgcatagcatcaccactgtgtcatctacttgtgcctgcacccatgcaaacacacagggacacaaagctggaaaagggctggttttgagaaggagtaagcctgggcagttgaaacccaggttcggtgtactctagggcacttacttctaggtgactgtccttgccactgctggcgtaccaaggtctcccagtcatatgcccatgcactgtatacattttggcatttattctcatgaataaagtgtcattagaggccagacactgctggctaacgcctgtaatcgcagcactttgggacgtcaaggtgggaggactgcttgagcccaggagttagagaccagtctggacaacacagtgagaccttgtctctactaaaaatttaaaaataagctagtcggccgggtgtggtggctcacacctgtaatcctagcactttgggaagccgaggcgggtggatcatctgaggtcaggagttcgagacgagcctggccaacgtggtcaaactctgtctctaccaaaaatacaaaaattagctgggcatggtggtgggtgactgtaatcccagctactcgggaggctgaggcaggagaatcacttgaatccaggaggcggaggctgcagtgagccgagatcaagccactccagcctgggcaacagagcaagactctatctcaaaaaaaaaaaaaaaaaaaaaattagctaggcatgatggcatgtgcctatattttagcttcactattttcacatgtaaaatggatgtcacagggcatatggctccttggaatattacatgagataacatatttaaatcattcagcagtatacttagcacccatggagtgctcaatggatggtagctctgtagatcagctctcaatagagggacaggccattagataagcttggggaaggcttcctggaaaagactggcttggtactggactttggagcctggatagaatatacatgaatgttggctggaaggagcctattcaaatggaagagggaagaggacaggctttggatgctggcagtttgctgtgtaatctttaacaggtgactttcttttttttttttttagacggagtctcgctctgtcacccaggctggagtgcagtggcacgatcttgactcactgcaacctccacctcccgggttcatgccattctcctgccttagcctcccaagtagctgggactgcaggtgcccgccaccacgcccggctaattttttgtatttttagtagagacggggtttcaccgtgttagccaggatggtctcaaactcctgacctcatgatctgcccacctcatcctcccaaagtgctgggattacaggcgtgagccactgtgcccggcctaacaggtgactttacctctcaaagtctcagttttcttctctgtagaatgtggataccactagagcatacctcataaaactgttgggaggattaatgaggtgctatactgataagtggaaaccactgaacagaatcctcagcatgtgctgttgctgtttttttttttttgagacggagtctcgctttgttgcccaggctggagtgcagtggcacaatctcagctcactgcaatctccacctcccgggctcaagcagttttcctgcctcagcctcctgagtaactgggatgataggcacacgccatcatgcctggctaatttttgtatttttagtagagatggggtttcaccatgttggccaggctagtcttaaacttctgacctcaagtgatctgcctgcctcggcctcccaaagtgctgggatgacaggcgtgaaccatcgtgcccagcctggtgatcctttaaaaatgtatgtcggactgtcatttcttggttcaaaaccctccaatgactcttttttctgagacaggattttgctctgtcgcccaggttggagttctgtgagatgtgttcatagctcactgcagccatgaactcccaggctcaagtgatcctcccaccttagcctcctgagtagccaagattattggcatgtgccaccatgcctgacaaattttttgtagagatggaggtctcactgtactgctcaggctgatgttgaattcctgggctcaagtgatcctcccacctcagactcccaaagttttgggattacaggcatgagctactggacccagtcgattttccttctttttttttttggagacggtctcgctttgtcacctaggctggggtatagtggtgtgaacatggctcactgcaaccttgacctcctggactcaagtgtttctcccatctcagcctcccgagtagctgggaatacaggtgcgaaacaccacacccggctaatttttgtatttttttgtagagacagagtttcgccatgttgcccaggctggtctcaaactcctaagctcaagcaatctgcctgcctcagcctcctaaagtgctcagattacaggcatgagccaccacacctgcccttttttgcttttcaattagtgagtcaaggggagatctccaatatatctccaatagtgtggtggctggtctgctctgaaatgtaagcagtttttttttgtccccttgaccagactctaaaagtcttaaggtcaaaaagtccacaaataacgttttgtttacccatcctacagtgctaggcctaagcctcggacttaggcaaaggagatcagaagggtcatatggctaaatgtaggtggacaagagggagtcggggagggccttcctgtgaatcctcctgcctctcaaggacgctctgttcccttagcttgagaagccttgaggaaagctttttccatgaacaagcttttaaaaaccttttagctctttaaaagcagcaagtaccattccagtcatgaccctgcagacaggtggaacacccatactccagcctcattctgaagagacttgcagagcaggaaggaaggggtaatgactttcagttccagtaatgtatctagaagcagcagctgattcagctagatgatgtcaccttcccaaacctcctgaccagcagctgagatggtaaaagcaggaaacaggggatactcagctggctaagtccgaacatgcctctggcaaaggcctacagtaaccccaggctctggaggcatcctcctgaagatgaggagaaagagtcctctcagctgggagtacagtaggtgtccttcaagaccctcaaaccaagatgcttctccaactctccttttgctaagcagctttctgcatatcctgaaccaacaatccttcatttattccaagagtggagcaggggaaagaagcctggctttagagccagcccaatctaggtccaaatccaggattcaccacgtaaagctgcaggaccctggcatgcaacttcacttatccaaaccttagtttctttactggaaaagaaagtagggctaatggaccatttagcacacagtctaggtgagggaattaaatgagaaaatgcatgtagagtacctgacatgggctaggtgctcaataaatggtagtcaaccattatcccattggatctctgcagaggagatttgaaagatcacctccatctataacacaaaaggaaacaaaggtaccaactagacccaacagtgtcaaagctgagtaactgagttggcccatgcatatagttgcttcctagatattccattactcagtttcattttctgtacagcatttaacccaatccctgaaataatcttgtttgtttctcgggctagctgtctctcccattaaagtaagagttctacaagagcaatgtccttgaccttatcttgtttatcttagcatcttcagcatgtagcacagggcctggcacatagttggtgctcaataaacatttgccgaatcgccaaatgaatagcacctgggatggccaaaagctaaactgacaatggccccacacttaactcctcccctcactattagttgaaggctctggctcccatttcagaagctgccattgccacctgggaatcagcagcccaaccagtggccagcatgggcattagtccctgggcacgacctatctattgggataccagggctgccaaggagggccttggaatcctccccctggcacttgaagatcctacaaacctggttctagctgacctttttggctttattacctaatgaaagagacccctccacatatgcctaaaatttgactgccactgcccacgggtctcttcttgagagttggtctcagcctgcaaatcttaacccacattgactctcctactgggagctacagcccctcttttctccgctttgtggtaaggctcggtgtaaacctcacctcttctgtgaagtccttccctcatttggcatttagcatttattgttggcttttacaagatctcctttcatgtatattatgtcttttctctctaattcaactggaagtatcttgagagcagaactgggtttccaatggcaatatctcaattaataaaccttctacagaaaagactccttgaaacaaagttagctaggtccagagaggactggagaggggtctaggctcctccctgctggaccagcccctttggcaaaaagaggagatcgtgttgcctcaatccaggagcccagctgatgaggcaggaagggagccagcaaatcctagactattaggtgcagtctgggacaatcccaaggtcatctatgtaattagattttttttttttggagacggagtcttgctctgtcgccaggccggagtgcagtggtgtgatctcagctcactgcaacctccgcctcctgggttcaagcgattctcctgcctcagcctcctgagtagctgggattacaggcacgcgccaccacacctggctaattttttgtattttagcagagacagggtttcaccatgttggccaagacggtcttgatctcctgacctcatgatctgcccaccttgccctcccaaagtgctgggattacaggcgtgagccaccacgcccggcctgtagttagatttttaaaaaaccatcattttaaatgaatctgggcaatatttagttataaagaatggcataaaaactgctcagttcaaaggacttttgtaacatacatttgtgtgaactaattttacttttggctcgtcttcttacccatattttcctttcacccgactcccttagctacattatccttttggttgtatgaattttcctaagttgcttccaactctttgtaaaacagagcaaggttccaataaaaaataagattggtccagttttcttttaagtggtacagtggtatatataaaaaatgatgttccaaacaactcattataacaattaagaataagtggcaaaaataatgcatgtaaatcactgaatacagtgcttggcacttaatgagcattcaaaagtaggatgaaagaacactattaattctcattagcttctcttctctgggcctcagttttttcatgtcttaggttttgttcatttgtttaataatttattcaaaaagtattcactgaatgtttactacctgcaaagaacagctgcagacactggagatacaatgatgaacaaaccaaacgccctataatcatggggcttatattctaatagaagagacagacaaaaacaagtacacaaacaaaaagaaaattccaggtagaggctgttgctatgacaaaactacaagaagactggagagggatttagaaatagcatggctactttaaactgaaggtcaaggaaagtctctcagaggaggtgaccagcaagctgaaccaaatgtaggcctcagaaaggaaatactaggggcagaacatttcaggcagagaaaagagcaactacaaaggcccttgggcaggaagaagttatgccaggatccagaagcagcaaggaacccatgcggcttgagtggagtaagggagagacagaatgatggaggggcagccaggaccagatcacacaggcctcagaggttggtaagaagtctgggttttgctgggtgcagtggatcacacctgtaatcccagcactttgggaggctgaggtgggcagatcacgaggtcaggagttcgagaccagcctggacatcatggtgaaaccccatctctactaaaaatacaaaaattagctgggcgtgatggcaggtgcctttatttttttatttttattttttgagatggagttttgctcttgttgcccagggtggagtgcaatggtgcgatcttggctcaacacaacctccgcctcccaggttcaagtgattctcctgcctcagcctcctgagtagctgagattacaggcatgtgccaccaagcctggctaattttgtatttttagtagagacgggtttctccatgttggtcaggctggtctcgaacccccaacctcaggtgatccacccgcctcagcctcccaaagtgctgggattacaggggtgagccatcgtgcccggccagtgggcacctttaatcccagctactcaggagtttgaggcaggagaaccgcttgaacccgggaggcggaggttgcagtgagccgaaatgacacttactgcactccagcctgggcgacagggcaagactccatctcaaaaaaaaaaaaaaaagtctgggttttattctaactacagtggaagaccacttggagggttgtaaacaaaaatgcaataagatctgaacttggtttttattttattaaattttttgagacagagttttgctcttgttgcccaggctggagtgcaatggtgcaatcttggctcactgcaacctccacctcctgggttcaagtgattctcctgcctcagcctcccaggtagctggcatcacaggcatgagccaccatgcccggctaattttgtatttttagtagagatggggttttaccacgttggtcaggctggtctcgaactcattacctcaggtgatcacccgccttggtgtcccaatgtgctgggattacagatgtgagccactgctcctggctaattttttgtatttttagtagagacggggttgcatcatgttggccaggctggtctcgaactcctgacctcaggtgatccacctgctttggcctcccaaaatgctgggattacaggtgtgagccaccatgcctggcctaaacttggtggttgtttttttttttttttgagacaagagtctcactctgttgcccaggctggcgtgcagtggtgcaatctcggctcactgcaacctccgcctcctgggttcaagtgattctcctgcctcagcctcccgagtagctgagaatacagtcatgcaccaccacacccggctaatttttttattttcagtagagatggggtttcactgtgttggccaggctggtctggaactcctgatctcaggtgattcgcctgtcttggcctcccaaagtgctgggattataggcatgagccactgagcccagccctgaacttgttttttttttttttttgagacgagtattgctctgtcacccaggctggagtgcagtggtgcgatcttggctcattgcaacctctgcctcccaggttcaagcgattctcctgcctcagcctcccaagtagccgggactataggcccacgccaccacacctggctaatttttgtaattttagtagagacggggtttcgccatattggtcaggctggtatcgaactcctgaccttagttgatccactcggcttggcctcccaaagtgctgggattacaggcatgagccactgcacccggccctaaacctttttttttttttttttgagacggagtctctccctgtcacctaggctggagtgcagtggcgcgatctcagctcactgcaacctatgcctcccaggttcaagcgattcttctgcctcagcctcctgagtagctgggattacaggcgtgcaccacacccggctaatttttgtatttttagcagagacggggtttccaccaccttagccaggctggtcttgaactcccgacctgatgatccacccacctcggcctcccaaagtgctgagattacaggcatgagccaccgcgcccagcctgaacttggtttttaaaagaccactttggctggagtattgggcaagagtgattttctaaggtcccttcccagctttttccctgtcattctaggctgccatgaactggttgcctgagccataaagacacagtttctggattagagtgactgaagagcttagagtggttccttgcccttggccggagtagggaatctgtgtcaccttgttctgcaggagatggaggaagtgactccctcagggaggggtgggaatcccatcttggaaaacatcctcaaaccacctgtattgtttctgcctcctgtgtggaagtttctgccaatgacacagtgctctctggaatgcacccccccaacgcacacacccaatcttccgtttacacaggcatagctgtactttgcattcctcctaggatttagttcaaagctagcctacaggaactggtcgataaagagttactgattgattactaaagaaagagaatattctcagccattaagcaaatattaatgagttttatgagtattatgttggtctctgggggtgcaaggtgattaaatgggtttctagtcttcactgagctcagaattcagtggatagaccaaaaactacagacaactacaatgctggatacaatagttataacagcaacatttactagggccttccttatccaggtaggacaagttggctttggagccagactacctgggttcaaatcatggttttaccacttactcgctgtgcatctttgaacaactttcttaacttctctataggaataataagagaacctacctgagtggtactattttgagaattcaatgaactatctcatataaaacacttaagtgcaagtgctcattgttaaatattactaaaattaccttaatacctgcaccatatgatcttacatacattcttacaaaaggctcttaaatccttacaaaaaccctatgaagtattattattatccccatttttcagatagggggactgaggctcagaaatggaaaggaatgcacccaaaatctaacagctgatatgtaatagagaccagattcaaactcaactctgtctgattccagagcccatacttccaattaacaaaatgatccccttttcataaagagccccagcacagtgcctaacacacagcagagactttataaagggagctatggttattatgtcattgtccctggagtttccagctgtagatgctgtagaacccagaggagggggcctctctttcaccctaaagggatctgagaagggtttaaaggtgctgggtgccaactacaggctttgcttgggagtcccaaaggtttccctcactggggcttgggatactaatatggaacctacactagcaccactaaatcagacccagaaagttcccccaggtgtccaaacacctgcatgaacaagcaggcagtttcctctaggttgacttcttgtctggccctacacatctctcagtttcatcactcagccaccagccctgggtctcatgtatgcacctgctgcttgacccagtcccaggagacactgagccttagaattgggctccttctctggaccttgccccaaaggctatttctgagtgactccctgggacttccctgacatggtaacccctagggctccaactgaacatgggtgctgtgagcaaggggaaattcttctgagtagcagatggagagtgggtagaacaagaggcagttgttctggatcagagataagcatggggtgagaaccatagtacactggattttatgtttaagcagcactgatcctcgatagttcagaactcccgcactgaagtccagcgtaggcaggtaaggacaacctggagccaggcattaatactcacttctacttcccatctgagtcatattcagagtctggccttgcctggtactttgactgcagaaggcaacccatggctaaatcaaggcacctcaagcctcatagagaaaagggaaagactcagcatttgctgagcttttactctgcactaggcaatgtgtaagtgcactttacatgtaccattaattattaggaatgtttgttaatccagtcactaaacactcagccaccaagtactaggcccagcagtagctgttaagagtgaataagacatagtttttatcctcagtaagctcagagcacctcgtttagtctttctcccaacaaccctctgaaatgagtattacttccactttatagatcttcaggtttacagagggaagtaacttgtccaaattcatgaagccagttaagtgataagatattgcttctactcaaaaaatgcttgttgactgaatgaatgaatgaatgacacagctatggctgtgactttagtcaaggagtagcaacaagaccaaatatttatagttctcaaagtgctttttcatctatcatctctttgggcctccctgctagcccatgagggaggcaaggcgggtgttatctttcttcaacatatgaggcaacaggcagagcttgggcaagaggcttgaggccacagagcaaacaaggagtgagtggggccatcctggaaaaactccagagttcccacaatgccatgtttaatcattcaaacccatgtcaagcacctactgtgtgccaggcatgctcctacccactttaaatacttaactcattaagtcttccactcagtcaacaaacaaggaggaccctgggaagataaaacaaaatatgccccattgccaaacgcctagtcaacaacactggccaaacctctactgtgtacaaggtatgacttgggccttgtagaggaggtaggggacaaggttgtgagccaaggccccaagcttcaggtaccttaaaatctctaaactcttggtccaaagatatccacatattctgtcagcctgaaagttcactcctggagagtagatccaatagcaatgacaacaatttgtttaccagtgattgcaatgtgacaataacagtaataatagtagcttgttatactaagtaattactatatgctgggctccttggtaagtgctccatgtatcttttcaactattttcatgctctcaagagtgtttcaagaaaagcgctgtaggccgggcatggtggctcacacctgtaatcctagcagtttgggaggctgaggcggacagatcacctgaggtcaggagttcgagaccagcctgatcaacatggagaaaccccgtctctactaaaaaaacaaaattagctgggcgtggtggcgcatgcctgtaatcccagctactcgggaggctgaggcaggagaatcacttgaacctgggaggcgaaggttgtggtgagccgaggtggcaccattgcactccagcctgggcaacaagagcgaaactctgtctcaaaaaaaaaaaaaaaaaaggaaaaaagaaaagcactgtatattgttacctcttttccatacatgaggaaactaaggctgggaaagattaagtatttgccaaggataactattaagcaagtgagactcaccaactcaacaacggtttgtcaaatttcgtacctgactcttaacaacgatggaatttctcccaaggaggcaaggcagacaccaggaataccaggagcagctgctgcctgagagagtggggggcctccagagcccccagaagagtcttcctaacctctttccatcaggttttaacatcacactgagatggggaggtaaggaaagaatggttaggtgtgctcaatctatccttagggcaacaagggtctggccctctttgttgaccctcaagggaagaagtttgtgacttcccatttgtcactcaccaaccctctagagagaaacagaagggggcaagggcatgggagtattttctccctggggttggggggcacacacaagggaagaagcagcagccttactggctctttcctcccctgggcaagaagcctgtacatgtgatacagtgtatgtcattcacatggaacccccttggggaaatgccaaggtaccttttggacccaagaagcctcagagaggagagactggcaaagccctgaactgcaagctaagctgacaatttctaagcattgtaactaggtcatcaggttcctggagaagccagctgtggctgggggatggggaggaaaattttgcagcctaccaagatccctacttccctttaggccccaccctccctgaaatctgcacctgctcccaaactgacccctccccccagctgagcccagctgtcaacggctcccaatgccccgccctgccttccttaggccagaaccatgggggcctcttgggcaggaggtacctgattgccacctgagctttgcagagaaggagctgtggggcagggaaggattggcctctcctagaagatatttcttgctccaccagggcagcaagaaagttaggcccctttgggcctacctagggtacccttcctggcattgtcactgcaggtggcaggagacaggtgatgtttaccctgctgaggccagagttgccaaaaggcttcaatcaatcctttgaatctgcacctggccctgagtcccaaaataacaaccagggcagcttacctgatctgcaggttgcaggtgcctctggcttttctctccctgcagctctgcctgctgagccctggctggcaagagattctttttcttaggggttactgagacctaactgcatcccacaggtgctctgggcctctccccattaggcccacctctaccatcaaccatccctctgtccagaggcctctgtcatcagccacctggtttcttccctgaccaactttattgctgacacagaccatctttggctctagccagtctgcctcctcatgatctctcaaatgcttcatacatactccaccctccagttctgtctgggtggttcttacccgtctggcctgctcgtgtgtgtgtgtgcgcgcgtgcacgcgtgtgtaactagcctgatctttttggtgtgtgtgtgtgtggcagagtctccctctgtcgcccaagctggagtgcaatggcatgatttcagctcactgcaacctccatttcccggcctcaagtgattctcctgactcagcctcccaagtagctgggattacaggcgcccgccaccacaccctgctaatttttgtatttttagaagagacgagccgggtgcggtggctcatgcctgtaatcccagtgctttgggaggctgaggcgggtggatcacgaggtcaggagatcgagaccatcctggctaacacggtgaaaccccgtctctactaaaaatacaaaaaaaattagccgggcctggtggcgggcacctgtagtcccagctacccgggaggctgaggcaggagaatggcgtcaacctgggaggcggagcttgcagtgagccgagatcgtgccactgcactccagcctgggcaactgagcaagagcaagactccatctcaaaaaaaaaaaaaaaaaaaaaaaaaagaagagacaaggttttgtcatattggccaggccagcctcgaactcctgatctcaagtgatccacctgcctcagtctcccaaagtgctgaggttacaggtgtgagccaccacgcccagccacagcctgctcttgttacattcttttcacctatttaaacccatcatggtccacatcttcctaagacataacaatgcctaacattgactgagtatatcagacaccgtgtgaggtggtctacacagtcacttattcaacaaatatttgctaagtgcctcctatgtaccaagcactctgctagatgctggggatgaaagacaggataaagcccgtgtactccgagagcttatgttttactacaggagacagatggtaaacatgtaaacatggcgacctctagggaggtgatatctgagttgatacctgaatgataagaagagagagagccctgatcagatccataggatgagtgatacaggcagaggaaaaacagcaagcctataaggaagagattactatcatcttcattaagagattagtattatctccatttacagaccgggaaactgaggcctcagtggaaattgtacaaagctacggtgctgagaaagctatgattatttaagctgtcagtgacctctctccttcctaaccctttccactgttgatgcagaagacagtctggattggcaatgcagttggctagggaaagggtgcaggttgatgatacaggctgagggtggaggcctctgggcccagtaatcaactgggtagctgatggtggaagctggcccatttggcagaggcccagggcccagcaatgcagtcaggtgggctcaacttcttccacttttggtgtttactctacaggtttggcacagtttgcctcaagccattcaccaagtgtttgaggtctattcctactgcttcaaatgagtttgcttccttaggggcagaaactttttttgtagcctaacctgtatctaataataacccttcatgttcattgagcaggccctggctgagtcctcacccaaccgcgggccctgagccaggtagtcagggtaaaataagccagtctgggcttgtaagaagcaatgacgcttataggcttttgcatcagacacatctgagtataagacccagctctgcctcttagaagatctgttactgtggacacattagggagcctctctgaaccctagattctccatcttcacaggagagcatttgtgagaaccaagtaagatgattatattgaggggataaacacagcacctggcacagagcaagtaactactcaacccatagtatctgttattattaccaaaaaacacacttacatttcactttctcattcatgcctcacttactctggtggcttggcattattctctcaggcttatggatgagaatttgaagctgatttgctttgtgttatgccaccagcaaggagtcaagctgtctcaaatgtgaggccagagttttgtctgtgtatgtgttgaaggtgattaatacatatcaactataatgaatcttgcctggtgtgtctggcagctgaggagaaggatggatggcacatgtagactgattcagatggcagagggacaccagcaagacccaaggtgtggagtatggaaacagaccattgagggatgggactcagtctcagttaccacaatatccacagtatcactagcatttagcacattacaaagcatttgtcaatatttgctgatttaacaaaagaaatgaaactccaaggacagctccaagccacacatccagctttaggagaggcagacagtattgataatactgtgttaaaagccagaacatgaattctaagtctgatgctgccatttactgtgggacaagaccccttatcttagtttcccctctggaaacagggctgaacatacccacctctcctacttcactgggaaataacttataaaaggagtttggtaaattgaaagtattatcatgcacataaaaagaataatcatgacaatacagactactaagacagtagagtgtgaatcccagctcttcttggtactagcctgtgaagctctgggtatatcacttttctctgagcctcaattttctcaaccataaaatgaaggtaacaacacctactttgcaagatttttaaggactggagataaaaaggacaggcttcagagtaagagagacctggtttcaaatgctgactctgcctctggctaactataagccctcccaaatctcagtgcctataacgataaggttgttgggatagtaacaaaaacagcgtcactaaaggctgtcacatagtgagcactggattaatgccagcagtcacctagacaatagcgcactggacgagggaacacagtggagcgtttaaaagggggaggttggaagctaccctcccaggctttgcctcttactaactgtgctactttgcataaattgcttaacctctctgtacctcagtttcctcatgtgtgaaacagggataaaagaacctacttcagagtgctgctgtgagaatgaaatctattaatacatgtaaagcactttgaacaatggctggcatagagtaagcactcaataagtgttagatactattaatagtaatgttaacaataatattaatcaccaactggagtaagagggagggactgtttatcctgggacatgggtgtcccatgaaataattacagagaagtctcagcagctgtttgtaggcaagtttttagcctcgaagactctatggaaaggacacgaggctgggggctcctgagcaaatatcccagtcccactgaccaggaggccagtctctagggaagcgagtcaggctccttggaagggacactatgttcctatccctgcctgactcgggggaacaaaggcacgtgtgtatgtgtgtgtggccagggaggagggaggggaatgtttccctttcaagagaggaacaaaggatctgaggcatagttgagtgcgttccaatcccctcccaggccagctcccattcctcagatgattgtccaacaaggttttcaaccttctagcttcctcctcaaaggtgactgggggaggggaaggcaggctctgtttcactccaccctttatcatcaatttccaagaggcaggatttatatgtgccaaacctcaagttatctcttaagaatcccatcctatgcaggggtggggtggaatctcctaggggaactcagggttaatggatgacacagggcaccgcaagcaacaggtttaatgcatctccaggggaagtccaggactgaaactgctaatgcgtgatggagccaaggagagaacccaggaattctaactgacctccctcacagcctagcctagggtagggggtaatggcctggcagaaccaagtagaaaggcattttctaaatcttgaagggatgatcacagctggaggcagaagccaggtgaaggaggaaagggtagggagcaaagaaagtaatggacaagaggaaaggcagggacacgtccaaaaaaagtagtttttggggggcggacctctagggacattgctttccagtttccacactcttgccggcagggctgggacaggaagcagtccatggaagtcatcgcaatggcatttcctgaagagctggagaaaaacctccagttccgaggggagcactggaggctgcccaaaaagctgtgtggctcagagttcactgtaaggctcaagcttggcccgagagtctcatcagggatgaaaccaaatagcagacggtcccaaaggcagtttctttatacaaaaccacaatttcaaaaatcaatatgtaaaaaaagagaagccagatgatgtgagtgaagagccctaggatgatatgaaagccttaaaagaatgaattaattcacccaatcttcagaaaaaggtggcattactatagccatttacaagttaaaagacttgcccaaggtcacacagcaagctagtagtcaagttccaatttgaaagtccaaaaactgcctcttcctcctgatgtaaccttgggcaagtcaattcatctttctcacctgatttctctcctttgaaacggagatgtcatccttcctgctcacctctctgggtggttataaggatcaaaaaggcaaggtggatctgaaagtgctttggaagctgtaaggtgttacataaatatagggtagcactattgtgggctcagtgataaactagcctgccttgacactgggtttagttaaggtgctgacatatctgtcaacaggagagagccattttaaaatataactaatgtgaaatatgctgtaatggtggaatccgccacaaggcctaaggatagagagaaccagcattcctttattgcctacttcaaaccctccatcttgcataaagggaaactggggactgggggtgaagtgacttggccaaggtgagactgagagtagaactgggattccaactccaagaccagtgcttacaccaccattgcacacaaacactgtggagctcctactacaacagaaatgctgcaagggcctgctctgagatgtgctgatgggtcactatggtatttagaaaaaggagagtggatgctcaagattccgtgaatgggtctctgacatgcgttctgtggaaagataataagaataatgataccaacatggctccagtctttatgcatctcaggtatacctcactgtgtctttaccatcgccccctgtgaggcaggtattattatttgtcccaagattcagagaggtaaaaggagcttgcataggtagacacggatgagttgggaactgaactcagacaaatttcatttactcagacagaaatactgttggagtggaagaggaccattcatcagaatatcacatttggagagaactattcccaaagaacatctatcttacttaactttgattctaggacctccaagtagttgaaaaatatggtttccaggatggctggacccatcaatataccatgtgcaagcctggtcttattctccagtccccgtctcactacacctccacctctaggtccaagccactattctttttcacctggcaattgcaccagcctcttcactgggctccctgttgccacccttaagaatacagaccaggcctggcacggtggctcacgcctgtaattccagcactttaggaggctgaggcgggcggatcacgaggtcaggagatcgagaccatcctgactaacatggtgaaaccccgtctactaaaaataccaaaaattagccgggtgtggtggcgggcacctgcagtcccagctacttgggaggctgaggcaggagaatggcgtgaacccaggaggtgcagcttgcagtgagcagagatcgtgccactgcactccagtctgggagacagagaaagactctgtctcaaaaaaaaaaaaaaaaggaatacagaccattccaccaaagccaaatcctcatcatggtctgtaatgctgtatgcgatctggcccccacctacttctccatcctcctcctcaaccattccctccccaccttctacccttttcccctttgctgtttcttctccagccacattgaccttcttgctcatccttgaaaatgtcaagcatgctccctcctgagtccattccctctgctttaaacaccctttgctgtagggtacctacatcatccacctccttacctcatttagcgcttggctcaaataaatttaggtaatacttttgttgggactcaggacataccatcccaaaatatgactgtaggaaaacaatatgccaccccaaaaatatacttctttggcatattttgaactggttattctgagaaactgcagacataagagtagctctgaaaagctgtccttttgtaaaagaaattcacatctaaaaaggaaatctacactagtaaaggtatctgtattaggaagagggctgctccagacaaattttattaccagagagactttttatttttattttttgagacagggtcttgctctgtcacccaggttggagcgcagtggcttgatctcggctcactgcaacctccacctcccaggctcaagtgatcctcccacctcagtacaccccctcaacagtatctgggaccacagacacacgccaccaccaattctttccctcaccctgccataacttgggttgctgccactcaagcccctaacagaagtcccaagccccatattcttttctgtagctcaggatgctatataagcttcaattatctgacccttctttgagcctcatattttgtaggattcctgtgtacaactatgtaattaattatttttcctccagttaatctgtctatgtcaatttaattctcagcccagccaaaggacctagaagggtagaggaaagccatttttttctcccttacaccttctttgatcactcttttaaaactgcagccccaccctcccttgctagacatgccctatgccccaacctgctttattttcttcatagcatgtacaatcatctgatataaacatgtaattatatatttattgcctgtcactcctcattggaatgtgagctccatgaggacagaaacttagttttgcttacttttgtttactgccatactcccagtatggtacacagtaggagctcaataaacattgtttgactcaacgaatgaa

SEQ ID NO: 126 - DNA, 207308 bp, Homo sapiens
ctcatgcctccacgtgaggtcttggttgatactttacaaagatgattgaaaagtaaaaaggcccgcaaggtggctggggctggggtgcctgggcggccggggctggagctcctgggtggccagggctggggtgactgggtatctggggcgcctgggtgtctggggctggggtgtctgggcggccggggctggggtgactgggtgtttgggcggccggggctggggtgactgggtgtctagggtgcctgggtgtctggggcgcctgggtgtctggggctggggtgtctgggtggccagggctggggtgcctgggtgtttgggcagccggggctggggtgcctgggtggccggggcgactgggtatctggggtgcctgggtgtctggggctggggtgtctgggcaaccggggctggggtggctgggtgtctgggtggccggggctggggtgactgggtgtctggggtgcctgggtgtctagggctggagtgcctgggcggccagggctggggtacctgggtgtctgggcggccggggctggggtgcctggatgtctggggctggggtttctgggcagccggggctggggtgcctgggtgtccgggactgggattcctgggcagctggggctggggtgcctgggtgtctggggtgcctgggcggccggggctagggtgcctgggcgtcccctcattgctggtccttggcaaggctgggccagaccctggggagggtgggcagacaagaggataagcaggcggcacggggtctcctgaccatgttgggcctgcgagtcaggaacggggagtgggggacgcagctgggcaccgtctctccccacagtgaccaaccacttgtgccaggtctcgagaggggacaagtgagcaaaactccctctacccggccccagatagccggaggcggcagctgccttgggccgtccccaccttgcttcccgttgagcctttggaatcctcatcccttcaggaccacccaggaaacgtggtttgagtggaatggtggctgctctcagggggtaggaaatggactttggacactaaggatttggacagaaggtaagagctgggccatggacttggcagagcagcgacttggatggaaggaagaaggaagctacaggaagccatgaggcaccaaaaaccaggctgggcagggaacaggggtggggcagacaggggcagcgtgtgcccgggctacagacagggaacaggggtggggcgggcaggggcggcgtgtgcccaggtacaggcaggcaacaggggtggggcaggcaggggtggcatgtgcccgggctgcaggcagggaacaggggtggggcggacaggggcggcgtgtgtctgggtacaggcagggaacaggggtgcggcggacaggggtggcgtgtgtctgggtacaggcagggaacaggggtggggcgggcaggggcggcatgtgcccgggtacaggcagggatgaggcccctctcctggccttgccctccctcctaaggctttcttgaaagccagggcctcgctgtgcttggaccctcccaggatggcccctgccccacaggcaggtccccaggtcctctcgtctcaggcacccctgcctcctcctgccctgggcacgagcacgcctgtgtccagaaccaggagggctgctgggcctgggggttgcacctgattagcagctctgggcttcactacttggatcgggggaaggggccggggcaggtctagcaccaacctgtccatcagccggccctgcaggagggtggggaggaggttgaggccatcaatggccctgtcgctgggcggcgtcaggcccgcaagggccaggctggtggtgaagaggtccatgatgctgcccagctggtggctcacctgaaacacatggcagcaacacggtcagggcactctgcaccgacccgatggggctgggggccaatccctgggggggcgtgagccccgctgcccagctgggtctacagatatgcatacatgctcacacgcccacagcagggactgagcggggtcacaaggcctgtgagagacagaggagcctcaaaccaggcccaaagaccccagagccaggccacgccctcactccctggcacccttctctgcctctgtggatcagatgaaaggagaatcacagccctcccagggagatgcccctccaggcccacctgtccggagaggatcagcctcgctctaacactgaatgccctaaggccactgtgagccctgccccttaagtcagaggagcaggtggagaaaaaccagatgtggaggggcagctgaggctggacaggagcagctccgagtggctggggtggggacggctcctgacacacccagagagctccaggacaggcaggaggctgtctttcccgccgtgccttgacctccggagggcgtgggcactgctgaccagccatgagcagagcgtgccatctggcttccctcagtggccctgtctgcttcttgttttttgtttttgttttttgagatggagttttgttcttgtcacccaggctggagtgcagtggtgcgatctcagctcaccacaacctctgccttccaggttcaagtgattctcctgactcagtctcccgagaagctgggattacaggtatgtgtcactacgcccggctaattttgtacttttagtagagacggggtttctccatgttggtcaggctggtctcgaactcccaacctcaggtgatctgcccgcctcagcctcccaaagtgctgggattacaggcatgagcccggcggccctgtctctttcttaactcgggggctccaggcttgggtcactcgacggggagactggggtggggctggagagacacccctgcctggcaagctcagcccctggggcagctgggcagggaccgccatccgctgccaggccctggagctcccacccagtgtcgacagccctccccacggtccaggggcaccctcgccgcctgcagccagctcctcgctagggcagacggcgatcgccagcttctccaacagaggagccctggcctcacagggacactcactccgcgctgcagccgctcacgggatgtggggtctgcagcgcccagtgtggggcagggaatgcaaagctcagcgtttgccaggaaagttcaggaagctttgcagaaggtgagaagcttccccaggtctggtcagcagtgtctgtgcgactgcttcccgtccttcccgtgtcctttaaaggacagaataataaaggaaagaaatccagatgcttttgtcatctgaaaaaataactgcggagcagtgcttgtggtgccggcagggcgggcgggcgggagtggtgtcagcacaggcagggtcctcgtggagcgttttcgaagaactctccaggcagcgatgccttccagaaacatccagaaatgcagtgggcagctgcggctgtgggagaagtcactgaaaccgttatcagcgctttcgagacttcactcagaatccagggctgcagggactaaagcctcccctgcccagagggaactgtcgggacagacgtcaggcgctttcactgaaaccccgtcgtggtgtcctggtgcacaggcctgatgccatcgaattcaatttcactttgtggcccacgggaaaaggcaacttggtggctctgggaagagggtttcccttcctcaggtggggagagggtttcccttcttcagggagcgaggcagatggcaaggttccaaaacgctgaaattggcatttttctcagctggagcctttccgtgggcaggtgggtggggaggtctgtggggtacagacgtccctgaacccactacgcatggagccgggcggcgctggggtggctcccctcaccttttccaggctgctgctgagcacagccacgggtggctcccagcctggggagcagagccccagccctgtcccggcctggtgggcacccactgcagtggggaacctcacatctcccagacctacgcaggtcccgagtctcatgccatcgtctcccagacctacgcgggtcccgggtctcacgccatcgtctcccagacctacgcgggtcccgagtctcacgccaacgtctcccagagctacacgggtcccgagtctcatgccaacgtctcccagagctacacagttcctgagtctcatgccaacgtctcccagagctacgcgggtcccgagtctcatgccaacgtctcccagagctacacagttcctgagtctcatgccaacgtcacagtgttcactgagtgaccaccggccactccctgcaggtgcccccacacaagaaaccaaatggcccatccctaccctcagggggatggcgctcaggggagtggagggggcggcacagctgcattctgtcctaggggcaccccacaccacaaaggaggccgtgcccaccacccatgcttctcctgcacaacaaggcggtcactctcacagccactctgcccttcacacggagccgcagctgccttttcagtgaaccgtggggtctcttccaccttcagggtcctgggaacttggggtggcccaggagtcccatgtcagacaaaggctgccctgggcagggtctgagggaggcccagacagctgtagagaacaggcgcccttggcagttgccgcccccagtcccactggctgctggggacacaggggactgcccaggcatggtgggcaggagtgcaggatccacagccaggcgcctgctcccacctctgctccctagtaattgggggaccctgacagacgacttcctctctggcctcagtttcctgatgtgtagaatgagtggggaagaggaggatctggcagaacagcagccaatccctgggccttcaggcgcgcgaccaggccaggcaattgaggcggcagacacaacgcaggccgctcatcagcgaggctcgaaacagggaggccagcctgggtgagcagggggtggggtgggacacagccacagggtcctcaaaagtggaacaggcgccgggcgcggtggctcacgcctgtaatcccaacactttcggaggccgaggcgggcagatcacgaggtcaggagattgagaccatactggccaacatagtgaaactccgtctctactaaaaatacaaaaattagccgggcatggtagagcatgcctgtagtcccagctactcgggaggctgaggcaggagaatcgcttgaatctgggaggtagaagttgcagtgagccgagattgcactactgcactccagcctgggcaacagagtgagacttcatctcaaaaaaaaaaaaaaaaaaaaaaaaaacgtggaacaggaaggccagggacagatgcctgcgtgctgctggctttgacggtggaggggccaggagctcaggaatggggcagctactaggattgggaaaaggcagggaacagaacatctcctggagcctccagaaggagctggccccacgcacgtcttcactcagccccatgagccccatgttgactctggctgtcgtcatgtgtgatgttccagctgccactgggagccccccccatcctcgtggggccacttgaaggggatggctgcctctggaggccattgggagggcaaaagactaagaaacagtgaagaaacagcggtcgtttacaaacaccagactcagccccgcgtgttgatgggtatgtctggctcaagtgcctgttacagaagaccacacggtgtgattctcaaccgaggggcagcttcctgggccagaggagatgcagtgacagcatgaaggtggtcacactgagatggcagggcgcaccctcgcccagccaggacccaggccaccaccgaggtccgcaccccatgcggcagacagacaccaacggtctcgtgtcgggctgctgctgttctctgagtgtccttaggacactggcctgagaagatgtgctttgggggaaaaaacgaccgattctgtagtagacagacaggtttttaaacactcagcctgctctaagccccttctagaagctcatggtgcccaccagcatgctaaaggcactgataagtcctgcagggaagaaacctgtttagctccatttaactcaggactgctgcggtgactggaccacggatgtctcctcaccacacagtcattaccagcacccacgtgacacacggcagtatacgtggctccagtccccaccgagagccttcctgcctgtctgaccaagcacagcaagccctacacaccgagagccaccgagagggacctggttccgaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagggtggtgaggctgagcatggggtgcgtggaggctgagcacagggtgcgtggggaggagagcggtgaggatgagcacggggtgcatgggggaggtggccagtgaggggcgcacacaccctgggatggctgcaggcctggacctgctgcccggcagaccggtggacgctgactcacctggcctgcagtgacgtgccctggccaccatgcgagggcaggctccctcatccctccttcaaacgtggtctgcttcccacacagaaaggggccgttgctgccacctgggagagaggggcccttgtcaggccactgggaccagatgtccccaggccctccccctccctccccactgagtcactgagactggtcatagggacaaagggcccggccaaggcactctggctggagtgcatgatccgagcctcggggtggctctccaggggctcatctgagatgccgcggctgcaaagtctcctggagaaagtggggacatcatgcccactgaggaaatggaaacacaaccatacggtgtcagcaagactcagagaggtacactcccgcagcagaggccctgggtgccacgtgcgcagctgccgactggtgcttcccgaacgtgaatgttcacaagcctcccggtgtttggggtacttaaaatgcagccaacttctggcctccccatggttctgactcagtcagtcacggtggggcgtaggaatctgtgtttctgacaagcccccaagaccggattttggtttctgaaccatcacttgtgggaagtggtcacggggcaaaggccatctcaggtgactacaccatccctggctcactcccagacatggaagaagggggtggggggcccacgtcagggacaaaagccacccctgctgctgtagcctgagccacttgaggctctctcagcttcgggtcccctgaataaaagggaaaaaggaaacgaaggggccggctgcggtggctcatacctgtcatcccagtaccttgggaggccgaagcagggggactgcttgaactcgggagttcaagactagcctagactggtttctaccaaagagagaccacggctaaaccccatctctacaaaaatacaaaaattagctgggtgtggcggcacgtcctgtagtcccagctactcaggaggctgaggtgggaggattgctggagcccaggaggtcaaggctacagtgagctgagatcgcgccactgcactccagcctgggcaacagagcgagactccttctcaaaaaaaaaaaaaaaaaaaaaaagaaaatatttttccggcagtgaaaaagtgaaccatccaggggaggcaaagtcaccgcagctccttcctgcgctgccatccaaccccgagcggcagcgtggggaagcctctgaacggaacctcgcaggcagctctgctcagagcccctcacgggcaaacacgccaacacccgcaacccggcctgtctcagggagggccctgctcacagcagcagagccacagaacctgtgaagggacaatggacactgagctggggacactggccacttctaggggacactcaggctcacaggaggccatgctgtgcttcttctccttccctccctccctttctttccttctctctcccatcccctttttttttttttttgacatggagtctcgctctgtcgcccaggctggagtgcagtggtgcgatctcggctcactgcaagctccgcctcccgggttcaagtcattctcttgacttagcctgcccagcagctgggactacaggtgcccgccaccacgcctggctaattttttgtttttcagtagagatggggtttcaccgtgttagccaggatggtctcgacctcctgacctcgtgatccacccgcctcagcctcccaaagtgctgggattacaggtgtgagccaccacgcccagccccctcccctgctttctttctctgggatgttctgtttctagtcttgtgctgggtgctgggtgtgtgggttctcatcttgttacaaataggtacatataccatttgttggtatgaaacatgccatttgttggtatgaaacattccatcatttagaaatgaagactcaggtcgctgggacccttgcccctgctggctggtggttgtgggtgctggcgtcgaggtgggcccccccgggctccccatggggaatgacggccaacaccaccctccccccacccagcaccctgcctcctgggagctgcctgtagccctccacacatgggtctgttgggggcctcgactcgtgggtctgactccagtgggcgggagatggagctgtccggagggcctgcacgagagccaggctcacccaggggagctatctggtgggacgtggcgcgagggagcctatgcttctgttttggctttcagctgtgctggtttctatcacttgaaactctgaagcccccaatccccgcagcacactgggctgtaggcgccccccgacatggtctgggacgaggctgtagggctctccccaccacgtggtctgggaagaggctgcagggcccccccccgcgtggtctgggaagaggctgcagggcccccccgcgtggtctgggaagaggctgcagggcccccctcagcgtggtctgggaagaggctgtagggccccccccgtgtggtctgggaagaggctgcagggcccccctcagcgtggtctgggaagaggctgtagggctctccccaccgcgtggtctgggaagaggctgcagggcccccctcagcgtggtctgggaagaggctgtagggccccccccgtgtggtctgggaagaggctgcagggcccccccccgcgtggtctgggaagaggcgggttcaggtttgttggcgctggggatgggtcaggcattcatcagtgccgagcgggggaaaggctgaagctccatcccaggaaccacttgacagggctgtggtgggggcaggagtccatcttcatggaggcagcccggcccctgggtgaccaggtccaggccacactcacagggctgctcggggtctggggtgccggcccccacctcagcagggacaccctgctccaccggccctgctgtttccatgcggcctccaaagcctccggcctccggggtcacccttcgggaggcgtcagcctcttccaagacaaaccctctcccctgtgtcacctcctccccacccccaagttcaaggtcactcctgcttccaggttagtcctgggccagaagggccttgctcgaggctcggtgacatctgctcctcccgctggacccagagggacccttcatgctctgcccaccacagaccccgtgggcacagccggtccaggcactcttcgctgacacgctggctgtggggaaaccgtgagaagtgacagcgagcactcaccttgttcgggggcggaaatgagggcagcgccgttgtccgacgtgaagaagacgaaggtgttgtccgcgacgtgcaggtcttggaggagctccagtatcttcccaatgctgtcatcaatctcccggacggcgtctccatacctgcaggatggtgacaaaaggcatctccatacctggaggatggtgacaaatggatcaggcagccaacggcatactgtgattcacggagttcattaaatcataacttcacagaccacagtgaaactggccggcctcttcccagaagaggaatggcctcagttcaagttcatgtggcttatgaaggacagagccagcacccccaccacagccctcctctgctgatcccaggccagtggacggcttcaaaggggtggggttgctctggcctttccataattggcctaaatgccacggtactgagtgtcccatctctggagtcaagcacagctggggcctccagcgaggtctatgctccatggagccaggactcaccgccctcgctgactggtgcccaagaagggtttggaggcatagacgggtgcgtgcgtggcgtcgacagcccagtagaggaaaaaggggtggtgccgtgcctgtctcttaatgaagtccagggcttcctatggagagagccacaccgtcgtcctccagcctcaggccgacctcctcatgcctcccacggtccccgtccccacacgtcccacggggcgaggttggtgcggtccccgtccccacgcgtcccacggggcaaggttggtgcggtccccgtccccacgcgtcccacggggcgaggatggtgcggtccccgtccccacgcgtcccacggggcgagggtgatgaggtccctgaacccatgcctcccacggggtgaggttgatgcattcctgtccccacgcctcccacaggatgaggttggtgcggtccccgtccccatgcgtcccacagggcgaggatggtgcggtccccatcacctgcaggtagatctgggtgaggttggcttcccccgtcttcagattaataggaaattcttcataatatctgaaaagaacacagatccagacagacttcagaatttaggccaagaaagtcccgttctccctgatttcaccagcaaagccatgggcttcatttaaaagaaggctagggctgggcgtcatggctcatgcctgtaatcccagcattttgggaggctgaggaaggtggatcatgaggtcaggaatttgagaccagcctgggcaacatggtgaaactctgtctctactaaaaatacaaaaattagctgggcgtggtggcgcacgcctgtaatcccagctacttgagaggctgaggcaggagaattgcttgaacccaggaggcggaggttgcagtgagccgagatcgcgccactgcaatccaccctgggtgacagagcaagatcctgtctcaagaaaaaaaaaaaaaaggaagcctggaaatgaaatgtccactcagggaacaaccaagctggacgcatccctcgctcccccagggcacggtcttgcatctgatgacctggctgaggccggtgctgcaataacctgccacatgggaagatgggggaatggggctgagggcacgacaccaaggtgaaggcagtgaggcggctgtggtcactcggctggggctggggagccgccgctcaggccatggggctcgttctgaagcagctacagtgctggttgtcccagcctgtgactaatgccaaccacagaactgcacacttcaaatgggggctgcgtggtgcgactcccacacctccacggggctctatctagaaagaggcagcaagctggtgctgcttctggtcaccgtcatgtaatgaatgagcacttccgccaagaagagtcaagttaagcaaaataaaattcacaaaagatgagggtcccggacccggcactgccgtgtcaagaggtgctgcccccacgcccgggcaccaggacggctctgtctggacagcggcttttgctcctggtgtggctcccagtgggggtttcatcccacctcctgtcctgcccatgtccctggatgtctggagcacagccggcctccccacccgtagaccacatgggcagtaccctgacagctagggcagaccgtgtgggctcgctctgctgggggccttcctctctcaggacagctacagggatctacgaccctgaaaaggtgggaaaccccaggcaggagtctcataggctctggggcaaaacttggtgggacagaagccaccaaaccaaagccctcggtgcccggggacccagggacagaccagccctcatgagtggcgacttgagcccaccagtgctagaggcggggggcaggcacgccgggcacagcagttcaggacgtgggaggggaaggggtggggctccattacctgccaaccatctcccagtccctgtacacagggatgttgggcctggccttgttgtcataaggtccaaagtggcagttgggggatccaaaccactcatcaaatccgtgcttcagggggtggaactggggcctgtgacccagatgcctggaaacaggaacccaggacacttcagggaccccacgtggggacactcggaagttctgagcagcaacagataccaccttcacaaaattcttggtaagacgagcaccctccagcactgagtatgggctatgcctgggcacggcagggacaaaagaccaaggcctcacccgaggagggtgctggcactgcccgcctaccctgcagagcgtctgggcacaaccgagggcggcaggcatggcggcggccggggttccctgcacggtgaagggtggtgcatcgtgaggagcctcccagccgcctggaacccgcctgacatgcccctcgtggccccggctccttccttccacgttttctgaactcccaggagagttttgcgggtcatgcctcgaacccaagtgtgtctcctctgggttttccagggcagaaaatatttcctgccaggtaattactgggtctctccacaccgaggcgctcagagtctcatctcccagttcagggcaatggccccaggatgacgactgggcggggcgttgtgtgccgtgcgggagccccggggcctgccagctgtacccacatccccaggaccctggcagaggcagggattagagtgacgacaagagaacgtgacagtgtggccacactggtgacctccaccaaccgctctcctgggaccggggttcacctgctgggaatggccatcgccaggcatcacaccccaggcctgtgggaacccctccagaccccgtcccgcactccccttctgacaatcccccgcagaccttgtgctcccaccctctggtggcacctaatctcatcctccggcccacagcagccctgcaggccacacctctgtgcccactcgccctggcccccaggccagctgtccgggtttccttgcgcagcctgtcctgtcctggaacgaatccagcttgcggctgctcttcagaacgggctgcaggagaggtggtatgagatggcttctaggcacggccgtgggcgggtctcacgtcagttgcgtgtcgtctgaggaaagttcttctgcagctacggctttgaaagcagcatccccgacgcagatttccccgaggcagatttcaccacagcagatttctgctgcctccctggacatggcctctgtaccctggacctcccgagctgcctctccccatctcctctctcaggtaagcacgcctggacctctctgtgacctcagagctcccttggctgccaactccgggctgtttcctttgggtcttcagcacttgggcccattgctagagcaccccgacatccctgaacaccccaggcaggtcaccacccagccacaggggacactcgtgcgtccacgtccgcaggtcaccgcccaaccacaggggacactcgtgcgcccacgtccgctggtcaccgcccggccacaggggacactcgtgcgcccacgtccacaggtcaccgcccggccacaggggacactcgtgcgcccacgtccgcaggtcaccgcccggccacaggggacactcgtgcgccaacgtccgcaggtcaccgcccggccacaggggacactcgtgcttccacgtccgcagcacaaaggccttgctcaggggaagcacatgggcaggacgctacacaaattaagctgtcagctcaacgtccttgtccgaaagcagcagtggggcctggcactcaccagcaggtgacctggagcagggagtgtccgcggccctctgggactcaagtccctgccctgcacacccgcgtggcttcatgcagatcaagcagcctctttttgagtccaggtgaggggcctcagggaagtctgagtcatggctgacaacacccctactgccctgagaggggaccctgctgggatagggacccccccacctgactgagcagccgctgtaggacccagcccgggccatccagccactgcaccatgtgcgggaggagcctggggctctgaggtctgcctggctcctgctcccactccttggggtcccctctctcccgtcgacagctgttcaggagcctcgaggcctctatggagacccactccctgtctagctctggccaccggcaccaatgaccatgcataggaggccgctgggcccaagacagagctgccaggccaggcggagagctctgggtcactgtggggcttgtcacttggagaggccaccggctcttcctcctgttggcacagtactcacgcgctccagtggccctcgggggctgacttccgccatggcccctggcactggctcagggactatgcaggctgcgtggggcccaacctccctgtgtgaggactctgcagctgctgtgcccatcagctctgccctgtgctttctgagagctcagctcggcaggctgcttcctctcatctgaagaatgatgaagtgctccctagacagcctctgggtcctcctcatccagtgatcaagctcagcaaattcctggctgccatgaccatctacatccaaggagcatccatctgaaggggaccggcaggagccacaggcagccgactggggatcacagaggctgggaaagcagcaagggcttcctggaggaggcggcatgcggacctgacaggcggggaacgctccaacaagtggagagaaattcgggacaggtgactcctacccaaccctctaggctcactcaggcgtcccagggagtaaaagaaatgaaacatcctgtgcgcctaaaaccgcagcgtgggggctgtgtagcacccaagctctcatcagctcaggatttcatcaactgctaggctgttactctccttcctggtggcttctttgtggtttagaccagagctttcaccatccaacaggcccctagggtggacaggcagctcctccgccacagctcctgtgtgtaatgacgtggcccctccaaggacgacgtggcaggaggcagccggggggcagtggtggcgggtgctaggggctgtgactcgagggatgacggtgacaggcctgcggagtctgatgccgcaggatactcgcggccgtgggaccagcctggtgacctgagatcctgctggcaaggtcacgctggcctgcacagggacgctggagacacctgaacacacccagaatcagctgccgtttcccacccaagacaccctcctcatttggaaacttgtggccatgtcccttggaaccaaggccaggaagtggatggagcaggacgcctgggcaggcgtggccaggagacttaccacttgccgacaatcttgctgacgtagccggccttcttcagaagctccggcaggagctgctccgagtctgggatgccgcccacaatctcctgcggtgtgtaggctggaagagcagcgctgggtgagccccgaggagaccccgagaagctgccaccaaccccatcctaacaggacactgggggctgcgtccacacatcctaacaggacactggcccctcggggtcaaaggctgtgcctgggggctgcgcgtccacagggcatggcacttcccaagatttttccaggcacccctcagagccagtgccatcaccagagggtggggacggggcagactccgtgccccccagcgccttccttgggactcctgcccaccctcaggccccaccctgcctctcaggccagcctcccacctgcctggtctccaggggtctctggaatatgccacgtgatgctgcactgccccacccctgcctcccccgtccttccctttcctcaaatgccactggaaatcccacttcccctgtgagatgcccctggggagcccatccaaacccctcaagcacagcgattccagaacattccagaactgccgctgatgccacagccccggcctccctgtgggtgtgcggctcacccgcctggggagtgggagcttctggggtgggggtgccggctcagctccttaggccagactgggcaccctccgctcagtccccactgggccagggcagggaaggaagccagctaggggggcctgcacttccacctaagtcccagagacccaggcaccagcggtaccccacctgcagcttgccacccgagtcccggagacacgggcaccacccgtagcccacctgcccaaccctgcaccccaagggtgtccctggaggcggtgggcagcctaccgtttctggcatgggcgttggtggtgtagaagccattgcggatgggtagccgtcctgtgagcagtgccgccctcgctatgtggaggtgacagaaacagaaactggataagaagggtgtggctcagaccccgggcgtcaacaagagccccaacgagtagacagacgcgtgacagacgaggcacgcgcaggtttacaaggggctgccacgcctgtcaatccccgttagcgtctccaccacctgggtggggcacggcacccattccactgaaagacgcgtggcccttgggccctgcagctcagcgttgtccccaagaccccgcctcctttcgcaggctcctgggacacccactgggcgtgcaggtccacacgcccccatcctcgagcaccagccccgtgccctgccttctcctcttcctcacgatcaacaccacatgtttctgtctccagcaggagagactctccccagggagggagggagtgggactcctgcttcccaggtaccctgagacggagccacactgcagcacctctccccaggcggccacagcactcgactctgggaaacagaacagcagccaccaacaataccgcaacttcgaccctgaaaacccagcaggtgccgcaccccacatggcacggagccgggctgggatttgatgagaaaggcctgagcccacctgccaccctccctgcagtagtaggaatagacaaggttgatgcagccgcccagagtcagggctggaaggacccgggaggcctcggcctgttgggctcaccccttcctgggggcgagggccccgctgacttacatggcgagcacagagggttggcagaatagaagtttgggaaaagcagcccttctgcagccatccggtccaaattcggggtctctctggagggctctccatacaccccgaggtcaccccatcccatctgcagggaagagcacggggaggaggaatgagcgccttctgcaggtgcttctggcctggggagctgcccatggtgccaagagcgtgtcggggaccgtggaagccagcaccaccctgtgtcccagccagcggcagagctcggccaaaccccagcatcgcctgcgtgcgtgcacgatggggccgctccacgccagcccaaacctcagcatcgcctgcgtgcgtgcacgatggggccgctccacggtcagcccacgctgtctttcgcctccacttctgcttggtcttcaggtggggaatgtgtccgtctgcctcctcccagcctgacaccagcatctgcatgctcgcaggagctggcctctaaacacgtgcatctattttcaacataaatacacaggccctcgtatgtctgtacacgtctagatttcaaagtcaactggtaactgtcccccagaagcccagttatcgtgtgaccctgcagttccacgctgcaactccactcctagctgtacacccaagagactgaaacttacgtccacacgcaggcctgcatacgagcgtccagggcagcacgactcagtggccaaaaggcaggagcaccctgagcgcccatcggcagacgacaaagtgcggccggcgtgtactacgtgggtgtggccacatttggaagtagggtctctgcagatgtagtgagctaagatgaggtcacgctgggccagggtgggccctcaatcctatgactgggcccttagagacgcagacatgcagtagagatgccgggtgaaggccgaggccgagactggagtgacgcagccaccagccaggggacagcaaggaccttcctggagagcctgagggggaggggcccggctgacaccttgattttgcacttctggcctccagaatccggcaagaatccatttccgctaaggccacctggcctgtggtaacgtgttatgtctcaggaaactcacgcacgtaccgcggcacactacccaaccatcgaaaggaagggcaccccacaccgcgcacggccctggaaagcttcatgtgagggaaggaagcagacacaagggccacacaggctgtgatttgctcattaagcctccggaacaggccggtccgcagaggcaggaggcggctgagtggctgccggggctgggggtgggtgctggggagggcctgctgatgagtaccggtttcttcttgggatggactgtttggaagcaggtagaagggatggaggcaccacgctgtgaatggactgtgcccgagtggtgcacgttaaggtggctgtcatggtcaattttacgttctgtgtattttacaataaaaaccccaagcaggaggacgggtgagcacagggcaggaagcacggaggctggggtgatgccaggaggccggggtgatgccaggtgtgatggcaccagcacagcaaatgcccacggcaaactccggaggtgagtggcagcggcggtgttcactgaaaacttcttcaaattttacagtgtgtattgttggaaaaaagtgcttttaaacaggcagtgggccaggactttgctctagaaggagaaggggagggcaccgcctggggctttggctctcctcggatcctccagccgtctccctgagcgcccacctcagcaggagcctggtagaagccaacactccgaggcccctctgtctggcctgtcttccttccttaaggacatattccctcctgaggtgctccaagcaccaaccaagacaccagtgaagtgactgtgcctgcctgggcccctgccctctacaggccgccttcagcagcttcggcagcacaaacacacaacacctgggaaagacaacacattctaaacacaacgaccaagttcacaggcccagctgaattcaaccaccacgttcacaggcccagctgcattcaacgcatatttatttctgaaaccaatctgaatgcaaatatggatatttagagctggcatcagcaaatgcattatgtaaagggcctcacagcaaatcctttcagctttgtgggccatatggggctgtcacagcccctcagccctgccacaagccagcatgcgagcagatgtgcacgctctgtgccaataaaactttattcatcaacatctgaatttcatataatttttcatgtcacaaaatattactcttttggttttttgaacaatttaaaattataaaacccatgcctggcttatgggtttaaaaaacggcaggtggtgggccgggctcggtggctcacgcctgtaatcccagcaccgtgggaggccgaggcgggcggatcaccaggtcaggagatcgagaccatcctggctaacatggtgaaaccccgcctctactaaaaatacaaaaaattagccaggcatggtggtgggcacctgtagtcccggctactcggagtacagtagccggcaggagaatcgcttgaacctgggaggcggaggttgcagtgagccaagattgtaccactgcactccagcctgggcaacagagggagactccgtcccaaaaccacaacaacaacaaaacccagcaggtggttcacatttgacccatgggctggagttggccaacctctgtcttagtgaaagtgcagctaccctatcttaaaaggcaatcatggggctgggtgcggtggctcacgcctgtaatcctagtactttgggaggccgaggtaggcggatcacaaggttaggagttcgagaccagcctggccaatatgatgaaacccagtctctactaaaaacacaagaattagctgggcatggtggcgggcacctgtaccagctacttgggaggctgaggcaggagaatcgcttcaacccgggaggcggaggttgcagtgagccgagattgtgccaccgcactccagcctgggtgacagagcaagactccgtctcaaaaaaaaaaaaagggcatgagaggatcacttaaagccaggagttcgagaccagcctggacaacacagcaagactccaactctaaaaaaaaaaaaaaagccaagtgtggtggtgtgtacctgtggtcccaactactcaggaggctgaggtaggaggatcacttgaggccaggaggttgaggctgccgtgagccatgatcacaccacagcactccagcctgggcaacagggtgagacactctcactaaacaaacaaacaaaaaaagatcatggcccagcaattccacttgtaggagtttatcctaagaaaataattacagctatgtataacccattatgccaatttaaaattgtggttgagatactgggaacagaaatttggttaaataaatcacagttcatctgtgttaatgggtggagctgtatccccaaaagttatgctgaaatcatggccccagtgtagctcagcatgtgaccttagttagaaacagggttgccgcagatatgattcagtaagatgaggtcactaacatgggggtggaccctcatcccacacactgcagtccttataggagacagggcgaaggtggccgtgtggcaatggggtcagaggcgggagacacacagccatgggctccggacggctgggggccaccagaagctgcaggggcaagaggtcccttgcaggtttccgagggagcgaggtcctgcccacaccttgagctcagacttccggcctccagaccgagacagaatgcgtttctggcttttttttttttttttttttttttgagacgaagtcttgctgttgtcgcccaggctggagggcacaatctcgactcactgcaacctttgcctgcacgatctcggctcacggcaacctttgcctctcgggttcaagcgattactcctgcctcagcctcccaagtagctgggattataggcgccctccatcatgctcagctagtttttgtatttttagtagagacggggtttcgccatgttggccaggctggtctcgaactcctgacctccggtgatctgcctgccttggcctcccaaagtgctgggattacaggtgtgagcactgtgcccggccgtgtttctgttcttttaagctcccgacccccgtgtgtggtcccaggaggctcctgggatgggtgagatgggggtgtggccagggggttactgagaagcccacttagtgtgaacagacattcacgacacctggttgtgtggacacctgtggacacacctggacggcagggagggaaaacctcttagtaaagcaagtatctgcagcccagccatgtctggcagccaaagccttcaggaggaacgcaaacagctccacccgcagctcttaagcacactggagaccaccgatggttctttttttaagtctctgaaatacttttctctctcgttgaccagcctgggcaacaaggtgagaccccatctctataaaaaatcaaaaaatcagctgggcatggtggcacacacctgtaatcccagctacttgggaggctgaggcaggagaatcccctgagctcaggaggcagaggctgcagtgagctgagatcgcgccacggcagtccagcctaggtaacagacagagaaccctgtctcaaaaaaataaaaaacaaaaacctgccacttttctccaaattcaccccatccagcctcctcctgtcacaagtggctccaggactcacccacagagtaggactgccacctgcatggacagcagggaccttgaggagggctgtgcctggaggccgagtggggctcacctgcccatcgggcccttgtaaagtttccaccatttcaaatgaccccaagacaggctgcatgggccctggtgctccaagagccggagagaggctcactttggtctctccacagttcaccacgacagggactagagtctgatcgctgattgtctaaggttgatttttaccaaacaaaacaaaacattaaaagtgaactcactggaaactggagccctcacacaccatgtaagaacgtgacacgcagcacctggtgagaggtccggcagcgccacgcagggtggccacgccgcccggcagcgcctccctggtacacgcccaacagaactgaaaagtgtgtccacgtggaaacctgtgcatgaaccaacacccacagcggctcgctccctggcagccaagctggaaacacccggatgcccatccatgggtggaagcctcagccacacgtggtccctccacactgtggaccatgactcagccacgaaaaggaatggagtcctcacacaggctgtgtgtgtgaagcccaaaaaccctgtgtgaggggaaaatagacacaaggcccatgagccgtaagattccattcaccggacacgtcagaaaaggcagatccttagagacagaaaggggagcgggtcggccaggggcttcggggagcacaagggagtgacccccatcagggctggggcttccttccgtggtgacaaagatgatgtgacgatgtgtggtggcaggacgactctgagaacacactaaaaatgacccgcacactttcaccagcgaattccgtctcagtaaagcggctataaaagaatgaaaggccgggcgcggtggttcacgcctgtaatcccagcactttgggaggccgaggcaggtggatcacgaggtggtcaggagatcgagaccatccttgctaacacagtgaaaccccgtctctaccaaaaatacaaaaaattagccaggcgtggttgcaggcgcctgtggtcccagctactcgggaggctgaggcaggacagcctgggtgacagtgagactccgtctgaaaaaaaaaaaaaaaggaagtgcgggcatcctggttttctgcagatggaccaggggctcccctgacactgctgggtcggggccggtgggcgtttgactcgctgggtcctggtaagtcaaagaagcagcagcctcggggcctgtgtgaagtgacaggggtctgaacagaggggaagccctcaccgggggcgggggtggcagcgtgctgactgggaacggctgctggagggatgggcgctgggccccggggaccgcgggaggacagtgggccgctctgggcgcacgtgggtggctggacatccaggtctgcgtggtcacaccttggtctttgtctggatgcaatgatccatttccccggtggacggcaggctacatggcccctgcctgtaaggctcagcttggcagggtggccgctccttgcctcagcccctcctaacgtgtggagtcccagagctgggccaggtctgggctttttcctctcaaaggccctccatgtctcatgggacacaattctgtttggcccttttagctttggatcccttttgagatggtttatttttttgagacagggtctcactctgacaaacaggctgaagtacagtggcgcgatcttggctcactgcaacctctgccttccgggctcaggtgatcctcccacctcagcctcctgagtagctgggactacaggcacatgccaccatgcccagttaattattattatcattattttttgagatggagtctcactctgtcacccaggttggagtgcagtggcgtggtcttggctcactgcaacctccggctcttgggttcaagcaattcgcctgcctcagcctcctgagtagctggaattataggcacccaccaccaagctcatctaatttttgtattttttttatagagatggggtttcaccatgttggccaggctggtcttgaatactgacctcaggtgatccacctgcctcagcctcccaaagtgctgggattacaggtgtgaaccaccgtgtcaggccaacttttttgtatttttggtagagatggagttttgccacgttgcccaggctggtcttgagtgaactgagctcaagcagtccacccgcctccacctcccaaagtgctgagatcccaggtgtgagccaccacgcccagccctgagatggtttattttgaagtcactgaaatggcttttctgaggacaatggaggctggaatgaaaggaggacctagagagaggtgtcccctgaagctgatgaggaagaaagggaggtgggaggacagggggcaggacgcccgcagagctgctcatgggctgagaagggaccttgggctcagtggcacctagtcacagtgggcgaatgcgcccatgtcagggtgaggtgcatcccactgaggcagcagaaacctgcagtgcaggctgggacggtacagctccctgaggccagcctgagggggactggccacacacgcccaaagctccttgccctccacctccccgagtgcagattcatcctctcaggtggcttctgcacttcctgctgtctccagtccaggtgggagagtacagaatggcaggtgggccgggggcacaaggcctgggatgggagggagcagtatgtttcgcccgttacactgtctgcccatgcccaggaccactgctgggctcccttcgggctgggagtgaggccgcacatctgaatactgggtgccatgtgcccgaccctccctgcaggctgcgtcctgaggcttcccgaggcgggtctggcctccccagaaggtcggcagtcagcagagctgcgtccggatctgcttgtgctcacctgggtcatcctcctacctgttccaggccacaaataacatgaatggatgcagcggaaaatgctgtaaagggagtgggctccacgctcatcactcaccagaaaatactgcggggaggagtcccagggcttgagggagggggctccacgctcaccactgactcagaagataccgcaagggagcactctcgctgggaggagtcccaggtcttggcgacagtcctactcactgccatgacttacaacggggagggcatcagccaggggagaaggtgcgggcggggccggggagaccagccgcagcgtggaaccctccccaggcggagccacacgggacgctcgggctgcgagcacaggtgcgggatgctgacggggaagctgtgcgagactcagttcccagggcttttgcctaggctggcagtgcggccgcctctgcctggcatgtgccgagactctttatgcccagaaggaggatgctgggcataaatcgtggcatgtgcaaaaacagtgtggcaaggtgagctgctcctatcagcgaacagcggggggacctcctgttcccagacgccagccgagggcaaaaacctcccacacatgtgccttctgaccagccgagggcaacgtcccacacgtgggccttctgaggacagcgtcccaggctgctgggccagctctcatctgctgaccctgttctttcattatttatcggcgcctttcttggctatgaaaagcaggtgtggacagcctccctgcagagtgagcaggttaccattgaacatctaaaacccccacagggcaccacgggcaggaaccacctttcttctctcccttaaaagtcctaaaagggctggatccagtggttcacgtctgttatcccaacactttgggaggctgaggagggaggatcgcttgagctcaggaagtcaagaccaacctgggtctcacagacagacactgtcactaaaaaaaactttttttttaattagccgggtgtggggattccgttccaacatggctgaataggaacagctccgggctgcagctcccagcgtgattgacgcagaagacggcgatttctgcatttccaactgaggtgcctggttcatcctactgggactggttggacagtgagtgcagcccatggagggtgagccgaagcagggtggggcatcgcctcactcaggaagtgcgaggggttgggggatttccctttcctagccaagggaagccgtgacagactgcacctggaaaatcaggacactcccgcccaaatagtgcgcttttccaacggtcttagctaacgacacaccaggagattatatcccgggcctggctcggagggtctcatgcccacggagccttgctcactgctagcacagcagtctgagatccacctgcgaggtggcagcctgcctggggaggggcgtccgccattgctgaggcttgagtaggtaaacaaagcggcagggaagctcgaaccgggcagagcccaccgcagctctgcaaagcctgctgcctctgtagaccccacctctaggagcagggaatagctgaacaaaaggcagcagaaacttcggcagacttaaacgtccccgtctgacagctctgaagagagcagtggttctcccggcacagtgtttgagctctgagaacggacacattgcctcctcaagtgggtccctgacccccgtgtagcctaactgggagatacttcccagtaggggcccactgacacctcatacaggcaggtgcccctctgggacaaagcttccagaagaaggatcaggcagcaatatttactattctgcaatagttgctgttctgcagcctccactggtgatacccaggcaaacagggtctggagtggaccttcagcaaactccaacagacctgcagctgagggacctgactcttataaggaaaattaacaaacagaaaggaatagcatcaacatcaacaaaaaggacatctacgccaaaaccccatctttaggccaccagcatcaaagaccaaaggcagataaaaccacaaagatggggagaaaccagagcagaaaagctgaaaattctaaaaaccagagcacctcttctcctccaaaggatcgcagctcctcgccagcaagggaacaaagctggacagagaatgactctgacgagctgacagaagtaggcttcagaaagtcggtaataaccaacttctccgaactagaggaagatgtttgaatccatggtaaggaagctaaaaaccttgaaaaaagatgagacgaatggctaactagaatcaacagtgtagagaagaccttagatgacctgatggagctgaaaaccatggcaccagaactacgtgacgcatgcacaagcttcagtagccgattcgatctagtggaagaaagggtatcagtgattgaagatcaaattaattagccgagtgtggtgatgggcggctataatcccagctactcaggaggctgaggcaggaaaattgcttgagcccagtagtttgaggctgcagtgagctgtgatcgagctactgcactccagcctgggtgacagagccagaccttgtctcaaaaaaaaagtcctggctgggtgtggtggctcatgcctgtaatcccagcactttgggaggctgaggcaggcagatcacctgaggtcaggagtttcaggccagactggccaatatggtgaaaccccgtctccactagaaatacaaaaattagctgggcacggtggtgggagcctgtagtcccagctactcgggaggctgaggcaggagaattgcttgaacctgggagacggaggttgcagtgagctgagatcacaccactgcaatccagcctgggtgaccagagtgagactccatctcaaaaaaaaaaaaaaaaaaaaaaaaggcctaaaagcccccaaatgattgtccacgttcagcgagcacagctgtgagccatggatcagtatccttcagaatttcagagttttaagaaacgcagtttccattcctactggttgctatgggattattatgaagacgagcaggccagtgcttgtctgtttcaaacgaggggcactgagcaaccctccccggactctggtggctcgacgaggctgctgtggcaacaggagctggcctgggtggccctgactctccacttcctctgtggtcagggctgaccctccttaaccctattttccaaataaggagtggagacacagagtgctgctcgccctgggaggcaggagctgtgtgtgggccagagtggaacttgtcactgggtctcacctgtctccaaggccccagaagccctggagagcagagtgggccacgcaggtttcctcactcacgcagcaggtgcccagggtactacgaagccaggccgcgctggaccgtgggtcagtgaaaggccagggcagggcagccctggggagtgcaggtagacccgtccttgcccggctcagctccccctggacaggtgggggctcttgccagctgctctcacccctgagtcccagcttccccttctggtcccgactctgggggcaatggttctctcccgggtcagtgtgaccagttggagagtggcttctggccatgaggggtgcaataagctagttttggggacaacccttttctgaaactgcacttgcttagacgaaaggggggcccaggccccccactgcccagccacagaggactggatagggggagactgggctggaggcagccggtccctggagggccatgctccaaaatctgaacttgagacatgcacactcgtcctcaagtggtgctgggcccagagctgtgggtcatcaagccatcccatgtcatgccagaggccgaatgacctgttgcaggttcagacgccagcgccctggcagaaacaaccggtctgcagtgcaggaagaggtgtggacagggctgcggaggaagccccggactccaaggagagaagacagcctgtgaggacccccttgcaccctgggccacgtcagggcacctcggggctccactgtgagcttctgtggctctcacctgccagcatccctgccctgtcctggcagctgcaccatgggcccttcagggaaccccctctctgctgggtccaggcagatgagatgatcaggggcagtctcccttctggggtaggcccgaggctccgaggcctgggctggacaggtcagcatgtgcccctcccccagtgtgcttggcgcagggctgagacccacatcacgctaacatgacacgggcagagccaacctcccactgggtctgctgactgcaggggtgacttggagtcacctaggaccatcacaggctgagtgaggatgtggccagttcagaggcagcagagccacgaaaggggaaactcgccaggcggccctggtctgtcgactcaggagggccagggaatccccactgttgcttgtcactttgacttcatcttctgctgtctgcatcagaaagtccttacaagtacacctaccggccaggacacagctcctctggggttctttaggcgtcagctgccaaacgaccccacaagccacacagtggaggccacagaacaggtgcccaggtgggcggggcttcctgtcaccctcccccacatgtgccccggtggccacaccccacccctccaccctgcacggcctgaacccttgctgtcctatggaaacgtagggtgagtccacatgcaattccctatttaccgggagccacattagaaaagcagaagtaggtgaaatacagactaactttatattttatttaacccaacataaccaaaatattatttcgacaagtcttcaacataaaaaattattcatgagctgccccgcctcacccctctgtcctctgagaaagtcaggaaaagcagaaacttaacagggaggcttcacctgcagagcccagctcatccagcgaagctatgctggcccagaaggagttacacaatgaaaagaagaaattctgaaacaaagtatctacactggcccagaggaacttcaaaagtgaaaggatgaaattctgaagcaaagtatctttaggagggagatgccactcagtgcagagaaaggcccggctactgctgtcaggacacggacccctgggcgctggagagcgtgctctggaaagcagtcactgcacacaaataagacatatgagatggaaaagcagctgcccaggactgtcggctgtcacccctgggtggggaaattatgggtggtgtctgttatcttttcaagtatatctttatgttaaaaaaccattaatttaataaaattgttaagtgagatattttacattatttttctttcaccaagtcttctaaatctgtgtattttacactaccagcaccttccaattccgacagccacgactgcccagcccttgggtgtggcccgtggcccccactggtcagcacaggtgggtctgaaggcacctgtcagggtctctgctggtcggagccagcacacaggggctgagcgacaccgacggcccaaaactgtctggtactcggtgtcgtcccagtcctcacacacaacgtgagcacggcgggacaggtgtaaccccccaggtgtggcagctgaggttcaagaatggaagtgacccccaagcttggagacagtagggtttcaacccaggtgtgtctggggtcctgcacggtgacccatgccccaggcaggctcattcctgagtctccaggtggctcccacaaggagttagggaaggaggcctccaggctggctgtgacccctgaccccgcacttgcccaccaggagacattccagcctttcagttcttcagaccttagggacacctgaccttcgctcagcattctccagaggacagagacagccgtcaggtaagactggagcccagcggggggacccggcggcccgaggtggcgggagtgattcctagggcgacgcagctctcaggcagggcggcaggagcagcctcttcctccctttggggaggccacgctgcgcgcccacctttcccaagagtagagggcgggaaaggtcagacgggggaggcagggcccggtagcacgccggccacccacctgccagggaggacgctgtcccggtcatgcagcacagtggcagcgcgtgtggtgatcggtgaccgccgagaccccacgcctggaccccgcggccactccccgaggggcctccccctccccgcacggggataccccccgtcccctccccctcctcctccccgcgcggggcctccccccttccccaaggggcctcccctcacctctccccccaccccgcccgcccttcccccacctcgctcctccctccatccgcccctcccctccccgccccaccccggccctgccccgtcccaccgcccgcactcacgtcgtccatgagcaggagcaggatgttggggggctgcggggcgcccgaggcccccatccccgcggcgctgagcaccagcaacagctgccaccacctcgtcgccgcgacaaccgccgccatggcaaccacgggagccgcggagccccggccagcgagccgacctagcgagcgtccgccggcccttccggctgggctgcggggcggggcctggacggccacgtgactcgcggggcggggccagagtccgcggagggacgggaggcggggcctggactgcctcgtgaccagtggggcggggcctgagccagctgtgtgcggatggggcggggctttggaggccgcgtgaccagcggcgggtcacgtgacgcggtgcctggcgccgagcctcccaagatggcggtgtgcatcgcggtgattgccaaggaggtgcgtacgcgcggcgtggggcgtccgggctcgcaccatcctcggctctccgctttctttctacttcttccctgggcttagaaggcaccttaggaaatgggacctggaggaggccttcgccgagctccagcggtcaggggcttcgcggtggacgagccgccaggcagaccctgactgagaccccagttccgcgctcgcccgtcccgctgctgaacgcacccctcggcgcagcaggtctcctccccgccaggacccaccagaaacctaggtggtcccgggcactacctccgtcctccgtcctcagcaggttctgcccgttctcccgtccagcgctggttccccgcggacggcggccccggccctcctgccagtctccccggagccgagttaaaaacaaatcggatcctgtcacgcctctgcctgagacctctgcagtggcttctcgttgccttaggatgctgtctgaataacctgctctgggatcctttccccccataacccttggcactctccgctccaaccaaacaattctgcagctccctggacatgctctgccctctcacctgtgggcctttgcacgcggaacacctctccccagctcccatcctctttactggcccacatacatttcaactggaaagcattttctgaaggctaagactgagctgggtggctgcccacacgctcctgctgcacggagccttcatttcctagccagggtctcccgagaccagactcgagaccgctccctgctgggcggtggctgctgctaagctgctcatgggcttccctcttggccaagatgatcatttgcttgtttgtgggtttattgactaggtatcactccccacgagggtagcgaggactcttgttcactgtatttgtgcaggacccagtgctgaacacacacagggtaaatggtggtgtgtgaaagaccgagaaagaagctgttaattctgggcttccaatggtcagaaatgcagagatgaagggaatttgagctgagtcttgaagggtttagtaaaagggtcactgtcaaggtgaagaaaagccagtattgagggtgctgtatttgggtgagccatgcagagttagaggtgggctgaggcagagtggcctccaggagaaggtgagaggcgtgcccaggtgccaggcttgatcggcaggctgtgctcaggcccatttttctgattcattttttcttttccgcccaccctactgctgctgctttgcaaacaacacataaatctccttaggttagctgggatcccctgaaggcagtgcccactgcggcatagagaatgaagcggtgggccttagagcatgggaatgcgttccccgggtggctgcaggtcacggctctgcagcatagttcagagctggtgtgcgctgggtggagtcttgtcctttcagtcgccgtcatcctttcttgcagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtgtatctttcagggcagggtgtgtgtcagggaggacctacagttgcaagatgtactttaggatcagataacttgaaaccttttagaagaaaaagaggtgagagtttttagccagccagggaattagggtagcttgaggtgaatgaaggcctgtaactcttctctttcattggaagagccatttgggaaaagcaaggctagaattccccgtagaatgttttggtttgcacgtgtccgttgtctggtttgcagaggaagtgggacacttctgctttgtacctgcaaggatttctttctgtgcttttcagggggagccaccacctttgagcaggggataatagtttcatttatttcattaggccttgcctcttatgtcactagacactcgtctagtcccttgggacaaatcacttgaggccatggaattcaaagaccttcccaaaagtcatcatgtagcctgtccatggtgacatttgctagtagccactattttacaaaataatgtggcctctagagaggggatccgccttgttcacgaagcctctggttttgcagttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcgtaagtcagggagttagagggccacgcccgagtgggtgttttgtttttcctttttgactttgttttgaaatgctgagaaactaaaaatctggcagtggctgtgtgtatgtggcaaggtcatggtttgctgggtctttttcagatgttccggaagctacacaactcctacacagacgtgatgtgcaaccccttctacaacccgggggaccgcatccagtccaggtgggccctactttctgtgtcttgccaccttctttctgtaggacatgccttgccattttggttgccaaaatgcaaccatttggaaaataagggaggaaagatctttttaagctatgagcaccatccccctagggcagaggttttaaagccacaaagccccgtttctccacaccaactcttacacagatctccagcgcataaagtggatagagtgtgtgtggtgtggggagtagagcttgcccatttggcttcccaggtgtgcccagtgggtacctggggcacctgcaggactcagggccaagcacatgggcagtggctttcagggatcacacgtccttttgtagctacctgatcttttatgttgaatttggaacagtcaggaacctggtttgcaggtgtcttccgaatagtccacaaagtaaacagatttaacttttgaacatcatgagggaaatgtggggtccatgcccacattccagacttgctttcagtgagtccccagttccaagacataattccctgtggttggcagggaagaggacgctgcagtgatccaaggcaggcccctccctccaccaggacactgtcttggggccatcctggtcccagatgggagcaggcaggcgaatgtccacagtcttgcctcctgggctgcacagggccatccttgccacaccaccgctctgcctgcccatgctgctccctcctccaccccttcctggggccttgggaggctgcacagggaacttggaggcagcagatgggttctcagtgcccggtggggtgggactcctgtcctggcctctcagcggagttcacatttctggaccctggagaaggtcccgagcatcctgtggatggagccatgctgcccggcccgtctctgagcagaggggtggagggcctggctctcctctgagtgggtctgtttctcttagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtttaagccactgatttttgggttttctgttaggtgcagccagacccacctgtaagtactttttacatgagggcgttttcacaagccttgttaggcagcatccccattttaagcccaaggaaacagtgcctgatgaggcgctgttagtcgtggaatgctggagtcaggtgtgtgcacataagcagccttgggcttctgcggccgtgcatgcagccagggagcccgactggctgtgctttcagaggggacagtcgtcaaagtgcccaggacagagacctccacttctgcttcctgagcttctgacaagggccagcgtcccgggtgtctgtgtcacttggtgggggacatgtggcagggttacgaggtgtgggggcaccttgacaggcagttgcagcccaccaggctggcagtggcattgacaccgcctcagcctgtgcacgctgcccgcttgctgtcagtcgcgaggggtctggagccctgtcctcatcccacagccacggctcgccagccgccttctgtgtcccgtcccacggggagacgcggagggaaccgcgcgccccgtcccacggggagacgcggagggaaccgcgtgtcccgtcccagggagagatgcaaagggaactgtgtccatggggggaatgcacaggagtgctgctgccatttgcttttaaaaagagcccaagtttaataatttatgcttcaccattaagacacacgtttctatttttcttaaaatgacttagttgaagagctgagcatgccaaccccaagctggcctggcactgcctgggactctgctcctcccctccctcaacacccagagccccgcagatccccgtggggcccatgccaggctcaccaccgggccgtggctgtgactcgtggctgtggccttgggtctggaccaccatacaaggccctactgggccatccccccgccaagagggggccagtggctgctctggacacccctctcctctggcctcgcccccgcgccactccctgccccagccccaggatggagcacaagtggtttactcctgatccaggccccagcccctctctcaaaatcgggtcttccctttaatacggtgaaaaccatggtgagaattttccacgggccctgcacggagagagaacacacactgagtggccttccagaggagaaggggtggtggcccagggccccgggggacaacaggataaggatgcagggaggtcacctggctgctcaggcaatgccccaggggcctttctggtgactcccagctgctctcttgggagggtcccacgaaaaggaaaggcagtgccaggagagccccttggggcagctgtagcccaccctggggcctttgtgggaacaagaaggggtcacctctcccagcagagaggctacaaaaagcgccccccccaccagctgatgcagcagccacagccctcacccaggccccgccaggtacattcctgcagccccatgaggaacgagctcagggaccccctcctgcccctgatgccctccaccatggccctcgcccccaggctgcccccacaggcacccactcaccggttctgcccttgtggtctgagccggggcctgccctggaggccgctgtgggggaagggtgcccccctggagcctgggtgtcctcgaaggcccccgcggtctgtggagctgatcccagggaagttggttcttttcggcagcacctggagcaaaggcctgttttgagtcctcctcaaggagcagccgagacccagctcacagcccccgcagcccccaccaccccggagcatggggtcctgcccggctcaggataccattcgggcctacagggttccctgcctttgcctaccatagctgtcatatgacaccccgtcacggccagcacccctgcagaggggggggtcacggccagcacccctgcagaggggggggtcacggccagcacccctgcagagggggctcccgcccgagaggggacacttccccaccatgccactggcagaccaaacccagcttcaggtccgagggtcccgccacatcctgtccaggcccagccaagcaccgtgcctgagacacgctgtgcagagaggagccagctggggctgctgtgtgtcccagggccagtgggccagcccctctgcgctcatgttcctggacctggggagcaccggcgcaccttgatgacccggccccggaagaggctctggtccagctccacggcggcctgcacggagcccttggtggcaaactctatgtaggcataactgaggggaggggcagggaggggaggggtgaggctgggccctgtccgcatggccagtgcccccaccaggccccacactgaccccttggggtgtccagagaacttgtcacacaggatcgtgactcggtggacctccccacagcggctgaagtgggcctccagctcctcggcggagcccccgtagtccacctgcacccaggcccagaccagcatgtgagggagacgcctggccctgactcggggccttcttgttagaggtgaggaaagaaaccccaaggctgggccccgtggcggggatggccccaggcctccaccccacacccccgctggggttggagggaagagaggaaaggatatctcgtatggagcgcttccttctggagagctggagccttttaaaaagcttctcaaaagtggagatttcatgtgcaaccccgaattccagctcatgttgaaaaactggaatatgtgcccaggccagtgtttcctcaaggtgacggggctgcccccagggtcagacccccttcccagcaaggctgcctggcccatggccgggcgccagaccctctggtagagatggggccccattcgctgcctgccccttcaccccgcccaccactcacgttgcccacgtagacggatctgtggtcagcctccaccttctcctcgggggtcccagagagggggcagcctgcggagaacacagctcaggcccgcaggcccttggttccttcctcactcctctcacggggaaggtcgcccaggcttataggggaggtgacaccttggagcctgccaggcccaaccttaatggaaactgtgggacccttgctcagtggggggcggcctgtgcccttggttcctacccacggtctcagggctcagcagctgcccggccgcggtgccctcctcttcctcggcctgttgctgcactcctggaggccgtggcgtcccctcggcctgctccatggcacacaccttcatcttgatggcctccagctcctgccgacacacggccctgagccgggcaggcagcctgcaggctctgctcaaggaaggtgggtgtgtggcctgccagctccagcagagggtcacagccccaaggggcagcccttctctggacagggacactccttcctggggcagctggctggggatgaactcgcccctgcagagaagcccccgaaaccgcacctcaagggcccttccccaggcgagagaggccaccttgaccctgcagtctgtgtggctgggggcggggggtctccttgccaccttcgtccaggcaggtgggcaatggccctctcccctcctaagtcagctgcagccatccgtcacccagaccccgtgtctccaccagcccctgtgccccaggtcccctgagatccccagggcctccacacagctgttacctggtcaggcaatgggcactcagccaggttctcttgctccagcagagacagcagaaagcctgcatccccatcctggtcttcctctgcatcctcttcctcctctttctcctccttcccttccccaccctctggccccagaatctccttggtctcgttccaggccccccagccctgggcctcagggtctgaggagaccgtctggagccaggcctgagtcgggggtgggaagagagagcggctcgggaagggccacatggtagaggggcaggaggaaggtgggccaggcgaggcctcccctccactcccctcgcgtccgcacctgcccaggctctcctggagttttaagccctcccctgaggccagctgctcccactagagcatttgcaaaggctgagtggggctgagcttccagccttggctcccggccccgccccttccctgtcactcggacaggtacctccaggacactctccctggaggaaggagaggctgagttgagtgggggtcaccggtctcttctgcttccgcctggccacgctgtggctcactggagccttggtctgtgacagggttcacacctcagcagcatccacacggcacgaacgccacactgcatgaacactcgatctaagtgggaacacgggagtggtttcttctagtaccagggaccaagcaggctggagaggtggcttccgaccaggagaggcagggcctgagcagagaccgagagcaggtgcatgggatgagagggccgaggcaggttggggcggggtcctgggcccagaggaggggcagcaacagctgtctctgcatcctgacccccatggagtccccagggacccttgcctccctaacccttattctgggccttttttttttttttcttttttttttaggcaggagtcttgctttgttgccaagtctggagtgcggtggcgcgatctcggctcacggcaacctttgcctcccaggttcgggtgattctcctgcctcagcctcctgagtagctgggattacaggcacctgccaccatgcccagctaattttttttgtctttttagtagagacagggtttcaccatgttgcccaggctggtctcgaactcctgacctcaggtgatccgcccgactcggcctcccgaagtgctgggattacaggcgtgagcaccgcacctggtctgggtcatcttttaggtgggagccacttccatgaggccagaattattctgctgtggggcgggggctccgtggggagtgacggcgtgagttattgtggggcggggtctccgtggggagtgacggcgtgagttactgtggcggaattcagtgggcatccggtggtgtctgcacctggcttcacccatgcagggttgcagcaggaggtgacccgtgtccgcccttgcgcctccctctgcacctgccaccgcggctgctggagtctgctctggccttcatctccagtgctgccgtctcccacccactctgtgaaggactcggggccagggggtcatgcatggctcttacccctgccattggtggtgggagacggggccccctgcacagctcctacccccaggccgaggccatcctctctgtgactgcaccccggtgtttagccagtggggctgggattcctgggaatttgggactgggggaggagagagagacagggcgtggcctaggctggagctgcactgctgcaccatgcaccacccacgcagggcggcccttcctccatcttgggctgggggctcggggagcaggtggacatggaggctgccacagcctgggaacccaggctcctgcacccagtctgttctcacctctgtaaaagccagaaggtgtctgagatgggtctcaatcaatcagtttagaggtgtatcttgccaaggttaagggtgcacccaggaaaaagaaacacgaagccacaggcaacatctgtgctctgctttttccaaagagggtttggaggccgggcatggtggctcacgcctataatcccagcagtctgggaggccgaggtgagcggatcacttaaggtcaggagttcaaaaccagcctggccaacatggtgaaaccctgtctctactaaaaatacaaaaacaattagccaggcatggtggcgggcgcctgtaatcccagatacttgggaggctgaggcaggagaatcacttgaacccgggaggcagaggttgcagtgagccgagatcgcgccactgcactccggcctgggcgacggagtgagactgtctcaaaaaacaaaaacaaaaaaacccaaagagggtttggagacttttatacttaaagggaaagagcgggcaggaggggaacacaggaaggaaagaaaagggagggcggataaaaggcaagtggtagcgttcctttgaatctctgattggcagtcaccaaatgcacattttgaaatgtggaaggtgggggtagagaagagaattacgtagccccacgctcagcgactctgcgtttccacagaagataaaactgccacagggaataggaagctggcaggttcgcattcgcctccggtgagcggagggtaacgttagctctgtcctttgtcccatacctgggaagataagctgctagatcacactatctgggtgggatccagcagaactgtttcagagccaagatcttgggacccacaaggaatttccctgtaagcgcgatgcgaggaggcacaggcttcttcatcttcgtggctgtccaattaggaagaaaatgggaggcaggtgtgtgtgattcggctcccagcttgacttttccctttggcttagtgcgttttaggtcccgaaattctgttttcttttcccacctccaggaggctgactgaagaccatgctgtcaccccatctgttcaccacccagaggattttctggggcaggctcatgaggtcggggaggaatgggccttgtctggaacctggctatggccctggacgccccttcccctctccctggctccgcacagccacacacttacgtgtgcgtggtccctggacgctgttccccctgcgaacacggtgccactgtttccgggagggctgccgggctgctcctcctccctcgagagccgctgtcctcacgcctttcctgctgtccgtccagtgttgatgacttggccagctctccccttagaaaccaaagctcctcaggggcagcgcccacatctgcaccgaggacaggtacgctgggtggagtgcggcctcagcctgggatcctcctgttgggatggagccccctgccccgtgtgtctgtgcctgtgtgttggagggtctgccagcacccgtgcctccacctccctgtcagaggcaggattgcaaccagttccatccaagaccagagtctgctggactcggcccaggccctgacgcatgcccctctgagctcgggccccggccatggaaaaccttgtcatcctcaccctgtctgagattgctgacacacaaggcccggccagggctcctgccagctgcctggcaggggacagacggctccgaccctggcctttccagtgacactcttcaaatacaccctgttccagagccgggcctgaggattcatggcagcctggcccctggggccccagcgcccaggacaactcctattccagacaggatccgtgtgtgacccaacaccagggccccatgggggtggctgagaggggcaagccgtcccttcctgtgctgtccaccctcaggtcccctgtgtcccctcagttttcatttcttttttttttttgagatggagtctcactctgttgcccagactggagtgcagtggcacgatctcggctcactgcaacctccacctcctgagttcaagggattctcctgcctcagcctcccaagtagctgagattacaggcacccgccaccacacccagctaattttttgtatttttagaagagatggggtttcaccatgttggccaggctggtcttgaactcctgacctcaggcaatccacccgcctcggcctcccaaagtgccgggatgacaggcgtgagccaccgtgcctggcctcccctcagtgttgtctgtgtcccctgaggtcccctgtgtcccccatcggggtcggaggtgtcatggccccagccccagcactgtctgaggtggggctgctcaggcaggggctccagtcttggaatcctcaggaccatctcccgggtgtaaagttgttgggacccccccaaagtcccctttgcaggctcagccgttgccagccctgcagggaccctcgtggctggggctgctgctcctccctgcctgtgtgctcccgccctgcctcttccccgtcgtgctcccgccctgcctcttccccgtcgccccagccccacgtcacacactggcctgtttgtccctgcagtgtgcgtggtgcatggggaggccccgccctaccaggcacggaggagccccagcaggtaattagtgaattcacgggtgagacgaggctcagccgaagcctcctgggacccaaggagaggaacagccaggcgacagcgaacgttcgctttattacacggacacggcgctaacccgactattgcatctcacagcatctacaggccaaacccatagtacgtcagacggagcggcgagggccacctcgcagccctgcacagcctgcagacccagggcatgggcttctcacaactacagaaaacaactcaactcctctgggagagtcaaaaaaaagaggaggagaaagtagagagtaagtcccctccccaccaggctgcacatggctgtgcccccgcctggtcctcaccggcccgaccccctcggccctggcagatggggttggggagctgacagctggcctggcggggctccccaccccagccaggtggggacaagggaggcctgttgccgtcattgacgtatttcaaaagcaggtttcactctgagtactgacgctgagttcccgttcctctgggtctttgggaagctactccggggcttggctggattgaaacataaagaacagaaagtgtccaaaatggagtttcctagaacttcgggaaaatggagcaggggttgtcagcagcgccctggccttatctctgaagtgtgcacgggagctggcgggcctctgggaggccagccccatggactcccccctctcctcactgtcttcctctccggccagcacgctcatcatccagggccccagccccattttggagagcaccccctcagtgtgggagcttgcagggcagtgtgggaggaaataggccccggggctcggggatgcagggcagggaggctgcagaggaccctggggagcacccatcactcctggcagaatttatccaggcaggtctgttcccagaagtccccagtctcaggccgtaaggactcaactctgagccatctgggatcccaggaaagggaatgggagcctggcacctgtgagtacaccccgaggagtggggctccaagagtgctggggtctcggggaggctgcatggggtcaccctcctctcctggggacaccccctccaggcattgacccctggaaacaaggagtgggagagggcggccctgcagcgtcgcggccctgccagggaatgtgctcaccctggcgccctggtcggggaccctgggcaggtgtgtgggccgccacccagtgtgtgctcctggccccggccacccacctggagctccaggtggccccaactggccagagctgttgcgaggtactggtcccacctgctcacagcacctgcagcagaattttatctgcccctgcaggtgtctggagcagtcctggactgcgctgggtatggaagaggctgccgcccaccaacaggttcccttagggcaacagctgaggtcatggcaggagcaacccttgtcactggcacacgacggggggcagctggtgccactctggggtccgtgggtggagagggtggggtgggatggagggacggctgtgtgggtggccagaggacacacagaggacacgcatgtggggcgcgtgggggtggaggggtgggtgggggggaagggcgggggctgggggtggggaaagtgatctctgggatactggacagatggggcagaagaaaacgtgatgagagagaagaaccagtcactgggggccgggtggcgccggcacgaggacggaggggccggcatgcacatggctgggatggatggggatcgatgctggagtcaggctttggtgtcagcttgaggatctatttggaaaaactggcaaacagaagccctttaggcccatcttgatccctgtcactgtgtcgtttgggtgaaccccccatccccgccggctctcccgccagccccccatcactgaacctctcgggcctctgtggcctgtccccacctggctgggcctcgtgggccctcctgggaggctggcccctccagtcctgcagcctcagccctggccaggtcctggggcggccctggcaggcagaggggcttgcgggtgttcagcaggcccctcccaacacccactccttgagcaccgtgggagacgctggtctctgccttgttcaggtcagaggactggactggaaggagccgtccgggtgcacagccatagcacagagccgggctctgctggggactgggaggccctctcagaggaaggcttcctgggtccgaggctggccgggacaaggagcagtgaggaggagtggcaaaggctgaggggcgtgcatcacgagcctctttccaaagaggtcatgttggttctgctaacccatcaggccatcgtccggccgggccttgggctccctcacggctgtcctgtcctggctgtgatctcaggatgggagatgcagctgccgtttggtttggggtttgaggaaaaggctctgaagagcgtttggcttgccatggtcctgtcttgacagtggctggcgggaggacagcttggcaggctgcgcctctagccagtgatctgtgagcttgtggaggtggcagccgggaaggggtagagacagggtgactctccccagtccaggtgtggcccctgcccagacccccctctgcctgggggaagagaagcagatgcctgcaggtgtagactgcaggtcggaaccatggggatgggtactcatggccaccaaggggaccacccctaacacaagaatgccgcctgtccccgtcccctccccagagctatgggttccacctggtttgctgtcaggtctttgaccaccagggcctgggcatatgagctacagaaagacgggcctctgaagcatcggagggggccccagagccttcctgggcaggagctgccttgcttcacgtgactcggccaacacccgcccagggttccctgacacattgcacccaggacatccccttcttctgtctccgggcctcagttttcccagctgtcctgattccttgtggccctcggccacagggctccatctgcctggtctctggccaggtcctcatgccagttttgcactcgtgctgagggtggcttggtgcatggtggggggctacgcagggcagatggcattcatctttggctcgagggctgaccccttcccaagatctgaggtgacagggcctgtctcaccctcagccttgtggtctggcccctggaggctgctggccagatcgatgcagccagctggtgcacatgccactgtccctggtacacctgtgtgtacccaaagaaggatccagggaggggagggaaaaagaggaggcttttgcccacaaagtaaactcgtgtctcctccacgctccccaccacagtcctgaccccagggacctgagtaaccagggaagctgcccatgggtccacttgccctggggctcggtgctctagagaccaccggttcacctgcacagccttggagggcctgactcaatttaccccacagcactgtacccatttcctgtcccctagagcctttgatcaccacagccaactgccctgcccacctggaagggcactggagtgtgggtggggacaagatggagccccagtgggggagagagatgagaagagtcccaggacgtctacctccgagggaggcaagtccccttcgtgggcacgggcgtgtccgctgctgccgctgtgtgggttcggagctggagaaccgcagccctggaaggaggagaggcgcgcttctgccacttaaccgagagcccaaatcccagaccggtccttgcttctctgaaacccacaaaagcaaaccttggggagcttgctgggcctgtcactgaggaatggaggtggtgccggggccagggcaatgtctggaggacagactcgatctatcttgactttcagaacgaggtttctgttgtcagacttggttccagacggtacctgaccggtggtgacccgacaggatccatccttatgatgctcaaagaatgaatttttaccaccgtgaaagaaccaccagcaggcaaaccgctcctcccctcggggccactgttcggatttctttgaaaatctgtttcctacacttcgcaaactcctgcggtttctgttttttatttggcaaacatctcgtttattaccatcatgaatatcatttggacctctgcaaagactatatacattcacattaacgtacacgctcagcttcaggcctctggcgggctgttcgtggctggttcagtagctgggtcactcccgtattgcactgagttcctagaactcctgatagccacgcacacagatgccaggccacgggccacgccacgcgcacagatgccaggccacgggccacgccacacacacagatgccaggccacgggccacgccacgcacacagatgccaggccacgggccacaccacgcacacagatgccaagccacgggccacgccacacgcacagatgccaggctgcgggccgtgcctgctgtctgtccttgtactcggtgcaagcatgaatttctttatccctttatttccttcttgaaatcgctgaggcagttgagaggagtggagggagggtgggcagggctggaggatgggagggagcacgtctgatagaaaacgtcaccgagacacaccccagggccagaggcgaacgcatctgaggggtggctgggcaggagcaccagggctatgtacacggtcagggtcttccctggggaggaggcagagggctgcttttgtttgtagtttttttgttttttctgcaaaagtttggaagaaaggggagtagctgcggtggggcgatggggccgagaggttggagttggggcgatggggctgagagaggtcggagctggggtgagggggccgagagaggtcggagggcgcggagaggagagaggtagaggaggacgggctggccgagaagcagtgtttcagggaggcctgctggctccgcatgctcgaaaagcagtcgagaatcaacccaaaagattgtcacagttttgtttcggaattatgctctctctgggaagaaaactttagcactttttttccacaagtggaaaacggaaatatgaaaagtcacagggggcgtgaggacagacggcgtgtcctttcctacacatatggagacgcaggccggagcaacggcacacggaccacgcacacgcggcggacgcaccaacgcctacgcagaagagaacaaaagtcgcttctaactgggcacaaaccctctgcacccaaatatcccgacacccacaaacaaaatcagaacagaagagaaaaagacccacatccaaacaaacccaagagcaagtgaaacagtgaaaaaaatactttggcagtgacaaacaaattttggattttgatttcttgtgtttgcttttttggatttcctttggagcagaggtgtgtccggtatccttggctggctagctagcaaggtagttcacaagtatgcttcctttgcttttttaaaaaaactttttggatttttacttaaagccaaagagtttaacattacaggaaaaaaaaatctgaaaccaaaaatgcatcttgagtcagaaatcgaaatctttcctcccgtcttcgctgatcagcctcacgcccctgggggaggggcacagctgggttcagatctccagctataaaatcgcagttttctttctccctttttaatcaggagggggagaacccccccgttttctttgtccatttctgagtagctcttttgccaacacacaaaaccccccaaaattctttgctgaaaatataagccaccaattcgattttttcattgaagagaaagtgtgtgatagtcatagagagagagaggatagagaagacagagggggagagacagacagagaggaaaagagaggtgggcagagccgccgcgcctgcggcatctgctctgctgtctaaagctcagtcgaggcttctgaggatgcttgaagagacgttgtcaggaggtctccgcgcggaatcattaggtagctgaggcaggtgcactgaatgcggttttgttggttctgtgtcttctttcggagaggggcagtagcagcagtgactaattggtcggctcccccaggtcaggcggggcgcagtgtctggcaggccaggcatcggaggccaggcacagcatccggtgggcctggagctgggtggggttggcacggtgctgtgtccggcaggccaggggccagtggggtcagcggggcacggtgtccagtgggccaggtgggctgggggagccggggcgagaaggccccgcagagccggcttcgctggggctggcagcacccacaggcagggaggggcccaggctgtgggcggcttcgggcggtccaggcaccgggtcggccaccacggctgtggggccctgcaggctctggccacacacgtggtgatgcttctcccagtcccgatgctggcagaaggacccgcagtagcgtgccgcgttgcagccgctgcacgtctcactggctttccgcccgcagttccagcagctctgggtgggggcagaggggccagtcagggctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggctgctgagatctcaccatccgcctctgctgcatccacacccacccgtccccctccccacctctgccccacccctgcctctgctgcaccccctccacctctgcccccaccctgtggtgggctctgctcccttcccgtagggtgagttgtgccctaggcatccctgtgggcagagggggtgggggatgccacaaaaagcctgtgggcagagcaggtaggagatgccacacaaagcctgagcatatttcttcttggggcctggctggatctctcacagacggttgggctgtggggtgggaagcccaaacctgccctaggggagaagcccaggtccctatttggcctccaaagcctctggtaccacctcccaccccacctcgccctcactgccactgcagcagcagcttccctgcggactaggcactgccaggcacagtccccgctccaggccctggcccctgccggtccctccgctgggcccgctcccccgatgcctgcgtggccagcttcattcctcccggcatctgctcaggtgtcacctgccgtgaggcctccacagccccactccccacacacttccacctcccgaaactgcacgcctcacttctgcgtttggtgtttccttctcagtgccagctctgtgagagttgtgcctgtggtggtctagcttctccctagctgagagcaggcgtggaaatggccggtgcagagacccctgaatcgatggggctccatctcctcccaccccggggctggcccaggcacagatgcacacaggggcttcagatagagatccgccctatctcaagggacagtcctggggctcccctggaaagggtctctccctgtcccctcttcgtggacaaggcagaaaagggtcgcggagggtcctctgcccccgcctgcctcccaggtgcacgggcacaagcatcgtaattctcaggcctgccgtgtgcaccgggagggagccgggcgcctcggacgccacctggggccctcacagctctcctggatcctcctgttctcacaggctagagaacacgggtttcaggccaggcacagcggctcgcttctgtcatcccagcactttgggatgccgaggcgggtggatcacctgaggtcaggagttcgagaccagcctggcctacgtggcaaaaccccatctctactaaaaatacaaaaattagccaggtgtggtggcgggcgcctgtaatcccagctacttgggaggctgaggcaggagaaccgcttgaacccgggaggcggaggttgtaatgagccgaggtcatgccacagcaacaagatcacttcagtctgggcaacaagagtgaaactccatctcagcatcagccaacctgggctcgagtcctggccccaccgcttcccaaggccgtgacctcagacaagctgccaaccctctcgagccctcagtttctggaactacagaacggggacatccataggacgcctcactgaaccatgtgggatctctgtgctgataaagcacagtgtgggcggggatggcgtgcctgctgcaggatgcccgtgacaactgtgctgatgccacgtggaggctcagaatcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacacggctttctgcagctccgacatggcctgccgcttcacctcattcacggcctcttctgcaaaggacatgggcagggctggcggtcacatgggccatcccagatgggtctctggacttcctacgcgtggccacaacctggggacaggggctgtgtgcagctgaacacacgtaccatctgtgcacacaaaggcacatgttgatggggctgtaggcagctgaacacacgtagcatctgtgcacacacagacacacgttgatggccctcatgcctgtgcagacaagtgcatgcaaataaacacaggcatcccaggcatgtgtgtgcaaagctgggtcacgtggtgtcacaagtcaaagcttgcactctaccgcagcggctccccaggcactgcacccctgcagggcaagggcgaggcccaccccagggcctggtcagccaggggcgcacccggaatctgcattcctaacgcgagccgggggagctgctgctgacctgaagcacttggataactctgccgttccgccttcacctctggccccacccagacgcagcccaggaagccccctcgtccagggctctgtgctgtcaccccagaccctgctgttatcctcaccgcacttgccatcctttaacctggctggcctctgaagaccatgctccccgacccacacacagccacacacagatcctgatctgtgctaagatggggtaggctcagagcagcctccagggagcactgcccacgcagctggggaggccatgtttcaactccaccactgaaagagaccctgaggccagctggagaccccggtaccgctgcccaaccctaaccctaaccctaaccccaaccctaacccctcttgctgcccacatatctggctctgccccagcccctcccccaaggctgattcccacggcatgagcaaatgtccccacagccttgcccagcgctcagctccacgtctgcccctgttctgaccccattctgcccggactctggccccgcgtgcctgacgcgcccaggctccgagtgtgtgcgcttctgcgtgccctcctgggtgtgcaggtccaggacccactttattctgctgggcggccaccggtccgtttcctggtaggcgcaggtagcagctgtcctgccctaagtgtgaacctactctgacctctccgtgagccacacagcggaatgcagaaagccttgtagcctgagcccccagagagagacagaagctcttcaaagctgagccggtgagaggcgcatctggggccctggcctcccacagctctgctggccaggcccctgcacccccactcaccagccttcctccagatgtcctcaggcacgtagccggtgagggtcctcggcaggaactcgcgaggcacgtctgaaacaggggccggcgtcacacaggatgggccacgcggctgcccctcccacgctggggccctccccaccctggctgggccctgagtgcagggcgtgagtgtgtgcgtccctggggggaggcccaggtgccctcggacaaggtctggctcaggcacccagggcagtgcccgggcacggggggcattggagctgtggaccttggactcggctgggagccgtgtgtgtcctgggcctctcctgtgtcagcattcgtcgctgaggcggagaagcagagaccctcagggcctcccagctccgagcctctggcccaccagacgctctgagctccaggcttcctggcagaccagcccgtgttttcctacaaagtgaaaaaggtgcctctttctcaagcgaaactgttctgcctggtgtttcgttgcattgcctgcctgacagctcccaggtgtccgccccaccagagcaccccgtgtctgctccctccccccacaccccacacgcacctagctgaggcccttcgggaccggcggagctgctgcggggccgggccgcggcgggagcggggcccttctttgtgtcctcggcgtcgctgtagcgccgcgcccagtggttgagctcctcgcggtcggcctcctggcacctgcgcagcaccgtgagcgagcgccgcgtcttctccaccatgtccatgatgcagttcaggagctgggggcgggcggcgcagccttcagcacctcagagggaccgggacgcaccagacactcccccagcccactcggccagagccccggacaggatgggtgcccgaccagcccaccgcccgtgagagtaagggggtgagggagggcccacctccatggcttgcaaagatgggtccctagcctgggactgccgagcgcctgggggtaccagactcacatggacacgtgcctagacgcacgcaggagtttgggattctcctttttaacccgctcagcggggctctgcctcagggacctggctttccgcctgggctccccttccaaaaagcatgagggcgaggggcgaggctgacaacagtgctgggaggggtgctggccccatgcctggcgacccctcctgggacgtgctgcaggatggggtgggtgggttctgaggagcccagttccgggccgtccccgaacacgtcctgcctcaaagaggcctcggcactgcttttgcccacacttcttgcaagactcaggatagactctgggaagagccagtgagcagaaagtaagtggagggaagcaaggcccgccatgagggttttaggaatcctcctccctgggcctctcgagatgcctgggctgcgctgacagctgggaggaggggggctcaggtgaaggacccagccgctgcgcagggacggcgcaggccacacaggagggcactgagctcaggggcgcccacacagccctgctgtctccagcagccccaggccccatggggcagagccatggccgtgtttatgcataggcatacaggtgtggctgtgtggggacatggctgtgtgggtgtagctgtgtgtgggcatggctgtgcgtgggtgtggctgtgtacatgggggggttgtgtgcatgggtatggctgtgtgtgtgggtgtggctgtgtgtgtatggctgtgtgtgggtgtggctgtgtgcgtgggcgtggctgtgtgcgtgggggtggctgtgtgtgactgcacgggcgtggctgtggctgtgtgggcgtggcttgtgtgggcatggctgtgtgcatgggtgtggctgtgtgtgggcatggctgtgggcgtggctgtgtgtgcatggctgtgtgtgcgtggctgtgtgtgtgcgtggctgtgcgcctgggcatggctgtgtgggcgtggctgtgtgtggacactcacgttgttgaggtgcttccactcttctgcccactcacgctctgtgagcttgtggtcgatcacttcttcctgccgggacccaggcaccactgtggatgggggaggtgcacgcttaggtcccacccacagccagtctctgccctattctcccagaccccgccctctgctcccaggccccacccgtgggctgtgcccgctggggacgatggacagggtaaccgaagggctggttgacttggtgaccgtggaggatgcctgggttactgagccgcctggggctctgggccgactgctcttcccctgcaacacggcacacgcctccaagggagggttcagtctcagtcccattctgcagctgaggaaactgaggctggttaagaggatgtgtttgcctgtggtcaccaggcagggagcggtgggggtggggtgtggaccgaggctggctggagctggagcagtgtcctcagccactggccgggaaggctttgttagactaagcgtggcctgaggatgcctcagtgccaagtcacaccatgacctggacctgccttagtccgtgaatcaatgggtaacctcactgggaggagctggtctcagtcattcgcggcagccctctgcggtcacccgcaggcgcccatgactccgatgaagccacgccaaacaccacccaaccacgtggcctcggcacccgcctcctgtctctgcctgtgaacaccgccagccaagccgaggccagggctctcggaacacgctggctctgaggcccatcctattcggggttgttctctgctcagttaaactctgttcaatacagcgtgtctaaggtttttcccttttgacaggctccaggactgaagccgcagaggccactcccacaggtcaccagaaactaagacgtgagtgacgcccggcagtggccgactcttccgccgtggctgtgcccatgggagacgtgagtgacgcccggcagtggccgactcttctgcggtggctgcgcccacgggagacgtgagtgaccccggcagtggccgacttccacggtggctgcgcccacgggagacgtgagtgatgcccggcagtggccaactcttctgcggtggctgtgcccacgggagacgtgagtgacgcccggcagtggcttactctttcgtggtagctgcgcccacgacttctggagacatcagaggcttccaggccccactgttttctgcatttggccactgcccacgcttctggggctgaggtctccctcttggggcccttttcagcccctaaagatctcctagcctccgaacctgaaatggctcccccaaattgcagaggaggtggggaagtggcagccacagctcagtcaccagcctgctctgccgcctgtgaagctgcagctggcagcaacaccccaaccaaaatagtggctgagacgtgcccgacagctggcgtttatttctgtattagcagaatcgggtgggagtcagcacctgcctgacccggctgcagcatgccagacgccgtcacctgctgcctgggccctggaaccctccgcaaggtgggggctgggagatggccttgtgtagggcaaggcctctgctgaccctgctgctgggcccccaccgggccctgggcctctgtctcagcatggcagactggaggcctccctgcagcctgtcctgggggggctcctggggtggggctgggcctgaccatctctgggttctcagcacagaggccgtcaaaacgtcaggcaggctgggctgtgagactgtgggtgcattatgtgtgctctcaggcctcagtctcctcatctgtggtatgggggtgctgacgccaccccactgacgggctcagaaacgagtgaaggataaaatgcaccgagactccgtgcccacctctctgttatccacaccagcctggcctcacgcagagactctgtgcccctctcctgctctagataccagccaggcctcacggcagcccttgctgggccctgcattaactcccccaggccttggactctgagagttgggactctcgtctggcccaggtgacagaggaggaaactgagaagcagagagccacgtgactcacctgtgggtggactgtgggaatcgccaagctcggatgagaaccacgtgggcagttccaggcccgaggccgcccaccccggggggagaggtgggttcagggcccaggacaggcccctctgcagccaccgctctgctccagggggaatgccaggcagggggaaggggtctcccgagctcaggtgcacacagctgcccgtggtgccctgtgcccacatgctcaggtgtacatgtgggcgcatgtgtgctcctgtaacacgcgtccacgctcccgccccaccgggctgctcaccaagcggccgatggcgctctcgtagctcccgggggtctgggtggcggtaggcatctcggaagtggtgggccatggctatgtcctccaggcggtagtgcggcggcggtgtgggctgcggtggcccgttgctggggctgtagcgctgggcagggttcagggtgcatggccgtttgctgaggtgctcggggtgcagcgggtcgcggtctgacccgttctctttggtcctagccccaagagcaggtggggcgagggcagtggacataggatgaaccggggacagaggtgcaggtggggtgagaggcagacaggcaagggcagagagaaagaggacacgtaagggcgagacagaaacacggagcaaaacaccagccccgggaagcccagcccggcgcccccactctctgcccctctgccggggcccatgccagcctcaacccctgctccagctgcatggcatcctggggcctggtggtcaaagagccggactcgctgctctgggaacgaggagagggatacaccaggcttccgtaactggagaccacctgccccttgggcagcagcagcacaagagcgtctggggcagcagagggggcccagcccaggcacctggggaccatggaccccggacgctcggagtccatgcccggcacacaggggagagccgtcctcccaccagcctcctccctgtcctcctaggctccccggagcatctgagtctgcagcccactggggtgtccgcccgtgcagccaccaagcctgctggccctagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgacttccagtagcagctctgaggagtcgatgggggaggaggcgctggcgtccagcaggagctgctcatgctgggccaagtactgggcgggcgtctgcttggccaggcgtgcacagtgcaggagctcccgctgcagcaagggcaggtttgcctgtggggtggggaaggagggcctgggtagcatgcaggggtgcacagccctgctcaggtccgagcagagggggcctgggctgggtggccgaaagctcaacttgacctcgggcctcaaaggtcaaggtgctcgacctctctgggcctcaagttccttcctagcagtgccatgggagggtggcgtgggagggtgggcacagagcttcgcaggagtgcctcacctgggccacacggcgatgtggggcatgtgggacttgagcccagatcctggactcccagggtggggctttcccaccgcacccagctccctcccatggcgtggtctggagaaggcgagaggacgaaggggcagcagatcatggttggtcttcccgcctgcacccgccctgcccagcaggcaccacatgacccaacacagctggggaaatgcaggctcagagagggggaggcagccctgggcctacaggcggctcacacgagggagctgggagtgaaacccagctgggattgcctgcagtgtgtctgctccagccctgatgggaagccctgaggttcagcttccccttcccttcccgctggtttccagccttggccttgatggagcgtggacctaggacgtggacacccacgttctgtggctgctcaagtgatcctccagccttggtgaggacggcctcaagacccacgtgtgcgggtaaagactccgcagcatgcggccgaaggacggcccggtgtacgggatccgtatgcagaccctgcctttgacgcctgtgtgtacccgcggcgcccgccgcctcgtccttggctccaggctggcactgctgggccgcaagccgggctcctcgggtgccttccccaaagtcttcccagagctgccgcgggagggcggacaggcgtgctggaccctgagcatgctggaccagggcccagcagcaggccacttgggagagccagcggttctaagcatttgtaaataaatccaattccccaactttctcatgcgtttcaaagctgccacgccgccttctcctgccagcgcctccccattccccacgagtgcatccaccaggccctcgagcagtgccggctgccggcctgtttttctctttggatggctgaacaggggccaaccggccatctgttgaggacatcaggagcatgagctgggaaacgaggtcccgggaggtctgaggagccaaacatcctccctccctcatcagcccctccccaggggcctcctcttggtcagttcgggaaccggctggtcgctgttagggcggggagaacatctggatccctggctggctggggccagctgaggccagctgggagccggggcggtgggtggggctgcatcccccagcttctggaaggcctgacccttgggctgcgtgtggggcaggctcaggaaagggtgcagagaacccaggactgggcagcatcagcgtaggggccggatgcacagcagccctcggcaagcagggaatgtttcctcaaggcctgcggaatggggtggggactgtgggaacctccggcagtgcctccttcaaggcagtgtccccactctgtccccaggagcccagggcacccggggaggtgtcaccactaaaatgctacacacactgagctggtcaaaatgccccaactccaccactgaacggaagttctgcctgcagaacttctgaagctgccctctgcacagatgggcgctcaggctggggaactggtgtttgcaatgacggcggcggtggctgaggcactagttgagctacaagggctttcgcggactccgctgctctgccaagcacccagctaaagcctccctgaccgtgggctctgccatagaggggctgtggccttgggctggtcatttaacctctctgacccttgctgtatctgcaaactagcgctgtggagcctctggccgagacagactccggggagctccgggtgaatcagctcagtcctttcccaccaccccgtgagggagattcaccaccccaactacgagagagagggcccaagccagggctggggttccagccaagcaggcccccactctctccggcccctcagccacgattcctgccgtttctaggatgatgtcttcaaggactgcgtgagagtaccccagactgggcctggcgggctgtggatgtcttgggaaggtgctacccctcccccagcccaggccacagtcaggaacaccgaggcccaaggggactggctgggggtcactcccactcggcacctcctgtctggcctgggaaggtcggactcccccactgcactctgtgtctgaaggggctgcggccctgcaggggtgtgggtggggttgggggggtgcgggtggggttggggaggggtggggtgggggaagggtgtgggtgggggaggggtggggtgggggtggggtaggggtggggtggggtgggagggggtggggtggggtggggtgggtgggaggggtggggtgggggctgctccctgggtgggacagtgacagtagggccagggttctggcttgtatctgagccacaagacctggaagcaggactggccgcaagatctttattttttatttttgaatcctcctggcctccccctagaagcgccatgtcagagaggtgaacagacttcatgtcccactggccccgggccccgggtgggggcacgaggtgggctggccctgagctccagctaccccacacaggccgtgggatcccctgtgtaccaaggggagactgaggtggacacggccctcacgagagccgggccgcgggcggcacctgctggggcgtggccgggggacaccagggcctgaccagacgtcatggacaggggccgtaggcctggtgggggcaagggtggggatgctgcggcgtttctctgcctgaccctgatcctcagttaagcaagggtggctgaggctgggggcatctgttggtaataagcaggcgcactgtgtccccaaagactgggaggggtggagtccgcagcaagttaaaagaagggaagggaagggccgctaacgaactgcaaacgacgccagatgggcccaggctcctgccactccagaagcttctcttttgtcaccatctgggagcatgagcacagcagggcgtgggagggggcggaggaaggcgggaggagggatggagcgatagaggagggagggcaggaggaaaggagggggtggtgggagggagggaggactggggcagcggagggagggagggcaggaaaaagcagaggaggcaggggcgggagggagggagcgagggtgggaacagaggtgggtgtgatgtggggtccccttggggagggactgaggggaatgagggtctgaccctgtaagtgccctgggacgaccagggcgtttggaatttgacagacctaggtttgagccctggcgccctctctccactacctggggggaacccagagcctcagtttccccacctgttaatcaggaacatggcagtgcctacactacaccttgacagaggccaacaggtctgtgagagaccttcctgaagcactcctcctcctccagggacgacaccccgcgattcctcctcctccagggacacttcaaatccctggacgacgccccgcgattcctcctcctccagggacgacgccacgcgattcctcctcctccagggacacttcaaatccctggacgatgccccgcgattcctcctcctccagggacacttcaaatccctggacgacgccccgcgattcctcctccttcagggacgacgccccgcgattcctcctcctccagggacgacgccgtgcgattcctcctcctccagggacgacgccccgtgattcctcctcctccaggggacgtttcaaatccctggacgatgccccgcgattcctcctcctccaggggacgtttcaaatccctggacgatgccccgcgattcctcctcctccaggggacgtttcaaatccctggacgatgccccgcgtgaatctagaacatgcctcacctccctgtagtccccgctacctgggaggctgaggtggaagattcccctgagcccgggagtgaggccccgttctttccgcgtgtccctccacgctgtctcctcaacagcctgaggatgattccattttgcagatacagaaaccgaagcacagaggaactggcctcacccaggggccaacagctgctaagtggcaggctcgggctcaagccagggagcatctggtctggtctgtcctctggacccccgaggggaggcctggcccagcagagatggagcccacagcagtacgggcagtgctcaggctgggcccgaaggtgtggccaggctggcagctcccaactaagctccacggaaccctgaccccaacacgtgctcggcagagaaggtcacatggtcagacacatttggggaacctttcctcagctcctgctagagatgtgcagccgtcttggggaaatggagacccgcagagatggcagtctgactccacggcactcccgtgcccgtcccgtctgtgtgtgcgtgggaatcactctcccatgggaatcactggcttcattcattcattcattcattcattcgttcagagacagggtgttgctctgtcgcccaggctggagtgcagtggcgtgatcacagctcactgcagtctcgacctcctggattcaagcaatcctcccacctcagcctcccgggtagctgggatcataggtgcatacaacgctcagctaatttttatattttttgtagagatggggtctagctgtgttgcccaggctggtcttgaactcctggcctcaagcaatccccgttcctcagactggcatctttaaaaatgcaggctctgattcagcaggtttgggccgggccgagagcctgcaaagctgacaagccccgcgtgctgccaccctggtccacggttgatctgggtgtgaccatctgacctgctttcacctgacacctcttcatccatcggcctgcgcagccacagaagccccttcccgcctgtctaccgccctcacctcccgccctcacctctgctctctccaccccacgtattctgttccagtcacactgacccctctgctgttcctcaagcacagcgggcgccccatacctcagggcctctgcacgtgcagttactgctgtctggaaaaccctgcgctggctctgcacctagctccgccctcatcctcagccctcaccaacacgcctccaagcaaaggactttcggaatacttctccaccacgtgcagctgcagatttgagagtggctgtggaccgaacgccttcccaccccagggtgctggctccaggagggacctgctgcatgtcctgggccctatccccgagccttgcccccacactggcacgtcgtcagtgctcaaaaatcacccgtggagtgagcgagcacattcggccaacggcaaccagaggcgaaccggacagctctgtcctgtgctggatttaagggctgataatcatccggtctggcaactaattttcaggccttaactagtaggagtcaaccctgactagtcagcagtgctcccctagggtaccacagggtcccaggttggccaagatcgatgcctcacacctcttcatccacctgcctatctggccacttaagccccttcccgcctgtccaccgctgtccacgctggcaaggagtgggattaaggggccttctagggaggctcccgcagcacgggggacgggtttcgcattaccttcaggaagggaatgacaaacggccgcagagggaagttggtggcctcctgaagcttggaatgaaactcctcgatcgtcaatgtcgagttctgcaggggagaaaacccacctcacatcagcaccgctcggcatgtgagccagcgccgacccacccatgcctgaggaggaggcttccgtgttggaggcaggcaggcagcccaggagctgggcacggcctgagagggtgcaggtggcatcgtgggagcgggtccacgcccggttgtcagcgtggagcccatgtaaggagtggccgtggctgcaacctcattaaacggagggaatatgcatgtcccaaggccccggctgtccctgcccaactcaccaccaggcccagcaccagtgtgcgcacgcgctccccaatctctggggagatgtcgctgccaaactgctgcagtgtggtgaggaagcgcttgagcttgctgagctgccgggccccgcaggctgggggcaggtgctgtgtggacaaggaggctgtggacgaggtggccgggccattgctgaagccgttgggtgtgcacggtgcaccattgatggctgttggtgagtggctgctgccgttcatcactgcaggagggaagcggacatgaggacacaaaggtgatggtgacaacacaacccagacggcggcgacagtgagggaagcagcgactaaggtgacaatgtcaaaagtgacggcaacaatgatgagacacaaggacagtagcgctgaggatgacagcaggagccctgggcccgcccagggcagctgagctggcccttagcatgctgaccatctgtccttccggccctgctctgagaggtcacacacacccccttacagacctggaaatggattcccagggaggtgaagcctctttgccccaggtccccaatgggtaagggctgggatggcacccacaatggtggtggccgtggaatgactgcgttctgagtgtggcttctcctgcctggcaccactcttgggacttgctctggggctgaagtcaggcccttcacacccagcaggggtgcggcccctacgcctggcctgggagacaccaaccctaccaggctggctcaggttttcactgtgaacagggagcaaggggcttctccacacgtcgggggcttgatggctcacttcccactttctggaggcacaggagacttggaaaatgagaagtcgctcatcccccgaaaggccagctaccatcacctctggcatgatgttcccaagcaatacccccacccccaatcaggcatctcccagccctgagcaatgtccccacaacaggtgcctcccagccctgagcaatgtgcctccccacacacaggcgcctcccagccctgagcaatgtgcctccccacacacaggcgcctcccagccctgagcaatgtgccccccccgacacacaggtgcctcccagccctgagcaatatgcgctgcaggtgctttccagcagagcaatgtccctcctacaagtgtctcccagccctgagcaatgtcccagacaggtgactcccagccatgagcaatgtcccagacaggtgactcccagccatgagcaatgccttcatttgcacacagccccaacgcctgctaatggggttccagggggcagaggagctgggacacccaaggacacactgggtgggttcctgcccctggcggctggacacgcagatgcccgtgcacacaggccagtgcatgttgaggacaagcaggtgacataaggaacagctgatgagcgcgctgcagggccgcctgttggccactgagacgtgactgcctggctggccctgctattggggtcagtgttccaggggcctggcagacatggggctgctatggaaagtcccagggccgggcctcaccccttttctcaggtgacagagctaaggccaagcctcttgcaaggcggccagcgcacccctcctgcgcctgggacacccgcaccccgtgcccttggcctcaggagcctgaggggcggcctccaggctctgaaggcaggtcagaggtcacagggctcccaagtcccttgctgacaggggagggggactggatgcctctgggaggcctgaagtcctggccagctccttctgtcaggaggactgaagccccgcacacactcacggctggctcccgcctcctgcagaaggacacgctccctacaaagggtaccaactcccctgccctcagagcgagccctccatttccctgcctccactcaccccccaccacccttacacacatgcacgcacacatgcacacacacatgcatacatatacacatgcacacaatgtacacacatgcacgcacacatgcacacacacatgcatacatatacacatgcacacaatgtacacacatgcacgcacacatgcacacacacatgcatacatatacacatgcacacaatgtacacacatgcacgcacacatgcacacacacatgcatacatatacacatgcacacaatgtacacacatgcacacacacatgcacacacacatgcatacatatacacatgcacacaatgtacacacatgcacgcacacatgcatacatatacacatgcacacaatgtacacacatgcacacacacatgcacacacacatgcatacatatacacatgcacacaatgtacacacatgcacacacacatgcacacacacatgcatacatatacacatgcacacaatgtacacacatgcacacacacatgcacggctatgatgtacacgctcgtctctcttgctccactgtggccccaagtgcccctctccaggggatccacccctcacccgtgctgagagtgtgggtctacgggtggggggcagctcagagccacctgctccctcagggccgaattcctccgaggccccagccgtgtgttcgcacctgtggctgagacctggcggggcctgtgtgcgccgaggaggaggggaaaaccctttctacaggatggagacgcccctgggctgggctggtgcagcggctccccctgggcagccggcaggcaccagctgtttccttcctgtgccctggatggtggggggtcttggtgtacccttcagatcaggccagccctgcccatcctgacctggcccctgggaggtgacccctgctgagtgttgtggcctctgtctggacgggagggaacatgggacgtggggacctacatgccggcccccctttctgggctgcgtccccacagctggggctccggctaggccaggcctccctttctacccgctcctgcaggcctggactggaaggggccgcaccctccagagggcactgaccagcccgtacctccaacaaggcccttctgaggggtcaggccctctctaagtgtccctccagtaacctttaggtggccgccatcagcttcctccactccgccttcccagaagccgcctgaggctcccaccttcccgacccgtggtctagtggcacctgcgaagtgcgcccgggtcaggaagctgtgctgtggcccgggctgggctctacacctgcacacaggctgcgcggttatcacacacatcccatgcggcaaatgggctccgaggaaccgaagacacacagcagggcagcccggctcccccagattgcctcccgtccccggcaggccccacacaccgagcaaacagcgctgggcacagtggcacaggggggaggccggccctgtgctctggatgttcttggtggagcggggggaacaggtgtgcccacgactgcctcccccggggcccagcgctcactctgctctcactccagcctgggcctcacagatacccactgcaggggctgtgggaggccaggagggcgggggatgctacagaggccctcagacacaccagcgtggtgaggaagtccagacagacacggccctgccctcgagggctgggggaagctgccctggttaggagtgaggaccggccgccaggcccagacgtgccctgtgagtcagactcggcgcctagcctcagtttcttcatttgcaaatggctcccaacccatcctggagttccaagtggggctccagggaccagaggacagcatggcagtgacctcctttgtactgtgtgtccccagccagagtcgctcaggcctgacctgggcttccccagcctctcctgcgctgcccaagtcagccccccagggttgctccatcctgactggttttatgggtcgggtgttgtgtgaggctgttggcaataaacagcccccacacctagtggaattctggaaaccactaatcgcaggtcagatatggcacaaaaccttgagtgcacgcgtggcctcagactttccctacgggggggctgcaggattgagacatctctgttgctggggccgcgaacctccacacgctgttctgagcggctgctcccctcaaccgggcaacctgcacagggggtagcctgtctgcgcccctggcttgaacgatcttagcagcgccttcctgggctcaggatggacgcaccggccctctggagcgcgcggcaccgataacggcgtcgtattctggggctttccctcttctggggggacagtggacgctgacacaggatgcaccgagcccctggtctctcgccttctgagcctctgtccggaggaccccaccgcgctgccgagtttccctctcaatggtgagctccatgtggccacacggtggactgtgacacacacaccccgtcaagactgaggatagccacttgcggtcacccagccaggccaggagatggcccgtcaccatgggagacctcactgcagcgggaggctggtttctccagaacacgagggactgtcgtcaggactgtggaccttccagcagcttctcagacgcgccacagtgcacgccggggcccctgcccaccgccccggccagcctgggcctggccctcccttaggtgcgcttaccagccttgccccgggtgcctggtccttccggcggcctgctcgccctcgcctgcccgcgcactccctcccgcgctgctgggcagtctcagcagctaaagagacgccaaaaataaccccggcacaagcgctttcattcccacgacaggtgtgttcctaagttagaccgcacacgtgtccccagctgaggattgggggcacacgcgagcacccccgcggctcccccagcctcagagccttggtgggggggtcagatgcgacagaggcaccctaacgcagcccctcctgtcacccctgctccttgctgtgggggctccgggatctgggattcaccaactttgccatccataagatcacagagtggatgacaagagccactgtccaggagctgcacgccaggcgcgagtgcgtggccaggcccatcacagaataatggctgtgaaaaggacagccctgtgcaacagaaacaacgcacagttgttctgctgccctcgttcttagagccgggagtgccacgacagccacacctgggccatgctgccaggctggctggtagtgatggaccggagtctgtctgatgggctcaagcatggctgcactcagtggttgacaaaaactataaccaccacctggtaagagcccatgctccctgaacgcccgccatgggccacgcacgttgacagaaacgtctgctggtgactcaagtctgctgagctctcagcatgtgcccggccccaccatctgacggctcctggagatcaccattggcactaggggccatgatgacttccattttacaggtggggaaactgaggcacggggggtggtacctggccaaggtcaccctggcaggaacagttgcagctgggactccaggtaggtggggtctgccctagcaatagctgagctacaggctggccagggacagtgtctcgcccctcccctcggcactcgcagtcagccccattggccatgttttgctgctggggaaggagagctcagagaggctctgctcctgcctaaggccccgcagcttggagcggagggtctgtgggatgcagcgacccggcggctctgccctcctgcgccctcttctccctaaggaggcaagaccaacacaacagaggcaatgctgagggtgcggaggccggggaggagagctgagcgcccccagggcagcagtgttgggccagctgaggatgctgcggtgaagacctctggggaggcctgcggtttttgttattttacttacagagacagaccatagaccattttaagcagccatgaaaacggccgtggggcagcgtcgcaggcccgtcctctcgatctgtaagcaaaataagaagaacacgctgtcaggaggggcgtgggcaggagactctgccctcaggggcgcccgcggccaccttttcctacttctcagagtgatttttggtgggggcgtgggcaggagactgccctcaggggcacccgggccgccttttcttgcttctcagagtgatttttgattttcggaggggcctgggcaggagactctgccctcagggacgcccgggccgccgtttcctgcttctcagagtgattttctgacggggctctgtcaccacctggggccaggccactcccctctccgagcctcagtttccttctctgagagtgggtgatccctaagggccgttctggcagcactgttccggagtttacaagaaccgcggcttctctatgagcaggggcggggccccttgttttcatcgtcctcttcccagaaggcccctgtgaccccatgagcaccatcctcagggacctgggccgaagccgcgtgtcctaaaagcgacctgagactcggcttggagtctctgaaacaaagccctgggtcggcactggaggaggaagcaccaaacaggaagaaagattcggctgggctcagtggctcacgcctgtaatcccagcactttgggaggctgaggcgggaggattgcttgagcccaggagttcaagaccagcctgggcgacgtagggagacccaaactctactatataaaaaaagaaagaaagattgaatttgttcgagctgaagtcagtggcgcaggccacaggaagacaggctctagtaaagacgggtagtgagttctctgtcatgggggtaatcaagggcaggataaagccttagccctttaagcgtcctcccagctttagaggagcttggtctgggtccctgctccttatatgccttccccctccccaccccccaccccacagcagcaccgcagcttcaactccaagatgaatttgcgcccagggctgtcactgggcaagagaaacttcggccctcaagtctccgttcagactcagtctcccatcagcttggctcagaggccagtccccggggaggagcctcccggcagggctctgcaactgagctgtggcccctgaagggcacccaccacccaccagccaggggcaggggtgcggccaaccacctggctttcacggaattgtgtggattaggggataaatctgaggctacctcaggggtggccagagcctcagactgatgctgctgacagcccagtgggactgaagcatcggcttagaaaagaaaaagcacctgcttatctctttcataaccttcacgctccttaaaccagctgggacctcaccccaaaaacatgaccccaaggcgggctgggagtggagggagcaggaaggaccccagccccaggcatgccggctgccctcacatccgttcacaggtctccagaagcagagcccgacgctctgctgatcccaacccacctccagccaggagcatcagaccggcaccttccaagcagaggctgctggtccccagggaagagcaggtgggggagacgcacccttgagggtctggggaaccaggctcagcccacggtgtttgtccctgacagtggggcctgaggttgtctgtggagcgggtgttttaggcactgcgcccatggccgggtctcccgtggtccgtcctgagcgtttcctcccccggggctggggtatactgcaaatttaacacagcagcggtctccctctacctatgtgggctcggtgtggtcgcaagctgcctggtagagagacggcccgtggtttgtaccagaccggagggctcttccgaagagagggaagggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagtagccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggcccccagcctcagcggcagagccagggagggagccaggcctggcctatagccacccggtgctctgaggacagtcgtgacgtaaagggactgaggaagcagctctttctggcccgtcagggacccggggcaagcaggacggaagtctcaggctccccgcccagagaggggcttcgtttgagtttcagagcctggggagggtcccccaggtacggggctttctggccgctgcatgtggaggtggtacatggagtctcccccctgcagacactgagatgcactcctgagcccccagccttgagggacagggacgctgccaccccgccggcccagcaactgggccaaagagcaccaatgtctgtcctcaaagccaaggctctgcgggtgactgtgatgagaactggctgttccctgccccacagcctcccagggcccaccatcggcggctctgtgcgccaagcacggccaaccccttgccagggccagcaagacaaggcctgacagcttcttgaggtcccacccttccggcctcctgtgccaaggcccccaccctggcccccgtgctcagccgggctgtggagctcctgagatctgagcccctccaaggccagagctgcctctgtggtccctccacggggcctgtacgcaggtgacctgctgtatgaccctgcggaagcccctgaccccatccgagttccacgttctctctggatgagcctggcattcctaggcctgccggacgaggcaggaagcctgaggcacagcggccggctttgacccatggccggccctggtgaaaggcctgtgtggactcacctggccccaccacagccctgggaggacctgcattgcagaagaggaagcccaggccccccggagggcaaggacatgacccggagctacccagtgggaagcagggaagctgggatttgaaccggccaagcctgggctctgggccacacgagctcctcacactcagggctcacagaaggtgcccgctggctccgggcaggaagctcagaatttcaaacaacacaagggcctcccctgaaacacctggccctcggctgccaggtgggggctacttacgtgtgtgtggcgtgaaggagggggggcgtgtggccccctgggatgcggcaggcggtgggggcggcatgctggggggtgtggaccggggctgcgtcttcacctccgctggggagtccggcatcgctgaggccttagctttcctgtccactggggctgcgaccaacggagaaagaaagagtcggtgaagcaggctaagtgcaaaggccagggcccgcagccccacggttcccagcgaaggccccactgagtgtccgcccagcgctggggcagtctgccccaggtgtcctgacaggtggctgacgtcccacgtgcaggatcacgggggcagaaccaggccggaggacgggcttgggccagctcatctgaggtggccggccaggctggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacaggacagccaagacagaggcggcattgacttcaggatggccgaggcctggctgcgctgggcgcagcccccggcaggtggtaacgccaggacacgtgattaatgagaacctgcagctgaacaagattccctcgtggtctgaggctccctgaagtctgagaagctccacccagggccagctgtgtccggagacggcaggaaaacgctcaaggcgctggtgggccgggactggggggcacggagcccccttgtgccacccagagagcaggacctgcagacaaggttaaccgaagggcctgcagcacagacgtgcccgagacaccaggaggccaagccagcaccctgtctgcggcattttctgcagggggtgcgggtgtaagccccagggcctccccatttatcttaaggcaaggtcagccagtgccaaagcaaggcagaaagacctgctatccgtggctgagacttcgggggcctcagcggcttagagcagcaaggtaggcatcctcaatctgctgaataccggactgccccgcaccctgctcctgctgacacctgtgggtctcacccacgactgccccgcaccctgctcctgctgacacctgtgggtctcacccacgactgccccgcaccctcctcctgttaacacctgtgggtctcacccacgactgccctgcaccctcctcctgttaacacctatgggtctcacccacagcctggggcatgaaacaggtgaggccacagttgggggctggtatctgtcgtgttattagtcaactgtgggcgctgcccctgcttctgcccgttccccattcccggggccccagcaccatcgtcagacggagagatccacccagggccacggccacgcggactctgtggaaggtgacggataaatgacttctacagcgatcacatgccaaatacggcacaaacctctgctgatcctcttgccgccggctccttttacagagaggcagagaggttcagaggtgctgaggtcctgcccaacatctcagggcagtggcgcctgggctctaaccggcccctggtgctccaggcaggagtggagcagtccccctctgctgggcctgtggggagtggtggggggaggaagcagccagtaaacagccacaggcctcgcggcacctgctgtcccctccgcacagccgctgacctccctcgcacagggcgccctgctcctcctggccacccgcctgtccggaggctgatggctgggcacacgtgtggccacagctgtgggggccatcaacaccgcctggctgcagggccggtggccagtccctggtgacaaccaaagaaggtgaatgtggcagggtgttcctgtggtgggggtgttcccggctgggggggggggcgttcctgggggggcattcctggggggggcgttcctggtgggggcagcccttccagaccaggctgcccttgggccagcgtgggttgggcatgcccagaagggagcaggcagggatgtggccgagagcttcaaacgccaggctggctcgggggacacaggtccaggacactggggatgccccctgtttggactttccaaagccctcccatggaggcggctacatttgagccacgagacttgaataaaacagaagtggatgcagagagccccactggggagctggtgccgggcgctggacgggcgctcgtaggatggacggacatgccacatttcctaaggtggagagggtggccaggagaccgctgggccgtcatgccacggcgcaaggagtcaccacagccgtcacccaacaagggctcatggccaccacctgcgtgctcacggccaccacctgcgtgctcgtgacactctggatcccgaagctagagcagacagtgccctgccggcgccctgagcagtcggggacttcatgtggttccctttgggcagaacaggaggctgtccctttacttcagaggcctggacagaggctcactgcaggaagatccttctcggtgctctgcagatatcgacgactcattgcatcctcaccgagaccctctgcggctgatgctgccatcagcccattttactaggacggaccaggctcggagagatgaagtcatctacccaaggtcacaccgcgagtgtgctgcgggccgggatcggaaccacgacctggtgttgcccccacagggccaggactcggcaggactccaaagtctccgcttgtcatcaacacgcttgcctccttttaggcctcaaggtacttgcaaagaggcagcaggtctgggattcaaacctgaggccgaacggaggctgcaggggcaggaggccccgtgcctgaggaacaccctgggagctggtggtgtcctcccctccgttctccaggccccaccccgggttgtgcgggggcagctgtgcaggagatgggacctttccgggccccaccccggattgtgcgggggcagctgtgcaggtgatgggacctcacgggtgtctgttgaatcctgtgtgagtgctcctggctgtgtggcctagggagagcctcttcccctctctgagcctcactttccttcctctgtacatgtggaggaagccaggtgacaggaagatgacgcggagttccccacgccctgccttggcaagcaaggaaaccaggccaaggctcatggagcaacgtgtggccgggacctgctcctggcgctgcccctggcacagactctacccgagaaagcagaaagtgacaaggaccctcagagaagatgaggggtgagtgtggaaaggtagaggaacagcatttgtggccaagagaacagcctaggagttggccaggacctgtggagggacctgggaaggaggggggtgggggagtgggcagcggggagtctggagctctgcacagcagcagctggcgccgtctctggggcgggcacatcgtctctctcctgcttaatacccttcagcagcttccactgtacatggggcttcaccagcccacacccactccatgacacccatctccctgctctcccccagtgcggggctcagggccatgcacgaccccccaccgcccctcgttccctctgggattcagcttcaacctcacttccccaggagaggctgccccgcccccgtgaagctcttccatccttccctgttcagtcctcaggatgtcaccccacactgggcggtcctgcctcttgtttgacctgtttgcagggtctctgtgcttgactgggccccccaggatgcagctcgcccagggtagccttcaaaggaaggcccccagaggaaatgcctctttgggttcccccagcccccgcttaggggctggaggagagcaaagatggaagtggggtgagtggagcgccatgatcagggcgggcctgaggggaggtggggctgaaggaggggcggggctgaaggaggggcggggctggaggggcggggctgaaggaggggcgggactggaggggcggggctgaaggacggtggggatgagggggcggggctgagagctagtctgcggcaggtgggaggggctgggctgcccagctgcaggacaggtgctttctgcagacatggggggctggttgctcagggcaggagacccatggctgccctggacacccatttccttggcgctggctgggcagggaggcaccgtgggtccaccccacagccacagcaggaggctgagtcctgccggcctggcttcctcgggcaagccacagcctctctgtccatttccttgcctcttcaaaggggatggagatgaggccgtgcgcagcaggggggtccagcactctccgccatcactcgaaatggtggctattattatcctcctctatccctgcacccccaagcagtgtggggagtctctggagctcccaccggcccacagctccaccaaggccaactgcaggctcctctccaggctaagacaccgctagacaggggcagcctcgtccttcctaggtgcctggcttcccaccccattcccctttgaggccctgcacctcggccacaggccatttctactccgcagacccacttcgaggctcggaggccccgtgggctaccagcccacggctgcgaaccacacaggaagaggcctggccgcatcccctcgtccccaagaccacttgctgaccctgctccccgctccagccgcaagacggccccgtccagacacacggaggtgaataagtcatcaaaccacttggaaaaataaaatcgcacagagcttcacagtagacaccagtgtcctggtgcaatggccctgaggcaaccccgggggctcagcagcgccagaaaggggaccgtctctgtctcaaggcagaatagagaagtggcaggaagggctaatgtcacggaggaacctggtgccccaggcctattctcagcaccgtctacccgctgccccatgaggcgggccctgtcactacgcccactttctagacggggaaactgaggcccagagagggtgagtgacttgttctgggtctcagagcccagaagcaccagggcatgtgcctgcagcccccaggagattaaacggtcccgatgccagccagcctggaccctgactcagccttgctgggacagcccaggcatccagccccacgctgggacacgcggccctgtgggtgtcacataggccgaagggacgctggctcgtactggaggctggggtgggtggcccgtcaccatacagggtctggggtagcacctggggtggccggctctgaggcatgagcggaaggaccatctttcaaaccccaaggggttttctttccagagctcgaagtgcccatgaaagagaaacgaggcctccagcatccctgaactctacatcagctgcaaggggaccccggtccccgaggacacccacatgtattttcaaacagctcccgaggcccagcgctgcccgtgcagaagaaagcatggaatttggggagggctcccgaggcctggccgcccagcacaagggggtccctggggcacctgctgtccccaccctggctatcctcctgtggcctacacaagtatcctaacccctccctggctcagaacagcactgaggtcctcctgctggggtgggtggggtcagtctgggtcccagtcccttccctatggccctggctcagaggcaggtgggcagcgggtgcggaatctgacgagaagggctctgacgcccggaggggaggaatctcatacagaggaccaactctgtcctcacggattcttccgcggccctgagatcctgcgcttctctatcttacgagtggggaaacagaggcacagagaggctgaggagggggagagccaggtgtggatccaggtgacctggcccagctaccccttccccactggccacagagggcacctgcagcctgggaaccccgaggggaggcacctgccctcctggcctccctctgtggcttgggcctctgccaagtgtccttctcactccccctgcccatgactgacggtggcatcttctaattgtcccctcaccccagagcaggggctttgcctgtccttcccaccctcgatggctcaggcactggctctggacacagtgcgcccctctctgggcatgcctgagtctgccctgatgttgggtttccctctatgcggttttccccaaagggtctgggcatgcaggaactggtcagatgtctaaaggaagaggacagggagagagtgccagttcctcccccagccctggctgcagcctcatctgcctcccaagctcccactcatcaagaaagttcccagacctgccagacgtggtgactcacacctgtcatcccagcactttgggaggccaaggtaggcaaaccacttgaggtcaggagttcaggatcagcctggccaacatggtgaaaccccgtctctactaaaaatgcaaaaattagccgagcgtagtggtgcgtgcctataatcccagctacttaggaggctgaggccggagaattacttcagcctggaaggcagaggttgccatgagccgaattcgtgccaccgcactccagcctggacaacggagcgagactctgtttcaaaaaaaaaaaaaaggaaaagaaaaagaaaattcccagaccctggaggccgctccccggggcccatgggagaggccgtttctttcccagacggcacatccagttcccagcaaaatgtcactaacgggccgggagaggaagccgctttgcaggttgggcagagccagtgggaaagagcctgcaatgtgccggggccgctcatccatcacttccccgtccgtgggggcacccagcccgccctgcccagctgggaaacagccacagcccagggctcccagcctgggagttccagaactctccatggaaggaggacccatggacaccagtgcaagagctcatctttccggccttccccgcctcgtaccctcgccagctctggagtaacaagccctgcttccgctgtaaccttctttgacccctcacaaaagccttggggcataggacgctgggcaggtaacgcaggtgacctgtcttgaggcctttgcacaggcaacatagccacggtgatgacgtcctactgcgtgccaggcctgacctgagcattttgtgcagaacacctcatttcgtgcccccgaaagtctagaggctgtcaggtggggaaactgaggcacgggccctgggcacctggctctggatccgatcctctccgtgggtttggaatatgctcccggggagcggggggcaccggctctgcccttcctggagctgaccacaggccccaggcaggggaggaggagggcatggcctgcaaccaacccgagggctccaggcctctcctgttactccagccgaaccctcatcccaggatgccccaaagtccagcctcagaggcccagcaaggcctcttgcaaagccttttctggggctgtggtgcaggcagggctcggagatgctcaggacaggtccaggacgggctctggacccagaacagtgctgtgcctcagttggcccctccataaaagtgcagaattaaggggatgagctcaggctccgggccctgcaacctgggtgggcagcctcagtgtccacatctgtgcaatgggggtgagggttgacatgaatgcacgcgtggcagtcactggcaaatcccaggcaaccccagcggcggctgggacggaggacaccactacatcccgggtgaccccgacggcagctgggacggaggacgccactgcaacccgggtgaccatgacggcagctgggacagaagacgccactgcaacccgggtgaccatcacggcggctgggacggaggacgccactgctttaaacagctgtttattttccttcagaatcacacggtcccacagcttcctctgggaaaggcacagatgtgcaaagaggagaccccgagagtcatccgtccacggccgccctcccgcctcctcacagccccggagatggacgaccccgcacccacgctgcccctgagaggtgaggtcatctgaggtcactggccacggccgtgcagtgagtgaggggctgagccaggaatggagccccagcctctgaactccagcctctacttggccgggcagccgtccagtgcagtaaacccaggccaaggtaaacccgtacacttggatttctggggaaccagagggacgagccaccctccaacacatttcccaagagctgtccacggcggctcccacggcggctccccagctgcttggccagtgccacagtggcccggctgttcctcgcttggtgcctggctgtcccctctggcctcaccagctgtcccctctggcctaaccacacgcactaccccacacccgcctgtgctgtgcctcggtcactcgccgcacttgccccagggcctttgcatggcggtgtttctgcagggaatgcacttccaccaggtccccgcaagtctgcctctcatcctcacacctttgctgcaggctgcctccttcccggtgatgctgcagcccgcgcggcccttcaccctggctcccctcctgtcaccggctctccctgtagctctgctggtgagcccacccgcctgtcctgctccttctcttctcttgtggatgctccccgtgagctccaggagggctgggcttcctctacagcctacaacagtgccggccacactgcaggcattcagcaaacacttgctgcgtggtgactgagaaaacctggaaaggcacagcccactgaggaccggacactcccagcctcagtgtcctccggagccaccgtcatctgaaggcgtggggacaggcagtgccctcccacctcaggaagagctgtggggtgagctgcggatggcgtgagcagtgcagggcggccctcgcagcggggtctctgtgccactctctggtgcccctgaggggcatgtgaaacagaggagaacctggtgctgactccgggaagggccctgagaaggtctttgaccagcatcagacctggggctcccaggccaagatagaggcaaagtgaagggacgtggggccccttcttggcaggctctaggacagtgggtgtccccccaaatcccctcgtatccagatgaccaggaggcggctccctcccctgcccccagcccccagcctccagggctgtgccaagtgtggggatctggggtgggcagaggcggcctgagagcctcaggcgctgccctgcggccgcctccacatctggcttgtatccagccttcctgcctggcgaataagcagccatataaacacggggagcagtgccttctctgccatcggtctaggcagaccctcccgcccccacagggacaaggagccaagtcctatttctctcccaggcccttccaggtcctcatgggcctgacccagggcggacccttcctctggccccactcactcactcctgctgcccttcccgccgtggacaggaacaagggaccctgaccccaaggcctgtgggtgatgacgatggacggcacggggttgccatggcaacagagcggggccaggtggcaggaaacccagttcgcctcccgcgccgctgtgtgaactgactgtgaactcggggtgggggccgtccccaaatgtgtatgagtctctggctccccttgggtaagatgcagtgcctctttgggtggggtcacagcaaacaaaaaggctttcgtaaactcaaaagccctctgtggccctgccacggggacgtcatctctggcgatctgaaggacaggggcagggagggaacgggaacctcaggcgccctctccctgcaggaacggagttggcttttccgtctcctaatctggcctcagttttctcatctgtaaaatgggaatggggatggaattcccgcagaatcacggagggacgaagtacatgagctcacgaaaagcgtctagaacagagcgcctggccgctcgccctggccacccagctgtcatgcttcgggctatctgtccggccacaacggccgcgtggagctggtgcaggtggggcttgtctttggcactgtgcccagagctggcccataggtgacactgagcatcagtgttggggaaggggacccatcggagagcctctggggcacagtgaagaccccccctcctgcctcgcagctgtgtgggggaagctctgttgcccagagttggctggcagggcccagactgcccaccggctgccatcaccaacacgaacaggtacccagggcatgccttcagccggcctgggtgcagaggtcccgtctgtcacagaagtgctgctgaaccgtagcagacgaaaatctcacaaactccctccgggccccggcccagggcttcccgttggaaggtgcacaggccggcctctgcctgcaggctgggcccacccgcgcctccccaacccactacgtggctccaggcggacctggccttgcctcttcctttcccaaggagagaagaaagcctccctcatgggtttttgaggaccaagaaggctctctggatagctgcaccctgcaagtgaacccagggctcgccaaagaaatgcggaagatgggacaaagtgtgctgtgcgtcctggggccagatggggacagatgggctgggggtctctccgtcagtcttggccagccacgccagctgtgcttctgtccctcccgttggcctcagggccttggctcctactggaatacttccctcgatctctgcatagccgtctcctcatcattcaggtcttggcgcaaatgtccctcctcagagaagccttccctgaccgcccatgtccctgcccccacgctctctgccccatcacccatttttcttctccagccactcgtcaatgtctgaagcctccgtctgtgttggtcctcgtgtttacgcccgtctcccccagggcagggccctgaacagcacctggcacacggcagggccccgtaaaggtttgctgactggcgcataaggacaaagccccctatctgcctcccctggcagccctgtcctctgcaggttcaacggggcggctcgctgctgcaggacagagcctgggctgggcttgaatcgaggcctgtcccctctgccgtgtgagcccagcaggcagctcccctcatccattaagtgggaggaacacacctcccgggggtgcgtctgaggaataaggagctaattgagtctgtcctgcagcaggaggccagggaatgccggtcatggctattcagggccctctcccccaaggcgcgtttcctgctaatggcctcgatttcccaccctgccaaagcccctgccctttcgatgggattgcagctcttccagtgcagaggcggggtccacttccctgccccctggatctgggctggccgggggacttgctttggctgggggcaggatgtggcacaagggatgtcagatgaccctgagcctggacgtcagcggcgggcagccccactagccctctgtggagcccccacgtgaacacgcccaagatgagacacacgcaggacagggttggcccggccacttggtggagctggactgaccgtggctgaccacggaccagccagcaaacccagccacgcccagaagaaccacccccctgagcttgccaaaactgccaacctaaagaactgtgagccaaagaagggtggttgctttgagccactgtttgagggtagcttgttacatggcgatagctgactgatacactttggtacttagaatctcaacatatcagagctgcaagggacctgagagacaatcaaatttcacagctggtgagagggaggctgggaagctggagaagagaagtgacccatcttgtctctagccgaaccaggcctcagatgccaatgctgcacttgccctccgctactccacacctcattcctccgtgggggggtctcagccgggaccagcaattccaccttcaggaatgcattctcaggacatgtgcacaaacagtgatctacaaggatgtttgtcacagcatcgtttatgagaatgacaaacggaataaatacgatgactcctcagagagggctgggtagataaattatctactcgacacaaaactaaggaacctgaaaatcacaccgtggccaccttcattttggaaagctgtttgttggtatctgctgactggaacagtcacagctgctggaatagccggctcactcctgggcacagaacctgcagaagagccaacccacagacacaggtgcctccagagcaacaagccacagctgcaccggccacttcctcagcaagcgtgcaccgaggtagagggacacgaggctgcagcacggccatacaatggaatacaatacagcaaggaaaaaggacaggcccaccaagtacaacactgcacacggtctcacaaatgtacagcactgcaagcggtctctcacaaacgcggtggccaggccccgcagagcatgggatgcgagagtccgtttctagaaaattcagaatcaggcagcaacactctgtgatgctagaggtcaggaatggtggccaccctgacagcgcagtgaccagagggggatcggaggccttggggacaggtcggaaaacgtttgtcaggcccatagccgtgtgcacgtgatgctttgtggtgcacacttctgtgtgcagtgctgcgagcatacatttaattgcaaaaatgatgtcacgggacgctctctattgacatcccctatgagtgaacatcaacaaggcgacaaagcatgaggttctattttggaaataaaaacacgcacagaaagacgactagaccaaaaatgtgatcgtggttgccgggcaggacgctgtcgcagccatcacagtcttgccatgtttttaaagcgaccagggtgagtctgggcctgtcctctggcttaagcccagagcccctagccatcaaaggtgccatcaaaggtgccctgaccctctgccctgcaccctgtggacagtgcccagggcctggtcttctacagcaccctgccggttgagcaaagcctggaaaggctgggggagagtggtgagctcagaggctggagtgaaaaatcttccctgctccccaaagggccgcaaatgggacccagatgtctggggcctgcttgccccgtggccgcacacaaaggaagcacattccttgcccagctgctagagctgcgctgccaacagcaactccctgagcgccctgggggaggtggccccacaatctgggccgcccgctgccggggcggggtgggggtgggggtgtggctgccagccgggggcaggggtggagggaggaaggggcgctgtccttacccagcactggccctggcaccctgggagtcctgggggtagcgggtcccttctcttgtctccatgcccccaagccaccaagggaggcagccgaattgcagacaagcaagcttccgttgaggatccgtgtgctgggggtgccgccaggtggtggcgtgggtgtggggtggggaggaggcgtgggtgtggggtggggaggagatggggctggggggcctatgggtgggtcgcggggtggggaaactggtgggtggtggcctcctgctctgggtctgcctatctgagtgaattctccagtctgatctcaactcagaggagggacagctccttcaggagctccacaagcagcatggaggggggagcgtggaggggggagcgtggacgggggcagcgtggaggagtggaacgtggaggaggggagagtggagggggcagcatggacgggggcagcatggacggggagagcgtggacggggggagtgtggagggggagcgtggagggggagcgtggacagggggagagtggacgggggagcgtggacggggggagcgtggaggggggagcgtagaggggagcgtggaggggggagtgtggaggaggagcgtggagggggagcgtggacgggggagtgtggagggggagcgtcgacgggggagcgtggacggggggagcgtggagggggagcgtggaagggggagcgtggggggggagtgttaagggggaagtgcagagaacgagcagacacgtgggctagacacagggtgggcgggcgccctggtgggctgtgtggctggtcacctcagtcagaatctcgccctctctgggccactccctgccaccttcccctctcaggagcgtcacggtgccctctatccattaggcatgtgtgcgtgtgagtgtgcatgcatgagtgtacgtgggtgcatgggtctgtattcatgtgtgtccatgggtgcctgtgtgcatgggtgtgtgtccgtgtgtatatgtgtgcactcgtgtacacatgggtgtatgtgtgcatgtgtattcatgcatgtgtgtattcatgtgtgtgcatgggtgtgtgtccgtgtatgtgtgcactcacgtgtacatgtgggtgtgtgtgcatgtgtattcatgcgtgtattcatgtgtgcgcatgggtgtgtgtccgtgtacatgcacttacatatacatgtgggtgtgtgtattcatgtgtgtattcatgcgtgtgcatggctgtgtctgtgtatatgcacttacatatacatgtgggtgtatgcgtgtgtattcatgcgtgtattcatgtgtgtgcatgggtgtgtgtccgtgtatatgcacttacacatacatgggggtgtatgtattcatatgcgtattcatgcgtgtgcatggctgtgtccgtgtgtgtgtgcactcacgtgcacatgtgggtgtatgtgtgcgtgtgtattcctgtgtgtattcgtggggtgggtgttgcgtgtgcatgttgtctggtaagggctgtgtgacctcagggatggctgcagaacactccggcctgagtgaaaggtggtctgatctgcagacagagcttctctggaaggaagaagggcggcccctggggagaggtgggtgggctgggtggggaagggggatggggggctcctttgccttccctccttgcctcccagccctttattgtatgccacatccttgttttatttttaaaaatgcctcttggccactggcacaggcccctccttgctacagcccctgggggtgaaggcgagactgctaggtggagtggccaacagagaggaggtcaggctggctgtcatattggttactagacaggcgtggaggggccaacagaggggagggcagggtctcgaacgttgtatcagttactagacgggcgcagaagcacggattcttttagaaaaagagggctgcttaggaggctgaggcaggagattcgcttgaaccagggaggtgggggttgtagtgggctgagatcccaccactgcactccagcctaggtgacaccgtgactctgtctcaaaaaaaaaaaaaaggaaaaaaagaaaaaagaaaaaggaaaaaagagaagaactggtggaatctgagatcatcggctgtcggctgaccccaggcccgggctgcaggagttagctggccctgccctctgcacagccacatgcctggacttaggtgtggagcagaaagtcccacagacaaccccagacacaagcggagcggagaaccttccaggaagaggctgcacctggttctgaaggctgcggaactggcaccgtgggagaaaggtgccaccgtgggaggggagggcctgccccggggagggcacagaggctgggatgctggggacaggcaggtcacacagccctgggaacgggaccctcccacgtgcagggcctgcagggaaggctcagctgtctgcggagggtctggaaacccctggaaacctgaggcctctgttaggattttccaccaatgaggcgccaggggaggctacaccggttcccaaagtgtcgtcgctgtttaaaaaaatgtgtgaattggctgcaaatcaccttgaactctgcagagggcggctgccaagtttaaagtcagccactgccggtgtggacgctaaggaataattagggtctggcggctcatggtgcccctgcgtcaagtcaagaatgttttccctgaagtgccagaatgttcccccagcaacccccagcagtgtcataagtgtgacatgtgatgtgcgcacgtatgacacacacatgcagacgagagtgtgcgtgaagacgagagtgtgggtgtggacgacagagtgggtgcggaggagagcgtgggtgcggacgagagtgtggggtcacaatcccctctgtccctccggggtgcgtggagggaccccaggagacggtgcaggcgaaacccacaaatcctagcagcccagacaggactttagaggtggcctccctggagtggaggagtggacagcctgggctggctttgccctggggcttcccgccacgtcctgtgagctggcatggccaggctgtgcaggaagtggcccccatggagagacagcgtggcctccctggtgctgactgcaggaagcccctgggaccccaggaccctgggccggggatgcctgtggcttttctttctcacccccacccaaatgcaaacacgcgcacaaatggccttttgcttctcagttttttgacactgaggcaccaagctgggccctccctgatccctgcaggccgggggtgaagggaggcctgggagaagaccccaccatggcctgggccctgtcctcttgccctggcatcagaaggggccctgatccccctgccttcgcagtgtgggctgtggctgcccctgggaccagctgcatcacaacgaggtcccagcccacagccgtggggaggccttcgccactctcacctcctggacagggtggggctcccgcccctccagagcccacacggttactggcacaggccctgagctccaagcgtgcggcccaccaacctcctcaaaatttgtggctgttgctggttttatgttgtgagccccacacaggaggctgggtggcctccaatgcctccaggagggagggctgagcagagctatgcccaggccagagcccccagcccagaacattctgtcttcttgccctaagaacttttgaaatgtcccagaagttccatggcaggtcacccacatggcccagcccggcctcccacggcagggggtgccgagaaccttggagccacacggcctccagggttggtgctgagagaggtcggagctgcaggctcgccgggttatcagtgtaaaaaagtagaggttccccttcaaagatactttcctccccgtctaattaggaataaacagtaacttctcttagaagcaaaatttattcaaagacctgtgctgacattcttaaatatctgctagccttaataaagaaatcaatgtactttatgttcttagctcccacaatttagcctaagtatctgccctggcatgtttatactggtcgaagcaagcattaggtcacggcctgttcctcttccttatttgaaggtgtttttacctttctcagcattccacaaattacttcctccttcctttgttctcctctgcctttgcctcttttaaaaagttctaagttgcgagccaatcgggacaaatacagaatgtgaggtcccgttccagccaatggaaaccggacacagcagtaggtataaaaaaaccggacacagcgtcaggttataaatgaccctggtctccttcattcggtgtactctcgtggcaaaactgctggcgagtgtaccctttctgcagaaagtaaatatggccttgctgagagaattaaatttacgttcaagtgctatttctttgcagcaccagggaacaagcactctatttctaaataaacattcctaacatcagcgtggcctcaggcgctgtccctaccgcccggtattcactcagccttacgggtaagaagctcagtgcccatggccatgatcacaagggcaaaacccactcctcgaattctccaaactgcacgcatggtgcagggcaagcgcgggtgttccctcccacccagagcagcctctccgcggagtccccgggcgggaccccagttacttctgagcacgtgcagtctggtgcatgtttactctaaaaagaaagacaaggatggtgcctacaagaggaactgttggaaagtcagtgtcgctccacgtaatccgtggacactgtttcaatgcaggtctggaggccgcatcagaccccgccccacactgcaactcctgggcctcggttccttcatctgcacaaaggggccaatgatagcgtctccctggagagttaccttgggaagcagcatgagaattgatgagaattaaagcgatttacaagtgcaggcatacagcaagtgctcaattagtgccagtctgtaaaccagcagcttcccgagcactctgctcaaggattcaacccgctccctggggtgggcgttcctgcctccctccttccccagatagtgaaagggtcaggcggtgtgcgcccgaggcctgccgtcctcccacaccagggactcgcaagtcagctgaccagtgaagcttgtgcaacggtggaatgttctaggcccatgcactgacagtcgctggagccccaactggctgccaagtacttgaaaggaagccctatgaggggagaactgaattttacattttatcttctttttttgagatggagtctcgctctgtcacccaggctgaagtgcagaggcatgatctcgcctcactgcaacctctgcctctcaggttcaagtgattcttgtgcctcagcctcccgagtagctgaggttacaggtgcccaccaccatacccggccaattttttttttttttttttttaaatagagactgggtttcaccatgttggccaggctggtctcgaactcctgacctcaagtgatccgcccacctcggcttctcaaagtgctgggattacaggcggaagccaccacccctggccaggaatatttcatcttaattaattcaaactccaacggccacaggtggtgcatggtgacggagtggcaggaggccccaccacgcaatgccaaaggcaccaaaagtgcaggtggacaagggcggcctctgcctccccgtggggcagccacacctgcctgctcctggattctgccaggaggactgggtccccagcccctccctgccctgcctgcttgccagccccagctgggtggtcttcctccagccaggcccacctgaggctgcctcccgccctcctggaggccaagcccctcgccagggggctacattaaacagcagggccaaactcactggggaggcatcttggagagcagcgggacgggtgtctccacaacctggaacaacacatcctttctctgagtttaaagaaaacaggctgctctggaggcaaaccttttaaacagatgtttcctcttggcggaacctccctgctccgcccccaccctgggccttcccccaggcaaggcctgcccggctctcacagggcggaggcctggggcaagggagaccaagtgatttcaattctttctaggaaaggggaggaaaatatttttaaaaatgtgttttacaagcctgcctctgccattgttgatgtaaacaggtaaattgtttcctgcctcaattaaaaacatctgccacataaatgaataccaattaactcatcctgtttttaattactctgttaattacacgcaggcagcagaaaggatgggcggggggagcagggaagccgagccgatcctccgtgccacgccgccccaccccagcttggcaggatcggaaatgtgtctggctggtgacggatggggtggcagggaggtggtggcacgtggccagccgggatttcccgatccagggcggcgagtgggcccctcttcccgggatctccctgggtggggtccagcccctgcccctctcctgccctccctctctgtctgcagccccctgctcacttcttgggccacattttgctgggggagggagggggggcggttggggggaggcctggattttgtccaggaagttctgccttaaggctggggtggtaggaggataagagtcaccctaaacaggacccctgggaattaggatcctgtcagctgccatttcctgagccgtacatccgcggtgccgggggacttgcggctgcagctccctcatttgaagttgcttcctcggcggcacctgggacgccccccatatgcgccatagccttcgtggtaatgacacagtttctcgttcgcttgcttcattaaatgtctacctggggaatggggacgcctcaccccgtctcacccagacctctctgcgcggcgcattttgactcccagttcacacgtgtcaaagctgaggcccacacaagcaactgcctgtccagggttaaatcactgggacaggccagggtgagccgtgagcccagggctctgatttcagggctggtgtcgatgccaccaaacgtgtcgtggccaggacatcccgggagctgggttcaatggctgaggctggcctgcgccacactttgggtgggggtacttccggtctaagggcatctgagggtcttcacccaagagggtaccccatgcctccctggaaaacagcccccacagaaactgttctcaccctaggtttctgcagtctaaggatgcggagatggccagacctggctgggctctcagagccggtctagccagagtaaaagtcctgtccagcagcagggcctaggatcctccccgggaagactgctgctgccttagcaggattgagggggccgagggcttcggtgcactcaccatgtctgccccgggcaccagcgtgggcgcagtgggaaggggctgtatgggcctggagcattagatcctgtctgccctttgcagcacagaggaggcaggacctgagtcccagggcctggccatgctgatgcccggggcagacattctgcaagcagtctgcctctcctatcccacgccagggctatgcttgaggccttcccgagggcggggtcaagaatgcaccaatgcccgggacagcagccaacccacgcctgttcctgggcaaatcccgcctacaggccgggtcccagcttgcagccgtcggagggtggtggacggccccttcctggaatcccatcccgacctcggagacggtgacaccactgttcccgtggcacaggctttgcccctgcgtggtttcacatggccaacaaaatactaactcatttaacctcggcagcacccccacccaggaggctgttctgttatataatcacgatgaaaacataaacctctcactcttcccaccgtacagatggggcagcaaaggcccagagaggaaggaactgctcaaggtgcacagcggacggacagagctgggacccgaccagctctacacggctctttacaggcccccagcgccctcacctagcgcaccccagctgcctgctcccaccaggtccctccaaataccccacgtctccccaattcgccaaatgtggagggagagacgcgggggagtttgtgatgtgctgagatggcacagcaggttggcgagctgggagcacagctttggggtttgaagtcagcgtccactggtgtgggcgagtcccctggccttgctgggcctcagcgttctccctgtgaaacgggggggacccgcaccccctcctcatcgcacagaggaggtgaggattcggcgcttctgcccactgccccctgcctgcctccttttccaggcaggccaccaggctgagctgctagttgccttgaggtttcctgagctgccagggacttgcacagagacctcaagctgagtgggggcctctcagacctttggccacccatgttacccgccacatccactgccaccagaagggctgtttgtttggggcctttgagacaatttcagcaacaaatgcacttcctgctgtgtgagctggggagcaactgagccgtgagggggcagctggggagcagctgggttgtgaaggggctgcaggctctgcacagcccagtcctggcgcgcagcacagctcggggagggaggccaagctgcgcatcctccgcaacccggctcacacatgtcgctcctgctgtcagggtgggaaggctccgacatggaggtcggctttggaactcgggctctgggctcctgggctggacaccggcaccgtctaggttggggaggctctgggaaagaccagaatgccgaacccacccccgaggaccgtcctctctcaaaggtggggccgggggaggagcccagtcaaaggtgagaggccaggctcactggccaggactttggagcatagatcaccacagtgcaaggaccacgaagaccctgggatctcatgctgagggtgcacagcccggcaagggtgcacagcgacccagccatggttacagcaaagaccgcgggtggaggtgggggcgtggtcaggcaaggtcacagcaacccagccagggctaaagcaaggagccagggtgggagggccgcgcctgctgggctaaagcaaggacccctgcggtggggcggggcaggtggtggtcatgtctaccctggaggggctacacctgctgggctgagtcccagtgagcctgagtgaagatctgccctctctgggccccgccttccttgctattccctgggagctgcaacggctgtgctgacgtggggcacactgcgtgccttcaggaccgctccagtcgccctgcacaagctccgccctggccctgcctccctggggccgccgaccacaaggaggctagactctgctgagacaaaaggagagggacccggggtccaggaaggtggggaacgaggctctcgggggcgatggctgggatggccttggagacgggtccagcaatgggcagacacaggccagggggagaagagcgggcggagggcccagtggtggctgcgggggccaccagggcagctctcggtgctgtgtcgtggggcctcgaagcagctggaagcagggagtggcccctgcaaggcagcacaggacaagccttgtggctcccagaggcagagccccatggccgggagcatgaggtcactctcgtcagacagcctctgctgcccagatgcagatggtctcacccattgccccagctggccggacgcggcggggacagccaggcactgggggccaagcaggtgcaggaaaccacctgttgaatttagacccaatcaggggctgtgaaggcgagtcctgcccacagcttcgggctgatggaggccgctgccaccgcctcccacctcactgagtgctctctccaccaaggccacagagccacactccccgccaccacgtgtgggtgcagacagtgaaaactgagggacggccctgaagaaattacaagccaccggtcaccgtggccaagcccagggcttgctgtgtctgcgaggggtctcagctctgcaccagcccaagggggaagcagtggagagagagggacccgcccggaatcacacagcaacggcctcgtcctggacaccgagctcgctgaccctggggcagcaggccatgtccgcagtgggcagagggccgggttccagccctgcccggattggtcctctcccagcccccggccttgggaaggtgccaggcaggcagatgggccgggcttgggcacggtgcagccgcagccgtggtggcagctgctcgggggagacccacaaggggcctgctctgctgctccctcctgagcggtgccttccgggtaccctgactcatccaccaggcgctctcatgcagcctccaggagatctgcagggggccagggggtggtgctgctgagtcaaaacagcccccagggaatattctgcaggggagggaggcccttcctgtgccaggcagccagagacctgctccgagtgccctgcgctgctctcatcccagcagaaggacgactctgagggtggcaggcgggacaggcagtcactttgcagtggcagacacaggctcagagaggctccaggcctgcctgaggccacctggatgactctgaatgctgcttctccctccagggcaccagggtaaccggaggcttctagtttcttcaggggccgtccctcagccttcactgtctgcccgactgcccgccgggagcccctgcgtgtgtggagatggcaatgtgctttcccgggggctcagagctgctcctgctccccggcgacgggcttttccaggctgcggcatagggagccccggtaccaaggacatgggtggcactgcggagtcggtgccatcctctctacgccagacgccatgtgaacgtttttacgatgatttttaaaagagaggctgagaaggaccaggaccagaaagacacggctgtcctgtctcccacaggctgcagcctcgaactggcaccatctcttctgccccctggaaggtcagctccgtgagacgggggaggcccccgtgaattgtgcagggagcacttggtgggcgctgggcggtctcacgttccccacctgtgaaagggggttaatcccactgtgatggggccagtgagcgaattcccaggagggcagagcagagccgcagccgggggtacaactggcttctggggccgggctgccgcctccaagagcctaaccttgttcccagaggcgaggagtgaatctgggttccgtgcagggagttccagcacctaaaaggtgtgacaaattcctcctccaatgtccagctggacaaacctcctcaatccaccactgaaggccccccaagcgctccgagggacctggcgtgctatgggctggggggcgtctgtcccagcctcgtctccaaaatgtcggtgtctgctcagccctgtgctgtggttttcaggggtcgaggctgagcgacctctctttctatctctcctgctcggggccagtcaccaggccggagtctcagggctgtgacacagaggtttgtcatgcgtcacaccaggtggccctgggtcagccaacgagctttgtgtcaggacagcgtgggtgagcgctgcccccactgcatggctgcagggaggcccgagggcaggatcttcccaagggacaagctggccatggtcccgtgcgtgccagggtggggcctgctgagcctcagtttcctcggctgtaagacgggacggaggtgttcacagtgggggttgctgggaattcctcctctggattgggctggtgcctcggtgcaccgtgggctcccaggagctcacaaggccttccgtgcctgtcccttgtgccccacctcacagcgaggtccttgcagcagcagggcagccccgtccggcccccgctgcctccctgccctcatctcctttctctgagacaaggctcctcactggtcctggaggtggcggcacactcctgcctcgggcctggcacgcgtggtccttccctcctcccgcagctaagttccacgtccctttaccagagaagccagtgtcaacccccacggcccttggtggggcaacatcatcgctgctcccttccttcactctgtctctgccagacggagcagcagccccgggcgtacagcaggcaccaatcactatttgtcgagggaatgaacgggcaccgcctaacgagttgggtcagatggaggcgtggctcagagatgtcagcgtcaaggccaggtcgacgtgacaagccgggtcccgccctgccctcgggtgcatggacttccccaggcagcactgatgcccccgctgaggtgaggccgctgggccccatctgtggggagaggcagctggaaactgggggccccagatcctcctcgagccagatcctgaccccagacccagcctgttttctgggtgtctgaatcctgccggggtggaggaggggctggggaagaggtgggtccacctgttctcctccagggacctccctgcaacccttcatgaggtcagagctgggcatccagggagacagcgaccctggccatgggggccacgccacccaggtaccagcctggcatgcagcctgcaggtgataatctccgggctgctctggggctaggctgcagctgtaggggggttcagctgtcacagagggagccggggaagccagcactgcctgggatgatcccccttccgcctcctcctccccaggccccggaggcccagctggccgtccgcccgtgcggacacccgggagccaacactgacccgaagacaggtcagccagacttcccacctgctccctcaggaggtgggatccggtcccctcctgctgggctgcacgggccacgatggaaaggcgcctcgtgacacgctgcggtcagctcagaaaagccgcagatgctgacacgggcaaccctgcccagtgtggggcgtcctctgaagtgggagccgcagggagggcctcacggaggcctctgtccacaggcagcggctcccggcacccaccgctgctgaccgagcccctggcacccccaagccgagcctttgaaccccagcagggaaggccacctggccgagaccctggccaccacggggccatcactgtcccacggggctctgttccgactccttggcccgagggtctctgagcaccaccagggttgcctcacgcctctgagtttggggtggtttgttcggcagcactggggcccggggcagcttcttgcccggcgtgtggcacagctgtccttgttgggggcgtttctgggatcctgtggtttcggggacgctcccctactccctggccttgggggccgatgaccaggtggagcgggcccggtctgtgagggagtcacaacgccaggtcactccaagctgcctctgtggccacacgtccagctgcccccacacaggcgagacccatgatcaagccccagggctggaaagcagacacaggggatgtatttgtttgtggaatcaaatacgacggcagcttgcaggcagcccagccgctgtgcaaacaaccctcttccagcacccagtgagggcgtccctgaagcagccggcgaccccgggcgctgtcacccgccaggtggggtatggggaccgtccctcaggcaagacagggtgcctgtgtactgagcgcctcgtgtgtcaggtgcaggtgcagacaggcaaaagtcctgccccacggagctgacctcggacgggagcccaggaacactgtgcaaacgtacgagaccgaggctgggaggtgtggtggttgggagaggcacgggtgggtgactggatggccactgaaaaggtgccatctgagcaaggcctgaaggagggcagctgggagccacgcaggcgtcggggggagcattccaggcactggggccagcagcgcaaaggccctgaactgcagccaggcacggtgggccagcagcaaggcggagcagagtgggtggtggaagggaggggagtttgtgtggtcttggaggccccacgaggacctcggctccgttcctggagagctgtgactggcctttaatgggttccatctggctgccgagtgcaaaatagacctgggatgggggtcaggggtagaagcaaagaaaccaggtacagaatctggcacaagtcacgcggtcagagagcaggtgctggagagatcccataactgtttgtggaatcaaacaggacagcagcttgcaggcagtctggctgccgctgtgcaaacaacccagggcgcccctgaaccagcccgtgacctcaggcaaacggcatccatcaccggggccggcacaccatcgcctgtgagaggcgtggtgagggctgctcccacgggcctgcgggaggacccggtgacagcaaggccaagccccctgcccaccaggacagtggcttttcttgataatttatcccttgaaaccccgtggacaattaaacccagagttaccaggtgagccagggattctactcctaggaatccaaccaagagaaatgaagacattcatccacacaaaagctaccgatacccacagctgcatggtccacgcaaaagctaccaatacccacatctgcatcacccacgcaaaagtcaccaatacccacatctgcatcatccacgcaaaaactaccaatacccacagctgcgtggtccacgcaaaaactaccaatacccacagctgcgtggtccacgcaaaaactaccaatacccacagctgcgtggtccacgcaaaagctaccaatacccacagctgcatggtccacgcaaaagctaccaatacccacagctgcatggtccacacaaaagctaccaatacccacagctgcatcatccacgcaaaagctacccatgcccacagctgcatcatccacgcaaaagtcaccaatacccacagctgcatcgtccacgcaaaagctaccaatacccacagctgcatggtccacgtaaaagctaccaatacccagagccgcatggtccacgcaaaagctaccaatacccacagctgcatcatccacgcaaaagtcaccaatacccacagctgcatcgtccacgcaaaagctaccaatacccacagctgcatggtccacgtaaaagctaccaatacccagagctgcatggtccacgtaaaagctaccaatacccacagctgcatggtccacgcaaaagctaccaatacccacagctgcatcatccacgcaaaagtcaccaatacccacagctgcatcgtccacgcaaaagctacccatgcccacagctgcgtggtccacgcaaaagctaccaatacccacagctgcatggtccacgcaaaagctaccaatacccacagctgcatcgtccacgcaaaagctacccatgcccacagctgcatcgtccacgcaaaagctacccatgcccacagctgcatggtccaccataacaacaatgggggcaacaacccacgcgtccatcaacggacacacaaaacgtggtctttctgcacagtgcagtgcagctcagccacagggaaggaggctccccactaggctccagtgcggggagccacgaaggccccgagctgacaaagccagacacaagggccacacgtggccccgtcaccttcatccgcggtgtccagaacaggcaagttcacagagatgcaggagcgggggcagactgagggctgggggtggaggagcgaggagatggggagggggcagactgggggctgggggtggaggagcgaggagatgggggagggggcagactgggggctgggggtggaggagcgaggagatgggggagggggcagactgggggctggggtggaggagtgaggagatggggaggggcagactgtgggctgggggtggaggagtgagtggcagtgggagtggggtttcctttccgggtgatgagcacgtgtgggagcgagctggcggggggcgtggcgttgcattgtgagtgcactaagtgctactgaagtgacactataactccacgatgcttaaaatgataaacgttatgtgtattttcccacaattaaaaaaacagcggggagactgagacaggcagctcatgacctattaacctgcccctgccagggacccatccacgttgctaacagcccaggagtgatgagtggagccaggctgcctcttccctgagtttgggcaccttaaatgtgagaggggctcagcctccctcccaggggccctgctcctgtcaactggggccaacttgcaggcaggtagcggaggcactgctgtgactccagccctggctctgtgagcctggctgtgctggaaaccaggagggtggaggccaggcccagaaggctgctggctggagtgagtgggagctgagcgaccttcttgctgcaaacaacccccttccagagacacaagcacacccttaagggtgggaagcgctcacaaggaccggtctgtggcaagtgacaagtgacctttccaacccgaaggtctcctcggcagaagccccttcatgtgccaaggacgagccagaggtggagaagggccgtgggccggccccgtggacgagccagaggtggagaagggccgtgggccggccccgtggatgagccagaggtggagaagggccgtgggccggccccgtggacgagccagaggtggagaagggccgtgggctggccccatggtgcagagtgagcaggtgctgggggcactggcctgcagctcaggcctctgcttgtccctctggtcaccccagtcctggggcagcatggtccctgggtctgggcaggtttggttggatgcaggtgctgtggtccccagtgagccctggtgtcacggctcacgctttataaaagctctcaaggggtcacagtgcagaggggatggggaggagggtttggggagggtaagcacttcgccggggcacttatcatttgtggaacattctctgaggctggctgtggggatcccctgtgagtctggacagccaggtcataggtcatgcttcctcctggcccggttttcacaccgtggtaccccacacgcatgcacacgtgtgcacaccatcacacactcagactttacacacatgcacctgcacgtgcgcccctggcaacggcacccgacgcagtgaccttggggctgctgtcgtcgggaagacagcctgccaggtggcccctcacacggcccctgcttccccctcacacggcccccgcttccccctcacacggcccccgcttccccctcacatggcccccgcttccccctcacacggcccccacttccccatcccggaaaacaggcagagcacacacttccaggaaagaggccgccctggcgctggactcaatgaccataaaacagcctcttaagctgggtgcagcggctcacgcctacaatcccagcactttgggaggctgaggtgggaggatcgtttgagcccaggagcttgagacagcctgggcgatgtagcaagaccccatctctaccaaaaaaattaaaaattaaaaaaacaattagctgggcatagtggtgaacacccatagtcccagctactctgtaggctgaagggggaggatcgcttgagcctaggaggttaaggcagcagtgagccatgatcgcaccactgcattccagcctgagcgatagagggagaccccgactataagtaaagggaaaaaagaggcagggcgcggtggttcacgcctgtcatcccagcactttgggaggctgaggcaggtggatcacctgaggtcaggagttcgagaccagcctggccaacatggcaaacccgtctctactaaaaatacaaaaaaaaaaaaaaaaaaaaaaaaaaaaaaagccgggtgcagtggtgtgtggctgtaatcccagctactcaggaggctgacgcaggagaatcacttgaacccgggaagcagaggttgctgtgagctgagattgcgccactgcactccagcctgggcgacagagtgagattgtgtctgggggaaaaaaagaaagaaagaaaagaaaaatggcctcttgggccaggtcctgggagctcgagggaggtgacggcatggagccaggacccggagacgtcacttctgatggaagtccgcacgcccagagacaggccaggccctcagtgtgcaagtcaccagccttctctcctttccagacaggctttgccctgtggccccggccctgcctggtgcacctcccgtttgcctcactggtcaactcctgggggctgttttgcgctcccccagtgcagggtcccagactgcacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcgtccccacagccatagtggccacttcatgccacgcgtatgtgacttggtgaaatccccgtccctctgctctgtgcagtacagcagccgcaagcacaagaccggcacgaggaggacagaggcgagaccccagtgagccaagctgcacgctgcccccgggagagctgaaaaaaaaatacctcagtcgcttaaaaatcagtgcatgtcgaaaataatgagttttggacacactgggttaagtaagattatatattataaacattaattttgcccggtctcttcttccctttttcaacgtggccacgagacagtctgaaatgatccacgccccttccctggcatgccgaagctcccttgggagaggccgcccctcggcacacggaggcaccggcgagaagggctgccccacgcccctcggcacacggaggcaccggcgagaagggctgccccatgcccctcggcacatggaggcacgggcgagaagggctgccccacagtggctgctcaggtcacaggaggggccgacttgggcccataggggaggctccatgcacgttcccgaacactctgctcccaggtcccctgttggatgctttgggcttctgggcatgaaaagtgctggaccctgaaggagcagctcggccgcagaggcacggtggggacacagcagccagcagggccacacagagagggtctcagccacacacctggccggcacggccggcaccatcggggggcgacaggcgaggctccatcttccctgtgcacagtgtgtggtgctgaccaacccccgcaagggacagatggggacacggaggcccagaggagcggagaggagtctggcctcgctgcctgcctattcttgctgttggcagggcctggtaaaggaggcagagatgccacgaaagaggcacgaagggccgtgccctgccctcttccacccccgaagttcagaaggacgcattctttttttctcggagacggagtctcgctctgtcgcccaggctggagtgcagtggcgcgatctcggctcactgcaagctctgcctcccgggttcacgctattctcctgcctcagcctccccagtagctgggactacaggcgcccgccaccacgcccggctaattttttgtattttttagtagagacggggtttcaccgtgttagccaggatggtctcgatctcctgacctcgtgatccacccgccttggcctcccaaagtgctgggattacaggcgtaagccaccgtgcctggccagaaggacgcattctttaagggagctgaaggccacgtggtggagctgcaagcctccatcaggcacagggatacgtggagtccagcacccaaggcccctgttctgtccacttgggcacagccacggcccagagacccaacgctgcccccggtcaggggcagtcctgggttctgatgtctctggcgcaggagaggctgcatggaagggccccatgtccactgcgctctgagtacaggctgggctggactaggctgtggagccctggtgtggtggccaaggcaaggggaggggcccggcaatccccaggcctggtgagagccccccaccacctgcgtggggaccctggtggtgcagaaatacctaggctctggagggcccaagtcaggtggcctcggctcccaagtgggaattctgcctctgacagggagtaactagagtacaactgatcttaccctcagtttcccctctgtaaatgggtctgcaggtggcgtggtgcacccgggggcccagggcttggccccaagcttgcaggctgtcctcgcgtgggtggagcaggcacagggcctggggtctgggctgtgccagagtctgaccatcgaggtggtctctctggaccaccccattttgcaaaggtgcagacaatgaacttctgttcgggggcctgcagagaagggggcctgggtgcagagctgcatcatgccgcatccaccactgagcctcaggacaccaccgggtgtccccccagaaaagggacgaggctgatggtcccagtccagacacacacatcccagctcatcacagcccgaaggggtaaatgcctttgtgactgcattttgcgtttgagacccgagggacagatgggaatatgtggtgtaggtcacgcagctgctgggaggggagtcgaatccaggtgggggctccaagaaaccgaggggctgcccatccccctccccgctgcctccgggaacagggcagggggctgcagtcacccctggccctcgtggggagcccctccccacctgtaagagggtctcactgcagctggagctgcttcccctgctggcttgatggcaccctggctttcccgggtactcagggaggtcgggtacactgggcggggacttcctcatgagttccatgtgtgacctggggccaccagggtgcgcaggagccctcctgactgccccgggcatttcctgggcgtctcccaggtatctcccatcctggtctccggcaggtcccacctgctgcctccccggtgtggactttcctctgctgagtaaacagaagactgccccggtgcctggacttcctccccaaacctcctcctgccacgtccaccatgaccccagcctcaggggcagccaagcatccaccacgaccccagcctcaggggcagccgagtatccaccacgaccccagcctcaggggcagccgagtatccaccacgaccccagcctcaggggcagccgagtatccaccacgacctcagcctcaggggcagccgaggaggctctgagctgcccagacccgacggggcagaaccggccctgggtggctaagcgggcgggaaacgcagaggcaggcggccgacagcagtgcggggtgagctgccggctgggctgctggtgccttggctccgggagacatcttccttattacggccaaattcatctttgttttccttcccagtgacatctggctctcagtgaggtcccacgaattacaaaaagcagaagtctgaacttctgttttattgccacaggaaactcattgccacagcacaggcggaaagccggatcccggcgggtcctgagtccccagctcccaccctcggggcaagctgcgagctcagaagtggggactggggagcagttatctctcactctcctcatcgtcagtttccagcccaactgccaggtctccgcctgagtcttttccactgatgctacaagggcggtttccactccaggaattttttttccagacaagcaaagcccttgcctgcatttgctctcggctaaggcggccctcccaggcctgcccggtgggctgtttcccgcagcacggcctgggctccgctgaaaggaaggtcccggcctacggaagcgcagaagcagaaccaggccttctcactctgcccaggaaagtcaggaggtggagaataaaacccccaggaaaggatctggggtgtcgttcactgacgcaggctttcccagagagactgagccacgaggtggacgaacagcgtggtgtccacccaacctggccctgacaccagggatggtgacgctgtcgtgagcctccctctgagctgccctcaagcggcctgcacctccctagccagtaccccagcagttgtgtttccacccctctcctgcccctgcgaggcagcgggtcccagcccacagtgtgcactggactctgcacactcccggcccactccctgccgtccccacgctggccctcccgtgtcagaactcagtgggaagttccaggggcctgaccaccctggatgtgtcacagacagagccccgtggtacccacccgcgtcgggctcctgcgctgtgagctaggaacttctgtgggcctcggcttcccggtctggaaagtggggcagcagcggtgccctcagggctggctgccgtgaggatccaatgcagggcctgggtgcctctcactgcatgtgactctgcccccgcctggtatggagtaggtgttcgatcaatacttgcccagggaatgagcactggaggacaggcactttttgtcctgtaagtgaagtggtggcaaagccaccctccggcattgacaaattgtagagtttaggtcctttccgtccccaggggcctggggccagcctgggaggtgacatcggttgcctggacgtggatttctatgaacactggatgccatgtctgtgataatagccgggcaatgttccagtggcttctggagggtctttagcaacaacgacctccctcccctgcacagcagggcaggaagcagaggtggggctggccagaggtgcagacctagagcagccgggatgaggctggccttggggctccatgacccaggcagggcagaggtcaagttctcccacccgtgccctgaccccagatgggccccagggcctgtatccaggtgagggcttttgcacctacagtgctaaccccgagtcatgaccgagccctcagccaccagatcccccagtcccttgggggtgctcaggtgctctaagaatgtggcccggcaggctggggatggggaccgacagcacaggcaaaggaacgcccgggcagggctggacagggactgggcggggctggacaggggcctggagacactcgctgcggcccgccgtcagactggctccctgcatgacctgtggagtgactgtacctctcccggcgtcggagacggggaacgctccacggccctcgtgggtgttacagggacgcgacagtgcgtgtaagccccagcgctgttgtaggctctaagacccacccaggaaggctccacgaccctgtgagcaggagacacaggccacaggcaggcagtgcagcaagtgcgggccgggagagcagccccatggagacgccagcgccttcacctgtggcaccaataacaaggccctgctagtccctccatgctgggtctgaacacccgcgtggcacacacggcactggggcacgctgaagttgcttctggttcctccctgccagggaaggaaattcagagccacttaattcaagcaccatccttccaccctggcactgtgggaggctgaggatgaatcagaaaaccccaaagtcaacctgctaacggtgcagcagggaaggggggaggccagcggagagccccaagatggttccagaagctggcagggaaatgcctcacccacctcacaccctccctgccaccccagaggcggcagcggcgaggcccggccctccccactgcagccctgagggctgggatcttggggattagtgacccagcctgctggcagcatctccagatcctcgcgtagggagaaaaattaatttcttccagtcatgcagaaatgaaaatacgtggagccaaaccagagagatttcctggaggtggtaactgaattacgcagatagcgggcggcaggggaagagctcaggggggctcgggcggctggtgtgtggcttcgtagccccagagggttctggaaggcgatgtctggggaaagccctcccactcaccagccctggcttcacaggtggtgacagcacggccccagcaccacgaaccactcatgtgaacttcccttctcccctgtcactagaggatcccagcacatcccaggagagatggagcctgccggaagactgatcctgatgcgacactctcttccctccctgagccccaatctcgggtggaggccacatctgttcctcctgctctgggcgcttcttcctttctgtttccctttcagtgtggaagagtggccgcttgcccagcaggacggtcccaaatagcatggcttttccaggcacggtgctgtcggccgcacagaacaggaccctcccggcagctccggcttgcacagcatccgcctgtctggcccctgtggaagtatctgactcccaacgcccagactggagcgggggcaaaggacacagcccgaccccagaggcacacagagccagccctccacggaagaacgtgcccaggaactgtgggctgggccttcctgcctcctcccctgccgcgaaagcgatgccaggggcaggtgagggtcggacgcgctcaggcccagccctcgccccttcaggtctgggggacacagtggagtcccagcctcaagaagtttccccaacctctcagaaacttgaagggcaatgccaggtaccgaaaaaccggcccccgccccttatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttcaagggaaaggtttttcttcctgggccctggaatgggcctgaagtcagccggcctcagcccacagggtgaatgaggggtgggcacagcccggccgcggccccagcacacacgggcggacgcaggggcgggggagcgccagccccgcagtgtgttcggagcccagcggctctgagtcgccgccaccagcctggccgccttctgctccacgtaagtgaagtcagccgtctagggctgcgtttccagccatctgtccctccacagaggctcacacctccctccccgctgttcccacagcctggctcggggcctgcccaacacagatggacgcttcccaaaggctgtgcgcgccatcgctgccacccggctgtgccgaggcccgcggccgtcaggaccccagggaccgcatgccaggcagggtccaggacccccagcgcggaccacctttagcctgcggggcagcgccggggacccgggcaggagggagaggagcaggagggagctctggacccccctccccagaccggccgccgccacctctgcctctcccagggccgccctcggcctccccactcccgggtctccgtcacgcgggccgcggggcctttgttaggaaaaccgggcggccccaggggagcccgcgagactcccagcgcccgggcgcgtcgttcccctcgaagtttcgccgcagcccccgcaggtcaggctctgctcacggggggctgcgctcagcccggatgggtgggcgctgggcgggttggctccaccctgccgtgggcaccaactttgaaaacggcccgtgcgctcggcgcggctgcggcgcagatccgggaacggcagccgcgggcggagtcggggtagagcggcggcggcgcgcggggcggacacggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgccccgcgcgctccgcctccgcctcctgccccccgccgccgccgctgcgccacctgcctcccgcccggcgcccatggcgctcagctccgccccggggcgccggcctggagaggggctccccgccgccgagagccgcccccaacgcctccgccaccggggcggcgccctaagaactggccgtgggggccggggctgtgcggagcgccgggagcagggagaggggagaggggcgcggggagggggcgacgggcgcgccgcctcctgcggggggcggcgcggggaggcgcaggcgggggcgagcgaagaggttgaggggtgcgggcgccgtggagggggcgcggctctggggggcggcccccgcctgcgcccaccctctccccctccgcaggccgcgcacacccacctcgcagcagtcggcggccgcgggcctcgcagctttagaaccgcggcttctggcggccgcgcgggaggctgaacgggagttggggggtgtggggggggtggggaggtggggagttgggggggaggtcgctccttcggccgccgcccccgccccctgccccgcgctcgcccccagcgcggcgcctggcccggcccggggccacctccgtgcgtggccggcaggggtcgcgctccccccgctcagcctcccgggcgggtccgatgcgaagccctcgcttcccgcgggtcccggggccaggtcatttgcatacactttgcattcatttgcatatcgtgcgtttcatgtccacctgcagaaacgccccgagccgctgctctgccctctccgcactttctctgccggcaggccccctcccccgcccgctttgcctttccctaaagtactttgtggcgtgtctggcgcatttgcctgcttagtacattttagtaaaattggcgccttttccctgtttcctgccccaacgcacacgtgctcttactttagacacaagcggctggggggcccaggggtcaccattaggagacacaagaggccagaccttcagagcagcagggccttggtttgcctctcatttcgcataaattttgcatgtgaaggtccgaggtccccaatccccaatataaaaatatggcaacgtgcgaaacatggcccattccagctttgtgccgcgggccttttccccccacccctcgtccctctcatggacttggctctacccacctgagctggcagaggaaggggacggaaacccagaacgggggctccgtgagggggaggacagcaccatgtcctcctgcagcccctgggcagcggtctggtcagctgggtcactaaccgcagtgtggcccagccagttcctccagctcctggctgtgggaagtgctgtctgaagccagccagactccgtgaaaattgtgacacaaacgccaagcaccttcattctcctggttttcagactgtgcgtaacatggtgcttgcccatgtggctcagcccagtccttgtggaatggaggttttcagactgtgcgtaacatggtgcttgcccatgtggctcagcccagtccttgtggaatggagggggagttctgagcccaccccacagtacagtgcgagtccccatgcggtgggtgtgttgcctaaggttaccgattttatgctcgaaatttatccatcctggctccctggcttcatggactctgaggcacagtggattttaagatgcaccattattttgtgtgccactaagaaaggaaaacattctgccggtgataatcctaaaacgcccccaggtttcagagattttacaaagcaacataaacgtgggagtgggggcaggtgggagaattcagcagcgaaccaccctgaagtcagtcgggttgtgagctaaacaatgcctgcggcagctgtggctgcccacagggcctgggagcagaagctggcctggacctgggccggaagccctcacccagcaccagcggcacgtccgtggtctcggttctctggaccgcaggcttcgggtgttaagtgaccagttgcaacatctctgacttacacagggtgctcacaaccatttgaggagtgacagacctgaaggcactgaagataccactgcagccatcagacaccacaacccaggcgctgcacctgccccaccgcagcccctcctccctactcaggagagctgtggtggcgtggtagagaagaaagggatatcgcaggcaggagggcttcctttagtgctgtgagtgggtcagcctgacgcctagcccagcggtcacagggtggtcagatggtcctggcagtagctggcacagagctgggcaccgtctctgcatttccccccgtgctgtgcggatgctcccggaacgcccattttacaggtggagaggctgagcctctcagccacaccgacttcctgctgccttatccaagaactggtttcttgccctggatgcggccaagtcacagctcctgggcatttcgaggggacatttaaggaggagactaccagccctatgtgaaagatgtctgcagtctgtccgacaaggccagcgtcacctgtgcgggagacagaccacgggcgagcaggacctcggagggccacactcagggctcgggagggggcagagccgtggaggagggagctcgagggtgtgcccatggagctcccagtgtgtcgctgtctgtagaggcaggagctcaattcacttaaaagaaaccaccacggccgggtgcggtgggtcacgcctgtagtcccagcactttgggaggccgaggccggcggatcatgaggtcaggagatcaagaccgtcctggctaacacagtgaaaccctgtctctactaaaaatacaaaaaattagccgggcgtggttgcaggtgcctgtagtcccagctactcgggaggctgaggcaggagaatggcctgaacccgggaggcagagcttgcagtgagccgagatcacgccactgcactccagcctgggtgacagagcgagactccatctcaaaaaaaaaaaaaaaaaaaaaaaggaaaccacctcccctcctcatggcatggcagcgtttccaagtaaagttgactccccatcagcatctggtgccccgatcacacacccatggaagccctgggagaccgtgcctggctctagggcccgcggcgcacagcggggcagccccagctttgctgacctgtgctgggtgtgcctctgaggccccaccctgctgccctcaggaaaacaactgcagccttctgtcctgccaactgcacttctggccatcctgatccccctccccaaagggcagcacccacatctgatttccctctcaaccacccaacagtgcccagctcaaggtttggataaagacgcagtttataaacacttgccacaggcgtccctgcactgtcacctccccgcagtcatggccccttcttctgataccaggtaagactcgctgtctgtggggccctggccaaagggcaggcgctaggccctctcatgtgccctccgtgaccctaggaggtaggtcttgccaccagccttgtttgccagaggagaacaccgggacccagaaagcttgagtaatctcagaacacaggctggtctttggcagagctggagtcctgccaggccagcgtggtccagcgggaggccaggccatcactgttgctgaccttcagaaaatagttctgagcactatagactctcaaacattttctgttataactaaaactctgcaacaaaagtttagatagctgccaagaatagaaagtctgatacactataggtatagatatttaaaaataagcgggtggctaatggattctagataccatagcaatttgatagccactgtcgttcattaaaaatatctgaataaactcgtcttaaacacctgcattttcactcagctccctacctagaacagtgagtttttaaatataacaccaaaagcatgatgcatacaataaaaatttggcaggttggatttcattaaaatttcatacttcggctctgcaaaagacactatgaagagaatgaaaagacaggccatagactgggagaaaatatttgggaaacacatatctgatgaacaactgttatctaaaatatacaaagaactcttaaaaccaaaccataagaaaacaaacagccccattaaaaatgagcaaaagatctgaatagacacctcatcagagaagagatctagaagatgatctggcaaataagcacaggaaacgatgcccagcagccttgccactagagagtgggtcagcacagccacgagaggccacgacacgcctgttagaataactaaaactcaacacacggacaaccccagatgccggtgaggatgtgaggcaacaggagctgtcattcattgccgacgggaatgcaaaatggtacagccctttggaagacagtttgactgtttcttatgaaactacacacttttaccacgccacccagcattcacgtttcttggtatttacccaaatgagttaaaaactaatgtccacacaaaaccctgcacattaatgttgatagaagtttcattcgtttttaccaaaacttagaagcgactgagaccgccttcaacaggtgaatacataaaatactgtggcatatgtagacgatagagtgttatccatgacaaaagtagtgagctatcaagccatggaaagtgaacattgatggccgggcgtggtggctcacacctgtaatcccaggactttgggaggccgaagggggcggatcacctgaggtcaggagttcgagaccagcctggccaacatggcaaaacctcgtctctactaaaaatacaaaaattagctgggcgtggtggcggtgcctgtaatcccagctacttgggaggctgagacaggagaattgcttgaacccaggaggcagaggttgtagtggcagtgagccaagatcatgccactgcactccaccctgggcaacagagcaacactccatctcaaaaagaaaaaaaaaagtgaatattgctaagaagtcaatctgaaaaggctatatactgtctgattccaactcaatagcattcaggaaaatgtaaaatgatggaagtagtaaaaaggtcagtggttttcagggggttatagaatagggaaggttgagtagggagagcagagaggtttgtttgtttttggaggcagagtcttgctcttgtctcccagactggagtgcagtggcatgatcttggctcactgcaacctctgcctcccgggttcaagcaattctcctgcctcagcctcccgagtagctgggattacaggcgcccaccatcacgcccagctaatttttgtatttttagtagagacagggtttcaccatgttggccaggctggtctcgaactcctgacctcatgatctgcccacctcggcctcccacagtgctgggattacagacacgagccactgcttctggctgagtttttttgtttgtttatttttagacagggtctcactctgtctcccaggctggagtgcagtagcgtgatcacagctcactgcatcctttgacctcccaggctcaagcgatcctcccatctcagccccagctaattgtatttattttttgtagagacagggttttgctgtgttgcccagactgcacagaggatttttagggcagtgacactattctgtatgacagtctaatggtagacgcaagtcatatgcttgtctagacacatagaatgtaacaccaagagagaagcccaatgtaaactatggatttcagttaatgaaaaggtgtcagtattggttcatcggttgtaacgaatgtatcacaccagtgccaggtgcaatgtagggaccccccactagggaacaagtcggaaagagtaatgagaactcggcgctttccgcccagttgtcctgtaaacccagaaccacgctaaagaataaaatctattaacttaaaaaattcagcagacaaaaatgaggatatcaatgacattttatttgccgtttaaaagacagatacaaacagactcttctgcagcgcctgaatctctacatggcccttctctcccttaatgcctccttccattctacccagccgatttttatcctaatatgttttcatgtttgaaagtcttttgattcccctatcgtacaaaactaggtacatagttggaatgtcaagatttaaacattttcctatgttaaaatttatttcctgggctggattatcgttataattattggtagtatacaaccgatacaaacaatgtgaatgtattacacattttgagaactaataaggatacaaagtaggctgggcttggtggctcacacctgtaatcccaatgctttgggaggccaaggaagtagtatcgcttgagcccaggagttcaagaccagcctgggcaacatagcaagacctcatctctacaaataataaaaaagttagccgggtgtggtggtgcgtgcctgtagtcccagctactcagggggctgaggcagtgggattgcttgagcccaagaggttaaggctgcagggagctatgatcacgctactgcactctagcctgggtgatggaacgagaccctgtctcaaaaataaaaataaagatacaaagtaaatttttgttggaagacatctcgtaaaaggagggaggggcactttttggtagtagtttgtgtattcatgcatgaataatactgccagaaaaagacaggatttgacattaattccattcccgtggtgggtgtttaatgtgaaagccagagaatcttcagtcccataaataactcgatcagaacgggagctgtgtcctaaccatctcactgtgacctccttctgagagtcagatgccgcaagccacgtggtgattggtcatcaaagtcatttttaataactatcagctgacaaatcggttctgtcccccctcaattctgtttcatgcaaagacaagaaatcagcaggttgcagcagagacacattcgtggcgagtggggagctgggggcaaggcaccaggctggccccaggcagagagacgttggtctttcttggggaactgggagagggtgactgtgcaggggtagctgggaaaaggacccacactggcccaagcaggttctgccttggccgtcagcctgggccgtctggtgtgggcaccagatgacgcggcttcaagttgcccacaaggtcaaggagaccctcccggaggcagggaggaaccctaaagcagagggagtccgggctccggacaggaggcttccctgcctcaggagtgtctcttggctttctcccctgactcacatcggcatcgctgcttttgcagaatgaggttcctaattgtgaagtggcttcattcacgtattcatttctttcttccttcactctccatatccaatagaaagcaagttactgaagcttgccaaacctcagtttttcctgtaaaacggggctaagagctggctggcctacacatttgcaatgtggctcaaagacaagttcagagttctctcttgtctttgttgaagttcacacgagaaccaggccaagcacaaacagttggaaatcggaagtgtcccgtaggaaaagcagccggtgctcgtgtgtaaaagggaatgtggatgggattgaggtggcatttaaaatccctggagaagcacaaactccccagtagatggtgtcaggacaactgccccatgtggggaaaatgaattatatactccttacttcacttggaaaaataaactccacttgggttaaagaataaaatgtgaaaaactggaacagtgaaaggattaggagaaaaaagcagagcaatttatataataccagtttaaaattaaggcagccgagaaactctgaaaaaattttaagaagctggaggggtttggccgtgtaggcatgagcaacttccatgtcctgaaagagacaggggaccccgataagagatgggttgggaggccgggcgcggcgcctcacacctgtaatcccagcacttcgggaggccgaggagggcagatcacttgaggtcagcagttcaaaaccagcctggccaacatggcgaaaccctatctccaccaaaaatacaaaaattagccaggtgtgatggtgtgtgcctgtagtcccagctattcgggaggctgaagcaggagaatcacttgaacccgggaggcggaggttgcagtgagctgaaatcgagtcacctgcactccagcccgggtgacagagcgagactctgtctcaaaaaaaaaaaaaagaaaaagaaagaagatgggctgggagtgggtgtggggacaaacgacagtggccccagcacacaaacattgctacagagaagaacaatacaagcactcaaaataacgctcaacaaacttcatgagtaggcaaatcccacaagaagaaaacaaaagggaccagacacagtagctcacgcctgtaatcccagcactttgggaggccgaggcaggcagaccacttagggtcaggagttcaagaccagcctggccgacatggcgaaaccccgtctctactaaaacacaaaaattagctgggcgtggtggtgggtgcctgtaatcccagctattggggaggctgaggcaggagaatcacttgaacccgggaggcagagttgcaatgagccaaaatggtgccactgcactccagcgtgggtgacagagattctgtctgaaaaaaaagaaaagaaaacgaaggaacgaaaacccccgccactctcgaagtcacacggcttccctgcttctcttcctcatgactggccccctctcctcctctcccgtctctcttcacctctctttatctggatctgtctctgcttgttctgcgtttccctgttctccagggcaggaaccacatcggtctgttcacccctcccctggaccggcaccgccacagagggtcagagtgttggcacctgtcttccaggtctgttcacccgtcccctggaccggcaccgccacagagggtcagagtgttggcacctgtcttccgggtcagttcacccgtcccctggaccggcaccgccacagagggtcagagtgttggcacctgtcttccgggtcagttcacccgtcccctggaccggcaccggcacagagggtcagagtgttggcacctgtcttccggatctgttcacccctcccccggaccggcaccgccacagagggtcaggagtgttggcacctgtcttccgggtcagttcacccgtcccctggaccggcaccgccacagagggtcaggagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccgccacagagggtcagagtgttggcacctgtcttccggatctgttcacccctcgcctggaccggcaccggcacagagggtcagagtgttggcacctgtcttccggatctgttcacccctcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccggcacagagggtcagagtgttggcacctgtcttccgggtctgttcacccgtcccctggactggcaccagcacagagggtcgagtgttggcacctgtcttctgggtctccatccctccctttgtttgttgagtgactgcatgttctcatttccttatcatacaattctttgagaggtatcattagctgcgtcttattttattttcaccttcttttctgttacctgtatgtttgaattttcctataagtatttttgtttcatctttgcttttttaaattaaaaaatcagttttaaaattgcacctgcagtacaaaatcagggtggcgaccgggttgctgccattccctcccctcgggtctgtggcttctcagctccagctcgggtcacagacctgctgccacggccccagggtgggcacagggctagcaggacagtcatgcaggcagccgcggccccagcgattggtccaggaggagggcaggtgaccacacgcggccaatcacaatccttccctgggagtttttgaactggaacaagagaggaaggacctcttctttgatctgcgtgggaggcaagcccagagtggcctggacagccgctgggaagagaaggtgggcagagcggcggagggtgtgctaatggttgggtctgtggggcctgaaaccggtgcccctgcccatcctatagtttggtgcttgagccagcacagtcccaggtgtccctgacgcctccgagctgggtttctgtcactcgcagctgcagcattctggcacagacccttggcccaggacccctgtgcagaggtgggtttgggtctccccggccccagcagccccaggagcctgtgagatctaagccggaagctgctctgggcacctgagtgctgacagcccgagtgatgggaacaggctcgctactatgcagagacagagagactaatttttatcagccagatacctggccaggccccagggtggacaatctccaaaccgcatgcatcccggcactgacaaagccgtctatcattgctggagccaggacacccggggaggctgtgccaggccacggggtgagggagctgcctccctccagtccttctcccgtggggcactgagacggctttcagcaagacaaatgcccaggccacagggtgagggagctgccgccctccaatccttctcccgcggggcaccaaaatggctttcagcaggacaaatgcccaggccatggggtgagggagttgccgccctccagtccttctcccacggggcaccgagacggctttcagcaagacaaatgcggccctgccactccctgaccgagataaagtctcagctcctgagcctggggtgcctgctgctcgcccccatcgcctctctgagctccagcctcacaggcacacaccgctcccctgcccagaacattctgcccacaaactcctcttagcctcaggtccctgctgagtggccattcctgctgggaggcaggaattccctgatctacccttcctgagtctgggagagacgcctcccatacccccatgacagcccatcacaattgttcacggatctctgtgttctccctcaacaaatacttggcggaccccctggagccacagctcaaggcttccttcccccccacccccacaccctggggacagcatgtccaggacccccacgcagggcctgtgtcgagacggcatgtccaggacccccacgcagggcctgtgtcgagacggcatgtccaggacccccacgcagggcctgtgtcgagacggcatgtcccgccatcgggtttgctgctgaatgagcagatgatctaatgagtgaccgtcctcacccacgagaaaaaacacaacctggtctccgtctgccggttagatcggcccccagtcctgctggccccagcgatgacagaggaggaggaatgaggagtgccgtgcctgggctgggccatcgcctctctccctcggctgggtttgtcatgctcagccagacccgctcccggtggagaggccgagggaccctcatttctacgtttgcatccctttcttccagggcctgcggggctgacaggcacacagccagtggtgaaggttcacggaagaacgaaggaaggagtgagcgtggggagagccagccaggctccccatgtccacccagatggtgagctggccctgccctggagacactgtgtccagaggccagcatagccctcaaaacggttcccacagctcccagcggagccctcaaaatggtccccacagctgccgcccactcttgggaccctgagtgtggggaggctggggttgagcagtggggatcaggatctggcaggatcggaatgtagaggcctgggggctcccggctggggacagtgccagcaggagtggccgggacgatgacgaggtgaggtgtctgctcccaggctgtgtgtggcttggatgccaaagcgccttttgctgtattcggcaccctgagacccttatgtctgcctattgaaggcacagtttactcccgggaaaataaacatttgggtttatttcgctgtgactgcaccccctgaatcttaatcatatgtgtctctgggtttcccttaagggggatggctccccttaagatgactttggggctgccatgggccttgtcacctgcattgggctggtgaggacagggacagagatgcccacagagcaggtgggctgtgctcctgccctgggcaaatgagggcaggcggcctctaacagctgacaccatgtcaggacagtggctacctagcaggaagctctttcatctagagtcctggtccttcatgcctgggtgtggtcatggcccctctacagctgccagtcagagaactgcccaggagctcccactcctcctctgaagaccccaaatctcaccactgaccaagatagccctctgaccacagtgggctcccccagccaccacgatggtaccccaactgctatgaaaggtcccctgaccacaacaggcaccctgaccaccatgataggccggccacccatctactctgacagcccccttcccctacagccctgcccaagtctcctgacccacccaagggtcctgaccccacccaaggctcctgaccccagccaaggctcctgacctcacccaaggctcctgaccccacccaagactcctgaccctacccaagactcctgaccccacccaaggctcctgaccccatccaaggctcctgaccccagccaagtgtcctgaccccagccaaggctcctgaccccgcccaaggctcctgacctcagccaaggctcctgactccacccaaggctcctgacctcagccaaggctcctgaccctacccaaggctcctgaccccgcccaaggctcctgacctcagccaaggctcctgactccacccaaggctcctgacctcagccaaggctcctgaccctacccaaggctcctgaccccgcccaaggctcctgacctcagccaaggctcctgaccctacccaaggctcctgaccccacccaaggctcctgacctcagccaagactcctgaccccacccaaggctcctgaccccacccaaggctcctgaccccagccaaggctcctgacctcagccaaggctcctgaccccacccaaggctcctgacctcagccaaggctcctgaccctacccaaggctcctgaccccacccaaggctcctgaccccatccaaggctcctgaccccagccaaggctcctgaccccagccaaggctcctgaccccgcccaaggctcctgacctcagccaaggctcctgactccacccaaggctcctgacctcagccaaggctcctgaccctacccaaggctcctgaccccacccaaggctcctgacctcagccaagactcctgaccccacccaaggctcctgaccccacccaaggctcctgaccccagccaaggctcctgacctcagccaaggctcctgaccccacccaaggctcctgacctcagccaaggctcctgaccctacccaaggctcctgaccccacccaaggctcctgaccccatccaaggctcctgaccccagccaaggctcctgaccccagccaaggctcctgaccccgcccaaggctcctgacctcacccaaggctcctgactccacccaaggctcctgacctcagccaaggctcctgaccctacccaaggctcctgaccccacccaaggctcctgacctcagccaagactcctgaccccacccaaggctcctgaccccacccaaggctcctgaccccagccaaggctcctgaccccacccaaggctcctgaccccacccaaggctcctgaccccagccaaggctcctgaccccacccaaggctcctgaccccacccaaggctcctgaccccacccaaggctcctgaccctacccaaggctcctgaccccacccaaggctcctgacctcacccaaggctcctgaccccacccaaggctcctgaccccacccaaggctcctgacctcagccaaggctcctgaccccacccaaggctcctgaccccacccaaggctcctgacctcagccaaggctcctgaccccacccaaggctcctgacctcacccaaggctcctgacctcacccaaggctcctgaccccacccaaggctcctgaccccagccaagtctcctgaccccgcccaaggctcctgaccccagccaaggctcctgaccccgcccaaggctcctgaccccagccaaggctcctgaccccgcccaaggctcctgaccccagccaaggctcctgaccccacccaaggatcctgaccccacccagggctcccgaccctgcccagggctgccaacccccaggcctgccgagttcctgctccctgaggctttgggaaagactcaaaggctttgggaaagactccatgtcagttgtctgccaggagagccgtggagggcagccgcctggccccagcccgaggccatgtagagcctccagacagaatggccaggaaactgagtcagagcctgtttatcacgcgtgtgacggagggcgaagacctgcatcacgggagaaccccacgcacacggagctcatggcctgtgccagggtgggcgggagaccttcacccacccgccgggtccccgggacacagcgtgtccgcctgctcttccccaggggtctcagggctctctgctctttgagcccaggatgaccctgctcccccaggctcagagcccagcagctcccggagggtggagggtagaggaacgcggagcttctactggcctcacaggcatggccccattcatttagttccacaggtcggggcttcccagcaggggacatggaggcccagaaagcatttgtctagagtcacacaataccgtggcagagggaggcgaggctgggacccataggctctgtctccattaccccaacctgcagctgccccacctggcctggtgtctgttactggtggaccctgctggcggagccctgggagaaagaggcgctccaggcgtgggcggcgggggctggcatctgctcctcggctgctttcctgaccgagtttggaactggaccgcatggcccttgccctccctctgtgccttctccaggtggcgtcacaggggcctgcagcagctgcaccaagcccggcccctggggttctcagctgcctggcaccctccagtccacactgtactttgccagggcctctgaaatgcagaggctgaaccacagaagaagtggctcacccggagactgcggcagcctgaagtcggctgaaccacagaatgagtggctcacccggagactgcggcagcctgaagtcggggccctctacgtctttgtcacgctctctcccggaacaaaaccgcccttgggcttcaggccccagaggttatgcccacgggcagctgcccagcagaaccatcatcacacgagattggttgctcactcctcccccatcgacccactccccggcatcttccctctcaccaaatgctgccggtggttctaacctcacagtctggacagccagctgatggccccagaggttcctggtcagaagtgctgcctttccctgccctcgggacacccccgcccccacggcagatgccactgcctttcagggccagtagcagacatggcagagcactctccgtggggctgtcacctgactcgggataacagtgctactcacacagcacaaacggggtcggagcttgcacagagaccacgatgccccctcagcccagggaggacgacgcaaaggtgatagctagtccctccacccccagacacatccccttgctgacccccacacctgtcctcagtgtacatctgggaagcccagagagggtcagtggctcacctgagacacacagctgtggtgagacaaggttctccatagactgtcagccgagcacagataaactcaaaagcagatgcagtgcacacttattcagacataagaaggaaggcaggtccgacacacgctccagtggggatggacccagaaaacacgggcgagtggaagagctggacacaggatcccgcttacacacaacaccggaaaagacaaatccacagaggcaggaagcagatcagtggtgggcagggcagagggagggaacgggcctgactgcccgtgggcatggggtttcttttgggggaaaatgttctaaaacttgttagcaatgatggttgcacacctctggggctttgctaagtgccactgacttgtgtacttgagatgggtgagttgtaagatgtgtgggttatacctcaacaaggctgctggaaaaccacagtagacccggaacgaaagtacctgtgagctgctcacaatccctcgctcacagagaggccacggaactttgtcagcgcaccagggcagtagcgggatgggtgtcaaggccgtgcacacccacgaggccgtaggaagcctggtcaggctgtcggggcctcagacggcagaaacctatcccgagaggaaagggccctgggcacaggctatggcagaagagcttcgagagcccaaagctcccagggaagctttgagcttcctcaaaaagctattttgagcctaaaatagcttcaagagcccaaagctcccagggagaagttgaggttgatgtggtcacctcgaatggggaactcctccaggaaggaaaggagaagttttatttggggtgggggtgttagagtaatgccaggcggggcggcgggggaagaaggttctggggcggggcgttagagtgacaccaggtcccggtgcagcgctcgtgagtgccccacatccctgggcatcacacgcgtgtcgtctggagcagaagctggtggagaggtgtccttcctatttctcagatggggagactgaggcctgggtgggggcaggtggagaagcacagtcgccgcccagcagcccagcactacctttggagggagacaaactcgctcccccagggccgggggctgggggcctcggtgtggcctttggaaggagatgaacttgctctcccagggctggggcctcagggcctcagcgtagcccaggtctgcgctggctctgggctcttcccgctgcaggtgtgggtcccccgtgggcagctctcacaccacaggcctggctccctaggggtatggtcagagtgggaccctgtaccgcctctgccgcccttttccctttgcctccatggagcgggcctgagttcccagagggctgattcctctctctgccccgacccctggcaaccctgtcagctgctcattcacctaatagacaagtgctgtgtgcccgggctgtgccgcaccaacccagggccaggattcagaggggaacagagaggaagccccatcctcgcgatgccaaggtcccagcagctggaggggcagcgccctgctgattgacgcgctgaatcgtgtgcccccgtccttactggcaggcacgccacatgtgctgtgtgccatgtgttcaggtctggcctgggcctgctgtgtcctggtctcatacacgctacatggacagtcacatgagcagctgctgtggccgcggacgggtggtggggacagggcatgaccctgttgggggagcagaggggtctccttgcgggagagagttgaagtagtcctggcgatgatggtgggctcccaggagaggtggagggaacacgcatgcacgcccagggctggaggcacgtgggtgttcagggcctgtgaggaggcccgggcaccaaggcagcacccagcgcttacagagcctgcaggtcttggacagaggtgcaggcagaggcaggaggtggcatgggtcataccacctgtaaaagccaggcgcagtagagaatgttctagaaataaatgtgatgctgcgattgcctgagagggaacccaggtgcaggagagggaaggtcccggggaaaccctccttttcctcctccttcctcccagcagctgggaaaggcgatggagagaaaacgggagcagggcagagacggtatctgggattacaggaggaaaggtggctcattgtttaaaaagatcattaagcctgtcatcccagcactttgggaggccaaggcaggcagatcacccgaggtcaggagttcgagaccagcctagccaacatggtgaaactccatctctactaaaaatacaaaaattagcaggatgcagtgacgggcgtctgtaatcccagctacttggcaggaggctgaggcacgagaatcacttgaacgcaggagatggaggctgcagtgagccgagattgcaccactgcactccagcctgggtgacagagccagattttccaaaaaataataataataaattaaaataaataaataaatcattaaggttccaaggaaagatgagtctgtttccctcagatgattttcagtagaaaacaggcagagataagacaaagtccttgattcccaggtttgtctgccctcccaggacagcccacgagatgtgagtggtattgaatgactcaggcctacacctgctgggctgggagggcagggcactcttctgcctcaagctctaagttcaatgtggacggcatctgtgaaatgggactgcgtcacctgctctgctgaactcacggggccaggtgccaggtcgacggggttatgggtgcagaggctgtttgaagatagcagagaagatgtgaagaaagaagtttgaaaatcctggtgtgagaaggccctcgggagtgtcacatttgaacactattgatttgtggactggaacctaccggaacgaatccatttgtcatggggcataaacagaagtcggctgagtgaggcctccacaagaatctcaattttccttatgaaaagaggctggcctagtctttgtcctctgccccttcttcctccttcctgcctggaatgcagacatgatgcctggagcaggggcagccactttgcagccaggaaaccataagcaagaggatagtgaagctgaaagagcagaaatgccaggtaccagacagtgtcgttgtggcactggcctgggccacccgcctctgggtttggtcatgtagaaacaaaccttgtttacacccccgttaggttttctgtgatttgcagctgacataatcctattggctacagggatcaaatccatcacagggaggtctgccagattttggagattacagatgcagaatgcctggttaaatttgaatgtcagataaacgataactgatttttagtgcatgtcccaggcaatatttgagatacgcttacgatttaaaaatttgtttatctgaaatttgactttaactgtaatgctattcactgatgaagtcacagaatccagagaggctgtgagacctgtctgaggtctcgctgtgggcaggtggtggatggggctctgccttctgtcttccacggcctctccttgctttgatcctgatctggtgtctctagagctttctaaacctgctgtaacagatctgtaaagaagggggcctgtggatgccgccagagcccgtgagaggtggttcccagacagggggcgcacggggagtgacggaaccttctgtaggaactgacacacagcactggagatttccactgcatagtaaccgacactcacccctgggcattcccaccacatagtgactgaccctcagcactgggcattcccactccatagcaactgaccctcagcgctggacattcccactccatagtaaccgacctcagcgctggacattcccactgcatagtaaccgacagtcagcgctgggcattcccactccatagtaaccgaccctcagcgctggacattcccactccatagtaaccgaccctcagcactgggcattcccactccatagtaaccgacactcagcactgggcattcccactccatagtaaccgacactcagcactgggcattcccactccatagtaaccgacactcagcgctgggcattcccactccatagtaaccgacactcagcgctgggcattcccactccatagtaaccgacactcagcgctgggcattcccactccatagtaaccgacactcagcgctgggcattcccactgcatagtaaccgacactcagcgctgggcattcccactgcatagtaaccgacactcagcgctggacattcccactgcatagtaaccgacagtcagcgctgggcattcccactccatagtaaccgaccctcagtgctgggcattcccactccatagtaaccgacactcagcgctgggcattcccactgcatagtaaccgacactcagcactgggcattcccattccatagtaaccgacactcagcactgggcattcccactccatagtaaccaaccctcagggctggacattcccactccatagtaaccgacactcagcactggacattcccactgcatagtaaccaacactcagcactgggcattcccattccatagtaaccgacactcagcgctgggcattcccactccatagtaaccgaccctcagcactggacattcccactccatagtaactgacactcagcactcggctttcccactccatagtaactgatactcagcactggagatttccactgcatactcgtacttttttacttttacaaaagcatcaattgccaatggatatttattttccacaaataacatgagacgccatgaaccagcctcgaaggtgaatgcacttcccaggctgctgtgtccactgtgtctgctggggtcactgtcctgtgggggacgctgaggcttcctctgtgctcagcaggaaaagcattgtgatccattacccatgcctgtcgtgagtcccgaaggagaggcccagggcccaggccactctgcaccctgagggcacgtggtggggccagatcaccaaagggcacatttgggaggactgaacacagatgccgagtcccctggaccacgtttcggggggagacagccacgtagccggagccagtgccttcccacccagcacctcctgtggtcctcacggtgctcggcccagccacgaacatgggtgtctttagatgtcgcctggtgggaaaacagggggagcaaagcctgctgctgctttctcgtctgtgccccgaaccctggagatgaggggcgctgaccctgcacggcttctgagcaccgacatgaattcccaggtccactcggaagggagctgggcaaccccaccccgcgtgtctgaaaacttccacttgcttgatttccacagggcctccaggagggcacagggcacgccaccccactctgtggtttgcagaggggagataacggaggttgggtccaaagccacatcctcagcacctgagctgcagggacacagtcagtgccaggggccctgggcagatgcgtagctgggcctggcaggatgctgggggtgcttcttcaaatctggagggggagctggaagaagcagacacaggcccagggccggagggagagaaggtgggggcttggacagaggctgtaaggagtttctaccaaagtccagggacagtgggggaaggccaggggtgggcgctcatcttctgccaggggtgggcgctcgtcttctgccaggggtgggcgctcatcttctgccaggggcgggcgctcatcttctgccaggcttttttttttttttaagaatgttaagatcttttaaaaatttgtgataaacagaacataaaatttactattttcaccattttaaagtgcacaattcagtggtatttagtacactgacaacgttctgcaaccagcgcctccacctaactccagagcacatcatcaacctcgcagtgaatcccggccccaggagctgtcactgtcttctccacaccctccccatggtgaccccaaatccactctgtctctgtggatttgttatcgtggacattccataaaatgggaccagaccgtatgcggcctcttggctctttcacttagtgtgatgttctcagagctgaagcaccgcgctgcagtgcgcatcaggaatagattttagcggcgtcatgcctggatttccctgctcagctgacacttcgtgagccaggcacacagcggcccgaggagagccgcattctgtgactcagggttctgcgggatcctggaatgcagggaggctcgggtccgtgcacgtctgaggcaggaggcctggcctggccacacgggcgtgggttcctcatccctctgagcctctgtctcttcgtggtgacttaggggactctgcatctcgcttgcagtgcatcttgagaaagagaagagctctgtctgcagtgaggagaggacagagagctgcccagagctcccagccctgcacctgtgaggtaggtggcacagctctatgggggtctttaaagggccacgcacacaagaccatctgcatacctgggccgatcggcttaaaggaatccatatgtgggtcttcaccttccagattgttctgcaaacacggcttggggtcagctgtgtgctgctcctgcctgctcttcccccaattcatgggttgcctctctctagcatgagtctgatgacagggcttcgacccaccagtgaaaacctggggcaggccccatgccctgcctgcctcctgttcggaaaccacagacccaaaggtgtaaaaaatcacgttgacttctggccctcctggtgttagccaggctgccaagggcccagtggcctcttttgacttttaatttactgctggtgaggcttcagttagggttagggtgcagaaaactgacaagttgcaagctacttgttgttctgaagaaagattgcacttcactaattcccactcgtcaggttccgtgtggctttccttcttcatggggtctttaatgtccctcgtcccctctgaatcacctgggctgcccgactggctccctcatcgcggaataatacacctttcacacatgcttactgtatgtgtgtataagaactatgtttttaagatttgaaaaatatactttgacctttccttcctgcttccttacctttttatcttcccatccatctatccacccaccaacccatctatccatccacccactcatccatccatccacccatccatccaccatctatccatccagtcacccatctattcatccatctatctatccacccacccatccatccactcacccaccatctatccaactgtccatccatccatccatccaccatctatccacttatccatccatccatccatccatccatccatccatccatccatctatccatctatccatccatccacctaccccacccaccatctatttatccatctatccatccatccacccaccacctatgcacttctccatccatccatccatccacccatccatccatctatccacccacccatctatccatccatccatccatccatccatccatccacccacccacccacccacacatccatccatctatatcacaattagaattcaaagtgaggcatttggatcatttaataacatgcttatttgaattaatatctgacaaacatcagtctgggcagattgtttttcagtgaggaccagttctgccctttgtttttaaggcagcatttctataaatcaagtgagctaaatgtgcagattttcataagaccagatgccaaacactggtaacatattaggtatgctagaaaatacagtttttgagactgtttaatcaatgtttagaggctgcaaattggcccatgtggcaccattgccaagggtcctgtgtccagcctttggtttagaaggatacttggtgcgcagcgccagccacaggccccgaatcctgcttctacaacccagggggctaggtccctgcggggcagagagtttgcagaacaggtgtgtgccacggccaacacatgcctcacacactgtatgcagctgttcttctgtgacccagtggtgaggttgcggggtgcagctgtcaccttatttattttaacaacgtcttgtccacagatacctgtcatgtttgaaaacctctctagtggctcctgggccaccattatctgccaaaaacgaagcagcataaggtctgtgtgtggccaggctgggtgaggctgctttgtaagcaatttcatcttataggggaacttggcttgtcaaaaaaaagttttagggagctcgcaaacaaaagcattaaaagcccacagaaccaccggctttgagaatcgggcctggtgcttggcacctgacaggtcctctccactgtgcccggtccctcctctgtgggctgatgtcaggggaggggacgggggcccattcggcagcaggaacagagagaccccacagagcatgggtgcatacagagttccccctgggccactccttggccagggaaagcagacctcgcctcctctcgtagctgcaaggtggggcccctctggacggagtgggctttcccggtttgtgtgggtcgctctgctctgagggtcactctgctcactggcctgcacagtcccaggacttccccgacctgagtcacagcacggcttcctgaaacacatcttggccacattaggccgtctctagggacagactccagagcagccagctaacagggctgccattttaccctggtccttggcaggagtgaggcctgtgccggggtaggggggtggcagcccctgtgagtgcccacagaggagagcagagcgggggatcgcgagtccacagacctcccggcccctctcccacctgtgcagcatggctgggctacctcccctgccacaccctcatcccacctggggtgaccaccaaacccatgtccagacgaggaccaggcccaatcaacctctggcctcccatgaactcagtagtggaagcagtagaagcacccggtgccaggccctgcccagcgcccagcttcccagcctcccttggaggccggccctggtttccacaaacaaggaattcctccaggagcaatggacactcttgacctccagaaccactgcctgccatcaccaacacctgcgctggacagaggcctttctgaacacgagctgggtgggttggggtggggggcgtctccagtgactcccgtgccctggccctgcctggcttgcagagccacccagatggaagtcggatgcagcacgcccactgctgcccctcagagaccaggcgctcatttcccccaggaagccgggatagggcccacacccaccctggactctggaagcccaggatgagaacttcgtatcacactctagtccctgtggccaatgtcttgtgtttgccttggagaaaccatgtgggccccaggggacgagggaaagcatccttgattgaagcattgtttgtagcacgggaaattgacgcactcaacctctctccatagggaagctgagaacagtgcgctggtgtgtgccacccccaacccccaacccccgaggtgccactcggccccgacacgcggcagcaccatgccaccccccagcccccgaggtgccactcggccccgacacgaggcagcgccatgccacccccccagcccccgaggtgccactcggccccgacacgaggcagcaccatgctcaatgcagtcagcctcgcaggtgtcgagagaggaaattgcaaaggaaaatgagaattcgatgccttttctgtaactgtgcgagacacactgcctgggagcgacggggacggggcaggatgcctggggacggctttccacaccctaagtgctgccatgcgtccacctgttcagttttcacagatgtgccggagacggggactgctattgccccatttaccgatgaggaagccgtggtggggtgtggggtggctaagcctctgagctaggtccccccaaccccttgatcccatctcgccgcccccaggtggggtggccttccgggctggggacactggacctacaggaattcctttctataaagaagagggaaggaaggagcaggccggggacggggacggcgtgctgccctgcgtggctcccgcgacctggcttctcctggggggttaaagatcagccacagagcacaggggtgagggtcaggcgcacactgcctgggggctcgtcgcggctcagccctcacactgccccttcctgtccagggcaccggggaactcaggacgccccctgccccggagcagcgcgtccagcgggggtcggcgtgagctgtgtggaggcgcccaccctcccttgcagccagaggtaggaagtagaagggaaagaggagaggtcgctctgtggcctccagaatgtcaccattttcacacatgttcagtttataaacttttaagctttctgcatccttcttttcgcaccatgactaaagtgactgaaattctgtgggttcgacgggtcatggggctgagttgggaccatgtgaccacagggctttgatgaggaaccccccataccgcccatgctggggcccacctggaggaaataggcccagagaggcacgccctggtgagaggccgaataagggtggaccacaggggactgccaggggccctggccgcaggactgcccgtcccagctgtctctggccctggggaggggctcagtagggaggggcgggaagcacctggcagtttcagtttcgccaggaagcggctgcctgctgtctcccttcccacccgccgcccggagagccccccaggtggggacggccccttgcactgcagacgaggaagccccagctgaggggccgcaggacaagcctcacggctcctggcagtggggacagagccaggcccagcctcagctgcgtctcaggaggacctggggtgggagaagcccctgggggccgagagcagatgagggcagatctgactggcatcttctgtcacctgctggtgaccttttagaacacgtggtcccaacccttggtctagaatatgctgccgtgttggaggggcagaagcagctgagacggctgtccgtcccccgcctgtcagtccgtctgtctggggctgggggtgtcaggacaacacccaccactgcaggcccccttgggaataagcggcaagaagcttcggggtccagtttgcaccgagcccctccagcggggacgcctctttcatttctgcaccctgcgcctggcacggaggggtgtgcggtcagcgggtgggggctgattgggtgacttgcagtgacagggtggcgaggccctggacctgagtgccatgtgacccccatggaccataacccctctgagctccagggtctgcagcgctgcaggcctcacacaaatcgggggccaggagcctaagatctgctctctaaatctgggagcccagccagagcaagccctcagcagacccagccccagtgtgcggcctggtgcccccgttttgaggaatcccccatcctctcgtgagcagtcggctgggtcaggctggctccaccggctctgggattcggctgcagcctggcccggatgccgccggggtcaccgccatctggagtgaggggctgcagcggacacggctggagggacggttgcaaggtcccctcccccactctgtccccctcaggtctgtgaagtcgggactttctagacactcaaaacacacctggacttgggagctcaggaggaagctccgggagcccacagggtggggtgaattctccagttccttctctactgggctccctcccggctggtgcctcctggccttggcaggggtgggaggcctggtgtctgcagggccagctgcgggggtcgcaagagcggggccccttgggaaggagtgccaggaagagggtctttcctcaccaaatcccaccccagccttcaggaggggctcgccgccaccccgttttacaaacaggagacaggctggggtcagcgtggccggtggacagcagtttccattcccaccatggtcgggtccagccactgcccctcacagaccagggagccgagggagaggggggcggggccggcctgacgacgcacagacctcagcaccgcccgtggggctgcatcttgcaggctcagggcagcaggccaggcttggctgccagggtgcgagtggcaggtgccggggggcaggtgctggggctcccggtgggccctactagagggcaccgtggacccggtccagttagggtgagcatggcctggggggttgcgatttggcagagcccccgatcttctgcaaggctgtgggttcaccccatccccctccacaggggcctcccaaaatgagccccagaagctgtggctgttggaggcttctgccatgtcttctcaggagggcatgccttctggccccactcctcccagggagaaagccacacttggggccctcaccccaggagtcctcgtctccacaaagggggcgcctggaaaagctgatggaaattcacgtcagtgggaggcaggcctgggggaggggttggcccactctccaaaagctgccagtgaaacggctgctctgcagctgtcctgggccgagagaggatttcactccaggaggcggtggcggcggccccaagccggcagccttgctgtgtgatcagctgggtgtcaggatgtgcttgatccaggggtcggcgacgcgggtgtcaggcagcacctgcgtggggcttcctcaggtgaagcaaggagacggagaggtgggttcggaggggctcagctgagggcgcggctctcgtctcagagcagggcgtgcagtggggtccctctcctgagatgcgacctcagctgccttgcctctgggagggtccctggcagagatgcacagcctgggaggacgtggcccaccccagccccgctgtgtgagctcggctggtttcctgacctttctgatttgtgtcctcatctgaggtcagcgatgcccttgaagtgttgccgggtgaaagccgggaagggattgccgtctgccccttccctccggggccacagggcctgagttcctgggaaaactgtggagccagtccctgcctcagcaccagcaggatgcacacagccaagtaacaactgaaggaccaggagcacggaggcctcgcctcgcctggagatggaatagactcacgccttccagggctcagcaccctcctgggccagcaccgtctgctgagggccctgctgcaagcaggcaccagagcccctgtctcgtgcagccgacgctgggggccgggggatgagtagtacgtaagggggcagctggtttttctcatggggtgacagattgaaggagaggaacaccgagggaaggaggtcggtcgggagggggctcctcggcgagggcatagcacaggcacgggctcgggaggcttgtggagccgccaggcagccggggctgtgagtgccggaggccgacgcggtggggtcgggccgggagggctgggccgtgggtgtgcgcaggtgtgatgtggctgacgtgttttcatcaactcaattttcctttttttttaaagacacggtctccctctgtcatccaggctggagtgcaggggcgcaatcttggctcactgcaacctctgcctcctgggttcacacgattctcccgcctcagcctcccgagtagctgggattacaagcacccactaccacactcagctaatttttgtatatttactagaggcagggttttgccatgttggccagactggtctcggaatcctggcctcaagtgatccgcctgcctcggcctcccaaagtgctaggattacaggcatgagtcacggcacctggccttgatttttcaaatgacatggtgacccagccactctctgcccacctgagagagctgcctggggcctggggtgggcagagctgggagaggaagcccctcggtggggtccccgctgtggacctgtgtcctgggcaactgcccgacaggcctgggagcggccgtcctgggggtggacttgggggttttgtgctgagaacttcattggcgcctgctgcaggccggcctctggctttgtaacagtcgacctgagtgacccagtccacagctcccagctggagttccttcaaagggtgggtgggcggccctcagacaggcctctcttttccctgcttctctccagctgcccctggccgacgtctcctcggaggagcactggccggcgagtcctggctcagctgtgaccaatcggcctctccctgaggccgctcttcctgcctgcgcctccccggtcaactgcagtcacggaagtgaaagtgccggaaaacccctgcccagcgcccaggcaggttaacgggacgcactgcttctcggtccacatgtggtgagaagtgaaagttgtcttcgcctaaagagtggcctcctagagccgcccccatggggccacttcctccaggaagctggcccggattgcaccctgaccctaggcaccgcccctgtcttcctaggtgctgattcaaggtctttctgctggacaggaggacatggctggttgctgtccttgtgtgtggggatgggctggtatggggaaggagcggagcattccagcagccactgaggcctcagggaagcagtgccacgcttactggggagggagggagggaggtgcacttatgggacctggaaagctggctgcacctggcagtgaggacgtgcccagagcccctgctccctgctctgtgccagtggagcctccggtggggagatagttgggggggagtcaggctttgtcccaccgtccactctcctgaggacttcctgcctctgtggatgcccctctctctattactagctcatccattcctcttcaccctctggccccagagctctgcactctgccgcctctgtctgaccttcgtaaatcctccctcatggagctgtccatgcactggcagccctgtccccttgcgatgctgctggctttctgccatgactgacccaggagggattccagggcaagcttccctccgagcctggggctggactccacggtcagtctgatttcacagcagcaagatcctcacatctccagcccatctgcctctgccccacagggtcagcagagcctgctgtgtgcctctcagaacctcagtctcttcttctgtgatagcagtaacagcagcactcccaggctggctccccgacatggagccccccaacaccatgtggtcaacaaaaggggggacaggaggcgggaggtgaggtctgagggtgctggggaccttgggatgatggctgtgatggcactttgctcacagacacaggtctgacagctaccatccggcccctttgcaggcacccttggggctgcctgtctgtctgtctgtggcctcagacgtcttgtcatgcacacactgacctccctgcctctggctggagcccacagacaccctggccgagctctgcatgatccaccagctccaaagcccagcagacacagggcctgcggctgaaggaggagtcgggctgagaccgcccggctgctcatgtccactccccctcccaccgcgcccccttgatggggcacctcccataaccggggctgcctgcagcctctccagtgcctccctgtgtcccaccgcctggagtgcagagtgagtggctggagctctggcctagggtgggctgggccttagaagaaggaggcagaggaagatttgggagggaggagacggccttgcaaagacagaggtagtggctgcggcacggcggccacagcccaggaacacctgggaccagcaggacctggagaaggcaggacctggaggagcacggccatctgacgccttagtttcggacttccagcctgcggcactgtgagaacagaagcctctgttgttctgagcccccagccagcttgcagcccatccttactgcagccccaggagatagaaacacccggggagggcaatccagacccagaacattccagacccagaaccttccaatgcagaatattccggacccagaacattccaaacccagaacattccggacccagaacattctggacccaggacgttccagacccacaacattccagaggacagctgggcctggatggccacttgaggggatggaggatggagagtgagtggtggcaaagcccagccccaagggcaaggtcgggtagagggagcccaggctgaccgcaggctctggacgtgacccctttgccaggtgggctccagccagggctcaagcttcctgcacggatggtgccttcacagcatctgcccagtccccataacatctgcccgccttgcccggtccccataacatctcccgccttgcccggtccccataacacccgcccgcctttgcctgcacccctccactgatagtgctcaccacctccccgagatcccacgtcgtccctctaaggtgacaccaggcaggcctgactcagtttctcccccatggaggtcccagcacatggcactgaaacttctctgcctcagcctacacttgccaggtggatttcaaaatctctgtccctggcaccctcctcgggtgacctggttcccatccctctctcctgaggcagtcaggtcacctttctgacctccgcctcttcttctgcaaagtgggcttggggggacaaggcggtgagagcctgcacagctccgagcacacacagcgggcgcctcgtaaacccagcaccgcaagcaccgtcttcaggggttccttctgcaccactgggcccaggggtcagtgaggatccagaccctccgcgtgagggggctggtgaaggagcccagggaaggggtcccggcccccagacggcggcgtgtgctctgtggccatcttctgattgcttacacctcagcccccaggacgctgtcagaggagacgaggggctgaggtcctcccaccccctgcacagcacacagacgtctctcctgcccgccaccaaacgcgcagcaacacagccctgctcagtacgcctttggtctaaagacaggaaggttcttctacttcagcttttagaaatattactgttctccccagagtttaaagccaatcggcctgttttcaggcctcaaaggttttaggaactcttgggaggcctgtgtgcctgacagccacacagtggggctgaggtgccctcaggtctgtccaggaccccccgcagttcccatgccccccatggcccccgctcctccagccaggcgaggcttgatgccgaggctttctggcatcacaaggctcccacatctgtcccctgggggccttgggaggcccctggggtacaggatgagaagccccaagtgctggtattcacatgtaactctgctgcctgatgtggctaaggctgtcccatgggtaccctggaatagggccgggtggttgcacggacagaagcccctagaagccaggggcaggaccccgcacccaagtgagaccctgctccctcctcacattgcagcccctaagcaggggctccctgggggtgggcacagtggctgggtactctgtgttagaggccaccctggccctctgctcctgacctgcagccatgtcagaggtccaccctgaccctctctgctccacatctttagccatgtcagaggtccaccctgaccctctgctcctcacctgcagccatgtcagaggcccgccctgaccctctgtttcatgcctctagccagcagcccctcgcatgactcaggcacggggccacctcttggccctaacctccttccacggtagacacccccgtccttccacagtagacgcccccatcctaacaaagcggcggctctccatgcgcctcagagcccgtctctctccgcgccggtgagaacctgctctcacgcggggagcaggtcggaagggtctgaaccatgaggaaactgaggcccagggaggaagcacccggcccaaggccactcagcgccaggggatagacagggccgctccagagaggacgggatggcagatgccagggccagtgggctggtgctgccttgaaggtggctctgagtcacccattcgggagaaacgaacagtagcactggctgtggtgaggtccggcctttgcattccgggcacccggggttgggaagttcctgctcacatctggggcccttgtgggggatggccctggggccccacgggcagctgcaggtgggaacagcctcaggcagccgccgccaggacctgctcagggaatgtggtctccagagatggggacacccctcggtcccgggttctgtgtgtgagtgtcaggggtgcagtcagaccttggacctgacggcctcagtgagagccccgcgagacgggagactgtgagctcctgaaggttccgacggctgctgggagtgtggccacgagggccactgggaatcggggccaccagcctgcagctgcagcccccagcgtccggggatccttgtcctgggacttcgcaggctcgggtggggggtatcagcaatagctggcgtcctgctggactggacccctccccagagcccgaagcccccagaagggcaggcccaggttccccgtaaacccccactgccctggctggaatcgttcctcggacaggggcccagggttgggtccatttcctcctcaccggggtcttgggccagtgccctcccctctggcctcagtttcctcatccaacctgctgtgaggtgtcacacccggagggcatcccaggaggaggagggctctctttctaggacccccccatcacttcccggctgcggccctcccacccccaggagaacacagcccaccctcctagacggggctgagcagcccggcctccagcatctgcctctgggtggggctggggcacctggctggcacctgccaaaccctcaccagcccacctgccccagctgtgcaggacctgcctgtggggtggccctgttgatatctgaggtgagtcaacacggccatccgtgccggcactgtcaactaagctgggcaggccccgcgaagctctaaggagtcacagccccggcaccggctgccgctctctgcccccaccccaccaccttcccctcgagcctcttacctgggccgcccttcctgggaccccggggtgcggagcagccggcagatgccaggaggccgctctccagcacagggtgcgtctgggacatggagccacaggtggatcccgaggctgaactggctgccctgtccctcagtcttgaagccggcatgaggagggccaccctcaggggccaacctggagcccaggacaggcctctaccaggactgcctttcccgacctcctgcagccttgagggaaagaggaggggctgggccagctggggcgtcctggagttgggcctctgtccctggaaagccgaggccctcccggccaccaactgggtgtcctctgccctggggagggggtgggagccctggggctcatgtgacgcggggcgggcctggggctgcaggctggggaaggtctccctgcagcctgcgggtgaggcagccagctgtgtccccgtgataatgccggggccggaggcctgcagctgcgcccgccacttccctgacaggaaccatctggggccctgccctgcgcggccttccctcgggccattccggtttgaccttccaacaacttcctcctcccaggcagctctggtgacgtcccacccaccctgagccctacagcgtggccactgggcatgtgtttcctcggccccagggcaggtgtgcaggcctgagggcagctccatcctggcccagagcccttggcctgtcccgcccacccatcttccccccagggcttggcccttccttcagcctggggtatctgggggtgtcctccctctccgctagccctcagtcagccgagctttccccagcaccccttttagtttgcccccgctccaggggccaccctgcccgtgttcctgtgtctgctgactgtgcccttgagcaaggcggggcctctgaccagcctctcctcagcccctgctccggggttcttgggcacctgacctgtcctcaaagtacctcccgcctgctgggaaggaaaccctctctctctgcttggcctcgtgcacagggctcctggccctctgtggagacagcagggctcccccactctccgggggtgcctcagaaagaccctcaccccacgccccagcggccgcctccggtgagcagcctggagtttgcgggggtcgggggtaggtggcttctccagtctgggaaattccagaagccacctcagagcactcttgggactacttagaccctagggagagtcctaggacccctttctagcggccgttgggctgagagagtgaggcacatcccagatgctgggaaaaaaagccactttctaaagctccctgacaactgtcagagggcaggagcttcctgggaggggacagtgacccttcggccctgcagccctggttcggtggcttttctgatgccatggctggaggtttcccggcctcagacaggccagaggtgtggagcccgcagacccagggccggctcacgggcatctgtgctattttgatttgatttgatttgagttttaggtcacgtttgcacgcagttaataattcaagccgtgcaggagtaaaagccgactccttccccgcagggtctccaggtgtcccgggtctccctgtcccaatagtcgagtgtctttctcgagttggtgacaacaagctgcatgccagcgtgtgtgtccagcttacagtggggatgtgtttgttcctgctggggaacttcccagacgccaggcccacccggggcctcccctgccctgggtggtcggccgttctgcccccaggactgaggctggaggggacattcctgccagcccggggcccatcccctggtgccatcattcggtccccacgtcccctgctgttccctgtgctctggctcagggtgggattcacagtgagggtcctgggggccctgaccctcctggtttcctcatttgtgcagggtgcacgatcctaacggcgtcagctcctacagcgtttccgggagtggagacagcagaggctctgagccgccacatgggccggggccaccgtgagcatgtggctggggttggtctgtgtcagtgcctattccccagctgtgtgcagtgagagtctcagagtcggggaactgagggtctcagggggcacagcccccactccgtgaggcagcaggacagcaccctgggtgagggtggtggctccccccacccggggtaggagacaggcagccctgcccccagccctgaggcagatgttcgaggcctgcacctgcgccccccacagatgggacacttccactttcgcaatgaggccctgagctccccgcctggccccgtcttgcctggtgtctaatcagggggtctgacggaggtggggttggaaagagaagagaagaaagttgcccacaagttgggggcaggagctgccccccaactttggcggccacctgggggtgtgggcaccactccccacctccccactaccggcctcctctcccccaggccgggcagttggtgcttgtggggaagcagacgttggctgtggctttcagagctgggcggccaggagataaggggctggggaggaagtggctgcagaggtgggggcagcaggaggggcctcggcttctcccagggacctctgctgtctgcagccagcacccagcctctcggggcaggaggggcctttccttccttcctaaaagacctattagggcctactggggttctttcggtgtccaagacagcccctggtcctgctctctgggaactataggagacacgttccatcaacatggcccagcatgtggggcccatagggcagttggggaaactgtccctgggtgggcagaggggccctaaggcaggctttggtgaatctgtaggatggccagagaactggaggagggtgagggggcagtgggggagatgacgccatgtgggggtgggtgaggaggccttccttcaggcagggtgtcttatgtttgccttctcttctagcatgtaggaacccccccacccccaacacacacacccttcactgctggatgaatagatgaatgaatagattgatgaatgaatgggtgggtgggtgagtggatgggtgggtagatgatgggtggatgggtgggtgggtggatgagtgaatgggtggatggatgggtggatagatgggtgagtgggtggatagatgggtgagtgagtgagtgggtggatgggtgggtggatggatagatgtgtggatgggtgggtggatggatagatgggtgaatgggcggaaagatgggtgaatgggtggatggatgaatggataaatgggtaaatgggtgggtggatggagagatgggtgaatgggtgggtaggtagatggatgggtgtgtgggtgaatgaatggtggatgggtgtgtgggtgggtgggtggatagatgggtgaatgtgtggatgggtggatagacgggtgaatgggtggatgagtggatagatgagtgaatgggtggatggatggatggatggataaatgggtgaatgggtggtggatggatagatgggtggatgggtgggtagatgggtgaatgggtggatgggtggatagatgggtgaataggtggaaggatggatggataaatgggtgaatgggtaggtggatggatagatgggtggatgggtggatggatggagagatgggtgaatgggtgagtaggcgaatggataggtgggtgggtgaatgtgtggatggatgggtggatggagagatgggtgaatgggtgggtaggtggatggatgggtgtgtgggtgaatgaatggtggatgggtgtgtgggtgggtgggtggatagatgggtgaatgtgtggatgggtggatagacgggtgaatgggtggatgagtggatagatgagtgaatgggtggatggatggatggatggatggatggataaatgggtgaatgggtggtggatggagagatgggtgaatgggtgagtaggtgaatggatcggtgggtgggtgaatgtgtggatggatgggtggatgaatgggtgcgtggatgggtggatggatgagtggatcagtgaatgggtgggtagggatggatgggtggatagacaggtgaatgagtggatggatggatacatgggtggatgggtggataggtggatggatgggtggatgggtgggtggatgggtgaatgggtggatgggtggatggatgggtggatggatgggtggatagatgggtggatgggtgaatggatggatggatggatgggtgaatagatgggtgcatgggtgaatgggtgggtaggtggatagatgggtgggtgggtcaatgtgtggatggatgggtagaggggtgggtggatgggtggatgggtgggtgggtgggtggatgggtggatgggtgggtgggtggataggtggatcaatgaataagtggtaatatggttttatgtaagtctcatgccagcccactttacagaggagggaggaggcccacaagggtgccatccccagtcacaaagcctggagagaggaatgtaagtcgcgaagccgctccagaggatgctgaacagtgtcatgtacggaggagccttgccccggctttctggtcctgaataaggtgtggacagttggggtgagccacagagggagtgggggccgggggtggaggcaggaaaaaacctgccccgggtgttcaaggcagtgcaggtgaagcggctcatagctggatgctcagccactccccagctcagggcacggctgagcaaacccagaaccacggagaaggtgccatggccggagggctggggtgatttggggaaacctggtacaaagtggtgcaggattccagggctctgagactgcagttactgggcgctcctgccacccccagaaagagcaggtctacctggggagtccgagccgaggcgcaggccggagacaccccaatgagagcacggaactggaatcggggtcttcaccttcccggtgtgtggactccttgggcatctagtaagcaaataagttcacagaattatgaaggaaacccattttaccaaaatacagctaccaccccgttagaacattctggtgtagtgagcactgtgcttttcattaagccatgatttaaagtggtgaggcgtgggaaccgcattaggagacgtggtggtgagtggaaggcgaggggggtcttttgtggagccctggaccctcccaaggcgtggctgcttggggcccaccaaagtggccctggggcagctctatcggtgtcaacggcacaggcgcggctgacaccctggggaggtgcccacgttcttggttacaggaaaggctaaattttggttagagacacgacacaatgccagatgaaactcatccaagtccacggatcccctgaattccaaggaaagaaccgcggttccagcttccctcgaaggtgtcccccggtcccgctcaccacctcagcttccaggagtctccggtgggacagccggaaccccactgagggtctcgaagtcacaggcccctggttcacactcagcatttcctgtctgtgctgggtacgcttgggcaaatgtcttgacccgtttccccaactgtaaagtaagaaggtaacagagtcagctgaatgggggtgtggtgaggatttaataaaaccgtccacgtttggactctcctatggtgcccgtgaaggtgggcaagcacggacgggcagctgtgacccctgcgagatccctgagccgtgaaggggccagcccagggggacagtggaatccccacaccgccttctggccatggccgcctccggggcaggcgcgttgctgctagaaagctcttcctaaattgagctcaggtcggcatccctgcagatgcggcccctctccggaagagtgctttggaagggagaaagggctctcccagccccaccgccgccccctggagtcagccacagcctcctcccccacagcctcctcccccacagccctcccgcccccatggcaagagacctgcttcaattgtgatgtggctgccccgcccctcctcttaaaccttcagtggctgcccacctccctcaagatcaaggccagaccctgaaggtggctgggggcccctccacactctgccccaaccctacatcagagccgcttctcctgagggtgtttcctcatctctgggccttccccagccctcccatcgaaacttgcctcacgtggcgggctcctacccagccctcagagcccataggaagtgccctgtcctgtcctgggctccacaccccctgcacaccttcctgggttccacacccccttcacaccttcctgggctccatgccccctgcacgcctccatcacagcattagcaccttgggttgcagttgctgtgggctggtttccttggacccacaggaaagcagccctgggcgggaaccttgcctgtctccaagggctgtgttcccggcacaaggcgcagggctccatgggtgatgactggctggcggagtttggcacacccacctctgggtcccccacacgacacctggaacttctctaggctgaattccacctctctcgccctcaggactcccctggggctctgccccacacacatcccagggaacacagaggaaatggccggtctccccagctgcttccgaagagcaggatgggctgagactccaggcccggccgcccagcgcagccttgggaccctggggcagcccccaaggcctagggggctcagtggcctttgcccggacaggagggccttccccagctcatcagccaccccaggcgggtagtgggtgtgggacagagagctgacggcagtcagaggccacagccccacaggacccgctgttcccttggctggcatcctcctcccctcctgaagcgcatggggctgagcccagcagggtggagtctgaacagagacaggaatttgagcatcagggcagcaacagcgtcgcccccgcttcctgagcaccctggacttgcgggggacgctggtgacctggtggcatatattcggtgtctgacaggactggagaggttaagcaatttcccaggtcaccagcggtgggatttgggactcaggctgggtctaagccagtcctctccctgaggcagagagcctgctgtggctacacccacccagcttccaggacacggagccctctgcccaccgtggtctctgctcctccccagcgcccaggaggcatcaagacccggcaaggctgcccgttctgcagaacaggaaaccgaggctcccagaggggaaagtcccagcctccctgggggtcccagggtcctgggctgctgcaccccagctgcaaagggggaagccccgtccggaggccactttccctgtaaggagcccaggcggggtgagggctgcgacgtgccggtgccgccccggtttccctctgactcaggctgaggcggctgcccctgtgctggtgccatgtctagtccgcaggccccacaccggtgacctgccctcatctcatctcctgtgagtccgcgagtccacggctctgccgacggggggtggtgtgtgtgcagcagaaggaatgaacgagggaacccctgccctgtgctcttcctctcctcccctccgtcctgcctgggtgttcacagcagcttaagagggaagaacgtggccctggcctacccaccaatgttctagaacattctggaacattctgttctcagcccggagcctgggaactgggtaaacctgggccatcgagcggcatccaacatgaggaaaataccaagaggctggtgtgtggttctgtgtgtgtggcgcgtggcgcgtggtgcgtggggagaggcagccgcccgccctccagagccagggtgccacctcctgcgtcatagacacctcccccaagcagtgccaagctcctgcctcccaccagtggctacttcgggctgcagtggggcctggggccacggaagacccagctaggtctggccaagaggcccaaggatattccaggcacccggaaggatccggaaggatctgggagtcttgggttaagaaccatgcagcctgacctgctccaaacgtggacttcgtccctgaagaggctgcaggaccctaaccattcgcgtcctgggcgattgtgagtgtgatggacgatcacagcactgttattgtatcttagagctgaactggaagacaaactggcctgtatccaataagaaaaaaactttgtgttttgcttccattatttattttttctgaggcagggtcttgctctgtcacccaggctggagtgcagcagtgcgatcttggctcaccgcagcctccaccccctgggctcaagcgaatctcctgcatcagcctcttgaatagctgggaccagaggcgcccgccaccatgcctggttaattttttatgttttgtagagatggggcctcactatgttgcccaggctggtctcaaactcgtggctgaagcgattctcctgtctcagcctcccaaagtgctgggatgacaggcatgagccactgcacccggcctcatggctttttaatagttaggtttctattgaccttgttttcagacacacacaagcttagaggatataacacaggcttgtggatcaagcactctgcttcactgaacttgaaacattttaaacatcagattcttttaaggcgcctttgggtgccctggcctaaaacacccttcccactctgcccgtgttcagtcctgactccagacaccgcggaaagtgagaggggtcgggcaggggagtccaggggttctcagagcgcagtccctgaccctgcgcccatgttcagtcccgactccagacaccgaggaaagtgagaggggtctgggaggggagtccgagggttctcagagcgcagtccctgaccctgggagcttgtcagaaatcctcacccacccaggatctgtgcgtggggcacctggggctgtcctgggtctgctccgattgtccccgaggggatctggagggacgaggttgccccggggtctgcttggggacagggtgagccagcactgtgactctgtcattgcaacggttgtctctccccatgggtgggtggagggacttccctgaggctctgggacctccctggcagttccagccacctgagctcggagcacatgtctgtggtgcttggcgtgggggtgggtccagggtccagccccttcctggctgtcgcctgcaggcctgacccggctaagggggtccaacctggccttatccgtctaagggggtccaacctggccggcccgagagggtagggcttcttgggagaaagctgaaggtcatggaggagaaatgggggcagggaagaccgtcaggctgaaaccccacatcgggcagctcagaggtgggggcagggaagaccaccaagctgagtccccccatcaggcagctcaggggagggggctccatgctgggcccctgagccgcctcctgctgtcacagcatgaggtttatcattcagcacccaggcaagctggccctgcaggcaggggtccggcctccaaccgccttccggctgccccaccatgtccagggacctgcttcagccctccagtcgtgcttcctttcttccctctgctcactcggctcctcctggaagttccttctcgctagcccccagggggtttggatgctggaccctggggaaggggccttggggtctgtagcagggcatctgagggtcctgggacacccagaaaccccaggaaggctgtgggtgactcagcaaacccacaagccggggggtctctcaggcatgtgctgcagggggggtatgatgtggggtctgctctgagtgagggtctcggcccttgtctgctccttgtccccctgtcccagccacagcccgctccactcccaactctgcccacggctcaccccgggcctctcagaccctcgcctctgggacccccttgtgaagatccgcctgcccccctacagccccacagcccccatcctgctttgcagccccctccctgctttgcttgtcttgaatagcaggtggcactctctgatgtgctgaacgttgtttactgcctgtctctcccgctaggtcagctccagggagatgagctttttctttttctttttcttttttttttttttgtttaaacatattttattttttaaagcagctttaggttcacagcaaaattgagcatgaagtacagagggttcccctgcacccctgggctcagcatccccacgagagtggccgtttgttacagctgagacccccctggacacagcatcatcacccacaggccgcacgacctcagggtccaccgggtgctgtgcagtctatggttggacgaacgtatcctgatgtggacccaccgttgtggtatcatacagagtagtttcactgccccaggtcccccgtgttcctgctgcacatccctccgtccctccctctccccagcccctggcgtcactgatctttgtgctgtctgcacagttttgccctttcctggatgtcagagtcagaaccctacagtgtgtggtctttgcagacgggctgctttcactcagcagcatgcatttatggtccctccgtgtctttttcctttcttttcttttctttttgagacggtgtctcgcgctatcacccagcctggggtgcaatggtgtgatctcggttcagtgcaacctctgcctcctgggttcaagcaattctcctgcctcagcttccctagtagctgggattacaggagcacgccaccacgcccaactaatttttgtatttttagtagagacgggggtttctccatgttggccaggctggtcttgaactcctgacctcaagtgatccacccacctcagcttcccaaagtgcagggattataggcgtgagccgcagcgcccggccccttcgtgtcttttcagggcctgggagctcatttcctttcactcactgaagggcatcttggtagcttccatgtctcagcatcggcaattgtgaataagctgctttaacaccgttgtgcaggtttttgtgtgaacacaagtttccaactcgtctgggtaaatacaaagaggtgcatcgtgtaagatgctgtcagctgcatttcctgctgtagccccagagtccaaacagcacacggcaaatggacactcagcaaatcctgaattaatacatgaagaaagaggcagggcggccagaacaatacaccacgcacaggggctttggtggcagaaaccagctttcgcacagttctggaggctggaggtcgagaccaagttgttgatgagcttggcttcttccaggcctgtgtccttgtctttgctgacagctgcctccgtgcgtggccttgtccacgtgcacgcacccttggcggctctgtaagtccaacttttgttttctcttttcttttccttccttccctttctttctttctttctttctttctttctttctttctttctttctttctttctttctttctttctttccttccttccttctttctttctctctctcttccttccttccttccttcctctctctctttctttccttccttccttctttttctctctctctctttctttcttccttccttcctctctctctctctttctttctttctttctttttctttgatggagtcttgctctgtcactcaggctggagtgtgatgacgcgatctcggctcactgcaacctctgcctcccgggttcaagtgattcttgtgcctcagcctcccgagtagctggaattacaggcacacaccaccacacctggctaatttttgtattttaagtagagatggggtttcactatgttggccaggctggtctcaaactcctgacctcaggtgatccacccgcctctgcctcccacagtgctgggatcacaggcttgaaccaccgcacccggctgtaagtccaagcttcctcctcttataaggacacctgttggactgggttagggctccactctgatggcctctgtttaacttaattatctatttaaaggccctgattccaaatacagtcccattctgaggtcccatccggacttccacatgggaatctgtggggcagaattgaccccatcacaaggttcctcctggagccttcagagggggtggccctgccgacaccttgattcagactgtggaccccagagatgcgagaacgtgtttctgtggtttcaagccctgggctatgggcctttgcgtgcagggccacaggggcgcaaacccgctcttatcctccggtcccatattgcagatgggaagccaggggtcagcactgggtgatggtcccactccacgacgggagctcccagcagtctccttcccacccactcggctccacgcagggcaacgggagctcctggctcccagcaatccccttcccacccactcagtgtctcgtgcatggcacacacgtgtcctgcgggcccgctgggagctggctgctggtccctgtacgaggctgggggtctgacctcaccaccagggacagacagcaaagcagaccatgagacaggggagcaaagccgtgcggtgggaggggtgaggcgtgcggcatgactgcagggcggggagggcctcaaggggagaggcaactcggggcagcccgcatggcccaggcgtgggtcaagctctgggaggcacgctccccgcaggaccagccgcacgtgcaaagctcctcctgcccccagccccggccagcatctcggagccactgcggattcagtcgtggggtccctggaaggcaaggccttccctaatctgggcaccggggcctcccaggtggcgacgacagactcccaggctggcttgaggcaaaaacacggcgcgctgggacgtatttggatgtaaatgttttcagcacagagcagctgggagatgcggcctccgtgggagctgggagccggggccatatggcccctctcccgcctgtactgccttcgagcgggggcgctgcctggtggggcccccaggggtgtctgcgggggtcggacttgagtcctgccggcccctcgctggctgctgcccgccctgccatctgtcaggtggggcgagaccgtgccagctgccctggccctgaggaggccttgagggcatctgaggggcttgggcctggcgccagcccgatgggtgtgtgcatctgcagccttggcagcatctggtaacttccctcttcccactcttggccctatccctggttggggaagagccaggtgctcacctgcggccctgcatggtaaaccagacggcggctcacagggtcatcttggcaggggaccctctggccacacagaagactcggaattcctggctcttctctcccagcccacggcggctccttccagagaccctgagagacccctggcaccctgggagatgggagcagagctgggatctgtcctggacgcaagggatgcctcccctctagaacaagcactggctccccatgtcccatcagctgaaggctacatcaggttcagccctcacagccctgagcgagctgccctcctgtgccctctccacagctggggcttcccggtggttccatacggaagcccctccctcacaacccaccacccccagctccagtcacccgtcctcagtcatggtagtgggtgatttgggctgtgaggccctggggggtggcccagtgcagcagcggcagacggggcactgtggggggctccacgggggtgctgctgggccctctccagcttcaaatggaaaaacacaggcctgcgtggggcccgtcctgaggttctggactgggtgtgtcagtcagtgacgtcatcagggaccctggcccgctccctctcatgccttgtcgtggcctctgccaggcccgctgtcatccggcctgtcgtggcctctgcccggcctgctgtcatccggcttgtcgtggcctctgcccggcctgctgttgtccgacctgttgcctcatggttcccagatgggtgctgcagctccaagagtcacagcttctgaccactgcgttcagggaaggaagagaaagagccagggaggaaaatctcttccagaaacctcatgcagttctcccctttcagctgactggctaagccgggtctcacagccgtgtctggctgccagggagctgggaaagttctgtggggtccctgcctttcggggggataaaggcaagggctcagagggaacagagttagccgtggccatggaaggaagagcagagcttcctccaggctgagtggggccggaacactgctgggcccagctctagtcggcgggaggctgtgtgctgtgttggggagcggatttggcacctgagtgtgtgcctcagtgacagtacctgtgctctggggctcaggatggggtgacaggacagcaccaccccaggtgtggacagcaggcttagactggtgatgagggggcttgtcctggggagggcctcaggcagctctgttagacccaaagtaggagagcttcttgcaacggaggcctggagcaaattcacgcctgcagagcggaggagccctcctcttcccaggtggaaccccacgtgtacctcttctccgaggaggctccttggggagctgtgtggatccttcccactttccctccacctggggctgcctctctcccctgcctagcttcgagggatggggatggtggctggctgggagccctgtgtcccctcactatgatggggaccctcagctgtacccgcctgagggctgcagccgactcatggtgccccttgcctggctgttccgaggagtccggaagaggctcacttctacatttgccctgaaaatctcaatttttgctttaaaatgcagcagcgactgggcaaggtagggctcacgcttgtaatcccagcactttgggaggccgaggcggacagatcatctgaggtcaggtgtttaagaccagcctggctaacatggtgaaaccctattgctactaaagacacaaaaattagctgggcctggtggcacatgactgtaatcccagctcctcgggaggctgaggcaagcgaatcacttgaacctgggaagcggaggttgcagtgagctgagatcgtgtcactgcactccagcctgggcgacagagtaagactctgtctcaaaaaataaataaataaaatgcagcagccctggtccccttaggaaccctttcctccacaaatacccctgtttacctgaacacaaggctgggggctgtgtttcttttgtgtccccagtgcctagactcgtaccaggcacacagtaggtgctttgtacgtgtttgtagaaggaacgaatgaacagtgcccctgtgatgggcccagggagcccaacgtgacccacacagcacatgcctgatcacacgtgggcgctggggggcgtgttatgtgtctgcttgtttgtaaatgtgagtcttttctttccagacagactggagcccgagggtaggaatttgtttttccaagactccagactccagcccatgacaaaagccaaacacacagctggcgacccgcgggcccggagctgcctggtgactgggataccccaggctgcccaaacaactgggtaccctggaacgtggcggcctcgtggattctggaggccgaggcctccgcatcctggtgaggtgcatggcttctctctgggcctgctgtgtctgtgatgtggggctccctgaccgcctgggcctcagtttccccaccatcctacagggataacggggtatagtgagagaaagtcagttgttctctgcagaaagcaccccgggccgggagtgctgggggcgggctgggactctgctgctgacggctgggcgaccgtggggacgtcttcctgggccacctccgcatcccacccccggggtcatcgcctctacagggtggggctggggctctgagtctgcagacaactccacatccggcagcccatctctgtgcctgggaacttcccccagtctgcccaaggtggcccgagagatactgggcagggggctgggagcgttcctgctgtgacagaggcagttacccggcctgcttggccttcctctgagtttatctcccatagcccagccaggccgcctccttatcacggccacggtgaactgggggcaggggtcacagcgtcaggcgccccttcaagaggcttctacccaaatccccagccaccccgaggtactccttccccaggggcacctggagtgtctcccatcagctgcctgggtgggctcccagccccccatcagctgcctgggtgggctcccagccccaagcgcgagagccctgttccctcggctgcctgcggcttcccccacccccaccgcccagggctgttttgctctcacacctgtgctctgagtctctgagtcggttcacatcagccctcgaatctaaccgaatccaaaaatatgaagccggggcccatctgtcggccaactgatgagcgcaaatgagctctggatttcagacgaggccggcagccggtcagggatgttaggagcggcacctgctgcccagcttccctgtccccctctcgttcctcagcccctcccagccccaagatcctctggaggggctggctcctgctccaccaagtgggaggagtgtcctggggcctccacaagagccaggcccaccagctgggaccctttgctgtgagcctgtgctcagagcccagccccgggctgcagctgggcaggagctgggtccgctctgggtggagacactggcagcactgcggctgcctcacagcctcagcacttgcttccccctgccgggagcaccatccccaggggccccaggactccttcccctccatcccaacacgtggttgggactaaacaatatgtttgcaacttgttttggggttcacatgagggttccatctgcttcatgtaacggatgcccttactgctcttatgtccagagggggtggagaggaaacaaagcagatgcccctccctccttcctccctccctcttccctccctcctcctccctccttcctgcctcctcccttcctccctccctccttcctcccccctcctctctcctccctcctccctccctcttccctcctcctttccccttcttctcttcctctctctcccctcctccctcccttcctcctccttcctctttcctcctccctcccccctcctctccctccctctcccctcctccctcctccctcttccctcccccttcttctctccctccctcctctcttccctcctccttcctcctcctccctcctcccttcttcccctccctttctcctccctccctttttttctccttcttcccttctgtgagagccagaaccaggggcccagtgaggaggctgtggttttggagtctgaggttggggctggacaggggaggtatggctggcagctgggaggagctggaatctggctgtagctggggaagaagcaacaggaccgtccggcagatgagaaaactgaggttacctggagtcggtcggccctgcccctgccccataacgtgccccccaggcacctgtgcacgaggcttctctgtggtcagcacctgttcagctccagggatggccgagggagccccaggaccaggagtcttggtggctcaggaggaactgggcctgtccagagtcctggggtccgagagcacggatgctgaggcaggttcagcccttgctggacaggtcggagacctgcttccaggccagcgaagcccagggggcctgtctaccacccacctccctcagctcctgtcctgggcgttttgctttggtaccaggaccgggcggtggcatgggctccactcccttctcccatgggacggatgaagccactgagagccagggtctcccaggcaggaaaaggcagcaccagaattggaacccagtgccccctcagtgccaggcatccatgaccccagtccccaagtggctgagccgtgggacccagatgagacctccctgcggcaattggggccccgagctgggcggccctaaggccacagtcaggctctcacaagcggcttggggcaagggctcccccaacagcaagccaggtttggggcctggctggggatccctggctgtccccaatcctcgcaagcctgtttgcccatccctcaaatggggatcaggagaagccagttctcctagtgtttgcattgaaatctgcccaggtctgtggcttgcgagcctttctgagcacaatctacagtgaggaaggcattttatctcctcacaatattcacgtgctcttgtgtgttctgcaaatgacacagcaatgccacttagacgcacgagagtctatgtgatttctgtgtgcgtgaatgtgggatctgttcacgctcacacgtggcggacagcagcccttccccttccccttccccttggagaagtgccgtggcttccattttatttactgtagcatttcttttacctttgcactgtgaagtgcacacgcccttggggcagcaggaaacagagcaggtgggacgccctgagcccctgcatcctccacggctgccccaggaggtggcttcagccccagcacgagctgcgatcacatccctgctttctccgtcgttttaggcctctgtgcgtgtcccttcctcagcacagcgtcgcctgcctgtggccgggacccgacgtctttttcgcctccttgcctctgagttctgtttcgtgtggggggtgagtctcaggctcccacgttcctgccgcacagcattgctggaggagacatctcctcgcttcatttgtctgtcccgccaggctgctgtgggacgttcacagtcacaaactgcagcgtcataggaaacgtacctttggcctctgccccagttcctggcatggagctcctaacccttagcctttccgggatgccaggagcatcctttgttctactgaggtacccatgggggctcctggatgggggctgcacatcagagagccccccctaggattagaagcctagaactctcagccccagcccctgggaagaagagggctgggacgctgaggtcatcaggggtcatgcttatgtgatgaagcctcaaaagaaatccctaaaagacaaaagacaggacttgggagcatccagggtggaaacacatcagtgccgtgagggcggccacccccactcagtggggacagggctcctgcgctctggaagcttccggaccccaccctacggaccccgtcctgcgagtcctttgtaacatcctctataataaaccagcatgtgtaagtgtttctgagtcctgtgagctggcctagcacacaccagaccggggctcagggctcacaggagtctgggtttacagctggtcagtgagaagcacaggtggcctgacccagagactggcgctgaagtgggggcagctgcaggacagccctgggctccccgggtctgcggtgactcaatgtaatcaggctaaatcgtagggctccccacggtcatccacagagagctggagactggctctgtgtggaaagctcccacgtccagggccccggaatgagtggctgtctgagaaaggagcttgtttccctcttcccagacccagtgcccggcatccaggcacacacagtctctctggggtacacgggcacctcgtcctggggcctgtgcctctcagcacccacactttccattttattctgtctcactaaaaaaggctgctcacgatccgctaaatgggttcgcgtcccctgcagggaccggccacccccgcagcctgacaaaggctggcctacaggtgccgggagggccgaggggtggccctcgggcacagggtgacactgcagccttggaggtccctgggaccccagccccatcctgctcacccagcctctcaccccttttagccatcaacgaaaggggcagcccctggcgtggagcgggggggcctctgggaccctgtgccatcccctggtgacagctggagtctgctctggtggctggcgtgggagtctttcggggctgccgtgataaatcagcacagaccaggagcttccacagcaaggatctgttctcccacggctctgagaccaagctgtctgcagggccggctccttctgcggtgctggaggggtgggggcgggcatctgctccaggcctctctccaggttctgggggatgggggagtctctggtgcgcccggcgggttctgggggatgggggagtctctggtgcgcccgggcttgtgggtgcatcaccacgatctccgcctccctcttcacccagcgttctccctgcgtgcacagctcagtgtccacacctgccctttctagaaggaagctagttctgtggggtgagggcccaccctagcgatctcacctggatcatcttgaaagaccctatttcccaggaaggccatcgtctgtggtgttggggggttagaacttcaacttataaattggtggggggctccatccaacccgtaaggtaaacctcttaggcctcacagtcttgggtgggggcgtatccccttgggcttcccagagccagcacctgtggggactgagggtggagtaggagtttgaccctcgagacagggttccagatcttggcaggtgcagccctcctaaatgagtccatccatggtgggtgagcctcctgcaccctttcgcccatcttctgggctcctggccttgagccattcatgttttgaccctcgagagagggctccagatcttcgcaggtgcagccaccctaaatgagtccagccatggtgagtgagcctcctgcaccccttcacccatcttctggactcctggccttgagcctcaatcaactggcttggatgagaagccagtcacactggattgggccaataatatgggttttgggactgagtcaatgcagcccttctcagccgcctgcactggtgcctgcaggtgactcatctgggctgccacacacatcaccctccagggcattgaattccagcccggccagggctgcgggggctggtgggaggctgggcctggggcagctaccaaaccacagatatgagaagcttggaaatgccacacaggataacacagcaacagtatggcaaacaacgaaaacccacacccaggcacataatgttcaaactccagagaaccaaagacaaagagaaaattatgaaaagaagttgatgcgggaggaggactgagcattttatatagttaacaccagagaaggcaggaaaagatggaaaaagcaagactcttcaagggaagaagcagaattcaaagtgtctacagtgcatcatccccagtactcaacatacaacactgctgggtacacggaaaaacaggaatgcagagcccatagtcaacagaaaaaacagttactagtagtagacactgagatgccaaagttagcaaacaagaactttaaagcagctattagaaatgggcacaactagccgggcgcagtggctcacacctgtgatcccggcactttgggaggccaaggtgggggggtcacttgagggcaggagttcgagaccagtctggccaacatggtgaaatcccatctctactaaaaatacaaaaattagccaggcgtggtgatgggtgcctgtaatcccagatacttgggaggctgaggcaggagaatggcttgaacctgggaggtggaggttgcagtgagccgagattgtgccactgcactccagcctgggtgatagagtgagatgctgtctgcaaaaacaaacaaacaaacaaacaaaaatgtgctcaactgccaggcatggtggcgcctatgttcccagctacttgggaggccaaggtgggaggatcagctgagcctgaaaggtcgaggccacagtgagctgtggtcatgtgactccaacgtgggtggcagaacaagatcctatatgaaaacaaataaataaataaatcccagtcctcaccccaaaagaagtgtgctcaactgcttaacaaaaaaatgtgatcacaatgggtgaacagacagggcttcacataaaacaatgaaacaaatagaaatcctagaactaaaaagtataatacctgaaataaaaaattcactgggccaggcacggtggctcacacctgtaatcccagcactttgggaggccgggcgtggtggctcacacctgtaatcccagcactttgggaggctgggcgtggcggcacacacttggaatcccagcactttgggaggccgggcacggcggctcacacctggaatcccagcactttgggaggctgggcaagatggcgcacacctggaatcccagcattttgggaggtcaggcacagtggctcacacctgaaatcccagcactttgggaggctgggcaaggtggctcacacctgtaatcccagcactttgggaggccgggcacggcggtgcacacttggaatcccagcactttaggaggtcgggcgtggtggctcacacctgtaatcccagcactttgggaggtcaggcgcggtggctcacatctggaatcacacctgtaatccactgcactctagcctgggagatgcagtgagaccctgtctcaaaacaaaacaaagctaattagactggataggcttaacagcatattgcaatgatagaagaaaagatcaatgaacttgaagacagagcagtggtaatcatctaaagaacagaaattttaaaaacactaaaaaagagaggcagagccaagtcacagaacaatgtgaaattgccaactccacgtgtaattggagtctccaaatgggaggagagagagattggagctcaaatacattatttagagaaataatggcccaaacttccctggacgtagtgaaaagcatcaatttatagacccaagaagttcagctaacttcaaacaggataaatagaaacacatctgtaggcacagcacagtcaaactgctgaaaactgacgaaaatgtggaagaagccggagaagagggtggccagaagtgccaaatgctgctgcctcctcatcaaaaaccagagggcggagggcggagggcgggggggggcggagggaggagggcggagggaggagggcagagggcggggggcgggacagagggaggagggaggaggtaggagggcggagggagggggcggggggcagagggcggagggagggggcggggcagagggaggaggggggggcggggcagagggaggagggaggagggcggagggagggggcggggcagagggaggagggaggagggaggagggcggagggcggagggcgggggggcggggcagagggaggagggcggagggcggggggcggggggcggagggcagaggagtgaaaacaatgagccgcccccaccgctctgaatccagcaggaaatcctcagagtgaaggtgaaggtgaaataaaagcgctctgaagtaaatgaaactgagaacatttgccgtcctaagagccgcatgacaaaaacatgctaaagctgcgtaatctgcacaagataaggaactcactgacgggcagggtggcgacagcccatgtgcgaccgtgcaggtgaacaaggcgcctgtcctctcctcgtcatctcttttaaagggcaaatctgcaggcgtgtgtgtccagcatcatgagcttcgtggggtctgagtcatagaacgtgtgaggacaggagcgtgaggcgtgggcgtggggagggaaccgcactgctgcaaggggcttgggtttctcatcaaacggcgccacatcttcagatgtctctggaagccgaattgagactggatttgggtgtgtgaagatgtttaggaccagcacgtgtgaagggaagcaggcagggctgacgtgtggtgcaggccccacggggccgtgtgaccccacgggcagctctggtgcactaggggcccatccggctggcactgtgggaagacctgcacagcccagccttcatcggtcactagactccatctttccgggaaggacagggccgtgggaaaggtgaccctgaaggaacagacggggtaccctgtgcttctaggagcaatctgagcagcaccaaccttgaaagcggactccaggcagaccgcgccgtctgtcttctctcttgctgccacgtgtccgccatccctccagatggaccagtccccagacgttccctgcacccacacacacctccgtccctgggctggggcctctcccatgcccggggcttcctccgctgccccctcctctgtctgtgccccctcctcctccaacccggaatcgctcaaggccgctagagtgacccacgctgtgcctcctgtgtggcccagtggtgctgcagcctcatcgcgatgtcggaggtgaccccacgcccactgcttccttgtggggaatggagcctccgcacctgcagggagtggggaggggccctttccagcctcgacctttctccttctaacgaggagccacatgggtgctctgccagcttccagcacctcctgttcttcagagagaattctggaaaataacaattcctgaccaacatgcagcccccacgaatactcagagtcccagtttttaaagccaccttagccgcctccatccagcttctgccctggtgtggcctctggtcagcactcactgtctatgaagaagacagagaactgggcctgcccatcccccaggggtgggctccatactctatttggcctggatcactggggagaggatgcgtgggtcaggcgggctgggattgctgttgggcggcaagaccctccactcgacacagccacggcttccgtgtgagtcgggcaagtcctccatgtggtgactcagggatccaggctgcaggctgctgagatctgaagccacagcttctgcatctccagggaggaggaggagtgctgacagcacggccgggagatgtgggggccaagtgtgcttggggagcaccatgctgcccggctgccacgagtttcctgggctcagcaccctgggagcctcctgtgctcggctcccgacaaccctaagctgctggcactccacctcattcctgcgctgggggaaattcctgcgggtggaggctccaggctcccggctgcagactcggagtggattgagtcctgccatctgcccaagaggggtcacagccaggtgggggtccgtgtgtgtcctctggctgagtatcaaagcaccaacactctgggggccatgacagtggaagttggggctctcacagcctgcagcggtgagctgacatcaaggtgcgggcagcgctggcttcctctgaaggcgctgggagcccttcccgcctcatccagctcccggggctccctggctcgtggccctcactcccatctctgcctctgtccgcacgcagctgccttccctgcgcatctgactccatcctccttctcttctaagggtactggccgttggatttagggcccaccctacccaggacgatgtcatctcaagatccttcacttaagttttcctgcaaagaccctttttctgaataaggttacatttccaggctctgggttttaggatgtgtccactggcaacatgaaactggggagctggggggacagaggagctggggagacagaggaactggggggacagaggagctggggggacagaggagcctgggggacccaggagccggagggacagaggaaccggggggacagagcagccggagggacgcaggagccggagggacagaggagccggggggacagaggagccggagccggggggacagaagagctggggggacagaggaaccggggggacagaggagccggagggacgcaggagccggagggacagaggagccggggggacagaggagccgggagtacagaggagccggggggacagaggagccgggagtacagaggagccggggggacagaggagccggagccggggggacagaagagctggggggacagaggaaccggggggacagaagagctggggggacggaggagccggggggacggaggagccgggaggacagaggagccggggggacagaagagctggggggacagaggaaccggggggacagaggagccgggaggacagaggagccgggcggacagaggagccgggaggacagaggagccggggggacagaggagccggagccagggggacagaagagctggggggacagaggaaccggggggacagaggagccggggggacagaggagccggagccggggggacagaagagctggggggacagaggaaccggggggacagaggagccggggggacagaggagccggagggacgcaggagccggagggacagaggaactggggggacagaggagccgggaggacagaggagccggggggacagaggagctggggggacagaggagccggagccggggggacagaagagctggggggacagaggagccggggggacagaggagccggagccggggggacagaagacccggggggacagaggagccggagggacgcaggagccggggggacagaggagccggagccggggggacagaagacctggggggacagaggagccggagggacgcaggagctggggggacataggagccggggggacagaggagccggagccggggggacagaggagccggggggacagaagagctggggggacagaggagccggggggacacaggagccggggggacagaggagccggggggacagaagagctggggggacagaggagccaggctcagtgggggtcagggtgtaggctccagcccctctgcccatcccatctgctttgccagccccagtttcgctgaattgtctcatgagcgtgttctgacccctgcctcacaggaggggcggcacggcaaggcggtggatgggccaggccccgggtcagctcggcctcggcgaggctgagcaggtcacgtgccacctccatcctgcgttctgctttccatcacgagctacagcaggagcaaggtggccgtgaccgagaaccccttggaaccccagtttcgttgtctgagaggaagataactgcatctctcgcaggatcaggtggcagcagaagagacggtggacgcactcaaaaccatcccgttcctcgactggggcgggctgtgttgtgcacacccggcccggccccacacccaggccccacacccaggccccaccatcaggggcacccagctggcatttggagtggagccctcagagggggctgggctgggactgggatcccgggggagaagcgaggagagcctgcatgggagcagcagaggctgcccagggaggctgtggggcttggatctggatctggaggggagaatcactggggagcacccccccaccccccaacccggcaacggcagccaggaagggctggaagcagacgggaacgaaagcaggagatggaagataggagaagataggagaagagagcagatgaggccgggaccgagggggagaggctgcggtggggaaaggaggtgctggggagaagggaagcccagaccgctacccctcacccccttttccccagcctggccgaggggcaggggccgcaggaagatgtaagcgaccaacagccttgccttgttgcaaagaaaatattccctgaaagacattaaaatgaagtaaataaaagagataaaaatggaaatatcaaggcagcaacttctcttctgattacaaagcaggcagcgggaagcagcgggagcccatgaggacgcagctgcacagccgggcgggcctgataaggcctcgtagcctgcgcgggcgagataaagccagcacgcgcctgtcctcaatcccggccgccatcaacatgcagacagcctgagcgactggcattccagatagaataagcacgcacggccgcgctattactgagaccttattaatccgcctgcaggcgtttaaatgccgtgggaaatatggagtttaccagcgcagctgacggggacttgacacttcatcacgttgttccctctcagcctctctccttggccatcgtctctgggccccaagtttcagttggaagggaagttttcaggtgcaggtggaggggccaggaggagggggcctccaagcacctggtgagtggggaatcccatggggtcacacccctccggggagctgtccctgaggtctgggtggagaggccgagtggcggcagtctaccgcgtgtgcgcagcctggcgacatctcaccgttttaagtccttgatgcgctgggttcccagtttgaatttgatctttttttttttttgcaactgcaattgctgcctggcctcctgcgctttttgtcatgggggggtctcccagtcctgagcatagaggcaggcggagcagaggagggtcagaccctggggagatctcctctcatcacagaacaggcaggactagagcccactggtctccaccttcaggtaactgaccccacctcagaccccagctgggagcagacagagagtttattgattgattggtttttatttttatttttattgagacagagttttgctctgtcacccaggctggagtgcagtggtgcaatctcggctcactgcaaagtcttcctcccaggttcaaatgattctcctgcctcagcctcctgagtagctgggattacaggtgcacgccaccacacccagctagtttttgtattttagtagagatggggttttgccatcaaaagttggtcaggctacttttgaactcctgacctcaagtgatcctcctgtcccagccgagttctatcttttctgtcgttgcggtgtcggcccagctggcagagacaagtgctgaacacacgaccacataaacaactttgctcctgcggggaaggaggtgagctggtgccggagccgcctcagggccctgtgaggaggaggccattcctgctgaggctgggtcagccaggccgccactctgcctgcgtcctccatggctgcaatgccctccatgggaagcccaggccaccgggtctggcctcctttctggtctgggcttgctctgctcatggcctcacatgagctgcaggccccctggagccctcttcctccagacgtccttgcagcccgcccacctccttcaaggccttgctcaactgccacctccccagagaggactctgggaccagcccctccctttaatgcactcctccttgcccacacataggagcaggtgccacgggagcgggtgccaggagagcaaatgccacaggaccaggtgccacgagagtgggtgccatgggagcaggtgccaggagagcaaatgccacgggtccgggtgccacgagagtgggtgccacgggagcaggcacgtgtgtccacttcctcccccactccttcctcaggctgaaaacagcaagtggagtatggcaggcatcgctccagggctgtcaggagcagtggggttggatgcaggggtgggctgggaggtgggatgctgaggcaatcgggggctgggccagtcagaggtgagtacaggggagggacctccaggcagagggactggcttgagcaaaggcttcgaggtggaggttttaggtgggtgaggagcagaaggccaacgcgggtggctgaggagagggcaaggaagaagaggcaggagtccaccgccagtgccaaccaggggcctcggggcaccgctccaggagcaaccccagagtgcatccacctcctcccgggtgggccacgccttgaggtgctgacggcgccccaaactccactccccggaatcggcccaggctcagccacatcggcccgggctcctacagaagccgacctggagacgaggaactgacctggagacgaggaactgacctggagacaaggaactgactgcaagtggaccatttgcagggcgaccccaagggcaggggagtgagatgggagggcaagatccccgaagaagtaggcgccatcagccagtcactgctgaggggagtggcacctcctccaggtgggggtctctggggaacgcgtggagcacagctcagagctgccccagggctgggagtgagctatgtgcacaccggctccctccagccaccagacagatgctccctgcttggggctgctgcgtggtcacaggctccagcagccaaacagaggtgggacctggctggtgggcacccctctcccctccctccctctccatctcttccccactcccctccctcctcctccatctcctccccctcccctccctccccctctatctcttccccactcccctccctcctcctccatctcctccccctcccctccctccccctctatctcctccccactcccctccctctgcctccatctcccccctcccctccctccccctccatctcttccccactcccctccctatccctccatctcctcccgctcctctacctccccctccatcccctccccctcccactcccctccatctcctccccactcccctcttctccctccatctcctccccactcccctctccctccatctcctccccactcccctccatctcctccccactcccctcttctccctccatctcctccccactcccctccctcctttgccctctcgctccccactcccctcttctccctccatctccttcccactcccctccatctcctccccactcccctcttctccctccatcttctccccactcccctcttctccctccatctcctccccactcccctcttctccctccatctcctcccactcccctcttctccctccatctcctccccactcccccctccccttccatcacttttcctttgccttcttctggtcccagaaggccggcaggagaagcctcatttcctcctacctgggtagatacaagcatgtttaaaagaaaacaggcacaaatgagaaaaacttcagaacaccacggggcagaagaaaacctgacttcctactcctgtggctgagaaggcctctggccccgtctctcaggacagaccactgctgttgggggacagtggccagctcctccttgtggctgtctctggctgcccctggtccatatcacctccagtgctgtactttctctccccagaggcgggtctatgtgggtacctggccttattcatgagcaaatgccatggcccccggggggcaagagcttgtggtgagcaggattgttctctgcagatattagtgatcattagcaatcattaattagaatgataaataaatgattgacggtgacagtgggaaggtctctcttgggagtgggttcccagtggacacaggggacttggctgagccatctacctcaccctcacatgggatcagaggctctgacacccacctgggctgcccagaggctggttctgtgagacccacctcatgcacaggatgaggctccgatggagaggcagcccggggttctggtgtgtaaaggactgcagggagtccaggtctccagagtgggtcagtgtccaccatccacctcatctttgccaggagaacccatgacacacccacctcatctttgcaggaggaccctgacacacccacctcatctgtgccaggaggacccgtgacacacccacctcatctttgccaggaggacccagacacaccctcctcgtctttgcaggaggaccctgacacacccacctcatctttgccaggaggaccctgacacacccacctcatctttgccaggaggacccctgacacacccacctcatctttgtcaggagcacccgtgacacacccacctcatctttgccaggaggaccctgacacacccacctcatctttgccaggaggacccctgacacacccacctcatctttgtcaggagcacccgtgacacacccacctcatctttgccaggaggaccctgacacacccacctcatctgtgccaggaggacccgtgacacacccacctcatctttgcaggaggaccctgacacacccacctcatctttgccaggaggaccccgacacacccacctcatctttgccaggaggaccctgacacacccacctctttgcaggagaaccctgacacacccacctcatctttgccaggaggacccgtgacacacccacctcatctttgccaggaggacccgtgacacacccacctcatctttgcaggagaaccctgacacacccacctcatctttgccaggaggacccctgacacacccacctcatctttgtcaggagcacccgtgacacacccacctcatcttttccaggaggaccctgacacacccacctcatctgtgccaggaggacccgtgacacacccacctcatctttgcaggaggaccctgacacacccacctcatctttgcaggaggaccctgacacacccacctcatctttgccaggaggacccgtgacacacccacctcatctttgccaggaggacccgtgacacacccacctcatctgtgccaggaggaccctgacacacccacctcatctttgcaggagaaccctgacacacccacctcatctttgccaggaggaccctgacacacccacctcatctttgcaggaggaccctgacacacccacctcatctttgccaggaggaccctgacacacccacctcatctttgcaggaggaccctgacacacccacctcatctttgccaggaggacgctgacacacccacctcatctttgcaggaggaccctgacacacccacctcatctttgccaggaggaccctgacacacccacctcatctttgcaggaggaccctgacacacccacctcatctgtgccaggaggaccctgacacacccacctcatctttgcaggaggacccatgacacctggccttgggttgaactccttgctcctcttttcctcgggaccctgagtgagtcatatcctactctgaggtccacatctgtcaagtggggaccgccgtgctgacctcacgggccgcgacacgggttagagacagggtgtgggtgtgtccagctcacagccctgtcgcactgggcgggtctgcccagggaatggacaggtgtacctgcaggctgtggggtggagtctccacatggctgtgacaggtctggggaagttcttagagggcagctcctctgtccatggtgctgaaccctcatcttgcggggaaacatcactttcccccactcctgagccccacgaatgagccaggtggaaggaaaaaggtgttgggagaaaaggaaaggcagagaaagggaaaagaatcaggaagagagagggagagagaaagagaaagaggtgaagagagagagaaagggaggccaaagagagcaagggagagaggaggcaggtggtctgagaagccaatgagggcacctcctcaagacaggacagagagcagcttttgttttgacatcattgttctgacatcaccctctctaaggagcacgtttccctgtggttatttcccaccttcctccttcccaagggttccacctgtgggtccctgggcaggtctgtgtatgagcagagctgccatttatgtgcatgcgacgtatggatagagaagtgtgtgtgcacatggacatcacacgtgcacccatgcacaagcctgcacacacgcacccatgtacacacacacaagaactcacacaacttggaatgtgctacagggaggtgaccacgcacagctgggcatctggttaagtgacctttgctgttgtccagcgctggagatgaagccacagtggacagtggggagggagctgtctgtagagtgggcggaggacaagctgcagccctaaggttgtccagcgctggagatgaggccatgatgggcagtggggagggagttgtctgtagagtgggggcgaggaccacggtgggcagtggggagggagctgtctgtagagttggggtgaggaccacagtgcgtgggctggaccctctcaagggcaggctccaggtgtcctggcagctgtgcctgtggccttggcaatgggggtgtcctgcagaaactggactcatcacagagctggacacaccccaggccctgcactcagaaaagccaaaggagggtcaggccactgggtcataggagcagaccctgccacagccacacagcaaccagcaactctgcagatcagggacaacacgagaactatgagggggggccacctccccaccggactcttcgagtctcccatgcagaaacggagctgagtccagcctgggtgacccaggacagagccactgcagtgaaggggcagcaggaaccggctctgggcagccagctgtggtttgcagttggttcctcttaggtcaggtctacgtcccgcctgtgagccccgctgtccttgtccttggaacttacctaagggtccttggaagaaactgccagacctcctcctctcaaccccttctggctgcatatgaaacttctcactgtttcttctgactccagagaagcacagaaagtttactaatctgggaagttaagcctctactttgccctcatggatgtgtgccatcgacccatccacccatccacacacttattcacccaccatccatccacccacccacctacccacgctttatccatccacccattcatccacccatctatccatctatccatccacccacccacgcactcacccacccatctatccatccaccgacccacgcactcatccacccatctatccatccaccgacccacgcactcatccacccatctatccatccacccacccacgcactcatccacccatctatccatctatccatccacccacccacgcactcacccacccatctatccatccaccgacccacgcactcatccacccatctatccatccacccacccacacactcacccacccatctatccatccaccgacccacgcactcacccacccatctatccatccacccacccacgcactcatccacccatatatccatccacccacccacgcactcacccacccatctatccatccacccacccaagcactcatccacccatctatccatccacccacccacacactcacccacccatctatccatccacccacccacacactcatccacccatctatccatccacccacacacgcacacacccacccatctatccatccacccacccacgcactcacccacccatctatccatccacccacccacgcactcatccacccatctatccatccacccacccacgcactcatccacccatctatccatccacccacccacgcacacatccacccatctatccatccacccacccacacactcatccactcatctatccatccactcacccacacactcatccaccatctatccatccacccacccacgcactcatccacccatctatccatccacccacccaagcactcatccacccatctatccatccacccacccatgcactcatccacccatctatccatccacccacacgtgcacctatccacccatctatccatccacccacccatgcactcatccacccatctatccatccacccacccatgcactcatccacccatctatctctccacccacacatgcacctatccacctatccatccatctacctattcacccacccatccatccatctgcctattcacccactcttctgcccacccactcatccatccatccatccatccatccaccccacccatcatgcgttcatccattcatccacccacccattcatccacccgttcatctatccatctgtccactcatcctccatccaccccacccaccacccatccacccattcacccacccatccattcatctgcccatccactcatcaatctgtccactcacccacccatccacccatccatctatccatccgtccacccattctccatccaccccatccaccatccatccacccattcacccacccatccatccatctgcttattcactcactcctccacccacccactcatccacccatccatccatccatccatccatccatccatccatgcatccatccacccacccatccattcatctgcccatccacccatctatctatctgcccactcacacacccacccacccaccatccatccacccatccatctatccatccattcactcacccattcctccacccacccacccttccatgcacccacccacccttccatgcacccacccacccattcatccacctgtccatccatgcacaggtatttgctgagctggtgccacatgcactggcactttgctagcctttgggaagcacaacagtaaaacacaggtcatgtttacctcaagtttccaatctattgtgaagctgcaggcagaggcgaactcatcttgggggcttgcaggacacaatcccatgaggtagagaagtaaatcaggcagaggtgaacgcatcttgggggctgcaggaagtaaaaacattagcacctgggtttgtgtgtcttttcatcccatctcattctttatgtgactccttctgtataccagttttacagtgcaggggggtgctcaggcacgtctctctgtttaggggctgcaaggaagtgagccactgggtggctgagccacgtaaacaagaagaggagtaacaatctaaactgaaagggcttgtggctgggtcacagtctgcaggagaagggagggttcatccgggtcttggatgaatttgttggatgggaagttggtgaagaacattccgtgggcaggacaggtgcagccagcaggggtggagaatgagaagacactcagggcatggagttttggagctggggctgcaggaggcggggacagaggcactgtcgatgggtatggctttgatgctggttcgcaggcagcctgaattccacctggtcgatatcagaagctgctgaaggaggatgagggcatctggcctcagccatgagactgattgaagctctgtggggaccaggaggaagtgggggctgaagctgctgggcagggggttgggggagatctggctgagtctgaaaggtaaggtgctgttcgcagtggcaggtgtgtcattaacttgctgtggaaccaaacacccagatctcagtggcttcaaacaacagcaatgtgccattctcctgggctgacagttggggatggcagctggcgcccctcgggtctcctacaggcagccggcagctccttccatggggttctctgggcggctgcgcgagggcagaggtggaggccacgcagcctcttagggcaggacaccacttccaccacgttctgtgggtcaaagcaaatcagacgcccacccaggctcaggagggggacctccacctcttcatgggaatttcagcaaatccctgtggtcgcagcgccgggggcccagtgtctcccgagtgcgtccacatgtgtgctgaatgcaggctgtggagtgcaggggagagaggtgagcgcctgggcgggtgagcggggagaggtgagcacctgggcgggtgtgcaggcagagaaagagtgaggaaggtccaccttcagctggagctgaggacagggctgcatttggggaggaaaaggggccagatgggagttctgtgccaggctggggttcgggtcaggaaggcttctccacagagcggcgtgatcacatctggatctggcaggagtggggaaggacagtcaggagtcgatggggagatgggactgggtgggggcagcaaggatggaaggtggggagacagacgctgtggaggcccaaggggactctggctggtgaacgaggacacccccaggctctaggcccccaccccagggcggagaacccccacttcccaggtcccgagggagccctgtctcacttctccgctgaggccaaggctcgtttccaaagaggagaggaagaggggaggggaggggaggggaagggaagggaggggaagagaagggaggggaggggaggggagggcaggggagaggaggggaggggaggtgagggatgttcagatcaagagccccactggggagagctttaaaaaatgcaattaaatggaaaataattaaatccaattaaaaatgagcagtggggggtggggagtggggggatgctgggactgcagggaaggcttgggctgccctgtgcagtctgcagtcttcctgattgcactttcgaggtggaaaaaggaggccagacctggcccccaacactgtgggagcgcccagtggctgcaaagccggggccaccaggccacgctctcctgggacctgccccgctggaccggggacgtctgtcaccgcttctttcccagccgctctctcccacctgctggggctccccagggccccaggccccctttggaacacccagtcttgctctcctccagtcaagccacattccatgagagcacctgaaggggattggctaggggccgcctcgagaccctctggcgtggaaaccgtcagctggtgagcacatgggccagccggggtgtttgttacatgtgcatttcctgaccccgcccagtctggctggatggatcctgggcatctgaatttatgtgaagcccaggtgggtcaggtggcagtcaggtggctcaggtcacacctggagaccccatctagtgccgccccctctttacagagcattgcctggggccctccttgctgagctgagggacggcccaggctgcatccccccgccaggaggtggcctctgctgggtcctggagagctggttcccgagctaaggccagaggtgctgctgaggggtctttgcctaggccactagcaggggctggatgaggaggggggccacggctttggcggctggtgcctgaccttggcagaaggaccaggagggggacggcggctttggcggctggtgcctgacctcggcaggaggacgaggagggggatggcggctttggtggctggtgcctgacctcagcagcagccttccccgatgggcttctgggaacttgctgcctcctccctgggctcccagctgcttccctcccctgcagcacccctctcagatctgccacggctgtatgcaggtggcttcacccctgggctgggagctggaggaggcagacctaacaggcggtgggcccagcccagcagacatagccgctgctcacagcaaggagtgcagggacctcagcaaggctggctgccaaggtggaaccactctgccgaggctccctgcaccctgcacgaggctccccacaccctgcccagggctccctgcaccctgcaccctgcccggggttccctgcaccctgcaccctgcccgaggctccccgcaccctgcccgaggctcctgcaccctgcccgaggccccctgcaccctgcccggggctggcatcccacactctgcacaacaaacgcctggtcctggggcacgggggctgtggggaggcgaactccacgcaggagcagggggctgaggagggcctgtctgccccaattaacactccaggatcatcgctgagcagaaaccccattcttggaggtagggcctagagaggcctagagaagacatcatttttaatttaaaaaaatgtaaatgttaaatagggaagacatgcctataacaccaagcccaacagctagcacagtcaacagtcagcacagtcaacagtcagcacagccaacagccagcacagccaacagccagcacagtcaacagctagcatagtcaacacccagaacggtcgacagccagcacggtcaacagccagcaaggtcaacagccagcacagccaacagccagcacagtcaacacccagcacagtcaacagccagcacggtcaacagccagcacggtcagcagctagcatagtcaacacccagaatggtcaacagccagcacggtcaacagccagcatggtcaacagccagcacggtcaacagccagatggtcaacagccagcacaatcaacagctagcatagtcaacacccagcacagtcaacagccagcacagtcaacagccagcatggtcaacagccagcacggtcaacagccagcacggtcaacagccagatggtcaacagccagcacagtcaacagccagcacagtcaacacccagcagagtcaacagccagcacagtcaacagctagcatagtcaacacccagaatggtcaacagccagcacggtcaacagccagcaaggtcaacagccagcacggtcaacagccaagcacagtcaacacccagcacagtcaacacccagcacggtcaacacccagcacggtcaacacccagcacggtcaacagccagcacggtcaacacccagcacggtcaacagccagcacggtcaacagctagcatggtcaacacccagaatggtcaacagccagcacagtcaacagccagcacggccaacagctagcatagtcaacacccagaatggtcaacagccagcacggtcaacagccagcatggccaacagccagcacagccaacagccagcacagcaggaaaaatagtcagttcccctccatctgcaacccccaagggccacagtgtcttctgaatcctcccagagatgggccctgctcaggaaagcatgtgtctgacactgtgtatctcacatgcacccacacatgtggcagcaaagcccagaatgggggtctccatccacagttcacatcaaaatcactgcagaggtgttcacgtcctcctaaagctcccacggtgaaatcctaccctgagaggatgagtgaggaggtggccttcgggggagggtgagtgaggaggtggccttcgggggagggtgaatggccttcgggggagggtgagtgaggaggtggccttcgggggagggtgaatggccttcgggggagggtgagtgaggaggtggccttcgggggaggatgagtgaggaggtggccttcgggggagggtgaatggcctttgggggagggtgagtgaggaggtggcctttgggggagggtgaatggcctttgggggagggtgaatgaggaggtggcctttgggggagggtgaatggccttcgggggagggtgatggcctttgggggagggtgaatgaggaggtggccttcgggggagggtgaaggccttcaggggagggtgaatggccttcgggggagggtaagtgaggaggtggccttcgggggagggtgaatgcccttcggggggcagttagggcaggaggctggggtccccccgatgggatcagtgccctcaccaaagaggccaagggagacccctgggagtgcacagagtgaaggcgtcacccacagccaggaagagggccctccccgccccgtcctcggacgctgatggcagattccagcctccagaacagtgaggactagatccccgtggtttcagccccgcagcctgtgatgatttgttacagcatcctgagcaaagacaatcaccgaggcaagtttttaaaaattcagaagactggccccacccccacaagctgcatccatcccagtggatgggtttgggcagagcgggttttttgttgttgttgatgtttttaacttcgtagacaatgttagtattcagccagtgctgagagccgcacgatgcaacgcagccctgcagcttgctgtttcttgctgtttctcctgtaagatagctggttctgcttcactacgattctcccaaacaccagagccctgatcatacttaacccacagccagctgtgcctggggaagactctggggccgtcctccgtccaccgtctgcgaggacgtggggatgggcccctggacagtcagagccacgggatggcccttaagtggagttgctgccgcaaagcgtttatgattcaaatggaatcagactttgtctttccagtgtcatatgttggggagagtgagacacagagtctggtccgatgtggggagggcacacccctctgtgcttgtcagcagcatggttggtcgctgatgtcatctggaggtctgggctgaatgaaagggggtgcgtgggtaaggcagtcacatgtgggctgtgcagggatctcagcatggctcttccagcctccattccagctcttcctgcctggagaggatgaaacgctaactccactgctcgctcttgcactgggcttctggctatagatgagcccccaccagctagacgtactcacaagctggaccagcaggcaagagcccatggccacttctgatgacagcacagtcaggagacacgactccctccgagcaaagttttaaggagcaggcagagaatggctggcaccctccctattccagcccatcctcctgagcccagcccagcctccggaagcaggaggtggtgcggccatcttcctagtccccaggaggacaagaaccgggtctgtctttcctaccagtgcctgagtggttctgttttcggggctgaatgtggactgatgcaatgtctcctttcccagaagcacccgtaggaggggctgggctgcagggacaaggatccgaggggtcagctgtgcaccagggaaggatagcttccccccgccatggcaggaagggacacggtcacgtccacttcagggcttctggacccagcctcaccccaccccactgcagggaactcaggcagctgctaccccacagagcaggccgcaggtggccccaaagcacatggtcctggtgtggagtggagtttggattttttttttttttttgagacgaagtcttgctcttgttgcccaggctggagtgcagtggcgtgatctcaactcgctgcaacctctgcctcctggatttaaatgattctcctgcctcagcctcccaagtagctgggattacaggcgcccgccaccacgcccagctaattttttttgcatttttagtagagacggggtttcaccatgttggccaggctggtcttgaactcctgaccttcggtgatctgcctgcctcggtctcccacagtgttgggattacaggcgtgagccaccgtgcctggcctggattttcttttcagagcagtgggggagccctgggagtgctttaggagcaggagcagcaggaccgtacactgagaaggagataccacaggtagaggagctgggaccagcacgcctggggcagggaggggcaccgctcgcctggagggttcctgggtcctggcctctgaagatcaaggggaggagcctggagccaaaggccccagaaggaagaagcgaggtcccggcaccaagggcacgggatggcagccactgggaaagcaccacggaagccgcatcggcaggttcctgctgccaccccttggtgccaggtacagggcaggacgcagaggggaagctggcccaggaatgccgccacaggaccccgcgggaccccctgcaggtgtcggaggggctgcccagaccctgcccagcattctgcaggcagcttgagtcccggggggctgatgaagtaggggctggaccccaaatctccagacagagcagcatccagttactgtgcagagacagcacatctcagtcaaagacggggccaggagggcggtggtctcctctggagcccctcttcctcccactggcagccctgcagactcccagagcaagctgcacaaccacaatcacaccttctggttcaccaaatattcatggagtgctccgcgtgccggcaccgttctggacacagacgctccccatgtagacgctgagaggcagccttgcagacaagagtcctcagagcagccagcccccgagtcaggtggatccccctggaacagccagccccgagtcaggtgggtcccccagagcagccagccccgcggccatgtctagagcccctggagcagccaacccctgagtcaggtgggtccatttgctcccggtcaagcgcagggacgcgtcccaggggcgtggttacaaggaggacttctgggaaatttgtttctggctcttaagggagatccacaggaagacacagctccctttttctatgtgttactccctactctgggtgtgataccccacattgctgagtcatcttgctaccaaactgtcaagaaccgtgagaggtctgaggctaacacattggcttgccattgttttaaagatgctagtggaatacacgagactcctggatcagaagcgaagacctttattactcatggcacagcaagcagcttgaggtttttgtttttgttttgtttcattttgttttgagacagagtcttgcttttgtcacccaggctggagtgcagtggcatgatctcggctcaccgcaacctccacctcctgggttcaagtgattctcctgcctcagcctctcaagtagctgagattacaggcacctcccaccaagcctggctattttttttgttttttgtttgtttgtttgttttttgtatttttgtatttttagtagagacaaggtttcaccgtgttggccaggctggtctcaaacttctgacctcaggtgatccagctgcctcggcctcccaaagtgctgggattacgggcgtgagccaccgcactcggccaagcttgagtttcatggctgccttggtttcccaagccctgatggtccaggggatgcttcgcacagggtgtttgcatcacagtggaagaaacacgagctcagggaactcgcacaatgggccacaagcaagcgtgcctgtcctttatcctggaggaaaaggcatctctatcacactgaacagcaaacaactttgccttctgctttggaggggatgttctctttaccaaggctgtttgcagagctaaaatctttgcaaagatcatctggaacaaaaacgatcagtgtctctgcttgcaagatgtgcagaaatgccacagcgacaggcccatgggaaattgtctcccaatggcctgaagacgcaaaaagaataagggtctccagtgacattatggagccatcgtgtcagcccacgcgggacctgcccctctccggactcctgtccgggaactcctttccttatcctctcaggttgtcgctcgcagccacagcatccgaggcgacctgcttcatgccgtgatcccctctaccaggtttcgtttagtccttacctgccactgacagtgtgatttgggacagatgattaaaatcttgttatctcactaaggtgtggtgagggccaacggagattttatggtgaatgtgcttagaaaatgacagagtagtatatcggccgggtgcgatggctcatgcctgtaatcccaacactttgggaggctgaagcgggtggatcacctgaggtcagaagttcaagcccagcctgaccaacatggtgaaaccccgtctctactaaaaatacaaaaattagctgggcgtgatggcgggcacctgtaatcccagctactcaggaggctgaggcactagaattgcttaaatctgggaggcagaggttaacagtgagctgagattgtgccaccgcactccagcctgggtaacagaacaagactgtctcaaaaaaaaaaaaaaaaagaaaaaagaaaaaaagaaaaagaaaagaaagaaaaggaaaggagaagagaagagaagggcatgattattttttacttttcccctctttccctggtcgcaggctggcccctgacttcatttcctggtgctttgttaaaatgagttaagtgcgagttcaggagagaggagcccctcattcactgcacaccccgccctccgccccttggtgaacttttgtcagagagaggcctgtgacccaggcgagggcagagaaggcagaacccatgttctaggtgggcaagagaggctggaggccgtcgcaggcgcgctgacgcccagcagcagccaccggagtgagacaagcggttggctctccctgcaccggctgcgggagccccagctgctccacgtccccaccaaccttggttttgtgccttcttcactgtagctgttgggtgggtgtgtggtggcgtctctctgaggctgagcacttttcatgggtttcttggccatttgggcatccatcgtcctataaatcttactaatttataggagttctttatacatttgaggaaacgacagtttgaggacgttgaggctggaggtgtgggtaccatccctccacctgtctgccctacccagacctgtccccagcaccacaggccacctcttcacatgcacagcctgagtgacagcagcgtttcccagcaggggctcaactcacagacgcctctcagataaaaggcttcatagtggacccatggtgcccacagcacacgggagcggctcagggaggtcctgcagccagcacaccagttcagccctgtctggccgagagctttgcacgctcatctaaccatggtttcatggaatgtctgtgatatctcatggaagtcaagtcacgctctgggaaagaagagtgggaagtgctgcgccagcctaacccctgcccagagactcacatgtggacgcaggatcttgtatgtgcacacacaccctgcatcctgcgaccgacacgcatacacacctcccaccacacccggcaaattttttttttttttgtatttttgtatttttagtagagacgaggtttcaccgtgttgtagagatggtgctcacatgcacccacagtcacactcacacacacgctcacactcacacgctcacaggcacgtcacatacacacactcacacgctcacaggcacagtcacatacacacactcacacgctcacaggcacagtcacacgtgcacccacagtcacacacacacacactcacaccctcacaggcacagtcacatacacacactcacactcatacgctgacaggcacagtcacatacacacactcacacacgctcacaggcacagtcacgcatgcacccagtcacatacacacacgttcacatgcacactcacacgcatacacacacactcacaggcacgtcacacaggcacccacactcacacacatgcacacacacaggcacatcacacatgcacccagtcacacacatacacacacactcacacacatgcacagttgcacgtgcacccgcactcacatgcatccccacctggtgctgcccccagggtctgggccattcaaccctcagggttgcccaggtctcttgtcccccctgcagcaggaactgcctctgcagagtctctctctgtccttcggggtctgggttctcaggagctgagatctcttcatcagtgaggggaggggaggtggcagttgtggcctagtccaacccacatccttggacctgcccagagagacccctctagcagccccagcttcccgtcccctaacacagaccccattctggacctggggttcccggccctcccggcccctcaccccttccccacctccactgctcggggctgactctgccatgcattacattccccgtgtacggcaacagctggctgagcttaattaagccccacagtgccgggttccacctggcgaggaattaacaacaataacaaaatagcaaacaccggaggagggggtctgcagaggcaggtctggggcctcctgcttctcccagagggtaggaacgtggccagggagccactggcctctgcctccagtcctgaggccacctttgggggcttgctgtcagctcctggtctggggatgacatggccagcccttgccactcttcccagcgggacagggtctcaaccaacgaggggtctccatgtcctttgctgtgtgaggggcggcagctggttgcccacccacaggggaggaggctcagggtacctaggctctgtggctcacctgttctgcacacacctgccgagaaccatggcgtgtagggcactgtgtgacaggttcccagctcaccagggtccaggcagaacggctggagtgagacggacacacggcgtgcaggtaccttgggtgtggacagggggcactgggcttgccttggaggagtggcaggggcttctctcactgatgtctgagcttcgtctgggggatgtgggcaaaggtggtgtcggcaccaggagcctgggaagaggctgggcggtgcagcagagtgagtggagttccacggaccctgaggctccccagcctgtgctctgcaggggtggctccaggagggccctgagttttggccttgcggggctggagctcagaggaggcacctctagcatcacacattaaggggcagaacaggaatttaagttcaggatgcctggctcctaagctagggcctcatttctgtaccagatacacacccagtcatccgctgcctggggtgggctcagcaaggatggagctgcaagggagggtggggctccctcagaagcaggcgcctagagatgacaagagacggggcggtggctggggacccccaggcagcacttctagcagactgagcgtcggacaggttagcagatgccgaggcccacctgtgcacacagattgattcctttaaataagttatttatagcttgtacccatctgcttccaaaaggggtttgggaaatgcaagaaaaaaacagaacattggaaacagaactagcagtttatcgcagaggcacaagaaaaacagaatagtgtaaatagaactagcaggtgatcgcagaggcacgagaaaaacagaacagtggaaatggagctagcaggttatcgcagaggcacacacacacacacaaaaaccagaacagtgggaatggaactagcaggttatcacagaggttgcagggatcatcgtgctccaaaccatcctaaggttttgttctggacttcctggcacctgaagcaaaaagggaaacaaaaaggtgttgtgagctttcattttgtgtttggcttttccaatttttccgaaaatcacaggagaggtaaaagctttcacagaaagagtgcactgtgccatgaggaacctggaatgggtccctgctctctgatctcaagaaaatcaacaacctgtttggtcttgttttcgtctctggtgaaatgggaataataataatgtccaggctgggcgcggtggctcacgtctgtcatcccagcactttgggaggctgaggcaggcagatcacctgcggtcaggagttccagaccagcctggccaacatggtgaaaccccttctctactaaaaatataaaaattagctgggtgtggtggtgcatgcctgtagtcccatctactcgggaggctgaggctggagaattgcttgaacctgggaggcagaggttgcagtgagccaagatcggaccactgcactgtgaccaataaataaataaaataataatcacaatagtgcccacctgcttccctgggaggatgagaggcccaagggaatggatgcttgtgaagtgcagtcaggcaactctggggggctgtgaataagaggggtattacgttaagctcctggagggtggggttgccatccaccgctgccctaggtgggctgcttatccttggttctcaggtccctgcctgaggttactaccaacaccgcactctctcagccagcaaagggtttttggtttggagaacaaagtctatggttatcatatccatgtatatgcctatttttggttttgtatttattttagtattatttaaaatgcagttccttatctcgaggagctcatgttgcagaagagtctagacaacaggagggaatcccaccaagggcagtgttgaaagatttcagtgggttccacagtttcctctcttctcatacgagcctttgtcttttgcaccaaacactcatgcgtgagagagaaaaggagatgagggagccaggctctgagtaccttccctgacgtgaggtgtgaagacagttctgccacttcctgtgtgactttggcaaggcactgaaacactcagccacttacctcgtctatgactcagggttgtaagaaatggtcagtaaatcaccaggtgtcgtggctgtggtagatgctgtagaaatggttcatgacagtgactgttctcaccattgccccaattgcattcaatctttccagactgttcttcagtaaaagctgatgactcatccttcccagaaccaaacaacctattctttcagtgggggaggttttcaattatgattgccattttttttaaaaatcagatgtcctttcagagtttctatttcttcttgtgtcagttctggtaatttgtgtcttttaaatctcagaagatttaaaccttaaatgatttaaatcttttgaatttattgacatgttttatagtgaatgatctaagtacatttgaaaaaaaaagtatgtgttctgggtgggtgggagcatcctattaatgccaactaggtcatgttggttgatatgttgtgtttgtcttttgcatccttgctgattttctgtctacacattctgttgctgagagaggagtattgaacgccctagaaatttgtccattccctctactgtcaagtttattggcataaagttgttcagaatattccctaattctccttttaatacctacagggtctgtggcaatgtgttatctttcattcctgttactggtcatttatattctgtctctctagtaatctaggagtttatcaattttatcaatattttcaatgacctaacttgtgaatttcttgacttttctctatggtttgttcattttctatttcgttgatttttgctgtttaatacatcctttttgagcttaatttgttctttttctagattttcaaagtggaagtttagatcatttgttttcaacctttagtctgctaacacaagcatttaaagctataaattcaactttaagcactgctttggttagagcaccaaattttgatatgtcatgttttcatttttattagtccaaaatattttctaatttcctttgtgatttcttgttttacccatatgttatttagaagtttattgtttaatttccaaatatttaaggacattttacagatatcttaatgtaattaatttctaactttatagtgagagaacatatcttatatgatttcaatcttttcatttgttgacatgttttatggtgaatgatctatgtgcatttgaaaaaaaagtttgtgttctgttctgggtgggtgggagtgtcctatcaatgtcaactaagtcatgttggttgatatgttgtttttgtcttttgcatccttgctgattttctgtctgcacattcagttgctgagagaggagcactgaacgccctagaattgtgggtttgtctgtgtttctctgtggatctatgttgcttcccatattttgaaactgttattaaatgtgtgtatatttaggattgttttgtgtttctgatgaactgacaagtttatgactatatgttcctccttaattctgataatatggtcttgcagtctattttgtctgatattaatgaaatcactccagcttgcctatagtactatttgtgtgatgtatctttttccatcctcttactttcaaactatctgtgctttatatttaaactattctcttgcagacaacagatggttgagtctagcttttttaaatccagactggcaatctttgcttttgtaaatttaagttttattatctttgctttttaactgaagtgttagtcaatttacacttaatgtaattattgacatgtttgggcataaatcatcttgctatttgttttatatttgtcccccttggtttttgttttgaattttcctcctttcttgccttcttttgaattatttaattatttcttagtattccatattctttaataaaaaacatttatttagagatggggtcttactctgtcacccaggctggagtacagtggcacaatcctagctgactgtaacctcaaacccctgggctcaagcaatcttcccacctcagcctcctgagtagctgagactagatgagaggcactgtgcccagctaatttaaaaaatctttttggagagacagggtctcactgtgttgcctaggctggtcttgaactgctgggctcaagtgatccttccacatcagcctcccaaagtgttgggattacaggtgtgagccatggtgcctggccattttatttatttcatatacgtatacgtgtgtgtgtgtgtgtatttatttatttggaggctacacttctgtttaggattttaacagctgcaccaaggattacagtgtctaccttgcatttatattattttgcttcatgtagaatggaagaaaattgcaatatggtaccatttacccatgtttgtgtttcagtcatacattctacttcacaaatattatgactcttataatatctttttattatttttacttaaaatggtcagttgtctttaacataaaattaatacaggagtaaagcacactttatattaatatatgggtaaagcagactttatattaatacatgagtaaaggggactttatattaatatatgagtaaagcggactttatattaatacaggagtaaaggggactttatattaatatatgagtaaaggggactttatattaatatatgagtaaaggggactttatattaatacaggagtaaagcagactttatattaatacatgagcaaaggggactttatattaatatatgagtaaaggggactttatattaatatatgagtaaaggggactttatattaatatatgagtaaaggggactttatattaatatatgagtaaaggggactttatattaatatatgagtaaaggggactttatattaatatatgagtaaagcggactttatattaatacaggagtaaaggggactttatattaatatatgggtaaaggggactttatattaatacaggagtaaagcagactttatattaatatatgagtaaaggggactttatattaatatatgagtaaaggggactttatattaatatatgagtaaaggggactttatattaatatatgagtaaaggggactttatattaatatatgagtaaaggggactttatattaatatatgagtaaaggggactttatattaatatatgagtaaagcggactttatattaatacaggagtaaaggggactttatattaatatatgggtaaaggggactttatattaatacaggagtaaagcagactttatattaatatatgagtaaaggggactttatattaatatatgagtaaaggggactttatattaatacaggagtaaagcagactttatattaatatatgagtaaaggggactttatattaatatatgagtaaaggggacttaatacaggagtaaagcagactttatattaatacatgagtaaaggggactttatattaatatatgagtaaaggggactttatattaatacaggagtaaagcagactttatattaatatatgagtaaaggggactttatattaatatatgagtaaaggggactttatattaatacatgagtaaagcagactttatattaatatatgagtaaagggaactttatattaatatatgagtaaaggggactttatattaatatatgagtaaaggggactttatattaatatatgagtaaaggggactttatattaatatatgagtaaaggggactttatcttaatacaggagtaaaggggactttatattaattcatgagtaaagcggactttatattaatacatgagtaaagcagactttatattaatatatgagtaaagcagactttatattaatatatgagtaaaggggactttatattaatacaggagtaaagcagactttatattaatatatgagtaaaggggactttatattaatatatgagtaaaggggactttatattaatacaggagtaaagcagactttatattaatatatgagtaaaggggactttatattaatatatgagtaaaggggactttatattaatacaggagtaaagcagactttatattaatacatgagtaaaggggactttatattaatatatgagtaaaggggactttatattaatacaggagtaaagcagactttatattaatatatgagtaaaggggactttatattaatatatgagtaaaggggactttatattaatatatgagtaaaggggacttaatacaggagtaaaggggactttatattaattcatgagtaaagcagactttatattaatacatgagtaaagcagactttatattaatatatgagtaaaacagactttatattaatatatgagtaaaggggactttatcttaatacaggagtaaaggggactttatattaatatatgagtaaaggggactttatcaatacaggagtaaaggggactttatattaattcatgagtaaagcagactttatattaatacatgagtaaagcagactttatattaatatatgagtaaagcagactttatattaatacgtgggtaaaggggactttctatttacttcatgtttgccacctccagggctcttcacgtctttgtgtggatctgaaattccatgtggcatcatttcccttcagcctgaagggcttccttcacatttatttatgtacagttcttctagtgattcattttctcagattttgtttatctgaatgctttatctcaccttaatttttgaaggacttttttttcctgcagagtgtaggattttgagctcacagttctaacactctaaagatactgttccattgtcctctggcttgcattgtttctgattagaagtcaaagattttgtttgttttgagagggagtctcactctgtcacccaggctggagtgcagtggcacgatttcagttcattgcaacctctgcctccctggttgaggcgattctcgtgcctgagcctcctgggaagctgggattacaggtatgtgccacgatgcctggctaatttttgtatttttagtagagatggggtttcagcctattggccaggttggtctcgaactcctgacctcaggtgatcacccgtgttagcctcccacagggccgggattataggcatgacctgccatgcctaggctctttggattgtttttatgtatccatcttcaagtttgctaaccatttcttctgtagtccaatcctctgttggactcatctagtgaattttaaattttagatattataatatttagttctagattttttaatatcatttccccttccatagtttccattcttttgagaatctctatctcctcactcatgtctttctcttcttttaaatctttctctttgaattccaacatctgtgtcatctctggctctgttctatcaacttctcttctggttaaatttgcctgcttctttgcatatataataatttttattgtatgctgaacatcatggaggctatattgagagtttggatgatgttgtcatctttaaagatgggaagttttgttctaggagatggctgtcagcttgagtttagactttgcgagggcaggttctcaagcaatccttagcctgtggctaggatagtcctcctgagacctgccttactggggttgtcagcgaggtctttccactcaagctgtttgggtcacacagtgtcttccagcactgttttacctccaaactctttcctccatgcaaaacgctttgtcttggccaggccttgtgaagtccttcctatacggctcaagggaactcctgtacagattcctgggctccttttctttgcacagcttcctcctttctgttcgccgcaagttgcggacacctcggcagccccatactccccgctctgcttctctgcctgttgagacatctgtgctgggttgagtccccacttccttgtcctgtggtttggaaagtacctcccagcagaaagcttgggtgcacgtggaaatatctgttgt

SEQ ID NO: 127 - DNA, 10031 bp, Homo sapiens
aaaagaacacacaagtctgtcctatttgctgtttatattacttcatactttggctcccctgagctacataatatgactctgcaggagtgccagcctagatggtctacagaccggtggcctggggcaaatgaaggattccaaacccccacatgtggcttaggacgaggctgtcaccatatccaaaatcagtgctggctgctggctgcctaggtggagttattggttgttcttatccatcctcccacgggctaggcatggcgtaggacaagctctttcatctggaaggtctcgaagggttccctgtgcaggatttgggcctccaaaaaatgaagacaggccttcttttgtttttattatggaaatttttaacacatgtaaatgagaaaatagtgctgcatctatcactcaccttcacctctcagtattctgctattctagttttagctcgacccatgaccccctttttctctggagcgttttattttattttattatttcattttttttttcctgtgagacagagtctggctctgttgcccaggctggggtgcagtagcaccatctcaaccaactgcaaactgtctcccgggttcaagtgattctcctgcctcagcctcccaaatagttgggattacaggtgcccaccaccacatccggctaattttttttttgtttttgtttttgatatggaggctcgctctgtcacccagcctggagtgcagtggtgcgatctcggctcactgcaacctctgcctcccgggttcaagcaactatcttgcctcagcctcccgagtacctgggactacaggcacgtgccaccgcacccggctaagtttttttgtatttttagtagagacggggtttcgccgtgttaggcaggatagtcttgatctcctgaccttgtgatccgcctgcctcggcctcccaaagtgctgggattacaggtatgagccaccgtgcttggccttttattttttaagatggagtcttgctttgttgcccaggctggagtgcagtggcgcgatcttggctcactgtaacctccacctcctgggtttcaagcaattctcctggctcagcctcctgagtagctgggattgtagatgcccgccaccacacccagctaatttttgtatttttggtagagacggggtttcgccatgttggccagactggtctcaaactcctgacctcaggtgatctgcctgcctcggcctcccaaagtgctgaaattacaggcgtgagccactgcgcccggcctctggagcattttaaaacaaatcccaaacatcatgtcattccatctgtaaaaacttgatcatgcgtctctcccgaaggacctggagcctaggcttaggatctaattgtgctcaaaaccctgcatcagagccgggcacagtggctcacaccggtaatcacagcactttgggaggctgaggcgggtagatcacctgaggtcaggagttcaagaccagcctgaccaacatggagaaaccccgtctctactagaaatacaaaattagccgggcatggtggcatatgcctgtaatcccagctactcgggaggctgaggcaggagaatcgcttgaactcaggaggtggaggttgcagtgagccgagatcccgccactgcactccagcctgggcaacaagagggaagctccatctcaaacaaacaaacaaacaaacacccctgcatcaggacagaccacccagaagctggctgtcagagcattcagaaccatccacctacccggaagggtcctttgtcatacatggcagcgtaagtgtaagcaaactctcctatgaacactcgctcaaaccagcctttcagaatggcagggactccaaaccactgcagggggaactgtgggacagaagacatcattgaggtaagaccaggggctccccaagcccagaaggtggctcggagtgctgagccgctccccatgatggcactgtgtgggaagcccctcttcacacctttcccattcctcctggggagttagcactttaaggaaagagatcattattgtccttggtcagccaacttgacagtcttctttttccctgaaaatgcaaatattgagtgggtccgagtaaagctagatacacagaagacttgttgatatgaaacttgtttgtatgaaatcacatttggcagcaaagtctaaatagcaaggattgcaaacaaggtttgcttcatgctgttgcttcaatcagtattttcccaagagtttgctttagtaggtgtggtatcaacaatatgactgttggccaggcgcagtggctcaagcctgtaatcccagccctttgggaggccaaggcgggtggatcacttgagggcatgagtttgagaccagcctggccaacatggtgaaacctcatctctactaaaaataccaaaatcaaccgggcgtggtggcgcacgcctgtagtcctagctactcgggctgttgaggcaggagaatcacttgaacccgggaggtggaggttacagtgagccgagatcgtgccactgcactccagcctgggtgacagagtgagaccccatcgtggaaaaaaatgtaggccttcttcattttatgactgtcccttgttatcgtggatgaaaaatcatatcacttagaataaacaaaatcactcaaaaatgcaaactaataatcagtgtgatggctgagtgtggttgctcatgcctataatcccagtattttgggaggccaaggtgggaggaccacttgagcccaggagtttgagaccagcctgggcaacaaagtgagactttgtctctacaaaaaaatttaaaaattagcctgatgtgatggtgcacatctctagtcccagctatatgagaggctgaggcaggaggattgcttgagcccaggagttggaggctgcagggagctgtgatcaccactgtattccagcctgggtgacagagcaagactccatctctaaataataataataataataataataatcatcatcatcatcaacgtggctaggtgcagttgctcatgcctttaattctagcacttttggaggccaaggtgggtggatcacttgaggtcaggaatttgagaccagcctggccaacatggggaaaccctgtttctactaaaaatacaaaaagtcaagcgtggtggtgcatgcctgtagtcccagctacttgggaggctgaggcaggaaaatggcttgaacccgggaggcggaggttgcagtgagccgagattgcaccattgcactccagcctgggcaacagagcgagactccatctcaaaaacaaataaataaataaataaaatgttaaaaaataaaaattataataaataataattagggtgactaaggttcatcagggacttcccatgagaaagtcttgtctgacctcttatcctaataaaagcagagtaaggactataccaggaggttttcttatccttgattcatgatttaaagatatgaaaggcacatgcctataatcccagccttttgggaggtccaggcaggcagatcacttgagcccaagagtttgagaccagcctgggcaacatggtgagaccctatttgtacaaaaaaattaaaaaattagcagggcatggtggtgtgcactgatagtcccagctattcgggagactgaggtgggaggatcatttgagcccaggaggttgaggcagcagtgagcagagatcatgccactgcactccatcctgggtgaccgtgagaccttgtctccaatttaatttttttttaaagccgtcctttggggtactggctagtggcatgtggctttgattcttagcaacaggcctgtgggtaaaataaaggacttcaaggattggatgttttgtagctgattgaataactaaaaaaaaaaaagagagagagagagaaaaaaaaaacacagcctgtaccaccctcctcgtggtttccaggatcatatacattctatgttcaatatcaaaagactggctggaattgtaaaagcaaagtcattgagtacagtcacatttataggaaagatcactgacgagatgcacgcacaatcccagcattgtctgctaaacggtaaggcagcttcccgaagaagaaaggccgtggtttgctgcaggaacacattcagcagggtttcaaagcccccttcagctggcaggctacaatggcagagaagtcaatgtctcatggattattctacaaagtatttgggattcttatggagaaaggaggagaactgcaaattttgagagagtccaacaggaatcgctaaccgcaggattcgctaactgaaggaatcgctaactgaaggaatcgctaactgaaggggagactaagtacctggaagaaagcaagctcaaggactgtacatcatctctgcagctgcatttctttctttcttttttttttttttttgagacagaatctcgctctgtcgccatgtcaccaggatggggtgcagtggcgcaatcttggttcacttcaacctccacctcccgggttcaagtgattctcctgcctcagcctccagagtagctgggactacaggcacatgccaccacgcccagctaatttttgtacttttagtaaagacagggtttcaccatgttggtcaggatggtcttggtctcttgaccttgtgattcacctgccttggcctcccaaagtgctgggattacaggcgtgagccaccgtgcctggccttgcagttgcatttacacatgcaacagtaatacagccagattcccaatatctgtgaaatccatgtaatactgcacctttaaagtaatcacccttatttgcagagaatgcagtaaagtgggtaactgtttaagatctcatagctaattaggtacatgtctaggacaataagcacgcaaatgtccctgacaccccttccgatgtccccccatacctggaatatcacaaggtctgcggcttccagcttcttttgttcagccacaatatctgggctcagatggccttctttataagccagaacagactcggcaggatactgaaagttcgcagggtccttcagtttacctgcagagaagaaaaagagaggctggggccagaggggccaaagctgggccagaggacccacaggcaaggagatccgcaaagaactaattaaagaggggaggaggaactcctcctacctgtgatgtcctttctggaaatgatgggattgaagttcatggcatagaggtccgactccaccacctcccatcctttcttcttcaaagccgctgcagcagcctccttcatggcatagttgaaggacgtcctctctgagtgagccagtacgatcagtgctcttctgcctacagagacacacacaaagcacacacggaaaacccattaccaaccagcaaaccttcagctacaggggagttgcagtctgtaaaggagggggcggctttgtttgacattaggttattgcattccatctcctgtagccagaaatgtattttccccttaaaagcactgaagattaaaggaagcatttaaatcagtggctgatttaataaataatgttgacaactgggctctgtggctcataactgtaatcccagcactttgggaggccaaggtgggcagatcacctgaggtcaggagtttgagaccagcctggccaacatggtgaaaccctgtctctactaaaaatacaaaaattagctgggtgtggtggcaggcacctgtaatcccagctacttgggaggctgaggcaggagaatcacttgaactcgggagggggaggttgcagtgagccaagattgcaccattgcactccagcctgggtgacaatgggagactccgtctcaaaaaaaaaaaaagatgctctgcgtgacctgtcaggaaaagcaaaattaaaatgagacatttacccattcgtttacatgggtactgtgtttacatttaccgtgagtttacatttacccacaaaatgtaaaacaaataacacccagggttattaagattgtaccaacagaaaaattggcaccttactggtggggataagaactgcctcaacctttagggaaagtaatgaggcagaatctcttgaaactttaaagacacataaatcttttatctcgctctccaatttgggggaatctgttctacagactaaaagcttcaggctataagagcaaagatgtgtattacaccatgcttttcactggcaaaaattagatataacctgattgtctatggggaacattttaagaaattatgggtacatccacactacaggatattttgctgttaacaagaatgagttggccaggcacggtggttcgagcctgtaatcccagcactttgggaggctgaggcgggcaggtcacgaggtcaagagatcaagaccatcctggccaacatggtgaaaccctgtctctacaaaaatacaaaaattagctgggtgtggtagcgggcacctgtaatcccagctattcgggagcctgaggcaggagaatcgcttgaacccaggaagcagaggttgcagtgagctgagatcttgccactgcactccagcctgggtgacagagtaagaccctgtctcagaaaaataaataaattaagataaaagtaaaaaatatataaaaaagaatgagttaaactggctgggcacagtggctggagcctgtaatccagctacttggaaggctgaggcggcaagatcccttgaggccaggagatggagaccagcatgggcagcatagtgacaccttgtcataaaaaaaaatttttagagactgttgaccaggtacggttgctcacgcttctaattccagcactttgggaggccaaggcgggaacattgcttgagcccaggagttcaagaccagcctgggcaacatgacaaaagcgaaatcccttctctacaaaacgtacaaaaattagctgggcatggtggtgtatgcctgtagtcccaactactcaggaggctgagagatggaaggatcacttgaacccaggaggttgaggctgcagtgatccgtgatcgccgcactgcactccagcctgggtgacagagggagaccctgtctcaaataaacaaattttaaaaattaaaaaaattaaaatgaattaactatatgtagtgactcaaaaagatatccatgctatattattaactgataaaaaagcaagtgaatatgaacccatttttatttaaaatgaaagaagtgagaggaagggagagagggaagggaaggaagaaaaaagaaaatacaaaaaaaaaagaaaaaaagaaatgacatatatttgtatgtagacttgcagcaccttggtatgagggggaaaaatgtgcagtgatcacattaaacttttttttttttttgacagtctcactctgttgcccaggctggagtgcagtggcatgaacttggctcactgcaacctccgcctctcaggttcaagcgattctcctgcctcagcatccccagtagctaggattacaggtgtgagccaccgtgccaggccaatcacattgaactattaacagctcagcttcctttataagaaatggcaaagaggtacaggtagaagggaaatgggcctcttttatattaacaaggttgtcagaggcagcatgcttcaatttgcaagaacagtatttagtggatccttagtgctaggcactgccctaagtgctttgcattccttttttttctttttctctttctgagacagggtctcgatctgttgcccaggctggaatgcagtggcatgatctcaggtcactgcagccttgacctctcaggctcaagctatcctcccacctcagcctcctgagtagctgatactacaggtgtgcaccaccacacctaattttttttttttttttgtagagacagggatttgccatgttgcccaggctggtcaaatttggagccgtgttgcccaggctggggcaattttgcctgcctcagcctcctacaatgttgggattataggtgtgagcaaccacgcccggcctgcactttcttcctttgtcaggacaacctgctatgttttaaacgtgtccccctccaaaattcaggtgctgccaatgtgagaggattaacagatggggcctgtgataggtgattaggcgagggggtctccttcctcatgagtgggattaaggccctcataaaagaggcttcgcccagcacggggctcacctgcccttccaccttctacctcccaccgtctatgtaaggacgcagcattcctccaaatgcagctctcaccagacagccaaacctgccagcaccttgatcttcgacttcccagcttccagaactgtgagaaatcaatttctcttttttattaactacctagtcccaagtattatgtatggcagcacaaaatagactgagacacaccctatgaggtcaataccatgagtagccccatgttacagatgagaaaactgaggcacaggagagaagcaagttacccaagtgtgtagtcattaagtggtgaagctggaataatttaaaaacacagagagtggctgggcgtggtggctcacacctgtaatcccagcactttgggaagccgaggcaggcagcttgcttgagcccaggagtttgagaccagcctggctaacatggagaaaccccgtttctaccaaaaaaaaaaaaaaaaaaaaaattagctgagcgtagtggtgtgtgcctgtagtcccagctacttaggaagctgaggtgggaagatcatttgagccagggaggtggaggttgcagtgagccgtgatcacaccactgtactccagcctgggcgacagtgagacttacaaacagtgagaaatacaaacaacagcgtacaagggcatagagcgaattgccagagaaaggacgcttacccccacagttgctcctgataatgtgcgctgctacttcataccctaccatgaacagtgggtggagctgggagagaaggcatctgcaacttttttggcagggtgggggtgggggcgggggagatggagtcttgctctgtcacccaggctggagtgcagtggcgccatctcggcttacagcaacttctgcctcccgggttcaagcgattctccttcctcagcctccgaatagctgggattacaggcgcgtgccaccacgcccggctaattttttgtattttttgttttagtagagacaccatgttagccaggatggtctcgatgtcctaacctcatgacccacctgccttggcctcccaaagtgctgggattacaggcgtgagccaccgcgcccagccggcatctgcaacttttttgcaccatctgaataactagaaataactaaaataactagaaaggcacatttaaaccttaagctctcttcctgcttttattattgaccacatctagcaaggcaagtgcctcttgggctaaattcagcgaagtgtaactttcagggcccaatatgccaaaccaggggatttccaaacttggtcctagggttttggactcttaaaactaagactcagtggaataggtgtctggtgatgatttcaatgcgctggaagtgattgacttgcttgggatagcttggaaaaaggaaaaggaagctctgaggctgcctcaacaaattcctacctctttaacccatggatttaacatgattgggagggaagtgagcatattcagctctaacaggcattttctttgtaacttaccttgccattagtcttatcaatgtttactgatcgccgctctgacagtttttgtttgtttgtttttttgagacagagtttcgctctgtcgcccaggctggagtgcagtggcgcgatctcggctcactgcaagctccgcctcccaggttcacgccattctcctgcctcagcctccagagtagctgggattacaggcgctcgccgccacgcccggctaattgtatttttagtagagacggggtttcaccgtgttagccaggatggtctcgatttcctgacctcgtgatccgcctgtctcggcctcccaaactgctgggattacaggcgtgagccacagcgcccagccaacagtttttattttattg
